United States Patent 7,365,185 (GENOMIC PLANT SEQUENCES AND USES THEREOF) - sequence listing, part 24

SEQ ID NO: 57803 - DNA, 58946 bp, Oryza sativa
  unsure (1)..(58946): unsure at all n locations
aaatagcctaggggttatggaatcggttttatcggtaatctacgtttaataatcttaaatagcaagattctgaaggactatttaatagcccggaggatccaaacaaggctataacagtaacaccaatccgaatgacacggcgagagagctagggaaccttccatcacgtgaatttggatgctagactgctagagtgtgagaggcagaatttgccttacagttcaatattagtgctgatgcaaatccctctcgctgcatattaaactgttttatttacaaaataaggaccacacctatgcatggaacatgaagtatacagacagatctagaatgcgaggcccacatgtagggcccctttgaatcgcaggactgagaaaatgtaagaataggaaaaacgtaggattttgataggaatgtaagtgtaaaacagaggattgcaaaacacaggaatgaccatttaattgaaccacagaaaaaacacaggaattggatgaaagagatagcctcaaaagaaagttagtaagaggtcgaagctcttgctaaattttttccaaaatctctataggattgtccattccataggaattttaaaggattggataggattcaatcctttgtttcaaaggacttcataggaaattttcctatagaattaaaatcctttaaaatttctatgtttttcctccaaatcaaaggagaccgtagtagtatcgcgtagtagaggatttgctggatcgggggagtaggacaagattcaatattttaattggattgcaatgcgttaccaaattaattaatcagtggtcagtgtacaaatttaacaacatgaaagtgatactactgttttgcaccgagatacatatacaatcataacacgatgatagccatgagacgtacctgacataatagctaccgatcgagtgacataggctgtgtgtttagatccaaagtttggattcaaactttagtaattttccatcataacaacctatcatatacacacaatttttcagtcacatcatctccaatttcaaccaaaatacaaactttgcgctgaactaaacgcagccatatacgggaagctacctggcaactcgcataacgccaacacgtaaatttgaatcctacagcattctctccatctcaaaataattttatttttatctacttcacacataacaatacaaaactaaaaaaataaaatattcttattttatcaaactccgatgcaattctttctcactttatctattttcaatgtatttatcctatatatttataaactccgatacaatgattactcaccaataaaattattcagggacaaacaaaagagataaaaataaatttattctggacgctgggatgcctgtagattaataagcagaattgattgttacgacaggagctatatatatacattttgctctttcattatctataaaagaacacacgattgacaaaacatcgacgcgaccgtcacggcaagccacaggcgaagcggcacgatgtagaggtgccgaagcagaacgcgctcccttctctcagaagctttctacagatttacgcggcttaaccctcaaataaagcgagatcagaggcgtgatttcctcatttaatagccttccaatgaaactgaaccatttctaatcaagagacttttccaagttttgtctctactgtacaagtgtacagtgatgtacagatgtgatagatagcttagctggggctttaacgcggtgagactttgatatatactcctttcatcctaaaatgacgaaattagactcatcttaggcagttgtctggtctcattctagattatactctctacattttatattataagactttgtagtattatccacatttatatagattttaatgaatctatacacatatatgtctagattcattaatatatgtataaatgtgagcaatgctagaaagtattataatatgaaacggagggagtaatattttaggacggaggaatcatctagcaattgaacggagctctcgtcgactcgttcctctttcaatcgattacatcgaattgagttttacgaaatgggtgtacaggattcagtgctaccactcatgcagacgacaacaagggggtgagacaccctcactacgcccaattaggcgtgaaccaaatgaacgaacaacgctacttcagccccacatctgtaaatgtcgtcgtcaccatcaacttcatcacacaattgccgaaaatgattctgatgaagcatgctagaagaggtcggcttaggcagctagtattaggggtagacaaaaagcctcaaaactcgggacttggataggcttgtagtcagcttggatcggatgaattggcttggagccatagttttaattagttagccttttagctgtaagcttaacgagctacctcgcgagctgctcgtttagctcgtcagtacaagatatcaccatacttttatatacttaatactttctccgtttcatattactccctccgtttcacaatgtaagtcattctagcatttcccatattcatattgatgctaataaatctagacatatatatatatatatatatatatatctatctagattcattaatatcaatataaatgtggaaaatggtagaatgacttacattgtgaaacggaggaagtataagactttctagcattgtccacattcatatatatatatattaatgaatctagacatatatgtatacctatatttattaacatctatatgaatatgggctagagcttagtctagtaattacattaaaactatttatatttagtgaattctttattatttgatgtttattattatggtaatatgtaataaaatgataaatttgaaattatcaatatataataagaaagataaatagctcggtaacaagtctaacgagccagcttttgagccgagcaagatagccttttagctcgttaacgttaaaataacgagcttgaacaagtcaagctggcttgttaatccaccccttaagcaagatttagggtctgtttagggagcttctagctgctgcaccttcttctagaatctccaggtcccccaaacagtccagattgccactcaaattttgagagtccaaaagctgaaaaacccagctttctagattctcagaagttagctaccaaccagcggattctcagaatcttccccaacctaggccttagaggcatcgaggatgattgcattttggagttgttccagaatttcgagacgcgggtcgaatggaatatgaacttgaaatgatcatgaccatagctactcgcagaattcttttgccccgattcggagaatggccacgcgtccctcgccacgtccgatttcctgctggccacgaaaccaaataatccccccccccccccccccacgagatgcgtattccgaaaccgtacagacgccggcctgccgccctgtgtgatcctacgaaccgaccgaattaactccccagcagcttccagcttgcttgacaagcaaccacgtcgatcgaccgtccgtcgtcacgtctcgttgtaggcaaccgccaagcctcttccagaaatatcgtactagtagcaaaacatgtgtaaaaccgaaaaaaaaaaacaaataacccccgttcacacggaaacgggaaccttgccaacggcacaccgcgtgcctcacgagtgacgtgttccgtcgccacctcgaagcccaaacagcgcagcgcaggcagggcatcgagataaaagcagcgaagtgatgaaggcgaccttcgagaaggtcgcgtcccccctcgatcgatcgcctatataaacgccacgcaccgttggctgactagttattagttggtgatcgcttggggcagcttccttccttccctcccaaaatccacctcacaaccacacgagacgagagccaaccgcgacgcatcgtcacatcacagaggaggcggtggccatggaagagagacctcgcgatcgcaccgtcgaggaggccgcggcgttctccggcgatgagtccgatggggaattcgagttcccgttcgtgagcagggagacggacgccgggggcgtggccgacgagctcttcgcggacggccgcatcagggcgttctacccggtgtttggccgcgtgctcgacgacgtggcggtgacgcctgcggcggcggcggcggaggagcggaggccgccgctcgggaggctgttcctcgaggaggggcggacctcgtccgtcgggtcgacgtcgtcgtcgtcgtcgtccacggacatcgccgagctggacggcgtgtcgcccgacagctactgcgtctgggtgcccgggtcgtcgccggcgtcctcgccgtcgcgccccccgcggaagagcgggtcgacggggtccatcgcgcggtggcgccgcatcagcgagctcgtcgtcggccgcagccacagcgacggcaaggagaagttccgcttcctctccgcgccgtcgtccccggccagggatcaccccaaaccgaagcccacgacgaagggcggcgccgccgccgccaccaagctccacaccgagctcgacaccatcgccgccggccaccggctgtcctactcccccaaccacaaggcgcacggcggcgcgacgcggcggacgttcctgccgtaccgccaggatctcatgggcatcttcgccaacgtgaacggcctcagccggactcaccaccgccccttctgatcgccggacacaagccgtcaccgtcagggcgaatgaccacttcaactcaaaaaagtgagaaagagagatttcgagtttgaattctccgggatttgaagtttcgaacctttgacttgaagcctactgcaatttgaagtttgtgtgattagcgtaatctatagctttgctattgcacgggggattaatgaagtcaaaattggaggcgtgaagtcagaacaggcgaaatgtgggggattcgctgaggaatacagctctgcaagtcggtttattgcgaacgacatgtgaagttgtgaacgtggtagggaatcacacacggggaagttgtgagagaaaaaaaagaagagcttccatgtgattatttgtacttgtacatatgtgtatgtgtattattggatatgtagattgacaggagtcgtttttttcccccttgtttgcacaatctaactactggagtagttgtgttgctttttctgcatactttgtttgccctatatttctttctctgttgggtttccgacaatgattgggcgtgcgattagaataacttgtgaattttcgcctaatgaaatggtatgaagagctacatgcgactatacgagtaattgattgcatggaaggtgaaccgcattcatgccaccaattgtttcaatcatctcgtgatcatctagaacattgacctttttccctttggaattgacagaactaaaaaaatcaggcgatattttgtttgctaagagcaatttcaatagtatagccaactgctgactaaggcctgtttggtacagttccaactcttaaaattaacttcaggagttgagtatggagtggagttgttgagctgcctaaacctagctccacaactctagtatattttgtgagagaggtccacccaactctactcccagttttggtggagctgaaactgtttgcctgagctccagctctaggaggggtggagctggagctggagctgtgccaaacaggcccgtaacaaatcatctgtagctaatctaatagcccattcattcaatagttacgtataaaaatatactacaccattaataccaggtcctacctctcatacacacataacgtcttggagtccgtgttgcagtcggctacaaatctgtagcctgctttcttctccctcttctcttttcttctcgatacgtggttatagcttgcttatagtttgctattgtatttgctctaagattcaacaggcatgtacttttattttatttttttttctatttttgctcttttcaaagaacccacttaaagtaactgtcattcaattatataccgacatctttggctcaattttcaggtctgctttagttcccaactttttctttaaacttttaacttttttatcacatcaaaacttttctacacatataaacttccaacttttttcttcaaactttcaattttagtcaaacttctaattttgacatgaaactaaacacagccagttgttttccccgagtgtaattgctctctctccagatgtaaatatgcttcaacatttccttatcttctctttcaagtagataataaattatttttattcttaattctcttatacattgtatattagaaaaataatatattttttcgaaaagaagaaaatacaatgtaaattttgaaacttaccatgtaactgcagagtaagttttgaacgttatatagtataattctaatataagtggatcttcaagagtggctatttttctatcagaatgcacaaattacatagccatatttatgtttcactacaacagtatctataatctctacattaaactgttcaatcgaacaatagatcccatttgttagactctctttatttattcttcctctctctccatctagatctttcccctcgccaaccactccaccctgcctcactagtgagacgtacgctggatcgaaggccgacggccgcgatgctgatagcatcattgcaagatatgcagcagatcatggtccccatcggttgatctagtcttattataagccataaggctttttagcgattacaaaatgatacgtgagtaaaacttttgtatatatgtttttagtgattgaaaagccaaagttgaaaaaaactatgttgaaaaaaaatcaaattcaaattcaagttttaaaattaaaattttggttttggcttataagccataaggcaaacgatgaggccccatgttgacggcggtgcttggcagatgggtgaacggccggatataaaaagcgttggcgaggaaccgaagctgcctcaggtcgtggcacccaccttttggcaaagccggaatagatagcaagctagggggagtggtttggctatcaaaatagcatgttgcttggagacatgtttctctatagactatatgtttgccaaattttgacatggagagtcaaacaacaactctcctggagttacttaaaaactagcaaatgctagcttgaaaaaaagttacttaaacatgtcaccgataacccatacctccattagcttttcagaaatgaccagaggagcctcttttgttcaaccctcaagtataatccacctctaggaaaaagcaacaaagagtacggcagtttgtgatgcttacagatcacaaactatgagtcctatctattcctaacagttccattaatctaggcgcatgattaatttgaaaagttgggttctaagcatgtgaatgttgtacccaaaatatttcacatttcgtggcatgtgaattaaccacttgattgtgcaccctcatttccaactctccattactacggggagacgggacaccctgacctccccggaaaagcggagcccctcgtcctatcagacggagcctggacatagcccggactctaatccgtcgcctgttgcttgctcccgacttctgctgcaaaacgagcgctgctgcatcgcggcatgcgtcgatgcatatctgagcgcctggtcaggcaggttccacggctgctacggcatcatccagatgatgcaaacagcctctcaatccagggaggaaaacacagagcgtcccgatgttacagcctgaagaaagaaaaacagagaagtggatactcttgcagttttcccaaatcggacgcaacctgcactcaatcacgagttgtttgatcagtgtagtgctagtaacgctcagctgtagagtccgaactgatcaatgccatctccacgacgacatgatcagtgagaattgatgggtgtcaaacgtatttgtcagttcagttttcaggtcaggtgtgcgtctgtctacgttcagtgatcagggtgttcaggcaggtattttccatcacctgtgtccgaatggtggtacatcactacatcagcagcagccaaattaattccgaaagccattatgcacgggtttgatgtaaatctctcgcaatcacatgctctgataattactctccatcgtcatgtgtaatttcagggtttgcctaacacccaagcacctaacagttaggcgcatatacactgaccctgcagctagcttgtttaacccgaggagatgacacacgttagccgtaatcctcgcctcatcccaagctcacgaaatcaactgctgcaagaaagcaccatctcattacctctgaaactgctcctgacctgagctgctcgaacagagagcagtgactagctggtatgaaatgtcaatgagtatccgttgccgtttcagcgtcattctttttcttcaattcatttatcccgaaattaagcatgcctgtttgcttacggatatacatgtatgcggacatgtggattcagtggatatatgcacgtacgtcatcttggaccggtcagtttattgacacgccgataatgcatgccttagctcactagctagattatggttggtgtgatccaggttaggttggttattggtaagtactagtagtacgtactagcttacgctaggtttgtggctaatatagatcagagcttcatgaaaaggcagaaaaggacatgtgctaacacatatatttctcacaagatattgcaagaaagaacatgtcaaagtgaacagctggaagctagtaactgccggattacaacatcagcagcgggtttcttgcgatctacgcgctcgagatcttgatcgatctcgcggataaattcaacggcagattaactacagagaatcgtgtgatccatgcgttcgcacactgcgcatagtgattatcccacgggagaggaggaaagcatcgtcatctcgtgcgattattacatggagccgcacgtaaatgaacacgaaaaagaatgttattctaatccatagacaattttgttctggtgcagtgcgttttgcgtaagtacgtgcgtgatatcagagatgagaaatgttcagcatccggagagtgttcagacatgtttttttttattttcctttttagcatgactgttctttgtttggtggtgattaattgttaatgtcctatgtaggtcagtatgcactacaaatatatctatctatctattatattattaaaacagctttgaaagaaggcaccacgttcgctgtgaaagctagaaaaaattaccacattaatcgtagaaaaagaaaagtaaattaaccattggattgtgataattggattgtgataagtctagattttaatggctaagatttattggaggtatgttggatcagaatcgtacagagaaataccgctaataatatatgaggagttagagtaggctgatgagttaggaatggatacggacgtcattaaacagtacggacttaaagcacggattagagtagaacttgaagatggatacatccaattcaaaacagtatgcgcatgtaggcgaaggcaaagaccaagacaactcatgcgttcctcagccaaaaatcgaatataccatgcatgaaaaagaaaaaaatgactaacaatgtggaaaaaaaatcattcaatgaagaagatcatttgcagatacactgtaactaattaaaatgtacagcggtataaatagatcatggatatatataaaatattgttatatttattaataaaaatatacgatgacgtagaaaggttgtcaggatcgggatactaggtagtatcgttttgctcaaagtaatatcgtatcgtaggatcgggatactatgagattttttaaaaaaattaattactatttatattaattatatatagacattctatataaaaaaatatagtaatgatatatgtcattcaaatagagacatttattaagagaaaccacgttggttttgatatatttaactgatttttatataaatttgagcatatttatttatattataaaaataacgaaattcagaaaaatgagaagagttcaagtaggaatacaatttaaaaataactgaaatttgaagtttaaaataagaaatattgaaagaagagtccatacaagaatccaatacgagattaattaaaattcagaataaaaaaataaaaaatcaaaattagaaaaaaggataataaaagaagagttcaagtaggaatacaatttaaaattaactgaaattcggaattaaatataagcaatattgaaccaaatagtagattaattaaaatttggaataaaaataacataacatccgaaattgggcaaattaaaaagagagttaaactaggaatacaattgtaaaataactgaagttgaatataaaaaataaaaacatcaaaaaaatataatacaaaaaatgaaataaatttagaaattagaaaaagaaaaaaaagatttcaactagaatacaatttataaataactataaaataattaagactattgaaagaaaatactatctaaaacacatgacgagattaattaagtaagaggcctatagaggagcagagtggtggcggttgatgaaatatcgaaaaacaattaataaaacaccaagtagaatcctaatgatgattaaaaggaaagacgacgggcatgtcgtgaagcaatcggtcaatacggttggagaggacttctagaaaataaaaaaataaaccccaatgataatcatatttaatttttaaaatctcaattacaataaaaaagagaggctgtgggcgggtcgtataggaataaaatggcagagccaccgatggttggtgggtcttctagaaagtaaaaaaatgaattccaatgttagttatgttcgatttctaaaattccaatgacaataaagagtatgcggcgaacgggtcgtagaggagtacagtggctgcgtttgacgagatttctaaaaattataaaaaacatgaaactcaacgagacaataaactcaaaaactataaggtccaatttttaaatgttcgtgcttctaaaaagtaaaaaaaaataaaccacaatgttaatcatgtttgattttaaaatctcaataacaatagagaaggacggcagcgggcgagccatagaggagtatagagacaaagtcgttggcgttttggcgaaacttctagaaagtagaaaaatgaacataaacgataattatgtttgatttttaaaaatatagagaagatgcagtggacagtcatagagaagtataatgacagcgtttgataggacttctataaattataaataagaagcccaacgtgataataaactctaaaaacttactatccaatttttaaaggtttcaaggagaatgaatagaaacagtacggtagattgggtaagctaataaagaataatatgacagaaataaagggtagcaactggtgtgacttttaaaaactataaaattaattagaaacacaacgatgataaggtttggtcttttaaatcttaagacaacgagataactatttaataaattttaagtaaaaatatattaaaaatatataattttatatgggtgctagccgcgcaattacgcgggccacccagctagttgatgtaaaagtagaggttatttggtcagttttgggtttgacggatcaatgtcaaaccgttcttattggttaagaagcttgtgatgacacggaaatggaacacagcgcctacaaaattgccggggaaaggcaagctgagagtcgtcctagtaaataaattacgctccgacctcttcaaatatttgacgtgatggtccatgtttgctttcgtgttagataaagagcagagtgtgcttttacctacttcctttgagatacactaggtagtgcaatgggtgtaaggtttcaactccaaaatccagttgttcaacatgagattaactgagcgctgtaaggtttggtcccattttctccttaaaatgtgatatcttcttcttattataaaggcaaaatttgatacaggacacccaaaaaacgcgtaattagctgagggacaccgagaaaacgtggaactgctctaggacactacaaattttgtaaaatttgccgtaggacaccgagcttattattttatcatttcccgactgaaagtggcgagtattttttttcaaaatacccagattgcccccgtgtcccaaactcggtcgccacacaccactcggcggactgcatcacgtagctcgccgccggggagtccgcaccaacgtgctcttcttcggctgccaggacacccacaggacaggcggcaccaccacggcatcaccgccgccgtttcgccgcagtagtcgggacacggccgaacttacacacaacaaccgccgtacgccgctttcctccctccctccctctctcctcgtaaaaatacttgctccaaacgccatccatccatccatccacccacccacacacagccgcaatcgccacctcattctccgcacgcaaagccgtcacgtcccgccacatcggcatttcggcgaacacctcacgcgcgcgctcctggtgtcggtcgtctgcctcgcggcgggctgcaacgtcgtgacacgctcctcctcccatggccggtgccagcggcgagcggccggcgagcaactgggactggtcggactatgacgccgcattcactgaggaggccgacggggcgatcgccgcgctgcaggacacgggcggagacgggctcgccaccaagcagctcctcgagaggtaccacgcctcgccgcttgcccacactatcctcgcgcaatggtacttcgcgcacgcggatcagcaaaagccgacgaatcacctcaggagagcggcatggatggccccgcgctgcctgcacatcgcctttgcgctcgccttggtgctcatcgagatgggctccttcgacgaggcagacatggtgtgtgcccacagcctcctcgtgccggatctcaccgacccggtgcacaacttcatctccccgaaagagcaggttgatgccattatcacctccaaagctccagagtatagattgggacgcggggcaatctgggcattttgaaaaaatactcgccactttcagccgggaaatgataaaataatgagctcggtgtcctacggcaaattttacaaaatttgtagtgtcctagagcagttccatgttttctcggtgtccctcagctaattacgcgttttttggttgtcctgtagcaaattttgcctattataaaacgtcggcaacagcctgaccgttcgaaaaaaaaatctcatgttcaacttctaacacactcgcaattttttcttaaaaattatttggaggatgtctctcccctctaaatcaccttggaaaggttaattgttctttcttaaatcaagttcggtggaatattccgaccacagaaatacgacattttgtgccaaatcttgatccaattttggtcaaattgcattgttttgaatttgaattctcgaaaccaatctaaatttcattcggtattaacattcttcctgcctctagcttaaaattttgcagttaaaaccatgcggtgcatacccaattacagatgataaatatattgatccgatccagcaaaaaatatcccgatgtaccagtacctcactatactaaatcgttttctatagttggatctaactccaaatcgtttcctatcgttgaatctaactaggcagaatggccattgttaaatcctagtaatcgaaaataatcttggtaccaagaggtactgagctattttttattggatagaaacaaatcttaaatgtcaatgtttaatgtttcttaacaatatctgggctgcaaatgagtcgaaatgacgactgaactagaacctttcgacccatatccccgccaaaatgtaatagagccggacagccggtagggattgggcctggataggcgccaaaacgaggcatgaattgggcctgattcgtacacacattggtaacagaataaggcccaggtgttgataagccacacatcctcatctggtactccatcgtagtaggctgtagacttgtagtgtaccaaaccaagaaaacaagaaaaaaaatgttgtgttttaaaagagtgattttacaatgcttgaagaggtaccgggattataatttgggacctcacgatatcttcggcactataagttccgaaatttgcattaaaattttggtaaatctaagtacttattaaggactataaaattacttttcaaaaagataaagtactttagcaaattctcatcactcccagcgtattcaacggattcggctatatccatttggccctgctgcagttcagaataagggttgaatttattcaaatatcataatatataagtagagactatttttagggcatatacaatagtctttattagtgatctctctctattgttatgcaaataaatttgatgacataaaagaaagagaaatgaatatggttgttatgcatgacaactgctcagagttgactcttagcatttattagagcaaattttgttgcatggtgatgaaaaaaaggaaagaagagtaagaaaaagtatttttatatattaatgattatagaccatattgtctctaactgttgtaggatgctagtctctagataatataaatctcatatctaactgtatctttgtacatgcacttaggtcgccaaaattgggttacatgaatgagacggccgagttacggtgatgccatcttggctatttcccatggcttctccgctctactcttgtccctgtttggatgacgccgtccagaccaagacatcaaaacggggcgacactgtgaggttacggtgtcgccattcgccacaatgagctcaccatgtcaccttgtcgacatttcgccgcatacaagtcgctgtgcgaccgccaggtgggccccactgtgagcagcacgagtgtggcgcgtatataaatttgtcggatggagaggcagctgaaggtttttcgccatggcaactgcgtccttcgacatctgcgcgaaggttgggctcggaatttcgacaggatactcacagcgaaatcaatactctgctatggcaaatggtacgcactcgtttcgattgttctgccttcttctgttttattttttttcccgtatgtagctgtagctgctgataaacgtgccatgtattccatctcgttcttgcaagcagtttcttagatgagttaaaatatgtattccatgtcaactgttcactttagttaggtagaactttcttacattatgattagttatctacttactctctctgtccgataataattatcgcattgattttttttataatgtttgatcattcgtcttattaaaaaaaattatagaattattttttttattttgtttgtgacttgctttattatcaaaaaaataatttaaatatggcatatctttttttatatttacaataatttttcaaaaaagatgaatggtcaaacgttacacgaaaaaatcaaagcgaccactattttggaatggaagtagtacctgtagagaaaaattaaatattagttcttaagtgagtgtggaccgaaaaaattccttatttatcataaacacgttttccaaacttttaaatgatatgtttttttaaatatataaatgaacatgttctttcaaaaatcaaataaatcactttttcaagtttgtactgattaatactagactaatcatttgctaattgtttatattgttttacttgccatcataactcatgccaaattgcttttccaaacccaccattagccgctgtggcaagctcagttgctagcttgaggaggactatacaaagttgcacacacgccatggtactaacgagaactggaaaatatgttgactggaaaaattgtatcagttcatattagaaacaaattactgtcagaatgaggaaaaactcagtccatgccactaaaggcatcagatgcgaattggcgctcctttctcctttcaaggagtaggcataaacataggctctgcagtagtttcatctgaaattttaagatcagctgaggtcttccaagaacccatgttcttggaaatcacatgttcaagctttaaaatgcattgataaaaggcggatatcatggtagcggccattttaaaatgcattgataaaaggtggaaagaaaaaaaaaacatctccaagtgtaccttggattgtgagaacgataaatattctaacaaaaaatttgaatgctagaacgacaagtaaactgaaacaaagggagtattagtgaagattcaaagcagtagtaagtaactaatttgaatgttcataatgatgatattgtaacataaacaatgatagaatataaggtttaaggttaagttttcataacacactataccatttatatttcatttccggagtccaaacattaccgaatcggaataaaatggtccttacaaaacggggacaacctatacggtcaaaaatctcaatatggttttcattcatgttttaggttgtgttcttttggcagttgagaacattttcctagcatgcaaaacgaagcaatggacaaacgtatgattaattaagtattagctaaaaaacttaaaaaaatatatcaatataattttcttaaacaactatcttatataattattttttaaaaaaacacatcgtttaactgttcagaaaacatgcgcacgaataatgaatatagaacttgggaagagggagtatagaacacacctctgctaccgtacgtaaaagtggcgtagtggtagaggcactactacagaaagtgtttttcagtacaagggggttattagtttacatgcgggcggcttaaaccttataaatttctgtacgagggggtcatactatggtggccaaaatctatctattaacttataaaagtaatagaaaaaggaggctccaagttcgctcttatgacttaaaaattctcacattaattagagaaaaataaaaaaaagagtccatattaaaatacattttataaataattaaaatttagaactaaaaaaataagaaatatggaagagaagactagagtccatgtagatatacaatttagaactaattaaaatttagaattaaaaataagagattaaaactagagtttagagtctatatacaaatataatttgtaaatatataaaattcaaaattaaaaataaataatattgtaagaagagtctagagttcatgtatataaaaaaaataaaatggctaaaatttgaaacaaaaaagaaaatattaaaagatgggtttagagtccttaaagaaatatattttacaaatgaaataaaaaaaaagagtccatattaaaatacattttataaataattaaaatttagaaaaaaaaaagaaatatggaagagaatactagagtcgatgtagatatacaatttagaactaattaaaatttagaattaaaaataagagattaaaactagagtttagagtctatatacaaatataatttgtaaatatctaaaattcgaaattaaaaataaataatattgtaagaagagtctagagttcatatatataaaaaattaaaatagctaaaattcgaaaaaaaaagaaaatattaaaagatgggtttagagtccttaaagaaatatattttacaaatgattgaaattcgaaatgaaaaataaggaatattgaaagaaaagactagagtctaggtatgcaatttagaactaattaaaattctgagataataaaataaaaataaaagtagagtttagaatccataaaaaatacaattttttaaatactaaaactcaaaatttaaaagtaattaatattggaaaaagagtttagagtccatacagtaatataatttaggaatagctgaaattcaaaatttaaaaagtaaaaatattgaaaaaggggtttagagtccatatgtcagtgttacggtccaccttaggatttaggaacataaactgacacatcacaggtggccatcttaagctaatgggccagccgcccagctcgtttctatctgcaacataaggcagaaaaccaaggccttgacatttcttttaggacacacgggctggaacggccccggcccaattaattaaatcctgctattgaaaaagggttctgtaattagagttcctactactatacatacttccgcaaggtaatctagcacccaaatcaaactacagccaacgtgtatcatcagtagattccaccccaagatcgtgtgcccgctccgatcggcagaacctaatcacgaccaatccgtcgccaacacagccacaaacccacaattacgcggcggtgcattctcgttgctttgacggcttcgctaaacgaaagatatttaccgtggctaagcaagccctgatcacacgttccacacctcgcagcgccaccacatccgagccgatcgaccggcccaacccccccgtgagacagactccagaggccgcgagcggtggcatcgtcatcgcaatatcaaatccacatccacatctccatcgagcgatccacccacaacctgcaacggcgcgacccaaccgcaaagccgctcgcattgaaacccgcgtaggttgccttcgttttccgccccgcggcggcccatcatccgcgcgcgtgtggaccaggacgcgcgggcggggaaccgttggccacggcgccgcggcgcgttatcgcgagcctatccgcgcgcgtgtggcgcgctgggtgggtgaggcgccgagtggcccggatccacccgcccagccgggccgcacgccccccctcgccccagccacccggcgccgcgaacgacccatcaccagtcacgtacgcaccgctcggcgctcgctagctgccaccatctccctcccgctgtccgggggcgctggttgtcggcacgcgggggcgcgggcgtctatttgttgcgcgcgcgggcgcggcggcgagacgcgtgtgtagctactgctataaggagcgcgccgtgcaccgcctctcacaatgtcgaccgccgccgccgccgccgctgcccagagctggtgcttcgccactgtcaccccgcgctcccgcgccacagtggtcgccagctagcctccccatcaccgtcctcctcctcctcctcctccaacagcagcaacctcccggcccccttccgccacagcataatcctcacccccacagtttttgccgccccagtcgcccccgccgcggtacgtgcattatgcatggtcacgccacccctgcagctagctgcatgcatatatacacgccggccggcaccctttgatatctcaagcttttttgacacgttcggtctcatgctaatttagctataacaaggctgcatatacatacacgatacgtgcatgcacgcgcctcgtgctgcattaggcccgacacatgcacgggtcgtacgtagcttgcattcctgccgctctctctagctctacgtacacacaacatgtcatttggttttatccatacctgcaaactgtgcaagaatggctacatgcatgcatgcatgcactgcagtgttatatctaagactaatagtctaatactgtgtgtctaattgtccatacctcgaaacatagttgtttatgcgtcaatcccacgtaccatcatcacacacaccccgcaactcggcaaattgtccaactaagcactgttccgtgaccaccgactctcttagttttttaagcaatcattgaacagtgtacagcaaaagaaaatgtatgttcaatttttaatcaacactgacaacatataggagtatatattgcatattgcccttcttatgcttttttcccaatttgttttctgtcaatcaacgtgcacgtcaacaaactctaaatagaatattcgggaggagaaaaggttcccaaacagttggccaattatattgttcattagagataagaaagcgctttggatataaaagatacccccaaaagtcttgagtggaatgaacaaagctccaagtacattaagaaatcaaacatctaggcggcttttccctcaaacgataaggtaaagttctagcagggacagatagtgttcgttttctactttgtttctttttcgcttgaggagaagcgtccatgatttagctttagtaatggactgtcgagtcactatcaacttcgttattttaacaattatatattttccattttattttgaaaaatgatacggagtattgtctttagtttctcaagccatataaagatcatagtatctagtatatacagaaatgctagaaaggtcaagtttgctgtttttctaggcaattttttatttctccaaacattaaaaagggaatttcactgtaaatggttgaactcaaaatattttttatattaattttatttcgtacgtggtgatctgacttgttggggtaaccagtacaagccctgatttttgttgcagtcaaggtcaggctgagcttgacgttgaccctcaccaaaaattgagtggtacaaaaccattcaagaccattaactgatgttagatgcacagatgagatgtcaacaagaaaatccacctgttatcaaaaccggtttgaaatgtttccttaatatttagggaaattgagctttcattaatcaataccggcgagggtacatccaacatgaaaatatattttttttatttaaagagtcatattgggaattaatttctatcaattaagctctaccaaaatttgcctaacagtactgaaattcctggttcatgtatacaagacaagccccaacattaaaactagcttgcaatactgatttgtcaacctatacagtcatacagacgcatacccgaaagaaacacctactctgtaggaatatgcctgtggttgcagttaacggattagggaccaaaaccttcccatcttgtggcgaaaagctaattgtaccttgcatgatgtactactagtaggggacctctatgccatttgtgtttagtcaagtaatatgggcgcaaagataaggaagattccgcgaaagagtagttggccgattggctcttccagcttgcaaagcgacctctcgccttgccgaaaacttactgttccttttcagatcagcctaagtgcctaactctcccgttaactgggatggctgcatactgatgcatgcagagtagttagcagttgtttttgtctaagtactgcagatagatggataaacagaaaaactaactgctgagtagtgacaagatcagttccggattaacgcgccagattgcgcaaatccagcatagattgtgtagcttgctcccgtactactggtactgatatagtagttattcaggcatatgggatactatgaaatggttcttggtctcgtttggagctattgtttcttggatcacggagccagtagctgctccatgtactttggtcacctgatgcaccaggcaaaacggctcttaagatgtgaggatgcagtagaaaactgctcaacctggcaggcatcctgctgacgcttccgaggcccaaacagcgcaaacaacttgtagcacttggatcaccccagaatcccagataaatcttgctgctgggttcatgcatggtgaaatctgcatctgatttagataatcttgtatttgtcttgcaaacaaatccactttcaagatttgtctgatgcgtgacataagtatagtagtaagaggttgtcaatgtctgcaaagtaagagaggaggagagctgatgatcgaatcagaattttgtgaggtcgtgaagttgcttcagctttaacttcaactatcaacaatcagatactccacaaaagaagtgcctaacgaggcaaccctactgctaagtactagcacacacaaacactagatcaacctgaacctttttccttagcgcgcacatgatttaatcaaaacaactgccattcttccacaataagaaagccgtgcacgcacacatgctagttagctagtagtttcatttctgggatcaatagtatagccgtcacgagtcaaattcaaaaagaaaaataaaggacgatccacacgaccgtttatatgtgtatacacactagcaaggagttgttgatcatctggatgcatcgacttaaggaaaaaggcatatgaccatttcgtgtgactaatcatactcccttaaaattaatcgatctccatttttgtaatcataatcctgcatcatgcaaccccatttcttacttgctctgccaaaggaaggaaattaaacaaaacccgcaaaattatgtttggctgaacagcataccaaaacagggggagggctcttgccattccgatcggccatttattttggccacaaaaccagcccctccatccatccatcgctgctatatttttacctctttgctagctgctccaactcaccgcgttccacgtggcgcatgcatgtttgctagtgatccgggaggccgcgacgaccgccagcgaacggaagggaaaaaaaaaagtcaaaaactagagccgatcgtttgatccattcgatatagggaagatgagtggatgcctctgcctcccccgctataaaaaggccccaaacgggacgccatcgccaccaccaccagcagcagcggccgaagcggaagcagcagcagcagcagcggcgacgaagccgtccatagattcttcttcctccccgtcactcctcaccaacaaccatcccccaccctccaaggtccgtccccctgtctcctcctcctcccgcaccatccgtcaatacagttactgctctcatcatcatccatccatcctcttctcctctctctctccttttcttgattcatccgtcgatcgattcgcgcgggcgtggcttccttttttgttgggcaaagagaaaaaaaagggagatcctttgcatccgctttagatcgccttttgtgcatgcctcgcgtgggcgcagggaacccacaacgacggcgatatcctcctctctcgcatattttcatgatgcatatgggtgtataaaaattttcacgcgtttttgtgtgcgtgtgttcttggtttgggattgggatggcatgagagctgatcggtgtgattaattatttttgcttgcagatggacgccgccgtcgaccgcctcaaggatgggttcgccaagttcaagaccgagttctatgagtaagccccccttgcctatagatggttaatttgagaagaatttgggtagccgcgcgcgcggcgtgagatgaaactgacatgatcaccttgctgtttgtctttttgtctcctccgcagcaagaagccggagctcttcgagccgctcaaggccggccaggcacccaaggtacgctgctccgtccatttcctgctcaaaatttgttcttctttgtctactagtgagccaacccagccagctggagttttacggttactcctccatggccgctacaccgtccatccctcagctcgcaaacctcgtcagcaaaagaaaagccccaaccttttacccccgatctctgcggttgatttggggattcgtgaacacaccttggcccacagattcctaccggtctagatactactgctactcccaggtagaaagtacacgcatgcttgcaacctgcaagcaaggcaaccaggcaaagcatatagccttgtgtttgcccatccggtgtacactgtttacggtgcccacagcatatatggccatcaaggtcaaactggacaaaagttagcagcaactggcctgtccaagttgcctggccaaagttatataagaggatgaacagcttgtcgccggcctgttaggccggggctggctgatcagttatatacgaggatatgataagtacaaccaagattataaaaagagagagggagattagattagattagaatgctccatttggcaggcgtacgcagcgcaatcttaattagtagctcgggtattggtaggccaggcaaagaagctgctgtagtagtggaaatccttcctcataatgcacgcacccaccaccgaagaagacgaggctcgcacctagtaacatgcaggatttcttcaccgtcccccatgtgcttgcccatgttgtgtttccgccgagatgtcgccttcctcgtatagggtttagcatccatcatcactactgttttccttttgatttcttcgttgcgtccagcttaattttagaatagtaagagcaagtttaatagtacagccaactactaactccaattcatatatagctaatctagaaactcattcatacaatagttacatactacactactaatacctgatcccacctgtcatacacacactgtgtcttggagtccgtgctagagctggctacaaatttatagcccactgcttttctctctttttatttagcttcttaaaatatgtttacagctagcttatagcatgctattgtacatgctctaataagctaattaggtcgtcgatcgaggctagggtctcctggcagcgcctcggtctaaattggcgtacgtcgtcctaacatttgggtacaaaaatttggaccggccggcaacctcgctgtacgtgttgatgaatttcaaagttcatttggacacggccattctcatggggatactgcaatgatgcccaaattaatttgggcgatatcatcgtctttgctgaccccacacaagctagaacgtaccgtgaaccacaagttctcttttgtttatagcaacggagaagaaagaaacagtggataaagccttgcagcttgatatactccatactatagctgtagctaagcaaaagtatttcctgtacgacatggcccggaggacatcacataattgtgggcccagcaatcacgcatttgtttgcacgtccaactcaacagcctttaacgaaagtttaggcgcatatccaaccttttgcttacactacattttggcatctgcctcgctatacagtaacttggattggccagccacacgcattgatgagcaggtgcaaaagtccagcagtttgcattacaacatgcgtacatatatactttattaatatcaaatctcctctcccggaaaatgatggcccccatccaaaaacattaatctacgccgcaactgactgcctgctgctgctgctgccgtaagcccgtaatcgatcggccccggcaatttgctaaagggtggggcctgatcgccatgagcatgctttggatgcgtcagctcgcgtcttaatctaatgctcggttatttggccgtttttgtctccgtcggcgttgtcgccagtgggatcgttagttcattaggattagtactaatcagcgcaacagttatatgccccccatgggccatgaactcatactcgtccgtgtcgtgggttatccttgcgtatccgttctgttttctgggtggaaaaagtggtcagggaaaacagagcagacaggtcaaaaagctggcagctttgggggcaagagaacgggaaaaaaatgtcagattcctgtgggggttgtgggcactcggatacgcctatcagcatctgctgcctccttatcgataagagcagtagtggtagtactagtagaacagatgctaatcgcctaatcctaatatgcttattgatctcctgatatggctgtgtaatcgcaaaattactactccactactagttagtgtggagtaatgaactgagctgattgttgggacaaatgcagtacatggtgttctcgtgcgccgactctcgcgtgtgcccgtcggtgaccatgggcctggagcccggcgaggccttcaccgtccgcaacatcgccaacatggtcccagcttactgcaaggtaaccaacttcatcgtacgcgttttcgtcgccggccggtcgattggtaagctagctattccggtcggtcgccgcggtttgcattgattttgacccccctcgtgtgtgtgcgtcaactgcagatcaagcacgctggcgtcgggtcggccatcgagtacgccgtctgcgccctcaaggtcaactctctctctctctctctcacagatagtgctctattatgtcaactatatagtacccgttgctctaattgtgccggcaacttcacacaccggatcagagaaaaatattttcgtacaggctgagaaaaatgggtcgtgtctgacgccagatggtgtgtgaattattttattgatcaagaagaatcttcccttccccacataatccatccagcttaggtttatgtagggtgtgtaacattcatggtgaaggtggtacttgcgttacatatgaatcttgtcaaatcaagcagggagcataattagcgcctttgtttagtatatttggacggtgttagtaggaaagcaccgtactttggtgaaatctattttatgctcatacagcacatgtatgcgtaaagtgtgcgtgcacgatttgattgtggggtattgacctggatcgaataatctgcaggtcgaactcatcgtggtgattggccacagccgctgcggtggaatcaaggccctcctctcactcaaggatggagcaccagactccttgtaagttgctgaacaaaagaaaacttagtgatagtactatagtattggcaacttgggcataactgtatgcagacaaacaaagggttgaagaaataaaaatgttagcgtgtcttgatcatcgtttgtttctgactcgggtttgcactttgattggttcagccacttcgtcgaggactgggtcaggaccggtttccccgccaagaagaaggttcagaccgagcacgcctcgctgcctttcgatgaccaatgcgccatcttggagaaggtaacgcacgtactagtagcatgacaaccactatgcataaatcaaaatgttaaatgaaattggaacatcagaattaattacattcataggaaggacaatcgaactgtctgaaacttgcgttgtctattcaattcagcactgactgaatttctgcgtccctgatcaaaacaattgatctgatgatctgcaggaggccgtgaaccaatccctggagaacctcaagacctacccgttcgtcaaggaggggatcgccaacggcaccctcaagctcgtcggcggccactacgacttcgtctccggcaacttggacttatgggagccctaaatccgaccgtccgtccgttcagttcgtcagtttacgccaacgcttttgcataagtactacctgaggatatcgtccccgatcatcgatgtgaacgcgtggagtactactacgtacgtaccggatggttcgatatatgtgaatgctgtattaagtaataacaagaaatatatctcctctactttttcctgacgcggagttgtactgcctatgatgcataatttgatcgcagtgtgatcaaaagacatcagctataatgtcttaataatattattatgaagagtttacctttttactaccttttactctggtatttctcgctggcgccagcattttcttttggtgtgcaagattgtcaaaaagctagatatcgtgcaattttttttctcataaaaaaataataccaaccatcatccacatgtacaataaggttgtgttctttcatgggtgatctggtgattgtgagtgagttttgtttcgtttttcgcgcacacgcttcccgaactacaaaacggtgcgttttttgcgaaaaaaaactataggaaagttgctttaaaaaatcatattaatccatttttaaagtttaaaatacttaatagtcaattaatcatgtgctaatggctcacctcgttttacgtatctttccaatctcctctatctcctctcctcaaacacagcctaagaagtgatgataagtagatgctataagaagtgatgataaatgcatataaagaagagaataactaaaatggtgcttctatacatcacccctaacatgagttgcattatattccaaaagcaaattagcatccatccctgggtcatgctttaatagctatcaaaattgtatcaatgcttaattcagaacataattaaggttcattgctgttgcaggctaatactaactgattatttgactatatagttctggttgtaatcggaatatatatacacggtttatagctcaatatcatctttttactaatcaaagaatatttcgatcaaaacaatttgccacctttcaacatttaatatataaattaggcttctgcccaactatgctgaatcgtgaaacaatattaatctacaattattaacgtgctttagttgtcgcatgtcaccagtcatctaaaatggtctatatatatatagcatatactcccttcattccaaattgatctacatatagttttttttaaggttattcctaaataatctatatatttgtgttcattcattaagtctattcgttatttgtgcactgaagtaaatagacattgatgcatgtatccatgcacacaaatttattacctacatacaatatcttgatttgctattgactaggaaatagtggggatggcgcatgcattgagtttgttgctagagcctagagtaaatatagtatgagagagttattagcttttcttgatcttagtataactataaaatatgtatatcaatttggaatggtgggagtactatcaaattctccacgttggattgttggtaggagctaagtgggtcttttacaagtgcctagttgaaacacattgaattgcacgatggtactacctccgttcctaacagtttttaaatgttctaagataaacaaaaagtttactgcttatatatatttaaaatgcaacatacaccttactcccttcggttctataataattgacgttttggacaaggttgaggtcaaacttttataactttgaccattaataacttcaaaagtatttagtttaaagaaactagaacaacatatatagatttgtctttcaaaacactataataaaagttaacatgcatttatttattgtgtatattataatagaaaaataaggtcaaaggtatattttgtagaccgtgtcattgtctaagacgtcaattaaaataaaactggagggagtatgagttatgacacggtatctccttaggtatataatttttcttttagaaatataaagtgattaaagtttaaatataaatagtagccgataacaagaatatgtatgtgggaacagagagagagagcaacatagcttcaaaccattgtgctatgctggctaaatttagggaattggagatttagctgcaaattcagatggagtgccatgtatacctttttcttcctagactgtgggctaccacctcaaaggtctcatgcatttacttcaaaatacttaaaattaaataattaaattgaatctgaaaaggcatcacctacaagtgccaattagaacaagaacatcgagtattttttttctaataaaaggataatataatagtaatttgcttatgagtttcataattatagagacccctttctaaacactactaagtactaccgtcgtctcaaaataagttcatttttggtttctgtgtccaacatttgatatctgtcttaattaaaaaaattagaaaacaaattaatcacaaataaagtacttttatgttttatcatctaataacaataaaaacattaatcataaatttttttaataaaataaagagtaaaacgttgtatccaaaaactgaaaaatgaatttttttatgagacaaagatagtaaggcttcaaaccaaagtatcctaaaactagtacaatttgataataaaaagagtgacaaaatttagctttagtatatgggttgaaagccttaacaaaatgtgccaaaatttaatattactatattctgttagggttaatagtggcaacaaaccttttatgcctcttttgccgtaacaatttactgaagaaaaaaaaggggagaaatttgataggctcagcaaaacccctgtccgattcccgttccgcacccgtcggaatccacagtagcactcgtcgccatgtccggctgccgccgccgccgccccagccaaccctatcccggcccctcgttactcttcctcggccgccgccggccgtagctctgcgcctctgccgcactaaccctcaaccccacttcccttcggaaactgatctcctcctactccccggccgccgcggcgccgtccacctccagactccccgcatggcatgccggagttacatttgggggggaataccaaataggcgaagccccaacctctttgggagccagtctggctgggaatgtgttctcgattgatgtcgacgacggccgccaccgactccctgaccgcctccaccccgcagccacggcggcggcggcggcagcgccacatatacgcacgacgaaataaggtactcgattttccttcttgcgtaatcctgcagattgatcctgaaatttatccgcaacctatttaaatcctctgaaacctatacggttttcgttataaatgccgtaaattaagtcaagttaacgtatctgttgcaattgcaaacgaagaggtagagtccaagtgattttctgatttcacccacgggcctatctgtttcatggctactaggttcagagtttgcctcctcattagtgcgcgcttcttcttcgtttgtcgccgatcgtttttgttcgtatagcgactcgcggtcgcggggacgcatcgaggatgggtgcctgctgctgctgcttcccggtctacaaacccgcgagggagaacccgatgcggtcgaccagagagtcactcatccagcacaagccgaggcctaccacgccgtaccatccaccaccacccccgtttatcacctacactgacaaggtcgatttccctttctcattgtcggtatgatcctcctgttgttgtcgctgatgggccgcccttatgtcgtgttggctgcttgattcttgcagggcatgaacgctgtcgagcgcttcaagactgggttcgagaatttcaggaatactatatacgagtatttttctgatgccctgagagttcgtcggtgtgtttaatacgattttgtgctaaatcgaatctatttgtttttgtcggttttcagcaagaggccggagctgtttgagcggctcaagactggccagtcaccaaaggtatagtgctgccatcagattaatagttttatacatagattatgaaacctataatttgttctttccagcacacatagaatgcgccggcataatttgctgtctctactaagaattatgccatttggagggtgcatacctcacattacgctcttttggtttgtttgtggactgaagtcaaactcgactaaggaattctgatgggaacagctcattaccattgtgaccattgagcaatatatattgataaaaaaaatagttgacaaaattttcatcttcagtacaaagtactagtggaatttcttcaaaattctacattagaggaactaacatgaacaaaagcacagagcggcttactatagatgaccaatgacatggttcctgcatatgttaactttttttttttttgaaggacagacccgtctaaataaatgaatatttttgttttcttattctattagcttgcttaggttctaagttttttcctttatgacttgcgtgagaagggctagagatgtgatttctagtgctgtagagtgtcatgtggggaatgcactacgtccgcaggcgcaaggatcagcgacaacagcaaaacggcaaacagtagatatgcaggatttgttttcgtttgtttcagagtctgttaaagtttgttagtttgatctttatctctaagagtttgttagatggcattgtaatctttacttaaagggccagtatggcgcatggaataaacaagcaatcagaaaaccaatctatcgctcctttcctgccttgctagtgcggcgccggtcacggcacctccgcgccggcgaggtccaggaccacgcccggttacttcgttcaaatactcccttcgccgtaaccctccttccaatctcctagcccgtgacaacttggtatcagattcctctggttccgatccaatggcctctactcagaatcaactcgatgaaatcgcgaagaacctcacctccatggcggcgcaaatctccgatctcgccaggaagatgagcaccttggagcccctcgtgccgctcgcggcaaaactcgacaagctgcctgatcgcgtcacgcaggtgcaggcgtccgccttcgagtactcggagcaagtccgcgctctcaacctcgccgtcgagcgcgtcgaggcttcccagcgcgcggccacgacgaacccttctggcttggtctcacgtcagccacgcgacaacacaccgccacaagatgacgctgacgcacgctcgcgacgcgaccaacacggcgacgacaccgcgatcgacaacagcttccttcctcgcgccaaactcgagttcccgacgtacgacggcaagggcgacccgctgccatggctgaaccgctgcgagaccttccgcggacagaaaacgccggagacacgcaaggtgtggtatgcctcattgcatctaatcggggacgcccagttgtggtattacaggattgagctcaattctggcgaaccgtcgtggcggaggttcgtccagttggtgcacactcgtttcgggccacccatgacggacagcccgctaggcgagctcacggccctgcgtcgcactggcacggtggagaactacgtcaacagtttcctcgccttggcgtgccgcgacgtcgagctatccgagtcccagcaggttcagctcttcacggctggcctcgtcaacccgctcaagactgatgtcgccctctgccgcccgcgatcgctggacgacgccattatgctggcacgcgcgtacgagcagcgcgccacccttggcccgactgatccatccgcgccgcgcacgggacgagtgccgcggccttcactgccggcgtcgtcggccgcatccgcatctgcatcgaccacttcggctgatgttgccgcatcgaccgctgctggcaagcagcccctggtgtcggatctgccccgcaagcgactttctccagccgagatggcccaacgacgctccgaagggctatgctacaattgcgacgagaagtacgtcgcaggccaccggtgcaagaagtcgttcgtgatcgaggttatcagtttcccggaagacaccggggacgaggaggactccacgccagaagcacacgccatcaccctcgacgagccgagcatcttcctccacgccctggctggtatctctgctcctaagttcaatactatcaaggtgtgggctcgtctcggctcgcaggaactcgtcgccctccttgactccggctcaacacacaacttcatcaacgatgccatcgcgcaccaggctagcgtccctctacagcgccgccccggcctcagcgtagccgtggccaatggagatcgcgtgccgtcaccgggcaggtgcccgccacagcgcgtctccatcggctcgcacgagttcgacatcgacttctatgcactcccgcttggcggctacgacattgtgctaggtgcacagtggctcggcaccctcggaccgacgctatgggatttttctcgacaatccctcgccttcggacccgcccacgaccgcgtcacgtggacaagtatcgacgccgcaccggcgcccgcccttgctgccgccatcgacggtcagccgggcgacctcatgaccgatctgctcgacgtcttgaaagacctcttcaccgagccgcacggactaccgccagaacgccatctctgccaccgcatacgactggaggcaggggtatcggctgttgcggtgcgcccgtatcggtacgcgcacatccagaaagatgagctcgagcgacagtgcgacgatatgctccgccacggcgtcatccggcccagctcgtcggcattctcgtccccggctttgctgatcaagaagtgcgacggctcctggcgcttctgcgtcgactaccgcgccctcaacgacaagaccatcaaggataagttcccgatcccggtcgccgaggaactcttcgacgagctgcgcggcgccaaattcttcaccaagttggatatgcgttccggctaccaccaagtgctgatgcatccggacgacgtgcacaagacggcgttccgcacccaccaaggcctctttgagttcttggtgatgcccttcggactcacgaacgcgccggcgacattccaagccttgatgaacgacgtgctgcttccgttcctccgccggttcgtgctcgtcttctttgatgatattctaatatacagctcgtcttggtcggagcacctccgccatgtacgcacggtgttgcaaacgctgcaagatcattgcctccacctcaagcgctccaagtgtgagttcggcctcacctccgtcgcatacctggggcatgtcatctccggggacggtgtggcgatggaccgtagcaaggtccaggctgtgctggactggccggtgcccaagacggtgcgcgctgttcggggcttcttgggcctcgccggctactaccgccgcttcatccgcgacttcggcgctatcgccgcgccactgacggcgctcctccgtaaagaggggttccgttggtccgacgaggcggcagcggcgttccgcaagctgcaacacgctttgacggcggcgccagtccttcaacttccggatttcaaccgcgacttcatcgtcgaatgcgacgcgtcgggtacgggccttggcgccgtgctccaccagggcggcggtccagtcgcgttcttcagcatgcccatcgccccccgtcacgccaagctggccgcctacgagcgcgaattgatcggcctcgtcaaggcggtccgtcactggcgaccgtacctctggggccgccgcttcatcattcgcacggaccattatagcttgcggttcctgctcgaccaacgcctctcgaccattccacagcatcattgggcgagcaagctgctgggattcgattttgccgtcgagtacaagcctggaacggccaatgtcgtcgccgacgccctatctcgccgcgacgaacacttggctgaagcgtttgttctatcggcgccgcacttctcgctgctcgacgacgttcgccgcgaggttgcctctactccatccctggcaagcctccgcgacgacatcattcgcggcgctaaacccccgccgtgggcattcaaagatggactgatcgtactcaaggatcgggtgtttatcccggagtcgtcaccactgctacccgcggtcctggagttggcgcacggccacggccacgaaggaacccagaagaccatgttcaggctccgcgccgatttccatgtgccacgcgatcgcgtgctcgtgcaagatttcgtgcgcgcctgcctcacatgccaacggaacaagacagaacatcttcagcccgccggtcttctccagtccctcccggtgccgtccgcggtgtgggctgacatcgctatggacttcgttgagggccttcctcgcgtccatggcaagacggtgatcctcacggtggtggacaggttctccaagttcgctcatttcatcccgctgtcacatccatacacggcaaccacggtggcggcagcattcttcggcgacatcgtccgtttacacggtgtgccgtcctccatcgtcagcgatcgggatcccgtcttcaccagcaagttttggacggagttgtttcgcctcgccggggttcagctgaatctgacttcagcgtttcatccacagtctgacggccagtccgaggtcaccaacaaaatcattgcaatgtatttgcgctgtctcacaggagatcgtcctcgtcaatggttgaggtggcttccgtgggcggagtattgctacaacacgtcatatcaggcttcgctgcggacgacgcctttccatgtagtctatggccgctcaccgccgagtctgcgttcttatgagccggggagtacatgcttgccagccgttcagcgctcgatgcaagatcgggatcagtttttggtagccatccgtgatcggctggagcaggcacagcaggtgtacaagcaggcctatgacaagaagcatcgggagttgaattttgatgtgggcgattgggtttggctgcgccttctgcatcggccgatggcgtcgctcgacacgaggggccgtggcaagctggggcctaagttctatggtccctaccagatcgtcgcttgcatcgggtcggtcgcttatcgtcttcgccttccgccaggagctcgtctgcacgacgttttccatgtgggactgcttaaaccgtttcggggtgagccgccaagcactctgcctccgttgccgccgacgcagcatggtcaagtctgtttggaaccacagtcagtctcccgcagtcgtttggctcgaggagtccgtcaagtcttggttcagtggaagaacaagccggcggcagacgcatcgtggttgtcgctggatgaattccgtgcattatatccggatttccagctcgaggacgagctgcttctcgagggagggagagatgtcatgtggggaatgcactacgtccgcaggcgcaaggatcagcgacaacagcaaaacggcaaacagtagatatgcaggatttgttttcgtttgtttcagagtctgttaaagtttgttagtttgatctttatctctaagagtttgttagatggcattgtaatctttacttaaagggccagtatggcgcatggaataaacaagcaatcagaaaaccaatctatcgctcctttcctgccttgctagtgcggcgccggtcacggcacctccgcgccggcgaggtccaggaccacgcccggttacttcgttcaaatactcccttcgccgtaaccctccttccaatctcctagcccgtgacaagagtaggtctccacaaaaaaaaaaggcccaaaatcggcaccacattttttgagaaatgtttcctcataagtcataactgagtgatttgccgatccatgatttatttggtatgattgtctccgttttgatttggcctggattaattgttctttcttgcagtacatggttttctcgtgtgctgactcacgtgtgtgcccaacactgaccttcggtctacaacctggtgaggccttcactgtccgtaatattgccagcatggttccagcctatgacaaggttcatgtttatgtacattatatcttgtctttcttcatgtactagtcagtaactttggcctgtgtattccaggtgtaaattactaagccccgtgttttcatgttgattgcagagagggcagtgcagcattgggtcagccattgagtatgctgtggttgtcctcaaggtcacatcttccttgcgaataattaatgtccttctaatctaagtcgcatgtttttttggtttaggaatagaacggcctcatgatattttgcagttaacttgtattagttatagaaaaggagagcagtggatatcgtagtatcacctgcaataaaggcacatccccattatgtcgaagtcataaacctaactggtgcacttgtaatgtgataagtggataaattattacccaatttcgtgatgacatcatacacaagacctttgtttggaaaaggagattaattcctgtttcacttacccttctctaatttgttctagaaattatcccatagaagtaaagaagaatcttgcgtcccttcaagggcatgtgtaggctctctctttcatttggaaagcatcctgtcaaatgcaaatgggtttaccattaggttttgtcggggcaatgtatacacaaatcaagtacccctggtatgatttagggagtgaacttctgttttgcatttcgaaactgtatgttctttgaaagttttagaaagaatgtgcatacacatagcagtgctagatatttgtgcgacaaccatcatacagtccacttacttccatattatgaataatagagtctgtaacattcatcatgtgttaaatgattctagcatggacgagttagctttcagattatagctgtaattcggagttctgtagagcactatagctgaactccgttagctgtatttattctcatttaaagtgcccaaatggatatggaagaattccactctagaataaatttggtgaactcacacattcgccccttcaacagttaacaaggatcttattattctccatgaaaggcacatgttgacagacatccatttggcaggttgaatgtatcattgtgattggtcacagctgctgtggtggaatcaaggaactcctctctctgaaggaagatagacctaacaccttgtaagtgaacatatccatactcggttcaagttttttatatgctgaaagcagtcaaaggattcagataagaccatacttacatgtccaggaagaatctgtcccacccaaacaaggccaagaaggaagaaacattttaaaatttaaaataaaattactgttgtataaatacgcttctttcacctatccctttttgcaatctcatttttgtttgattacctagccacttcgttgatgactgggtcaagattggtctggctgcgaagaagaaggtcgagagagaaaacatgttactgccttttgacgaccaatgcaccgtgctggaaaaggtattattgcttggaacaacattatattatttctagtagaattgaattgtgagtcttggactaagggttcactgctttgacccacggacattgagcaaagcgggctaaaattccctcacgccgatatttgcttatctgaataatgttaggtttgcaagttaactcccatggaactgagctttactgtgtggatgtaacttttttaagataatggaaatggtttacattttcgggtcttccgtgttcgtcgatagcgacacatccaataagtgtttgggtgagctacagagtgacaatagattttaagttgaatattagcatgctaaatattaataaagtgaattgcatattgggctatttattttttatcatgattttagattggaccacccttaatccaatgctttcgcattaaaccagattttcttaccaaaagattgcagttaggaccagtggctcacttgtcaatattgcctctctctcatctctctggtctccattgatggctcgtggtcaaggttgaggtcaagctaatgccggtgtacgggagcagaacctcgagcgcaaggttgatgtcaatgaagcttgagtggaaggggaccttaagctcgacctacatccacaccgtgtcacgcaagcttgaccttcgtcatcgtcacgcttggcatgggctcaatcacgacctccatccacacagtccctgggcttgagatcctcttcgcctgtcaccccgactttcgccccgccgtctcctggctcgcgatcctctccaccattgtcttcctctcctctctagctcaccctcgatctcctcgcacgccatccctagactcgattcctctccgccagcattggccccaagcttgacattgacttctgcttgtgcaatccttaggctcgtacttctgcgcgcctgccttggagtcatgaggactcgccagagtgatagaagaggaggtcgatatgctctctcaagctcccatcacgatgcttcgttttttagtccctatttaacctcactgacaggtgggtccaggggcagagccatgattttaggtcgatggtgtcattcgtcggctctaattgacgatcatggtttaagtgaaacagaaatacatatgaaaaatacaaaaaattcctcgcaatagtggttgctcaacctatgtttcaccaaatcactcaagaaaacttatgatgcacgaactttatttagacattgtgcatagtcttgttgaattagccgttgtgtatggtcaaataactataaattatagtttgctagcagttattttgttgatgctgtcaagttgtccatgtccacataagctaaattgtctaatgaaagtgcaaaattattcacacgttggtgtcacaaatcaaaatttactagtgtcattcattgaaaaattagaaggataccttaactaatagatgggtcattgttgtccggtgacaccactgcttgtatgccagctccacccctgggtgggtcgttagtccaaagtgtaaccttttggcaacaaagtatggtgtaaaatggaaacgttaagggaagaatggttcaatgtaaatctaaggtaaaataatataacccaatatgcaatttactatatattaataataatacacaccttattcgtcttaataaaaaactaaaaattgactatgaacgatcaagatcgaaccgacaattttttttataaatatctaattatgtgttatgattagatttctaatgataaaagaatactttattaatatcctatcgggagatatctattactaaactgtattgagggttgaaacatagtcatcacatttgcctctaaagtctaaagaactagaaattactgagtatattaagagaggttgaaatggagtcatcacattcaccgtgcgtctaaagatctagaaattattaccaagttataaattgaagaaaatgatatatatatatatatatatatatatatatatatatatgtatgtatatatatatatgtatgtatatatatatatgtatgtatgtatgtatgtatatgtatgtatgtatgtatgtatgtatgcatcatttgatcatggtggggtctaaattatggttcttaagattcataaatagagttgtctgccaaaaatatagagattatatttatgaaaatagaagcaacaaaattgtatacaaaatagtataagttatttatggaagcatattatgtaggatcaggagagcgtcgatgagatgaggctaaatgatcgcatatgtttcctgaaacaattagccattttaattgttacaagttacaacaaacaatacctttgagacacatatatgatatatagccactctagccttacaaactagaaatgtgcttttaagagagtgcaattgagttttcaaaaaaaaaaagagagagagagagagagagagtgcaattgggcccacaactaagacatgccatactcacaccatcatatacgtgtgtatcctctacagacgcctgaagtatcaaatgccctcatgacgtgggcatctgcatatataccctacaaatgccccaatgtgtactcctaattagaaaagaaagaatgttttttttttacgacaagaacaacgtatatctcatacgcgtcccacttatttgcacaaatatatgtaattaaaagtttgcatgaggatcggagaagcatgtgagtagattgtcgacggcctggtcaatcagagcatgcggcggaagagattgtccatggagatgagcgcgctggcggccagcgcaaggaacccaaggaacgatagccaaactgcgttgttgatttttgtgttgagtggctccttgccgaacgcggccgtcgacgaggctgacattaggaggtacgccaacacctgcagccaaatgaaaccaattagccgcgcgcgcgtgtgcgctgaaaaacttctgcttctccaacacgtatgttgtgtttagttcgtgtgccaaattttttttaaagtatacggacacacatttaaaatattaaacgtagactaataataaaataaattacagagcgaaagggcctgtagcctagtggttacagagcgaattttctaggatttaacggcgttgtggtttcagtggtaggcgacgtacccgtcgatagagaggcgtctgtggtgacttcgtcaatctcttcagaatttgtcggcccagtcttcgaagatgctcataggggtagggtttgcgtgcgtgtgttcataggggtgagtgcgcgtgcgttgtgagtgtctgcgttgtactgtgtaattctcaaaaaagcccagtcttcgaagatgctcataggggtagggtttgcgtgcgtgtgttcataggggttatgctcataggggtagggtttgcgtgcgtgtgttcatgggggtgagtgcgcgtgcgttgtgagtgtctgcgttgtactgtgtaattctcaaaaaaaaaattacagattccatgtgtaaactgcgagacgaatctattaagtctaattaatccgtcattagcaaatgtttaatatagcaccacattgtcaaatcatggcgtaattaagctcaaaagattcgtctcgcgatttacatgcaaactgtgtaattgatttttttttcatctacatttaatacttcatgcatgtatcaaaacatttgatgtgatggaaaagttgaaagtttgtagaaaaaagtttgaatataaatatggccgtagctttgcaatggcgcattttgagcagaagaattgatgggttgatagatgtttcaaaagaaaaatgaagaaccgatgtattgtgtgtattgggcttgcctgatccaggaagaggctgacgcagtaggttatcgggttcagagaagcagcaaacctcggcgaaatgaggcgcccgatttcgaccactgcttgcgcggtcgagtagacgcagactatcagattcacaccgagggcatacctgtcatagtacattggcggagaagagagaatatttttaactaaaaaggataatagatgaaatgagaagggtgaatagtaaagtgatctatgtggataaaataaaacctgaagaaccaaattaaacctttggtgaaacttaaaggattagattagttattcacctaaattaaaaaggagaagctgatcactttgtagtgaagctaggaactggctagttcctttggggatcacaccgctagatccaccgttattcgactcctaaccaatctacttctctctctactgtggtcaagggcagcggtgccttgccttccatggtcatcctctaaagctgcccctccattgaccacccttacacatcaacctctaaccctgataaatctattccgttgtgtttgctggatttcggaccatcactgttgttgcaccatcgccggaacaagttgtcgatgagttcttctacttgctcttctgcttcttcatctattctatctagaggttgaagaagactctctgctccctggaccttagtcattaatgaatgtgatggccaggaaaacatttgggtggctgtgtttagatctagggataaaaagttttagcgtgtcacatcagatatatggacacacatttgaagtactaaacgtagactaataaaaaagggacaattgcttatttgaccctgttttgaagtctaactaccaatttgaccctattttttttagtttgcttatttgaccctgcttttcaaaaacgaaccttccgtctgaccctgttttcttaacaccgttaagatttgatttaaaaaaaagaacgaaatataattaaaatttataatgcccaaaatacccttgagaaaaccatacccatctctaaccctatccacatgtctctccatgtctctctctcctgccagcgagttgcagcggcggcgtcggcagcgtcgcgcgcagtggggagggaggcggaggtccggcgcgcagcgcgggaagaaaggggacccgggcctggcggtggaggtggtggcgcggcgtctgcatcggcgcgcaaggagggaggcggaggccggcatcgacgaagggagggaggggagccgggcctggcgacggagacgcgccggcggcatctgcatcggtgcataggaaggnaggtgnaggccggcgccggcgaaggaagggaggaagccggggcctggcggcggtgcggcggcgtctgtatcagcacgcaaagagggaggcggaggctggcgccggcgaaaggagggaggggagccgggcctggcggcggcggcgtctgcatcggcgtgcggggagggaggcggagaccggtgccggcgaaaggagggaggggagccgggcctggcggcggcggctctcggtggcatcggcgtctgcgaaggtggtgcggtgacggtggcgtcggcatctgcgcgcgcagcggggagggaggcggaggttggcgcgcgaagaagggagggaggggcggcggcgatggcagccggcgccggagggaagaagcgacgcggaggaatgaaggaggcggcgtcagaagaagaagagagaagagaggagaggagaagagagaactgacaggtgggtcccacatgtaatagggtcaaatgagtaagggcaaaagggaccttttgtgcttcagttaacaccgttagtagcccttaacagaatagggtcataccgtatctttaattctgaaaataagggtcaaataagcaaaattgaaaaaagggggtcaaattggtaggtagttttcaaaagagggtcaaatgcgcaattgccccaataaaaaaactaattacacaatccgttagtaaaccgcgagatgaatttattaagccaaattaatccgtcattagcaaatatttactatagcaccacattgtcaaatcatagagcaattagtcttaaaagattcgtctcgcaaattagtcgtaatctgtgtaattagttattttttagcctatatttaatacttcatgcaggtgttcaaacgtttgatttgacacggcgtaaaattttagggtgggatctaaacaccccctaacttttattgtagaatatttacaaaacctactaacaatgcttggtcaaggaaactcctgacctaccgactctcatttccaagttctaccggtcgtaaccaacatagatgaaaattaaaacagtaaaaaatataaataaaaaatggaaaagattttgctatttccaaattttaccttattattgaggaaattatcctttttataatatagcaattactgtattttaaatacccaataccatgattgaggtctctatttaatccaaattttagagtaccatcaatttctcaatgaaattccaaacttgggtgcaaggctaaaagagagacaatttgtaaaaatatgattttacaaattaatgtttttgacgttattactagtttccgatcaattataacatgttttcgttcgtacagttccatttttcaattttcccgatatttcggatacaattttaattttaatttttatcatgttttatcccatttccgagaaaaaaaatatgattatggcaatggttgatttttgaccgtttccatcccaggctataatatagaggaagtacttaattttgagataaatctacatacaactatacaagggagtattgctagcatctagacttgttgcatgttaagaatgcatgatgtttagacgcaacaggcaagtgatcatgcaataacctgtagtactgttcgtagaggtcgtagcggtcgctgtcccacccggacgtccggacactagccatgagcacgaacgccggcaggctcagcaccgccggcgccacccgcagcgccgccgacagcgttctcctgtcccccgccgccatgtctcgcggcacgtccgggacgacgtcggcctcggcgggcggcgccggcggctcttgatcgaccacctgatccggctccgggacgtgcttcgtggcgggcggcggcgcctcgtcggggttcttctcgaactgctcggcctgcttgaggtaggtgtccatgtgcggcgtggtgtagagccggacgccgtcggcttggcccctggtggcgacgcgctggcggtcgtgggaggcgagcgaggaggcggcgtagggcggccctccttgttgtagaggtactgcctctccatgagcccccgcagctgccgcagctcctccaggagcatggccaccgtcgggttcgccgcctggttgaaattctcctccagtgccttccgcgcctcctccagcttgttccgcgcgtcctccatcttgttggcctcggccatgtccctggctgccctgatcatgtcggcgtgctgccgccgggccagctcgttctccaccggctgtggcttcctcgccgcgcctggtgcagcactcggtctgcgttttatggtgatgagatcggggttggaggtcacctgctgggcctggaaggtgaatctgtactgtgccaagcagacattggcgtcgtacggaggggaggcggtcttgtcagcaagcgcgaggtagacgatgaccctgcgcgcctctgcgctgtaaagggtgccgaagctgactgtgacggaggagccgtcgctggcggtggtctgcgggtaggtccccgcgtccacccagaccaccctcttgatggtgacctcgccatggaaccgcgtgacggtgagctcgaggtcctgggcgatgatggtgaggaggccgccaaggagctgggagaagggccccgtgaggttggcgctgtcggcgacgtagttgaacgtcccgccaaggctcttgcgcgcgatcgcttccagcaggttggagtcgtggctcgcgccgaagctgaaggtgtagacggggacgttcttgagatggacgtccctggcgtcgccgccgtggttctggtagccgtcggacatgagcatgacgctgacggcgcggccggcggccagactgcggccgtcgacaacgctcatgccggtctcgaggccgcccttcatgttggtgtcgccgtaggccttgaggccgtcgacgagggccttgagctcggcctgcgcggccgccgtgacgaagcgcagcgggcagaggcgggtggcgttggtgcaaaaggtgacgatgcagaggcggtcgaggtcgctgagcttgcggatgacgaactgcagggcggtcttcaccttgtcgatcctgtccccgtccatgctgccgctgacgtcgatgacggcgacgaggtccaggcccgccctgtcggtggacgaggaggagcccctgagctcgagcagcagctcctggtcatggggtgccatggacgcgacgtcgttgtggtacttgttgagacgcacttgcttcaccagttggcccgtgatccccaccgtcggcctcgccggctcggtggcggtgctcgtcggagcagtctgctcgtcgtcgttgtacgccatctcttcgcgatcactagctagcttcttggttgttggcaaaagcagctagctctgcgcgatctctatatatacagcactccacggcactcatcacgagcgtgtaacttttacagcggatttgccaaaaaaacttccacaagtttttttcccccctaaaactttcggatttatgaccatcggatcatcttgagatttatacatgaaggaaaaatattgctggaaagaaatttttatacatgttacgcataagatttcagtactacctaacctaaccaaagcgcagttgaatacaagttttatgtaagttataccgtaattgcaacgtagttataatcaaggttgacaatttcaaatttggactttatgccaagggttactgaaattttggaaatttcggaacgaaattatttgaaattttgattgattttgaatgaatttgaataaaatttgaccaaattcacaaaaatttgcaaaaagccaaaaatttcggatgagatttgagcatgccggcggggggcgagattaccgaaatttcgggcgagatttcggaaatttcaaactaaaatttcaaaccctggttatagtgcagctacatgtaattacacttcaattatactatagttacatctgaaatttttttactagaaaaacttacggcagttttttagatgctctccaccgataatacaataaattttggctttgtttcaagaaaaatcccaaccatgagcacaaaccatattctccataaattaaagagcacaaaatgtcacaagtgtgttaataagcgatgacatgcccatcaagtgaattattcgttatattaggtgagagtattttcatccttgtagacaattatatctcctatatagtcatataactttttgaaaacgtgttcttccataataaatatgcaagtttgaatttgacatacacaactaaaaataaaaacaacaattttcttgtgaataatgcactattcgcattcaaatatgttttttctcctcgtaaatgtcaaatttaaagttgtatatttgtaaagatattgtcacgccccgaactagccccgactggaactagcccgtgacgctccaaattaacctgttaatcgataccagtcccaggaaacagtgctggtatcacaggaagacagaatatcacaactgcaatacaaaaggggaaacggaagccaggacttggaccaatcatcacaggcgcgacttgggaactaggccgaaaccctaaaactcatcgtagccggcttgctcctggaagaactccacatcaacaggatccgcttcatcttcttcagcaactgggggggattatttatctagagcaagggtgagtacgggagtactcagcaagccaggggaaataagtgtttaatgcaggcttcaaggaaaggctgttgtttttgcaattggttttatttgaactcttttctaaaacaactaggtgagtgcttctcaaacgacacggatgagacagtgcgtctcgtccggtcggagtatgtgcaatgtatcagctctttagaattgaaacaagattggcacccggccaacagctttttaaacggccacccgggccaacaacttttcaaacggccacccgggcctagctgatcccgtcagctgctgatttttcagacgtcgaacccattttcacgacagcaatttcacaatcagtagtcaaacaaaactacgctaggaatcacctcacatccgcccatgaccgtgggcacgactgttcgaacagtttgttaacctctgcagagggggtacactttacccacacgacattactaacccggatcacccagcccgaggggatcagccacgtcgggagacctccaagctttcatgacaaggcatttcgaaagccgatacaggtttaccatatgccgacgagaggggtcccagaccaacaacagggtaggtcccagaccatactgtgccagcaagcccaggggtcctccccgacaccaccccggtgaatccacatgtctctcggcatcaaggctcccctgataagctagttactcagccaggggtgtcccattccacccatgtggtcgtacttatcttatgtttggatgaaattccaaggaatcggtccttaagtgcgagagcgggaaaccgtacacccggtacgttccccggtccgcggttttggaaattcatttagttcgcaagcaccgacccaggtgtcgggttttccaagtcttttgtaaaactccagttttacccaagttggtattcagattttaagtttgaaggcgtccgtcgatactcgcacggggtgcacgaatatcgagacgcaactagatggttacaaggggaccagatatagcaattaacaatggaaggatcaaatgcaacaaattgggtaagtccgccaatctgccttgcagacgggacagcagattaagtgcgatcctatcaatgcataatattttttttcaagcaacataattaaatttcaaatataggttcaagatgttcaaaggtggcttgccttgctcgagatctggagcttgatcctcgaaatcctcgcactgcgggtcttcgggctctgaaactacacgcgaaacgggacaactcaacaaacggcgaaaaaaataaagccctattaatgacctctaagcgtgccattagatagatctcgagatttggggaattttggaagttgaacggagtcaaacggatttacggttgggaagatattgaatttctaagattattggatttttgatctaaaggaaaaaggattaaattaaatcctttttgagaaaaataaaaaggaagagggaggagaagtagacttctctcgggcggctagggcgcggcccaagggaaatggagcggaccggccgatcttaacgggccggccggcccaagacggcccaagcgcgcgcgcgggagggaggagagagagtccggtggaccgggctcaccacgcgcggtcccgggtgggacccgcttggcagcggctcggctcaccgtgcggagggaatttgcggcgtacgcgcgcgggcggagctgggacgcggtgcacgcgcgcggttcgcggaggaacggatgcggcgggcccacgcgcagcctcacggctcaccgcggaccatgcgcacggggaaaaaacggagggagcggctggccgggtcggctgatccggtcgcggccgaggtggcgccgacgtggcgcctacgtggcagccacgcgggccggcgggaggtagacgacgacgccggccggaacggacggcggacgacagcggcgagcggcggagcgaaccacggtgatacgggcaacagcgagcacaccgggcagttgcacgtgacaaggggaggcgagccaacggcttggattcgccggaggttgctcgacggcggcggattgcggcggcggcaaccgatggcgggagaagagggaaacggcgacgaggtcacgagaggtcgattcccggcggtgagagcatctacacggcgatgacgacggcgctgacgacggcggtggccaggcggtcggccaccacggcacgcgcgcgcgggaggcaacgggcggcgtccacgcgggcgcgcacacgctggctcgcggggccgagcgggtgcacggctgcaggcgcgacagagcgagggaaaagggagggggcgctcggcgcggcggctcacgcgcacgcgcgcgcggcgcgcgggcggggcggagaaggagggcgagggcgcccgggagagagggggccggggagagatgggccgagcggaattcggcccatcgaacccagggaggcaaactagacttttgcggaggaatttaatttggagggatttggattcggaattgaactcgacgatagatcggggattgagatcttgagatggcacggacactagacaacaagcaaagaaacaaatttcgcaattagggtttttaagagataattttcccgctaggcgccacgacggaacgggcgctacagatatattttatatttatctatcttgttgtttttttaaaaaaaaaatctttttagttacattttggatgacatgtacaaatcactagggaagacaatagttcacctcagttatattactttcctgtcccgaaatataaaatctaggagttgatcagacataacctattacaataaggatatcttgatatattgtacaaggttatgtccaatatatcttttcttaagtcactactcctttcgtcccaatatactgcaatctaggatatgatgggattatattcatatatccatattcgtagtcctcctatcctaggttgctacatattggaacgaagactgtatattttaggacaagaagagtatgtgagaagagtgggtgccttgaatgagaattaaatgaagctaggatgcacttaattagtacttcctatgtattgtacggttatttgttaaggaagaaaagaattgatctagagtagacttgacatgcaacaagatctgtcgctcatgatcaccatgcagagcaaaattttaggaactatctatatatgtcgtcgtatttttataaaaaatagtcggcatatatttatattgtaaattcttaaaattatatatgtaagtgaatataagtagatgtaagtacaatctaacgaacatatattgtaagtcagattcttttccagctcgatattacccaggggaacttgctcttctggaattcgaagacatttctttaactgggatacgtggaacacgttgtgcacatctgcgagaccttcaggtagctcaagctgataagccacttcgccacgtctggcggttatgaggtaggggccgatgtagcggggtgctaacttgccggacatcccaaaccttctcataccatggaggggtgatactcgcaggtatacatgatctcctttttcgaactcaaggtcacgtctccgattgtcagcgtaattcttttggcggttctgcgctgtcttcaaacgttctcggatcagcttaacttgttcttctgctgacttgagtatgtcaggaccgaatactagcgcttcgcccacctcattccagcacaagggagtgcggcactttcttccgaacattgcctcattcggcgacatctgaatgctggcctgatagctgttgttgtatgagaactcggcatacggcaaacaacgatcccaagtgccttcgaaatccagggcacacgcacgtagcatgtcttctaggatttggtttaccctttcggtctgaccatcggtctgcggatggtaggctgtactaaaatttagatcagttccgagagcttcatgcaactgcttccagaaccttgaggtgaactgagtgcctcggtctgacacgatcttcttgggacagccaaatctacatacgacatgggtcatgtagagttctgctagtttctttccatcataggtggttttcactagcacgaaatgagctgatttcgtgaggcgatccgcgattacccaaatggagtcgtacccgctaggggttcttggcaaaccggtgatgaaatccattccgatctcttcccatttccactcgggaatcggtaggggttgcagcagaccagctggcctctgatgctctgccttgactctttggcaaatgtcacacaaggctacgtattctgcgacatctcgcttcattccagcccaccagaagtatgccttgatatcttggtacatcttcgtacttcctggatgaatggagtaggcggactcatgagcttcttttaggatgagatctcttaactccttcttggccggtacatagatgcgtggaccgcaccaaactgtgccttgatcgtctatggaaaaattggtgtctttcttctcctgtattctttttattaactcttttatcccttcgtcgtctttctgtgcctcccggatttgcgactctagggtaggctgtactgtcaagctggcagggacacctgactgtaccatggtcagccttaacttctccaattctctgcacaggtgatcttggtcgggccgtatttgagctacgttgcaataggccttgcgacttagcgcatcagcgaccacgttggctttaccaggatgatagtggattccaaggtcgtaatccttgattagttccaaccatcttctctgtctcatatttaactcggtctgtgtgaagatatacttaagacttttgtgatcggtgtatacttcacatctgttcccgattaaatagtgcctccagatcttaagagcatgaaccacggctgccaactcgagatcatgggtgggataattgacttcatgaggcctgagctgcctggatgcataggccacaacctttcgttcttgcattaggacacatcctaagccttgtcttgatgcgtcacagaagatctcgaaatcttttcggatatctggcaaggtaagaactggggcagtggtcaaccttttcttcatttcttgaaagctgtcttcacaggctgcagaccattgaaatttcttttccttctttaacagctcagtcataggtctggctagcttagagaatcctttaatgaatcttcgataatatcccgctaagccaaggaagctgcgaatctctgacacattcttggggtatatcaggatgtcatcgatgaacaccacgacaaactggtccaggtattccataaagattttgtcattaagttcatgaagaacgctggagcattggtgagtccgaaggacattactgtgaactcgtatagaccataacgcgttgagaaagcggtcttcggaatatcttcagatctgattttcagttggtggtaacctgacctcaagtcaatttttgagaaaactcttgctcctttgagttgatcgaataaatcgtcaatccgtggcaacgggtacttgttctttatagttacttcattcagggctctatagtcgattaccattctctcagagccatcctttttcttaaccagaagcactggggctccccaaggggatgagctaggtcgcacataacctttactctccaattcttcgatttgtcttttaacttctgctaactcattagctgccattcggtagggtctctttgcaattggggcagtgcctagtgccagttctatggcgaactcgatctctcggtctggtggcattcttgttaattcttccggaaatacgtcggggtatgcacagactatgggcaccgactccaaggaggtgacttgtaaacaggttagaatagaccggcttgcggtaggggtgttaggggtaaagcggatttgctttcctccaggtccttgcaaggtgatggacttttcggcacattctatctgtcatttgtgcttagccaaccaatccatccctagaatgatgtccaagctttgcgagtctaggactatcggtttggctaggaagtcaacttcctcaattctaaggttaacttccgggcatatttgagttgcccttatattcctcccaggggaatgtactatcattggtacacgcaaattttgggttttccaaccatttcttttcacaaaagcttgtgatatgaaagaatgagaagctcctgaatcaaacagaactattgcgggtacggtgttgacagagaacatacccatcacaacgtctggagcatcctgagcggtttcagcttgaatgtgattcacacggcctcgaccaaagttgttggaagcacgtgaaccttgtccacttgcctgagagctaggacgagactgagctgccgctggagtaggagttctggcagtgctgccattagcatgtcctgagttggtgttggtaggattctgaggacactgtctagcatagtgacccatctggttgcaccggaaacactgaactgctgacggtccctgtggtgacttgaaagaggtaacactgtttggcgcagtgttgccactaggggcacgctgctgtggcggaggtgccggacggttcatctgagggcgaggggcgtagcctggctggcggttagcctgagtgaccgactggtggtattgcatgggttgaccgtagcgagggcgaggtgcgcctcgggaagaatttccctgatggttagacttgcgtttcttgtattcttcggtagcctcttttctggcatcctcaagtagaagtgccttgttgatcatatgttgaaaagtggggaagtcatgcgcaagcaactggagtctcattccaactgcgatccctttcaagaatttcctaatcttcttcttgtctgtgtccacttcctcaggggcgtaccgagccaacttattgaactgacttaggtactcattgacactgctgttgccttgcttaagtctgttgaattcttctttcttcatgtcaatagtgctttcaggcacatgagctgcacggaaagccgtagcaaactcatcccaagcaatgttagtgggttcaaggtgtgcattgcagtaattctcccaccaatctgcggcaggtcctcttaactggtgagaggcgtagagcgtcttctcaaccggagtacactgcactaagttgagttttctatcaacatctttcaaccaatcgtcagcctcgacgggctcgacggtctgagagaactctggcggacgagacctcagaaagtctgtcagcttggatctgttgttgcccatgtgagggtggccatttccatgcgcattatgctgaaaactggctatggctgtggttagtccttgcaagatttgtgtctgaactgccattaagtgttgcatgttgttttccacatgaggtggggaagggaggcgttcttctccagaattgtgactggcagtgtggtgagagcggtgagactgttccatctctgcatcacgggaaactgtgcgatgcgagcggctgctgcggcggggttgctcaacctctgcgttgcgggaaacagtacggtgcgaacggttgctgtggtgagactgctcattagctgattcatgatttgcttctggttcgactctaccatcttcaaaaccaaagcgggctggcgcacgagctgtacggcgggggcggctagccatctaaactcccagaagagggcggggtaagagtcagataagcacttaggagggcaagaagcaaagaaaatagcaactcagatagcacacactaggcataaactggatttttcaaatcataaaaacacctgatacaacgggtatggacaagtcacagagctacgccgagcttgactgtgcgcacaccacctaggagaaccagactaccaaacaacacccacaacaaacacacgcacgcactacctcgccacgactccaaaagagttggcggcggaacaaaagggcctatcacacggacggctgctgaagactgcctcctctactcctcgtcggcctggctgcctcctgtagtcggctcctcagtcgaagaaacgtcgatcggctggcgcgaagggaccggcggaacctgtcgagggccggcagcagcacggaccgctagcggtgggggagctgggtagtggaaacggaacacggtggaagaaccaacaacacgcttccgcgcagtgcggataaagcgtgggccacggcgggaggaagcaactggggtgtgtccgggggtgtaggaagggctaactgggtgtgggtagggggagtacactggtgagtacggcgcacgcgagctgggggagcgcgggccactgggagtgcgggcagagccgcgggagctgtgggaggacaggtggctggcgtggcagaggcggcctgagtcccaagagatagtgtcaactgaggtgacaccctcctcggccagacaggcctccaaggcggcgtagcggcgggcaagggagcggtaagcctcaaggagtaggtcgtgctgagtggcctgagcctccgaaagctcaaccatgcgagtcagcactggctgagactcgctgtacggacaagggtacctggcgtctgagtggccagaaggaaggcgtggaagctgccggaaggcggagcctccgagacggtggctgtagtcgtgggccaggcgacgaagcgcagtccaggagaggtcctggtacgcgatctagagagtgggcctggccacagtgaagtggtgtgggcgaaggccagctccgtgtatacctccacgggggtaaaggtacacagagagctcacagtgagggggaacacggtccacggagtaccccgtgtactcgggacacgagaagccaaggaaacgggcgaggtcacgaagctgagcgacgtggtgaccctcaccaaaaccgtgggaactgaagctggcgttcactgccatctacaattttgaaagagggagaaagatcagtaaccattttagaaacaaactattgaaaataaagaaaacaaaagaaaccttagcttttcgcaagtagttttgaacttagtatccttagggtcgtcctaagcgtcgggtttcgccctagggccaagcctgtgctctgataccatctcttgtcacgccccgaactagccccgactggaactagcctgtgacgctccaaattaacctgttaatcgataccagtcccaggaaacagtgctggtatcacaggaagacagaatattacagcaacagaggtctctttattatagagttggaatacagttatgttgggctacggacagatcccgagctcacaactgcaatacaaaaggggaaacggaagccaggacttggaccaatcatcacaggcgcgacttgggaactaggccgaaaccctaaaactcatcgtagccggcttgctcctggaagaactcctcgtcagcaggatccgcttcatcttcttcagcaactggggggggattatttatctagagcaagggtgagtacgggagtactcagcaagccaggggaaataagtgtttaatgcaggcttcaaggaaaggctgttgtttttgcaattggttttatttgaactcttttctaaaacaactaggtgagtgcttctcaaacgacacggatgagacagtgcgtctcgtccggtcggagtatgtgcaatgtatcagctctttagaattgaaacaagattggcacccggccaacagctttttaaacggccacccgggccaacaacttttcaaacggccacccgggcctagctgatcccgtcagctgctgatttttcagacgtcgaacccattttcacgacagcaatttcacaatcagtagtcaaacaaaactacgctaggaatcacctcacatccgcccatgaccgtgggcacgactgttcgaacagtttgttaacctctgcagagggggtacactttacccacacgacattactaacccggatcacccagcccgaggggatcagccacgtcgggagacctccaagctttcatgacaaggcatttcgaaagccgatacaggtttaccatatgccgacgagaggggtcccagaccaacaacagggtaggtcccagaccatactgtgccagcaagcccaggggtcctccccgacaccaccccggtgaatccacatgtctctcggcatcaaggctcccctgataagctagttactcagccaggggtgtcccattccacccatgtggtcgtacttatcttatgtttggatgaaattccaaggaatcggtccttaagtgcgagagcgggaaaccgtacacccggtacgttccccggtccgcggttttggaaattcatttagttcgcaagcaccgacccaggtgtcgggttttccaagtcttttgtaaaactccagttttacccaagttggtattcagattttaagtttgaaggcgtccgtcgatactcgcacggggtgcacgaatatcgagacgcaactagatggttacaaggggaccagatatagcaattaacaatggaaggatcaaatgcaacaaattgggtaagtccgccaatctgccttgcagacgggacagcagattaagtgcgatcctatcaatgcataatattttttttcaagcaacataattaaatttcaaatataggttcaagatgttcaaaggtggcttgccttgctcgagatctggagcttgatcctcgaaatcctcgcactgcgggtcttcgggctctgaaactacacgcgaaacgggacaactcaacaaacggcg

SEQ ID NO: 57804 - DNA, 36530 bp, Oryza sativa
acgaacggtcaaacatatgataaaaagtcaacggcgtcaaacatttcgaaacggagggagtatgttcttaatattttgggggaaaaacatttgaagttgatgtaaaacaaaatgttgaggatgtatgttcatgtggaataatcatgtgcatatggttgacaagagctactgtctaattggaatgtgcgctttgattaagattgtcacctacacatgttgggtatagttttcagtctccttgcaccttttaatgggattgaaaacgtaactgcagggaaaccatcattcacttggtttggcccaacgccaagagtgatgatttcagaccctgaatcaataagggaagttatgtctaataagtttggccactatggcaaaccaaagcctacccgtctcggaaagttgctagcctccggagttgtaagctatgaaggcgagaaatgggcaaagcaccggagaattctgaatcctgcctttcaccacgagaaaataaaggtgaaattcattttatcacttttagattgcagcattccatatttcttattgggtaatgtaccaaagttggctaacaatgttgtctcgttcacagcggatgctgccagttttttctaactgctgcacggaaatggttacaagatgggagaattcaatgtctattgaaggaatgtcagaggtagatgtttggcctgagttccaaaatcttacaggagatgtcatatcaaagacagcattcggtagcagctatgaggaaggaaggagaatttttcagctgcaagcagagtcagccgaacgcataatacaagcctttcggacaatttttataccaggatattggtttgttctttcttcttacactataaaagaaatcatttggacatgcatatcaaatatcttacgaacaatcctatgagttatataatatctttatttagtacttatgtgatatattacagttgccgaaaaccgttgtcaaaaatgcccctctgaggattgtgaaattaaagtataaccttcagtcatgtttttagatacaggggaaaacaataatatgctgaaaaatcattcagaatatggcagtcattgccagttgacatgtgagccaagagtcagacaaaaagatatattcgatctttggtttagaagaaaattttgcagtctgagcacatgcaagttttcagataatagaaaacacacactgatgagaacaaaatgcagtttttcatttcttttgtttgatgaattagttctttaacagtccttttataaatgtatcaatggtacgacaattatgacttggaatataccaaaatatggtacatcctctaagtacttcggtactacttcggaaggtagaactaataatacatatcagtgcaatttgaatgattgcaagaagagtctacgtatacatttttttagactaagctaaatttatacagtagcaattgagagtttactcttgcatgattgaaaattttacaggttcttaccaactaaaaacaacagaaggttgagagaaattgaaagagaggtcagcaaacttctacgaggaataattggaaagagagagcgggctattaaaaatggtgaaaccagtaatggtgacttgttgggcttattggtggagtcaaatatgagggagtcaaatgggaaagcagaactaggaatgactacggacgaaattattgaggaatgcaagctattttattttgcaggaatggagacaacatcagtattgctcacttggacattaattgtgctaagtatgcacccagagtggcaagagcgagcaagagaagaagtgctacaccactttggaagaaccacaccagactatgatagcttaagtcgtctgaagattgtaagtataagatgaacactgttctcttattttgccaaatatgcaaaatgcagtctattaattaagacactaagtttgtactggatttgttttgatcagttacttatataaaatctgaaaatattgcgttgaaatgataactatttgtcaccaaaagtaacaggagcttatgccatgtattttccatatgcttctagaatgttttttttttccatacagttcagatgatgttattttaaagctttatcagttatcaccggtaataaaattgaggggggttgaattgccaatatatgtaagtgaataaaagattctgattgttagattaagcaaggatttatttgaagcaaatgcgttttaatttcagattaattaacaacagtcatgatctctgttttgttactgcaggtaacaatgattctgtacgaggttcttaggttgtatccgccagtggtgttcttgaccagacgaacatacaaggaaatggagctcggcggcatcaaatatcccgctgaagtgacccttatgttgcccattttatttattcaccatgatcccgatatttggggaaaagatgcaggtgaattcaatccagggaggtttgctgatggcatctccaacgcaacgaagtatcagacctctttctttccatttggatggggtccccgaatctgcatcggccagaactttgcactattggaagccaagatggctatctgtacaatccttcagcggttctcctttgagctttcaccatcgtacatccacgcaccattcactgtgataactctccacccacagcatggtgcacaaattaagctgaagaaaatctaaccatgctgctcacttgctcggattggtcaaggagaaacaagtcagtttgataagttatatatctttctcttttgtaaacagaggtagtctacaggtttcgtattcgaactagaaagattttacttattgatatactagcttttatgcagataaaaacatggtgagtgaaataatattccgagtttttaatacaatacaagagtgatttttaggctcttgaggatgtatcatattttatagtgtaaaatttaatctctctaatacaatgacatatgaaaaatttgcattaaaaattttaataccttttgatacctctcgaaaacagtaaaatatatcacaacacaatcattacatagtgacaccagccattgtgaaaacagagcaggtcttctaggcaccggcaggtacgtcccacaggatttccaccaaatctgcggttcgcaagaacaaaaccccttctttgtgattgcttcaagtcttcaaccaactccgctgggcttcgacagacgactcaaaggtgcgagtgtttcggtctttcaaggtcatccaactaccgagactacgagctgatcattgttcgttacccattgtaatgacacagcttatcagctgtagggcaggctcctctcttatggccaataacatgaagagtttgcatctcgctggtgcattattgtacaccgttcccactcggggccatgaagaaaatggaataagtagatgaagcagagtaaagtccccttccctaacaacacaatccgttgtgccaccctaaaggcctaaagtacccttttgaattagtacttggcccttttgaattagtacttggcaaatcattttatatttttttggaatacgcaagcagcacatcattgtattaaaaagagtaaagtttatataaaaggaaaaccgaaaaaaaaaacaggaaggggacagggtacatgagatacaaagagattagggcctaatctccaatcagattctgcgagcgggggaacatgctaggcgtggttagttctgtcatcaccgcatttgttaggcgtcatagctcagcatcagcagccataccctttgccacttcgacccagggcttgtgatgctgattgaaaaccctgttattcctctccttccaaatcgtccaggcaaccagggctgcgatggtgtcgaatccccgtcggtgagccttgtcaaccttcatgcggttatcacaaagccacaagtggaaggatgcttcattgaatggcaggaaattgggcaatctaattgctctgagggcaaaccaccaccattgccatgattccggacaagcgaccagaagattattgatagtctcgttgcattgatcacaaaagacacatcgatcaaggtgtggcaagccgcgattgtggagctgatcggccatccaacatctattgagatccaccaaccacatgaagtaacgacatcgaggaggcgccaacgacctccaaatcggcttgtcctagaactgcaccctttccagttcccacaaacagagacaggtaggcggaatatgacgagtattcccctgaagactcccaccaccagatgagggaatcgggctccttggagaggtcatccaaggagtggattgcaggccacagattgagatattcgaggattgcctagacccctaaggcactggtgatgtccttgatccatcttctatcttgtagtggcaaatcattttctggtaggtttgggagtgttgtcttgcctgaatggaatactaaatagcctaataattcgaggtacaaacaaatgtattaagtaaaagaatggtttaaatgtaatattttaaataacttatatgtaacttttaaaaaaaatcacaccaatagagaacatgtatattcttattctattttattctcggggaaagaacacaccttaacagtttaggatttaagaagaccagctgaatacccgtgatatggagtacggatactcatacacttcaactatgcaaggaactgcagcagcggttgtcagcaaatagtgttctgctttcatatcagagattgagatttcagagtgccggatgcccggaacatggagcttccagtgtttatcagcaaatgtgttctgctttgatatcagagattcagaatgccggatgcacggatctatacagacgatttcatttcatttcatctttttttctttccctaacccgacgatcagagtcggcgcagcctaaccggaacgccgtgctgcgggtgcagcgtcagcacggtgtagggcgcgtgcgcgtacgccggcgacagctcgaacgcgaagcgctgcaggatcatgccgagcgccaccttggcctccagcagcgcgaagttctggccgatgcagatgcgcgggccccagctgaacgggaagaacgcgccggcgccggggtccttgcacgccctggccacgccctccgcgaacctccccgggtcgaactcgccggcgtcgtgcccccacgcggcggcgtcgcggtggatgaacagcacgggcagcgacagcatcacgcccgccgggtacctgacgccgccgagctcgatctccttgtacgtgcggcggttcatcatcaccaccggcgggtacaggcgcagcacctcgtgcagcaccatggtcacctgccaaagatcggctccatcgatcatcaaatcgtgaacatcttttgcagaaaacggtgcaaaaattgcgttacggggcagagtgcacaactcacgactttcaggcggctaacgccattgatatcaggtttgtttcgcccaaagacctgcagaatctcctccctggcgcgatcctgccactccgggtgcatgctcagggcaaccattgtccaggtgagcaacacggcggttgtctccatcccggcgaagtagaacagcttgcattcgtcgatgatctcctcgacggtcatccccttgctggatttgccgtcctcgtcgctgtaataatccatgttggattgtaggagcaagccgagcagatcgtccttgctggcttcgccgttcttcgtggccttctgcctcttttctattatgcctcttagaatactctttatctctctgtctattgccttcatccttctgttgttttctgtcggtaaaagactggagggagagtattatgttagttctatcatctatggatgaaacgaataagtggatacaaaatgaatttagtttttttctctacataaaagttggatatattcccgaaacaatgaaagttggacacaaataatggcaaatgtaaggagcactttttggtctttggtggtccatccatgtttttctcacaactattatgttgtcctgtatgtacttaattttctcttgatattgataaattcggcaaaacaaaaacaaaacaaagaaagattaggagcactctgaactttaggtagtgttttaaatatatactatgcaggtaaaagttgatggatgatccactcgtttgtaaagataaactacatattatatattataaaactaacaaataacttagaataagtggtgtcaacaatgcagtaaaagaaagtttattaagagcatttttagaagtgtgaaacaaataatccagttataaattactacttctttcaggttataaggctttctagcattaacatctatatgaatgtgggcaatgctagaaagtcttatgtagtaatatgaaacggaggaagtataatccaacagatgagttgaaaaaagaaaacggggactgaaactaaagatgttgggacagtgatgagaaccatacgataagcctgggatgtaattactccggaaagattgaacaaggcgttcagcttgctcggcctgaagtaggaaaatttgtctgccttcgtggtgtctgacaccaaatgctgctcttgaaataacatctcctgataaattctgaaaatctggccaaatgtccagctcggcttttccaacagaagcagcaaccgcattctcccatctgccaattagttcgctacaagatgcggagaatgctggcaacatccgctgcaattagttccaagggaatatataagtcagggaaaggggaaaaataccaggaaagtaagtgtaaccaaattgatctccagttctaatatgtttagttcgacctgtttagtgactgcaaagaatgcaggcattcatcagattaatttaacttctgatcaaatagctaggctaaacgatcgtcttactaaatgataattcttacacatgaaatcctgaatactaaatacagtagtcaggtctcatattcacgaattctttcagtaaatcctagtaataatacctttagcttttctgcatgaaaggctggattcataatcctcctatgtttgacccatttttcaccatgaaggatcacaagcccaccaacgagtaacttagaaagccgagtggccagctttgtcttctcaaagtgaccaaatttgttcgatagaacttcacggaccaagtccggatcagtgattgtaacccttggcattggcccgaaccatgtaaaagaaaccctacctgtattttcatgcgcacagagatcagaacatggtacaaagacactgaaaaaaacaagataattgatgatcaaatagtggcatttctagatcaactgtacgatgaacttaaagttgcataacaacaatcaaatcttggatgtgttcgccgaaaaacaaaacaaaagaaaacaaatattgcagaagtagagcgagtacagtaccgtgttcctccaaggcacggtgaagcagaggcgcgacgcgcgggatgaagtcgtggggccggtccatgggcacgggcttggagcgggccgccgtgacgagccgcaggtcctcggtgaggtcgccatggaggaagcggtactgggtgcccctcaggccctgggccctgagggcccgttccatccgccgcggggccagccaggcccactccagcatctgcgcggcccagaccagcagcagcgcggccaccgcgccgccgagcaggctccacggcgaggcctcgccgaatggtagcgccgcgccggtgccggtgccgatgccgatgccgatgccgatgccgatgccgatgcccattgcttctttttctctctgcatgtaccgagcaaagcaaatgtgttgttgaagcaaacgggacggagagatcagtacgtgtgtgcagagtgcagtgcagatatactaaccaattactaacaaagtaacaatcaatgattgccttctcctgttctccaacactaaaaagaaaatgatatcctaaaaccaaaaccggaaattagtgaccatcctgtcccacagaataactccgaaatcctatctgatactactgacgtcactgattacggtagtgaatcactccacgtgacggcgccacgtagccggaggtgaggtgaggtcacagcgcgacctccgccgcattgccacggtggaggaattcagcaagacacgtgtgtgcagtatgcatgcagatgcagtacctggtaccttgtacgcgggcgaggcgtcgccggcgtcggcgtggtcgacggtgctcaggttggagatcaacgaagggggaggccgagaccggccgaacgagcaggcggggaggctgggggctgccagccggtgagcgtttgggagaaaaggcgaatggcgccggcgccgccggagagatgggaagaaattaagatggggggaggatttggaaggatctcaaacagaaaagacgtggctaacataggtgtatctcttgcaggagcgggacaacgacatggggagcatgggcgccgctgcgcatgtcgacgcgacgcaagcgggggttcacgcatcttggcgtggttctacgtgcctcgggcggtggtacacgactggcgctttgaatggaggagaggatgtatggttgcaaatcccggagataccgcaccgcgcgatagggccggaggaaggagaagctgatccaaagacagaccccccaaaatgttcagtcatcagtgggcctggaacggaaaacatcttccggcccatcaaacaccccatgttgatgcacacaggctataaccaacgaggcccatggatgcgtaaggtttagctgaagttttgatttctgggctaaaccttctgcttcagacgttctgatttctcaagctgacgctcgaacattgtgtttttttcttttaagaaaagaacatttgtgtcattttacttttttttaaaaaaaatacatacagagatgggcatgtcgcctacgtggcaccgtcccaccaccattacactgtcctccacctcactcattgcactcacagtcgtcgtccatctgacccttccctccaaaaaaaggtcggctatgaccctatccaagagctactggtgccgtcctcgaaaagccaacaagagagtggaggtagcggcacccccaagaagagtgcatgaggaagacgaggctatgtcttttctaggagttcaccgcctatgcctattcataatcttgtgttctttggttgtttcttcaacttcatgcttaggttaatggatggatggggcaactggcagaggaggcacaatgtgtggggacaggaagaatatgacttgcttggttctatgcgataccttcatgtacattttttttgttggtaccagacttgatatgcaacaactggcctcgataccttgtgggtattaggtatgataccagtatcataggtaccaggtctggtacccaaagcatcaaatctgatacctcaggtatcaactttggctcctgacaagcgtggtgatcagatacggacatgcggtaggcatgagataatgcatggtaagaaatgcgaacacgtgggtgtgtaggggagcagttgatgggggtaaagactcgtcatgataatctatcccattaagaaacatgatatcaggggctagcactcttttttttaattgagaaacacagtttatatgagcacccatgaaagtctagacctacatattttgatattaataaagttatcatgagcgactcgctaccaacgtgtgcattacctacgactaaaacaataataaccgtaagtacacttgtggacattacttcacctttagaagacttgatgtttgtcggagtgcgaaactcctctagaggagaagcaaggcactccccctatatgaattcgtctaggatacaagttttgagctcgggtcctgatcacacgtgagaatgagcacaaacaagtatataggttcctagttcaaaaatcaacctcaggggcaaattcgatgcttttttaaacaaaaacaaatttaaaacagtaagttcgatcgaaatttcgttgaaatctcagttttcaacgtttcgcggggttccaaattaatcaatgatagcgtgaaccgatcagagcaccccaaagcatctttaccagtaatcaggcctccaaaacctattcacgcatatgctctccctgcagcctccaagggcgattgatatggatttatctggactgttaatcacaaaagtctgcatcatcagcatgcgcatcgcctatatacgcacctactgacctgacctgcaacctaggcatgcccgggcctcatttttctatccgcgacgaatcgcgcatgcgttccctgcagatgacagcgatctcccctctcctcctccttgacgaaaaaacaccgcggccgggggcgagaccgggagagggggggttttcagttcaccggagtcaaacaccggatcagcaaaggaaataaagtttggtgccatgtcgctctcggcaaaggaaacgcttgcctcctggaaggcacgcctgccacttcgagatcaatttttaaaaaaggtgttagactacgacttatacgctgtctacgcatgtcatgtatgaacaggttaatttttcttcatagaaattttacaacaaagtcgcctcgcgtactctcaccggtaaaagagaagaccagctctagcagggtaagcgtgttttctgtgttattaatggacttgctctagatcaatctcaactttaagaggacaaaaaaaagcatatggctgcggtaatatcatagtatcatataggagtattacatcatgcaggtgtcttagctttcttatttgttgttacatgaccttgcttatgtcgacacttcagtctgttatgtcgacactttggtctaaacacatcctgtgtactgtacagcggcgaccgtcctccccccttatatgtcaataacaccttaaataacagtacatgtgaaaaaagaaagtttacaacataaaagaaaagaaaaacaaatactccatttgtttgcaaatatttgtttgtttggactaaaaccagcattttttaagtttaagataaaaagtcggcaggaaaattaaaaggggtgagctcctatataacaaatgtatttttaactattatatttgaagtaaatagctttaaaagtatattgcagactattaagaaagtaattttggttacataattatataacctaaaaatttttgttgagtacagtaatcagtttaagtcaaactaaaaaaatatttacgaggaagggagtacaaatcaaaataaaatatgcagcaataaagatgaaagccccaaaaagaaagtcttgaaaaaatgtctcaaatcaaactttaaagctctgaacatcaatatcttataaacatctaggctatggtcagtgaaaatatggatgacaatgttagaaatctagttattatttagcatattttaatccaaaaattatagcataataaatatgacataataaatatgacatgtatgcaggcgagtgatccaaagctggtgctaacattaacatgctaacagagacaatagcatctagacatatgtttaacaccagagtgaggagaacatacccgcagaacgctctggattcagaggttgtggtgttgatgttgtcgttcccgattgagccgttgccgttccctccattgctattcctgtcgcagttgtcgttgacgtcgttttcgatactgatcgacatgatccggaggttgatgtagaggaagcatatatgacttgatgccgaggaagtagtgctgatgtgaagcagaggaagaagtagagcagtcgcgcgaagaacacgctcccaaaaattttatcgcccacctaaccgtgcatgtactctggtggacggaattctggaggtctactcgtcccaaatacccgtatgcgcaagtactcagaactaggaaacaaccataggagcacataagcagaggaggtgtctacacaagaagaaccaaaaactgaggtagatagaaccgagagagagctctctatctacctagaggtggaagataacgcaagagaaacattactacgttaatctcgattgattgcactataggcctcgtctgttaccggagtaatgaatcatgccggttatgcttttactcataaaaacaaaacggctgaaaacgagcagcccgtccgaacccgccgctttgacgccctggctggcttggcttggctcgagcgcacgcgtgtgacattcccaccaccatctcaaccgctcagtaggtattctctagtagtctatttaagttaagatcatttttcattggtttttaatgtggtattaatctcttaacattaattgtgagcccttgaaattacaagaattaatttgggcctatcccatttaattctaatagataagacggagatacataaataaagaaaaaacaatttatatgtaaaacattttatatgtgtattatcagtttaaaagtcaaggctaaaaactataatatggtgaaaataattcaaaaatcctattgtagaattgtgttttatattaaatatttagttgtgtccgataagtaaggcttagattggatgtgcaaaaattatatgcgtagatttatcttgaatagtacttttatggtgctataaattatatgtagattttaaatagtttgtaataataatatgtggtgaaagttttattttaaataccatggaatgtttattctttcatgaacggatggagcaactggctagataatatttttatataagtatcaaaaaaggagttgaaaaatgtgtggtaaggctcatgctcgtaacttggctagataactgttccaagtgtttgatactttgattgctcctagtattaatctaatacactcctcaccacctgcaaaatacagtcaaaacgctagtgatgatctcctaatggcccgattagtcgtcacaggtcaaccatttggtaccttattatgtaacaagcatagtggcccgcgcagattgcgcggctagcatcattatattttctctcatataatagcatatatgttttctcattatattattcaaatatattaaaatgacaacataattttaaattttgcaataactttacaaaactactaatgtgtaatatttatattatattttatatacgtgttagttattaattatttttaatattaaattttagttatttgtaaattatatatattcctatatggactctagactcgtcttttaatatttctttttttaattccgaattttctgtaaattgtatttttatatagagtctatgctcttcttccaatattatttatttttatttatgaatttttattatttctaattgtatttctatgtggactctaaactcatctttcaatattctttaatttttaatttcgaatttcagttgcttctaaattatattccaatatttgtattcctatattgaccttaaattcttcttccaatgtttttcttaattttgaattttagttatttgtaaattgtatttttatacagactctaaactctacttttaattttattatgtttattccaaattttagttagtttgaaattcctatatggactctatactctacttctaatattccttatttttttaattccgaatttctatttttttttctaaattgtatttctatatatactctatactttacttctaatattccttatttttaattccgaatttatattatttcctaattgtatttctatatgtactctatattctacttctaatattccttatttttaattccgaatttcagttatttcctaattgtatttctatatgaactctatactctacttctaatatttcttttttttaattctgaatttcagttatttcctaattgtatttctatatggactctagtctcctcttctaatattcctttttttcattccgaatttcagttatttcctaattgtatttctatatagacagactctagtctcctcttctaatattcctttttttaattctgaatttcaactatttctaaattgtatttctatatggactctagtctcctcttctaatattccttattttttaattccgaatttcagctatatttaaattgtatttctatatggactctgtcttttctttttctccgattaatgtgagaatttctaggccatgagagcgaacttggaggttcctttttctattcctttaattatatatttaattccaaatttctttctaaattgtatttctatatggactctagtctcctcttctaatatttcttatttttaattccgaatttcagctatttttaaattgtatttctatatggactctgtattttctttttctccgattaatgtgagaatttctaggccatgagagcgaacgtggaggctcctttttctattccttaaattatatatttaattctgaatttctattttttcctaattgtatttctatatggactatatagtctacttctaatattccttatttttaattccgaatttcagttatttcctaattgtatttctatatggagtctatactctacttctaatatttcttatttttaattccgaatttcaggtattttctaattgtatttctatatggactctagtcccctcttctaatattccttattttttaattccgaatttcagctatttgtaaattgtatttctatatggactctagtcccctcttctaatattccttattttttaattccgaatttcagctatttgtaaattgtatttctatatggactctgctttttctttttctctgattaatgtgagaatttctaggccatgagagcgaacgtggaggctcctttttctattccttaaattatatatttaattccgaatttctattttttcctaattgtatttctatatggactctatagtctacttctaatattccttatttttaattccgaatttcagttatttcctaattgtatttttatatggactctagtcccctcttctaatattccttattttttaattccgaatttcagctatttgtaaattgtatttctatatggactctgttttttctttttctccgattaatgtgagaatttctaggccatgagagcgaacgtggaggctcctttttctattcctttaattatataatagatttccagatattcttttacccccaaattccaagtagtaacagagaaagaggggcaaagctagtacaaattacaaaagcaatagcacttgagagaaaaagaaggggagaaaaagtaaacacacatccacccagctagtgcttaaccccattgtgtgtatggattcagtgcagcagctgcaggccaagcaggcagcacagcactacacatacaaggcacacacatcccatgctactagtgctgttgcccttttgctcctgttgtcttctccgctcctgtcgtctcctctcctcccccccaaatccccctcctttttcttggtgctgctgctgctgcacgaagccacgagcgcctcgccacctcgggatcgcctccaagatccgattttgatctccccgccgccgacgaattcgtcgagacccgccctcgccgtacctgcccaacggtgctcgatttggttgtagccttctggttctggtacttggctccatggacctatctttgatcttattatgattcttattacggttttaatcttctatatatatcggttgtggcttgtaattgggggaatagggggatcgtattagaacagtgaaagtttggaaaaattttccatggtttgtgtgtgcttaccaatcaaggaggcagttggaggcaagcctgttgttttcttgattggacactaaaagccggttcttgcttttaactgtgttggagttttattaaggatgttttctgttggtatttaatgaagtcgatttggtattcaacagtaacttaaacactaatcacgatccacttatctaatctcgtgtagaactctgctccccggctctgggaattagttttcccacgagaacaaatatatagttgaaggtagcacgaatggattgggtctaccactaccaccaaacagatgacatgcttgaagttgtatatactagttagcactgtattttctctatccttctgttggtatttttacgtgttgataacaaattcacaatcagcaggattgcaggaatataacaaaacttaagcactgagcagcagtatgccttggacccctttgtactcgacttattacagcagccgaaagtctgttcaccttgctgtgtttttccgtgtgattgtgtatgtctcttgatctcctgaaacctttcatattcatgataatagaatctcataattctcactgaatttttaattttccatgcattgcaggtgaggcggtcacatttacaggagaatccttttcctttgtggttctttgttcttgacgacattgggtgtgtaaaaattgagaatgtatgttaaggttgaacttaagagattccgcattgtgaaggaggtgggaacaatagtaatgaatgttaggatctttgcttattaccagttgatgcaagtgtgccaggtgagatatttatttgttgacctaaagaatcctgtttccaaaatgattcatagctgttgctaaacaaaaaatgagaatcaggtgtcatttttcatggaaacattcttggtactttgtttgggattttcacaataatctcgtatagtgaaaagtaccacccatcaactatctacacctatgtaactgtttgagatctttctattatagcatagctaattaatttagttgggttttggaatgcatattgtataggtgatctggtcatgttctcattgttaacctgtaatcctggaccatgtagtgctattgcagatgaaatttaaaatgatgtggggtttcagtctcttcccttccctgtccctcccccagtgaccctgatattcttgagttatgctagaaagttttgattgatcaatcattatttcttttcatgaaattgaacggtgttatcgataaatgattatttgattaccataaatagatattttgttgttttgtcctcaagactttttacatgatttgctaatgcatacctgaatcaaataatacatatacttatcagttcactttattttttagtataaatttattaagttattcaggcatctttgtataccttattttactatgtgtctcttctgtattttaacaaaatattctaaattgcaggctgagtacttccgtcaattgcttaagcctgtcacgtagtccaaatacaggagtcgagattagtcactttatctgctatttatctttcgtctggtataaagtcgcaacaacaaaagcagtgcattcatgatggctaccttgtggtagggtgtttagtctcttgttgttgcgagtcgcaaacatattgtagaattctcgttgtttttgggtagtgtagctactacatcagatcaggtagaggtctgtacttaagtgcgttctgtccagtatcagccattgactcatgcagagggatccaacagcattcactggaaacccttcctttgcttatggacatgaagcagatggttatatcgcaaatggacccttgggtggtcagtgcaactacagggttcctgtttcacctgcctttggtgccccttcaggcatgaccagtcctcaactccgaacctcactcggtggatttgagtttcagccttccaaggtatgccccagaaacttcatcatctttgatcaaactgatgacaaagggcgcatcatgtgtcatcctgcattggtgagcaagctaaacccttcagccaccaatgctttcccttcctatcccgagccaatttgcagaagttccggccaagataacggaaacctggaagaagtttcctcatctttcaaggaggatacaagagagattgatgcactgctaagctctgatgaagaaagcgatgaagatgatgtcaagagtactgggcgtactccggactgcttcgagagtgattcccttgattcatcttcaccaccaaggtctaggaaaatgcatcattcttctagccagagttcagtcttccatggatccatggacactgttactcatgagaggatgagaaatatggtcacagttcttaggggaataatccctggtggagaccaattggatacagcctctgtcattgaagaagctgttagatacctgaagtttctcaagatggaggcgaagaaacttggcgtggaggtttcggataactagaactggcaactggtacagtggcgatactaaagctcacacataaataaaatctgaaggcatcaatgtgtgtatatatggtctttggtaaggcccttatcatcattgttacttgattgactttgtgtgggtgtggaaggtaaggcaggcagccagcttttgcttctttctgcaggcctcaaaagaggtattgtttgtgggattctgatgcttgatgtctggtagcatggtgttgctgcgctgtgagctttccctccctcatcatggtgtggcactatggttagatcgtcagacgaagttctggatgatgcattatgttttcaggcttacctttgccttttgtgacttaagcacctcagctctacctatcctatggtcagatcaccgtgctttgctctttttcaagctctgcttatatttgttgcactacttaaataatgtacatacttggcttgttaaattgtagtattgtgtaccgaacaagatcatgtcattgtgaactaaattacgatatgaaataatgtactttggatttatcatactatttgtcaagaggaatctgtctcattttatttgctttggaaatgatgatgatgatggttctcaccatcgaattaagcaaagggagatgattgtgatgatggtgtccaagagatagcacgacatttgtgcattcatttattccctgtgcttttttctgaaagctatgaaagcgaatcgggcattggcacaaacgtgcaatcttttgcaaaggccaattatgttgaactaaaggttggtgtttcccatgcttttgccttcagttggcttggctattgaagtggaagaagtttgttcaacattgccatgcagaaaatattcttatagtatatcagtatatgtatgcgtgttgtgtgtatgcatatatagtggcatatgttcagtaatcgaaaaaagaaagatgtgtgttcctaaaatagtggacatagcccctatcaagaaaaaaaagaagtggatatagctttcatatgaatgtcttcttttttcaattttgaactttttgtcgagtaagcgtgcataatattttttttccttaaaatgaggcttgaatttttgttaaggttatttatcatagaaggaagccattgttaccatataccagtggttctaattcaaagttttacaaactgagggatggactattagaaaagagaaaattccttatatatctctaaaatatttagccgatatattccagagttttgctcactcttgtatgcctttcacttttgactttattctttttcataccatttctatcaattaactattagttgaccgtttaatgtgtgaacaagttggttataccattggacatgaaggaacgtggaaatttattggcatccatcgttggaaatatttatggtaatttgttgtgtgactaatattctttaactttgttgtataacggattattatatgtggaaagaatattatgtattaaaaaaatgcatgtgtggcatttttcaatatgtaaacgtaacagttagtttctattcgaaaatatataataagtagaataataaatattgaaatttttttgccattatataaaagataaaaaaaacttgccactaataaaaccctacacaaaaacgcgaatattagggaataacctaatatccaataattagaaaaggtgagacttcaaacccaaatcgactagcgcaagagctgcctgaaggccctagatgtttctcaataaaaccccacacaacaaaatcataaatatagtagtctcatagaacaaactcctgcacacttccaataatatactttacagatttctatattcatttcataactatggacaaatttagccttttcatagctattacctagtcagctaatagacaactggtgaaatgggcataaagtagatcaaaaccaaattcgaggccataaagtgagcgagcaaaactcagaaatatataagagatcttctggaatttaggagccataaaagaaattttctcatcagaaaatgaggtcacaccatgttcttggtttgtacgccctgcttggagttccctgagaaacatgttccctttttcatcacttcctcatctttctttacccatttcatttcggtttattactatatctcacaagggcttaaggtcgctgcaaactcatgattgacgttgacatttgtaatcttgagttggtgtcgggcccagctggcctactcttcagcttcctatagacttctacacgacgagcaagcctaacatcctaattcgttttacagcttacaagcccgtttatcggcccacaagttttgtcacgttgcttactggcttaacctgccacatttaggaaaaagtacaccgaaggtccctcaacttatcatcgggataaaaaacgtcctcgaaccgcaaaacctgatatgcgaggtcccttaactatacaaaaccggtcacccgaggtccttcggcggttttgaccctagttttggtctacgtggcggcggaggcagtgtgggacccacgtgggccccacatttcaggtgtccacgtcacctctctctttcccctttcttttttctcttatttttttacttctcgttccttgctaatcacccgcccgcgcgctcgcccgcctgccaccaccgctgctccgcgcgctcgcacgccgccttcgccggccgccgctcgctcgttcgccgtgaccagcgcgaagctgatgtcaccgccaccgcgtacgcgcggccgcgccaccgtagcgtgttcccctcggccacgcacaccatcaccttctcgcataccaggttctccagacccggcgcccccgccgcggtcgggttcatctgggggtcatccgcgccgtccgccgcgtcggggcacacgaactcccatagccccttctgctccccatgtcgccgccttgccgccgatgggctccttgccccagaaccacgggtggatcatcacgatgccctttaggcggcacgagaggtgttggctggtcaggccgtggcacatgacaaggtgatggtagatgttgtcgctggcgctgtcgcccgcgaggaagacacgggagagggggccgtgcgcagcgagccacgggtcggcgacggagagcacccaggcgagtgctgcggtggagtcctcgtacgcggccgggagcgggtgctccagggtgaggcggtagcaacggagacggtgacggcagggcaggcggcggcaaggtcgttgaggcagcggcgatatccgggcgacgcagccgacccgatcacgaaccccccgccatggaagtagaccaccacggggagtctcttgtctccggcagcgggcggcgggaggtagagccgcacgaaggaggaggcggagaggtgcacgtccctggacaccatcactcttgcagcatgcaatccatatggctcgcgaggaggtgcttggcatggtggtcgagatccaggagcggcacgacgcgcctccacctccagatgtcgacgttgaccgccgcccgccgcctccattgcctctccacccgcggctctgccctcaccaccccacgtatcctcgctcacctcaccgccgccagagtccatgccggtgagctcgcaaaagcaccgccttcttcctttgcaccctcggtcggagcagccgccacagcaccggccatcgcaggcaaccggacctcctctcccgactcgccccaccggcctcctccgcacctgtcggtcgaccgtcggcctgctgagagtccctgacaagaaagtgttggagaggagaaagggagagaagatgggaaagagagagatgacatgaccagtctgacatgtggggcccacgtgggtcccacgttgactcagccgccacgtagactaaaaccggggtcgaaactaccgaaggacctcgggtgaccggttttgtatagttaagggacaccgtatatctagttttgcggttcgaggacgtttttatatcccgataacaaattgagggaccttcggtgtactttttccccacatttatggcctattttcgtatcagaaaagaagttcagaaagggccgcccggtccacattgaagagcatgaacttttaccaagaagaagaagaagaagaaggaggaggaggaggaggaggaggaggaggaaagctgcgtctacaaataggtttcctgtagtcaattagatcaaacattttgtgggtaacatttccctgtaattttctctctctggataaaaacacaccttggtcgctgggacacctttgcttggcgaaatagcagatattgaagaacatgcacctcgtctcgacgttggtagcttcttagcttctctagtccaaagtcaaggggatttaccaagaatttgtaagaacacagtgtgatgtagatggacttaaagcatgaggctgttatgacatgacgccaggatcatgttcgtgttacaatcaggaccatgatatcatccgtccggccacgccacaccatgttacatacagtatgtgtttgttcaaaacccctcaatatttagtagctcccaacatcaataaccaacgtacctttttattaatggagtgaaatacattacacgttacattatattatcatttagatctgtgaatgcaaaatacacatttaaattcattatcttgatttgatcaaagcgtatcgacttgcacctccacgttggcaaatgttttgcgtttggcccccttcacagctaaccatggcagaaaaaataaattcacacccttcctgctacagtttagcttttttccttctccttttcgctcattgttcctttcttttctttctctttttttttgtcttcttccactgtaacaaccgtcgtcgaggtcgtagtgtccactaccacgcactcgagaggaaagggacgctgacgaatggcttaggtcttcgccacctccttcgcaagaagggaataatgcctggtgttgccaaagcgtggacaacagaggcatatggacctggaggccactggagccacgctctaggaatacattcctactccacccgttgactgctttacccagtatctcgaccccattctagcacctccaacacacctgctctatttatttcgccacctcttctattgctcctcgaagtccagctggcaacgtgcttgcatagacccatatggaacgagccaacggcaggtattggtggtgatggggatttactgcatccgcgctgcggcttggcgaatgtttcgtaactaactagtggaggcttaaaaggtgagagaaggggtagtgtacagaagatgctcgataaaatgcgcaaaataactcaagcttggtatcgtgcgtattcaagcaacagtgccagggtgcctccatcgacagcgtggtcttctccttgaccttcggtgccacctcattgtcgcatcatgcctccgcaaccttcaacaccacagtatcccaaggctttacatgtgaaaggagctgcaggaggaggctaatcgccgtcaggattgagctcccccttcaccatcccctttgctccaccattgttgccgtcagggtcaagctccaccatccccataccgctctgctccaccaccaatgtgtgaaggggaagttgctgccggagttccatgacagtggtgagctcggtctaattgcaatgtcagtgtttgctacgcgttgagctctcccgcacctttatgaaggaattagagaaaataaaaggaatatcaaatagaagaaagaagaaaaggaatagggtgaaaaaaaaagaacgcaaaatacatttacttcccattgcactgtagtgggaagggggcaaatgcatttttttctgccacggtgtgttgtggagagggttgaacgtaaaatgcttgccaacatggagcgccatgtcgccaatcatatccggtcaactgagatttagacctattgtgatacattaaactaacataatagacctaaatgtgcattttgtagattcatgaacctaagtgacagcaccgtaacttgaatgaccttagaatatatacttgccttgcttgccttcctatcagtacctccgagagactgacgatagtattgattgaataattatagacaacttactgttgatcaacaacacattgtctaagattgaatgaaacactcgtggcttgctagctcgtttgacctcttgggatttgttgactagcaaagataaagttttaacctgttaagtagataccaaaatgaacgaaagaaagcagcccaaggagaagaaaaagacatctctaaccctaaaactcctctccctattccatggaaacgtctccccactccccagctcccctctcctctcgttgtctcgctctcgcacggctaacgggtattggccaagtcaaggagtcacgacactgccctaggccacagttggctaccccactcccagcctctatctcgccacttactactttccatccccttctccacatatttgccattaacaacaccagatactagcagtgtcacgggctcgcgacaaaagccctagctggacgcctactccgcctcagcctcaccaatcaccagtcactatcatcttcgttggtcgccacccatagaattatagtagcactagtcacttgctagatttgtgggctcatgacaccacccagcccactgccagtagtcagactccacactttaccttgctgtctctagtcgccatcccctacaacacttcactcaatattttattgctcttgctcacaagctaattgacctaaaaaatgagccaagcaagcttagcttgttaggataaacagtcaaaccgaggcagaccaagctaagctggctcgatatctaaccttatcattgtccgtcactaaatagttataaatctgagcatccacatgagtcaaagacttaaactcgagcagacagattagaaatctaatcaacttatagctacaccaagtttgcctctttgcgatcttcatcttaccgagataaaatagtatcctagagttttcactcagtattggaaggttctataaatacccttgagttctatatatattgcctatccaaataaaaacagaaacgcaacagtttgaattataattgctacaacaaagttagtatagtacatatgtgtgtacagtacgtagcaaaatcttgcacacatccttccggtgaaatttaacactgcagtacagaggccaagcaagcaaatccccagttattaattacgggagaaaattttcttgttcgtactaatttccatcgctcgctactgctaccgtccaaagtccaaacacgatacatatacaccgaatctctgaaagggaggtgccacctataaatgtgcaaaaccgttgctatcaaaaggagaaattcgcaaagcggtaactctcaaggagtcgcattctcgaaccacaatatccagcagggtaaatgtttggtaattggtactggtcacttcaagggattctagttaaccacatgtgcttaaatattgttgcagcttccaggaaacatcacgtccgaccacattatcctcaaaagtttggttcgcaagatcttgtcttccccctttttccgttcactgatcctgaaacagagcatgaaagtctacttcaggacctgcaaaaacacggttattcatttttctccctttaataagcacaaacagaaaaccatcttaaccaattatatttatatgtcccgaactgcccaaaacatcgaacagagttatcatggagatatgattattgaaccatatgtgatgaagctttaggctgagttctttctcgattattcgtcggacggactatttgatacattttttgatatatatatatatatatatatatatatatatatatgctaaagataatttgcttccacttaaatgcataggcaacttattttaagctatttgctactttatttcttaaataattaacttatctatataatatattagacaatccgtagcaacaatccgctcaataatctgtgattattcaggaaacagtagcaggtgtgttggcttgatttcttcttttttctaattttcatatggctattggttttactccttccggtccttccggttccatattaattgatattttagacaaggctaagatcaaacttttataactttgaccatcaataactttaaaaatatttagtttaaaggaactagagcaacatatatagatttgtcttttaaagcactataataaaaataaacatgtatttatttattatatatattataataaaaaaataaggtcaaagatatatctggtagactgtgtccattgtttaaaacgtcaattaaaataaaatcagagatagcagttacttttgtaaggtatatcggttatattaaaacctactgggaatttgcgagctgagtgcgcttcggagcggcgtgttcgcacgcggaggcatccacgtcgcccgcgagcgctgggaggcgggtggattccgcgccccctcgagcgtccgcgcgagcggctcccgcgccgtccgatccctcacagcaacggctgagatcgcacgtggttcctagcgtgggtggacatttttcaaaaagacccattcttaatagataatttgttttatatccctcaccgtacgatccaacgttccgatttcttacgtatatactctccaaaactaggaaaatcctatgcgacgaagagaaaaacacgaaataggattgcgctctaaaaaagaaaagtcaaggggcttttctgaaacaacataaatccctacccctttcggcccttcctccccgaaaccctagccgccaccactcccgtgacggtgcgtcgcttccccctcctcgcgccgcctctccccgccacaccgacaccctgcgcagttgcgccgccgctccatcctccagcacctaacctcgccccgacaccgccacatgcttcgccgcatgtcctccacttcctctctcttcttgctgccgatgccgctgggctcgagctagcgagtaggtcgatctggctttcaatcaggttaggtctccgtccttagcaccacctcgtcggcgatttaccttcgccacaatccaagccccacgctgccttcagatctggtggcatctaccttgcagcggccagatctggcgaagagaggaggagcgcatggcggagcgggcctgaagtgtgtagctggcaacgtccccggtgtggtggtggttcactggttcaggtggacaatgcctcgagcttgctagaaatggcgttggcatggagttctccaaggtgaggtggcgaggtatatgtctggcggtgcatggcttgattttcgagtgatgtgggtgctccataagcagtggcaaagctcctatttttttctggccaccagatggaggaggagttgtctcccatcgcctagccgttctctggatgcagcaagccatctcccattagtatctgatttttgccgttctctggatgcagcaagccatcttccattggtatctgattttcgtttgtattccccacaaaaatttgaggtgtttgttttgtgtggtgtcctgcctacaaggtgttcgttgttttccctacaagcatgggaatgtggcaatcttacatgacctgttagtgtgtaagcctgaatggtttgttgggctttagatttggatcctagcttccacttaatttgccctaaacatttgaacctaccttaatgttagcagttaaaatatctaatgaaatgcatcattgaaaatattcatttgtagttagctctgtagatgcatgcatttcatatagataatgattgctgataactgcttcttttgctagaatatttatgtgactacctaaatagctaacaaacttctccaattataatcagtcattgcttgtccctgtgattcataaatctgtatggttcttgtgattcctgattgagttttcaaggaaaatactaacattaggtggggaatactgtgcaaatgattctgtcacagctgaaagacactctaaaaaacctctcatgtatttcacatttgaatgcaccattcaggtgggaaggagattacacattggtgatggcacaaagccacgggcagaacaactctcttgcgtgctcgagaaaaaagccagcggcagaaatgccatctttgttcattttattttcctttttttagttagtttgattagattaaggtgcttaacgagctggatttgctgttaaattttaaatgatttaaacagcgggccatgggttcactatttgctagaggtgttcgcatcgtttaattcttacatgcattccttggggtcctacatctacaatcctggttgcctttctaatttgagataatacaaagcatgtacagcctatatggctctatcggttttctgatcacaaaatttgtctgtatacatctattagttttctgatcacaaaatttttgttacaacattgaaaatgctggtctatctatgattagaaactttgctggttatttctgtgtataactgcaatatgatgttatctatatttgcgatacaattctgcaaattgctgattacagaagttgtcttgcaagagttgaaaaggacatgtttatgtgcttagatgttattctggttgcttgatctggcatcctgtcataatttgtttctaacactatcagaacaaaaggatagaatatatgttgcctaaatgctgtaattttcatggaaagaagcttgatgatattgccacctcatcccacaactatcatgtaagctatattggttgtatagaaaaccaagcatttgagaattttttttattgtcaaagattcaaaagccttgccaacccttggtattgtttgtattttctgtatttggtctatttggtagttaagaaattccctacaagtctgatttgatactttataaattcattctcttgcagtcctggagcattgttctgcttgacgggtggacagggataagtgtggccttttgttctgtagctgaaaaagtggaagctatgtaaggaatgttagctagcatatgatcagagtgatctaaggtttcagtctgttggataggattgtgttggcttaatgtttaagcttttgggtataggtggagatctcttagtagctttcttttaagctggtaacccccaagccttttgtcttctgaaaacatctctatgaaaatatttacagtttgtagttcagtaaagcaattgatcaacatgagtattatattttgatatgcgaatgttgttctcacaaaagaaaagtgttaattttgtcgttctaattctatagttaaaacgactgcaattcatgaattaattggttgtacccaattactacacaaaattgatcttcgatagggcgcacaacgtgcgccaaaatgtctagtactatgtaactattccatggttgtatgcaaagacgagggacggtagcagaagcaccgatgatcaagatgacaatgggaaatccctcgccaaacaatacatccccgtcgccgccaactacagtgatggggaacttttttgttatccccgcctccacacggaaaattaatcaccgcagatcgcccatccccatttttaaaatcatttacatatcaatagcatattcttttaacatgaaaagtgtccgtccactgatcatgttacgattaaacctttggacatacataatttgcattggatttagacccttatacccgctaatcaggtcttcacagggaacggggacgacgagggacaaaggatcatccccaccgtacccctcgccacacccaacagggacaacccctagacccgacggggacatatttccaccattccgtgttctctaataagagaattccctacagaaaaaagggaagagagccccatttcgatacctatataccgacggtagtgtgatgaagttatatgggtataactatattcaccggggctcaaattctgatacctaccgatattacatacatacacatatacacacacgtaggtatactttcaatgggatcttagtgagctcggcgatttgccggccatttacatctatctatttgagctcgtgttagggagacacgttcgtaaatatgtaagtatggtatgtatgttatcttttacgtaataaaaaaagtccaatgaaggataaaagaaaagtaaatatattactagtcgtaaaaagtaattatcattcaaagatctgtaaaattatatacatatgtgcgcatgtgacaagctgcctttttttttgaatgtttcattactcagccacttcttataagagtgaggatatgacaattttggaatcaaaattagcttggttaataatttaaaatactgccaaagcagtgtaaaacctggcctcttaaccaattcatgtgaagtgaattagaggtctataagtgttacgtacttgctttgcaggagaaatatacaagtaaaacacaagaacttgctatagccaactgtcctttcagtctttcaccatgaaaatgagtgttcacccaatcacccatatattctctagtacatgtcattagttttttatatcttcagagggatcttcacggacacttaatgatgcggtgaggccactaatcttcaattagaagatccagtcatccaatgcatgcatgcttaatgcattccaagctaggtaagttctagcattcataccccgagccgcacgcaaatgtaagtaatataagacatctctaacccagaaactatcaaatagtttctatagttgtcatatcgatcgtataaacactatatatagagactatatatccaatgaattatatcttcaaaattaaattatcatcctatcacaactcttctctatccttttatctatatatccccttattttctttcttgcttcttgtgtagagatggttttcttacctgagaaatgttttcttcatctttttacctctttcctcattatttttcttgtcacatcagattttttttacttatgtggcaatgtattaaatgttatggacactagatgacatagggttgatgatggtctaatatgttgtcttatgatagaaaattaatgtgtcatttggtgtcaaaacaaaagtttcaattaaaatatttataattctaggacaatctatctatctattaacttattaaggtaatagaaaaaagcgcttccaaattcactctcatgacctaaaatttcttatagtaatcagaaaaaaaaggaaaaaaatagagtccatataaaatataatttaaaaatagattaaatttgggattttaaaaataatactcaatttattccaaaatataaggcacaaccacccttaactcaaagaccacgaaataattattatcatcttgtagtttggatcatcctcataaatataatgcatgcatccaatagaattagagataacataagagtggaggattttaaaaggttataatttaatgaagaagatgtcatagttaattgcatgcttgcttccatgccttatattatggaacatctaagaaaagtggttatgccttatattatggaatggagggagtaaaatattgaaagaggagactagagtccatacatatatacaattatagagctaattgaaatttggaatttaaaaaaaaaatagaaaattaaaactagatgttagagtccatacataagtacaaaatacctaaaattcgaaattaaaaaaataaagaatattggaaaaaaattatatagtccagaataaaatttagaaataactgaaattttgaattaaaaatatggatgatggaaagaagagtgttgaaattcggaattagaaaataagaaaattaaaagtagattttagagtagacaggagttttacgtgataataatagagataacatataagatagctaggtaacaaaactcagatttgacaattttcgtcctagagtctgcagtcaaaagcttaagttatagaggtgcatttgacaatttccgtccaacgaccaagtatcacaattcgatggctgactaaaaccgcgcgcgcttcctccacgaatcacgaccagcagtaatttctattgcagtaggccaccgtaccatgcacagcacatgtaggaattatagcgttttacttccacatatgcatgagacagactctcctctcagttcttggagaatcctcccacagtggctgcacgatcagaagatccaacttttctagaaaacgcccaaaattgcgtgcaaatggctacttgcaaccttttgttggtcctaggaagaacgtccttcttggtgcatgcgtgacaaaatgattgattgatttgttcacgcccacgtactggccgtagctactagagtagcagctagctagccgcggacctcccttttcacgaactaatttccttgtccttagagtcggcaagaaatcgatcagatcatccacactagctgggcggtaatgagaatctcatcgatcgcacgttcagccagcaccaaggccttgtaggttgtagccactcaagttaattagctgaaacggagcagagtcaaaatttgactctctggctcgtgtagcttttgataaggaggttttactttctaattccaagccttgatcatcagttcatcacaaccataaaatgagtgaacgcttatatggctgctatttatggtatactaatgaaagataagcccttctgcgtgtgcccgcagtgttatgttgtgtaaccgaattgctttcttctaattgaatgatgtgcaattgttctgtgtgttcgaaaaaaataatcaaaggtaatggcagaaggaagacggaacaataacaccacatatgaacatctaatagtgtgccgcctaaaaaatataatttacacggaaggccatctaagatacgtccccatgtaaatatagatatttttctagtcggcacttcaatgaaaccgtctgcgtgcgggtggctgcttaaggtagccgctcgggtaaattgaaacaatcttcacgtgcggcggttgtcagtggtcacccgcgtttttatgtttacacgaatggctctctgaccctttgacacaagagatatcatcattcgtaaccataaaacatgcattttgtattttcatccacttgggaaattaatcgtgagggacctgcaaaaacttttttttgaagtagtgggagctagcacactggtgttgagaggtgtcctaggagaaactggagctcgagctagtaacaatcaacaagcctatgttagatatgaatataatcaaaactgaattacggaataatcaaaaccgaattgaaagtcgattatatggagatttgagatagatatatatttgcaaacatcgaaaaaggcaagatactaaagcactttcaatatctaagaacctgaaagatgaagctatccctgaagtgacctgaaagatgaacatgaaagacgaattacctccttgacaaataaaaaatagaggggtccacttgttagttctatctcttctttcggtcaccatatggcagttcaatcagcactaaaaaaagtacaaaaaggtagagcccacatgtggtgattgagagaagaggcagaactaacaagtgggcccccactattttttattttgttgactaccacgtgtgtgctacatagaatcaaaaccgttctggattcggtcaaggggtaattcgtccggtatgaaaagttaagagtgaagaatatctatttttaaattgagggggataatacgtactgttacaatagtttgagaggtagagagaggggtaattcagatttgtttttttcccttaattaatctctacatttaatttgtgacttgtcattcctggatcaagttctagagttacaatgttccatgaagatattataggcttaagggaaaattaacatgtactcccttcgtcccaaaatatagtaacctaggatgggatgaaatctatcctaggacaacgaatctggatatgtcttatcccattctaggttgttatatttttaggacggagagagcaacaaggtatttgtacttctatatcttgtattgcactttattatgtattagtgtgccactatcgaggagtttgaggataacaactggacttgaccagggcttgagaaaatactaggtccgttaacgcagacatacacaaaggctgatagctacttaaggccatttacaacccaataactaggatggtgtccataacattaaataagctgccacctaggatgaaaaatgatgtggcaagtgaataaatgaggaaagagaaggaaactatatcttgcatgagacatgacttctacacaatatccaaaacatcatgtgagataagtagcattaaatttaaatataggataattatgtttacattggaagagtagtgtctagtaggagtagtagtttcttaatgatgtggagtttatgaaaactatgtctagtgtcttgggttgagaatggccttagtgatcctgtccttgctatatattataggattggcaataattaacagccattctttttcctctcttcttcttttagatattttctttttttatttcaagaacgttagttgagctagcatgcgtcctttttttaaaaaaaaataatcaagatcttctctcttgcatgctgtccttaattaagagaagaaaataattgagcatatgaattgacttgttagttttaatttacttgattctccaaagctacctaccaattctatttctacacctgaccgtcaacagtattgatagtcgtcagcaactaactactaatttgccccatatatatatatttatatatatgcttgcacgagggataaccggaaaagaagagtttggtcaaatatgacggcagagggaataaaaatgatggcactagactgtcaaaactaaggaattattcagctatatcgagaggaaaccgagacatgctcgtatctgcaatccgtttaaaaggtgcaacttttgcgtggcaaagatacaaaatacatgtgtgtgctgaaggagatcgagcctttttatcattccatgcatgcatgcgtgaaaggattagaaaatacaccatctgtgcactcccaaagcatgtcgtgagggcaagtattttgcacgtctccttcacattttgtgcagataaaatttcgtaaataaacttataatcaaagtggattcactcataaagagaaaacgtatgcacgctagtaaagactaatcttgaagaagtatttatgcttgccctccgtcctgtaactgaaaacttactggtactccggcacttgcaatattaattaatactagtatatatgcggatttatcgtgtacatctaaaaacttgcggtcacaaccatatccatcagaccaccgtacgtacacatatattatctcagttttataatatatgatgtcgttcatttttttaactaacatttaatcattaatcgttttaatcaaaatttttgtgtaaatataaaaaaattaagtcatacatacgtaaagaatttttaacgataaatcaagtcaaagtaaaataaataatagttatatattttttaataagataaatgatcaagcatacgttaaaaaaattcaacggcaccatatcttagaaaaacgaagggggtacatcttggggaattaatatatcgatcatgatcattcatagaacatataaggccagataaaacatcagattcaacacatgttttgattagataccatacaagaatgtgaaaaaagaagaaataataaatgtgttatgttgaactgaataacaaatagctagcgatagacatagatctaacgcaaaaccggcctgctgcaggtactagctagctaatcgaatatgagaacaacagtattaattatcatttacttattcttgtgtcaaaatcccaatattacggccatctgctaccaaacaaaacaagcaaaccatgcatcatgataaggctatcttatggacactaccacaagaaaccggccagttcagtgtatcaatgtccaaagcaatcagaactctctcttttgcaccgtcattgtgtattaattccagatttatacatatatgtaggcacaaaagaaactacacacccgtcattaatttgtacaatctaacaaccaaaagcgggtcgatcatgtataataagttggcatcttctttgattgtcaaaagcgaaaatgtgagacgaaatattaattaatttgctctctccgaaaatgagtcaatgaggtacacatgatatacactagtacatgcatgtacaataagtctagaggtgcagaacagtaaagggctatgctgaagaatcaagtggaatgcagccgttctacgtt

SEQ ID NO: 57805 - DNA, 649 bp, Oryza sativa
ttctcgcgaaccttccacacacagactaggagcttagaatctcacccagggcccccggccgaaccggcaaaggggggcctgcgcggtctcccggtgaggagccccacgctccgtcatctggcgcgccaggtagggggctttgcgtgtgtttttctaagctctcgcattctttcgtgtgcgccaagcttttcctgttcagcccaatggccgaacaagcaaaggcgcacatcctctctccgagtggtagcggtgacgacggggagccgaacccacgccgtcgagctcgtactccaccgccccctccacgccaaagtcctaggcgggaggagacgctcgagagggtcgaaggatccgcgacttcgacatccacgggtgatggggaagggcggcgagatggggagcgtcgcctcctcgtctacggcgacggcagcacgccccagggcgcgctccaagctacgggcgcgctcctacgtcacccgcccattgtccctgacccggagtctccagcccaacgttggctggacgacgtggccaacttggtcatgacggcacggcagcgcctaggtgctggtgggcggtcctccgccaccaagacctctggcgctgctaccaccggcttcgtgtcgtcaaggcggaaggcgcggcgagc

SEQ ID NO: 57806 - DNA, 7214 bp, Oryza sativa
aaaagagttgctacgtgtttaatgcaaggagtcaagtgctataactaattaaagccaaaatggaataggttttgtgtatcttggttatgcagaagtcgagagtattctcagtcagtggtatcacttttatataattagctaagttcaataaagcttccattatatgttaaagaaattggaatatgtcaatgactacagaaaaaaccacttagtttaaaaatccgagcaatagtcgtgtactattaatagccacaaacagcacattctactatattaattagctgagactatctagtcagaattcttgtcacgcaattgcttggataactctccttaatagttttagttttattggtatcaatcctttctgctgcataatttggagaagaatatcaggttcatctgctactgttcgcaagttcatttgtactggttcatctcctaagtaaccaactttgtttgatttgtactaggtatggctcattcgaagtcggatggcacgagcttttggtggcacgcaaaatgccagtaatatatgaataattaactgttataaacttacaaatgaatttgtttaattttagaaaagaaaaactttatatataaagctattacaagacgtatcgtgtaatagtttgggatacgcgctagggagaagaggagagtagagccaagctcatataaaggactagatctgtatggtggcaagcatacataatattaatcaccgcttcgagccggccggcaacatcagctagacgccagacacgagcacgggcacacgaagtgtggggcggagcgggaggtcggccttccggcgggcggtgataccaaatccctcagtcatgtcaaactcagcggggtcggccacgtcgggcgcctcccagtcgaagtggaatagcaggctagcgagcgcgagctccacgttggcgagcccgaacgccatcccggggcacatccgccggccaccgccgaacggcaggagctcgaagtcggcgcccttgaagtccaccgcggcggccgcctcgccgtcgccgaaccgctccggccggaactcctccggcgagccgccgggccagtaccgctcgtcgcggccgatcgcccaggcgttcaccagcacctgcgcgccgcgcggcacgtcgtagccgagcacccggcacggctcccggcactcgcgcgggagcagcagcggcagcggcgggtgcagccggagcgtctccctgacgacgaggcgaaggtacgggagctcgccgacggcgagcgcgctctctgacacggcgccggccgcctcgaagtcacggcgaacctcggccgtcgccttcttcatcgccgccgggttccggattagctccgcgaacgcccaccccagcgtcgtcgccgacgtctcgcagcctccgctgatgacatcctgcgtgtgtttcatcgtttttttttatgatatgaagctgcgtgatcgagcattcgagctggccatcatggcagagaaaaaagaacagcttggaaagacaccatgaaaccattgttcataagaaatgctgctagtcactcacaacgacgacgcatttgacggcgtccatgtcgagagggaactccagcccgccctccttatgtatcctcagtagcacgtctagaatgtcttcgccggcgccgccagtctcctccaggtgcgcctggatgatgccgtcgaggacgccgaacatcgtgtcacgacacctctcggcttggcgcacggcgccgctgagacggccggcgagacgcgacgacggccacaggtccgccacgttgagcccagcagcgagctcgatggcgcggtcgagctggcgaagaaacacgtcgaggcccgcgcaccgctcgcccaccacggcgcgcacggtgggagtcggccacgagcgcgcacagcgccgcccgcagctccacggtccgcccgtccgccgcggccgcggcgaccgcgcgcagcgtggcggcgacttcctcctcgcggatggggcgaaaggacaggacgcgtcgcgccgagaggagctccgtgacggcgatcttcctcagctggcgccagtagtccccgtacggcgcgaaggctatgtccctgcctcctttggtgaccgcgcgcacgttggcgctcagcggccgcgacgcgaacgccgcgtcgtgcgtccgcatcacctcccgcgccgcgtcccgcgacgacaccaccagcgtgggcacctctccaagccgtagcatcatgaccggcccgtggcggcgcgccaggtcgcgcatcgcggggtgcgggagcttgccggcgaggtggtgcaggctgccgatgaccggcagctgccatggccccggcggcaaccgcagcccggcgtcgccatgtgccgccgccgccgatcgcctgcgcctggcgaacagcacgacgagcaacgacacgagagctaagccgaggtagaagtaaccatctgccattgctgtgtcgcgcaggcaggatgctggggcgctcggctagtgtttgccagtgttggtgcgtacaaaatgtagtggaggagacggctcgtggatgaaggggatttggttcttaatctgtagtgatgtcgttttcagtatggagctccataatccggatgcgacgaaaatgcagttaatcttcgtgaggacaaatgaatgttatcttgtttatttctggtcatttataacgttaatcgtaaaatgagtataaattaaccggctaggtttctggaatctatttatccggatttaaattcttaagtgggcataagcacttgtctttatgactaattattatttcattaatagacaatgtgcctctcgatagcaagccgtcatatcacaacttcctgaatattaagatgtgtcggcccacctaatttgaaaatcaaatttaatgaagagagtactaaatattaaagtttaattgcatacctaatgccatttatagtgcgcgtgcttgacgttcggccccgaccatccacatcggggattccatgccacgcacacatctgcgctcccaacctgaagaccgtggaaccaaacaaagccaccggttcttcatcaaaatttggatagacatttgtcaaggcggaatgaggcacagggcgagcagcgtgttgggtgaggtgtggccccgtgcgacgcctccacacctcgtgcaaggcggcggaggtcgccagcgaggccaccatcacgagctgcgtcgtcgccaaagcggagctcgctaaatcctgtgaacccgaggtcggatctgcttagtggggtggtggtcgagtgaggagaagggaggatggttgcgacagaggaaaaggaggtggcaaactaaccttgttttcgttcccgttcagcgccgccaagctcgtcgtcgtccccgctccgaaccacctcggtctgcatcagcagcagcttgacggagagggagaggagctcgtcagtatccggccaagggaggaaagccaccagttggagtaggacatgagtgggggtctttgaagagctcccgccgtcccttgctcccacgctgccgatctcgccgtctcccgcagtccacgccgcccaagggaatagggccgccagttggggaaggaggatatataggaggggtggtgtgccggtggcgactgtatggtgaggagcgtgggtcgccgttgggggatgggaacgggagaggcgtcggtggcactggaagggcaacggggaaagtgaggaaggagggattttatatatgtttccgattttgagggtgttttgtgtaaaatttgaagtattctctaaattgacaaactacgagaactttaatgtaaaatgttaggggctgatatgaaaagttaaagccacaggtataactcctttgcattgtgggataaagagagagttgagacccgttgccccatgctacacgaggtttctcgtaacaaagtgatgcactgtggaataaagagagagttgagacccattaccccatcctacatgatgcttctcataataaagtggttctctgtgaatggctcgatagaattactgccaacatgccttaggtttcacgatgtttctagctccatcataagatccatataagcagtgagatatatattatgtggggattcttcgcaatcattactatactacaaaaattagcgtgtctattgacgcgttgtccctttagcatatatagatcatttctttattttccatttacccttctgcgaagatcgcacatttaaaaggataatttagtgggagtatcgcgtgttaatgacctgtaggtttttaacagagtgaaacaattgaggctaaagttagaacaaaccgataaattttgataaaaacaactacacttttcatttcaattatatttatttgtgctgctaaaattctagtatgtgtctgaacctgaaattgattatctttttctttcttccttcctgtttgtgctgtctcctaggccaattggatcgtttagcacttcaaagtgccaccaggcccatgcagacccagctgcccaagctgctgctcgtgcggtcgtgcccaagcaagccgtaggtcacgcagtgtgtgtgtgggtgcggctttcctgttcctacttccgtattcccgtcccttttcctgctacgtggcctactcctattcgcttcttgtttgcctggtggccccaccctttttcttcccaaatcaaaacagaaacgtataattttttcagccttcattactccattggtatattggattagttccgcttggacacttccacctccaatgatgccccgtagccgcaggtgatttcctcttggcagtttcttcgctaatcggatgtgtggcgcatctcaatagctttgattatgtctgcaagtttcaagatgtgctcaggtaacaccaaaaactgttactcgggtgcttcctatcatccatggatgaacatggagacaaaggtttttggaagttttgtccttttatgaatgtgtagcagttaatctgctaggagttcatttcaattttcatcggtggaagcctgtaagagagtacatactcacagagtcgcagacttgcacggttgcaccagaatgtatgaaaaaaataagaaacaaagaaaaggatggaaagaggcatcgccctagttgaaattgttatcaattaatgatcttctataacagtattgattttgttcttgcctcaagctagctaaggtttccgttttgtccctttgataccacacatgccattgatgcaaaagcacagtaatttgttcaggatggtttagggcaggcaacactagcaaggaagaatccaagaggacctctccaggtgatgagcatgcacccgataaccagcaaatcagcaaaagttgttcagacctgaacgatgtgaggatcagtctggaccctgtagggagagtgttggagactcgatttttgtttttccgatggatgggaaggaagtagggccaccggtgaaacaaaagcaaatggatgtacgccatgtagcggaaacagggacgggaatacggaagtagtaagtacaggaaagccgcatctgggggaggggggtgccacctatgtttccggatacggttttggactttttcttttcctggtaacttgaatttatcttagaaatccagcctattttcatactggcggacttgaaagcttctaaggaatcccttgaagtcttggacaaacagagaagagaagatagttcttgtgggcgggaaacgaaaccatcacaggagggaagtgcaaggtgaattggacgtggactttcctctctactgcctcgggaggtcttggcatcctgagtctcgaaaaattcgcaagggcccttcgattgcgatggctctggcatgaatggaagtcaccggaaaaggcttgggcgtggggtcagaaacaccttgtgataaaactgacaagctattgtttgaaacagcaactacaaaacaaattggagatggagcgaaagtgaagttctgggagttggcttggctccgggcaaagattgaaggatgtcacaccactagtccacgcggcctctaggaaaaagagcaggaccctcaaacatgctgctttggtagatcaatggctagagtcgaccttgctcttccaacaaacgaaggatggacaacggatctgattgaccagctcatcaccatttggagcgccgttcagaatgtacacttcacggaacatgaagaccagatcacctggaagctaaacaaccatggcgaatacacggccaccacagcttataaggtgcagctcctgggtacaacatcgtcaaatttcgacaccctaatatggaggccttggatgccgcacaagtgcaagtcctttgcctagctgatactccaatacagagagtggacatcagacagactagccaccagaggctggcccaacggatccacatgccctttatgtcgccagactcaagagacggctttgcacctgctagcggaatatagatacataaggagaatctggaatgaaatcgcgcagtggacaggcaacgaccatttaagaccttctagttggcaagtaactttgacagtatgagtggtgggaggcccccgtaagcatacgggaagcacacgctaaccttgcttgtgaaccggagatatggaatgaaaggaaccgaaggactttccagcacaaggagttgccagcgccaactctgctagccaagataaaggaggaagcaaaaacgtaggggctggcgggcgcaaaaaatctcatcgcctggttgacaatgtaattgccagtagttaggaccgtggccctggtttgtttcctgtacattctccctttttatacagtttcttctctattcaataaaattggtggcctagtcgattcgttcaaaaaaaaaattatcttacaaatcgaggtgccacatgaaccaatcagatgttgacataacagcattagaagtattggttgatggattgattggttgattaataagccctgggacgttgtacgtatttatcttttgtttcaggacgcacatgtcagtttctacagccattacagaagcagtattggtatactactttcttcaatgcagttgtgtgtttctgtgtacaacgtttaaccactgtcttatttgaaaaatatataaaaaaataaaaaatagtcacacataaagtattattcatgttttatcatctaataacaataaaaatactaatcgtaaatttttttcaaataaatcagatggtcaattgttggatataa

SEQ ID NO: 57807 - DNA, 3817 bp, Oryza sativa
  unsure (1)..(3817): unsure at all n locations
tacaaaaccagtgcaaactaggtccctcggcggttttgagtccggcttttgtctgatgtggcaattgactcatcatagaacccacgtgggccccacgcgtcagcctcttttcaaccccccctctgcacctttcttcctctccttcttcacgggcgccggcggccggagcatttgcacgggcggcagctagcgggcgcagccggcagggggagaagccacgcacggtcgccggccggtggtcggtgaagtggcgcacggccggacgacggagcggctctcgancggcggcgnaaggcgnaacancggagcggcgctcgggcggagacaaggcagaaggnaaggctgncgccagcgggagcacgggggagatcgaagttcgaagaggacgacctcaagcacggcagcgagtagagtggggtgacggcgaggcggagcggatcggcggtgacaggagcaactcacctagggcgccgtcagcttcgcaagggtagcacgacgacagacgcacgaagggagatgggaatccaacgaaggatgtcggggtcgtcggcggcggcggcggtgacccaaacgggaagcatggggacggcgccgctgagggagccgtggaagtggagcgtgacatgaaggcagctgctgccaccgcctccgcagtcggtgtcgtcgcccatgcagcggttgccgcttcaccgtcctcccgcgcgccacttcgccacctgagcgccgctctgtcgttcgcccactgcccacgcatggcttctccccccccccccccccccgcgagcgccgtgaagaggagagaggaagagaggtggagaggggaggggaagagaggctgacgtgtagggcctacgtgggtcctacgctgagtcggctgccacatcagataaaaccagagtcaaaaccgtcgagggatctattttgcactggtttcataagttgaaggatgccggatatctcgtattgtggttgggggatgattttgtaactcgatgacaagttgagggaccttcggagtactttttcctttttttttctgtccagattgatacatcgcccaacgcggcagtggggctgggctcgattcaaccaagtatggttatgaaggttatgtttggtgtatgggccattttggtttggtgccaattattgccctaccaattctttaatagttttgaatagtgcatattagcattttggattgaagccaatttttgccacatcaaaagagtggagtcaaatctattctatcaaaaatttggtggtaccaaaatttgcccaaggtttggtactaccagtattttggtagtgtttcaaaccaaacaagccctaactctatctctactattataaaaattgaagatgtttctgcggtccgtcatccgtatttgagtcggttataaaaattgaagatgtttccgcggttcgtcatccgtgtttgagtgggttataaaaattgaagacgtttttgccggtattttggtacgtcatccttgtatgtgtcagtttttaagttcgtttgcttttggaaatatatatttgtatttgagtcagtttttaagatcgttcacctttgataatacataaggaatcatataagaaatctgtttaatatatatatatatatatatatatatatatatatatatatatatatatatatatatatatatccaagcgaactcacacagtaaatttcatcttaactaaacaatatctctactacttaaaaaatacgaggtgcttccatcgtccgtaaaaaaaccgtgggagaaaaaaaccgtgcgaaaaaaatcgggcgaaaaaaaaactatgtccaataaaaaaaggacaaaacaaaaaaaaatccgcggacgaaaaaaaccaaagtccgataaaagggcgaaagaagggaaaaaccggaaaaaaagaaaaaaaaagtccgatccaaaaaaaagtaggggcgaaataaaggaaaaaaaagaaactaatctgactcggtctacacggtaaaaaagggcgaaaaaaggaaaaaaaattaaacaaatccgactctgtcgacacggtaaaaaaaaagggccaaaaagaaaaaagtatatgtccgataccaaagaaaatcgaatcctattatatgtgacatggcgtggtaaaaaaaatcgaatccgattccatcgacgcggtaaaaaacaagcgtaaaatttttttctgtgcgattccaaaaaaaaagttgcgaaaaaagttttccgtttctctttctctatctctatctctactacttaaaaattaaaaagtgtttctgttgtccatccgtgaaaaaaagcgtgaaaaagaaatcagcgaaaaaaatcgaatctaattatatgtgatgcggtaaaaaaattaaagacgtttctgacatccgtagtaacgaaaaaagggcgaaaaaaatgaaaaaaaaggaaagtccgattcaatatctatgtatacctaattaaaaaaatttgtatggcttgtgggttatagaaattccatcacacgtgcgatcgatcccgctttaatccctctccgatggcaaaaaaataaaaaaagaaaagaaaaaaaaaatgagagactgcatcaaatttggacctaaattctaaagaaaacactactacaagaatacaagatcagattcaagaacaccaagaaaacgccgacgccggaaggggagggtgtcgccatcgctgctgaaccgccaccgccgtcgtagggatgtcggtatgtcaggctgccgccacattgttttgagagagaggggggaggggaaatgattttagggttagggtttgggctgttgaacttttatataggtcgggatgaccgtctatcagatcggacggctctggcttctcccgcgtcaggccgaacgccattcccaggccgcccacacggaataagttcactttaggttgtttaagttgttcctccccgattctattcccaggccacccacactattgggccgcctcatggaccatgtgtactctccgtatggaacaagttcactttaggtcactttagctgaacttttttatttcattataaatatattttcttaaagagctcatatcatgtaaaactaaaccttaatcatataatatttttatatttgttataattttaattacccatcacaacgcacaggcattttttctatgttaaaaaaaagaccacgacatacgagtgagagatatataccacacacacccgcaggctcatctttaactgaactagcaacagattttcaattacaggtctaattgttttatttaggtgattaaatttgttttcatttatataattagtttgctctatttaagctttttgaaaattgctaaaatttgagaataactttcctacttcgtattatattatttttagctaatggaattaatggaaaattaattatatatttttatctttttgaccaaaggtcactgcaattttatttcattaataataatattattattatgattcctttattttttttcccatcagtatacatgattaaaattacctttacccgttgcaacacacgggcatcattgctagtaacaataataagattaaaatagacttcacatgttgtaacacacgagtattttttttttagtattatcaaaatcagactaccaaactttagttcaaaacacacctattataattatatgtaagtttgacttttcttagtaataaaatattttgaacacaaaataaacatgttatcaatatatatacaatgttagatatagataattttttatataaaattaatcaaacttagagagatttaactaagaaaaatcaaagcgatata

SEQ ID NO: 57808 - DNA, 1037 bp, Oryza sativa
ttaaggtgggatctaaacaaggccttatacagtacatacgagggttgcaagatgacttgtgttttggactctactagtagctcttgttctctactactccctccgtcccataatataagggattttgactttttgcttgtactgtttgaccactcgtcttattcaaaaaattttgaaattattatttattttatttgtgacttactttattatccaaagtagtttaaacacaactttcggattattatttattcaaagtactttaataattctaaattttttttgaataagatgagtggtcaaacagtgcaagaaaaagtcaaaatcggagtacttgcaagagagtgggtaagaaaaccctcaaaagcactaatctagaattatgtgatacgcactggagtacacgtctgtacaaatgtgttggttttgcagcatgtgagcactctgcaactcatgtggtttcgatggctgggaatgggatcacgtgatgtgactcagtgttgcctcctcttcctctctctgattgatggtcgatccttgttgaaatgtcacactactgtatttaaaatgacaggcagatcaccaccggtatcactgtgctcagagagaacgattgttgggttcaaaaatttttaaatatcctcctacagatcaccatcagtatcactatgcccaaagagaacgattgctgggtttaaacatcctcctacatttggcatccatcagtatcactcactcaattgttcgttcggtctgccccaattacaagcctaacacaggcaatgtacctaggagaactgtacaacacgagttccctacgattcctttttaacaggaaatgggatcggcagatcaccaattgatgatacagagagatacatgatgctgtcgacatcagaaaaatgacagcataaagctcatcggtagatcttccggcatgcacgtccaagcacattactatagtctctctgccagctacgtactaccgtctaaccatatctaccatttgggcaaaatgcaggcacaaaagccacaga

SEQ ID NO: 57809 - DNA, 10937 bp, Oryza sativa
caaaatagcctaggggttatggaatgggttttgtcagtaatctacgtttaatactcttaaatatcaagatttcggaggactatttaatagccctccgaatcttaaacagggccatagtctaggggacttgcctcagcaccggcacaaaaccctcatccagcctgatggtcgatcgcggctttcgacttgttacaacggacgtggactctagcaaccctagttccaccactacaagggaagtgtgtaagggtagcagaaattgtgggaacaagcggagttaaccacacgatggcagtggcaatcgaagctcatcaacttaggaccagcgtggtgatgatgagctcaagggagaacgccaaatccaataggaggaagaaggctatattggtacaactgtgtattttttaatgatgttttaacctttacaacctggtgttacatgtgcgagaagcagaatatttgaactgaaatttgtcttagttttatacctaagttcttttgttttagaaatctttttcgatgtttcggtcagtggaaccggtccaatgttttacgttgcatggaacaaagttgtttatttcttcttcttttttcccttcctaatgttgcactcacttcttcagatgtttcgtccaacgtccatctatatataaatataatgttggtttgttgcacgcttgtttctcatagtaactattttcaaatgtttcaaatattggtttttttgtttcacaatttacagtttgttctttcacgtataactgaaacattcaagcgcctgatgcctagtcttgtaatcaaaataagtaagtactatgcagggatgcagccacctgcagatcccaaatcggctccgagctgccgctgcggcggattcgcaccgcgcgagccaagttgcgcagcggcaacaccagttcaattgccaacacgcactagctagtggtcgatctgccgcacccctagccagatacggatcgtgcgcttgcatgcgtgcaggaacggcttgtcccttactgctgaccagctgccttgctactaacctccccgtaagggcacccgcaatggttatctataggctctctacaagagatccatgtcaacatattttcctacttggaacagattaaatgaagaaagagagtaaagctatctactaatctggagatagtctatagagaaaaacgaggcaatagatgagagagctatagatacctatgtagacatactattgaggtggtttactattaatctagtctattgctgagatgtatatattttatagagagcaacttactttaccattgtgggtgatctaatagtaatgacgttctatgtatcgggcgcagcttagatcgacaggtggtcttgtgtagcgtatatcctgaaaacaataaaattgacaatgtataagcagagcattagggcattgccgctttaattggtgatcctaaacggccaaaccgctccttttcaactctgtagagggagtgcttgcgatggtccagatgatcaagttcttggaagccagaagtatatgcatattctagctagcactaaacaactgcagcgccgttgcaccacacgttcgtcgcaaagttggattccaatacgccatgctatgccaagattctcttattacactatgggtaacgtagttccataaaaattgctagctaaaatattttatgtggtttaacgctagtcaataataaatggaagttggggatttgtcccatcaccttatttctcattttgatttatttttaccttacatttttattactattaaacttatggctgtatgtcttatgacagaagccggatatgtaatctatttccattatctaccaaaatacgccatgctatgccaatgaagcagtagtagtccgcgcgaggttactggttgtagccgaaatgattaggcgggcgtctaaagtgcgctgccagaagcactgccaatgagcgtgatggaactttcagcgtcaacttggcatggcttttacgtctgcacgccctcatttcgcacaagtcttgctccgcctttattcgatcctggctcgatgatggatcgacctcccaataatgcgcacgttctcaccacattctctctcgagagcagattgtggacaattaagtccactttgactcccttaaaagtgatccgaatttaatccatgaccctaaatcgtaaaaccgggtatgtcgactcccgaactattgaaaccggtgtaatttgactcccttggtggttttggagggcagttttggtgacgtggtggtgttgacctggtctatagggttgacgtggcgtttaggtggcatttgaattaaaaacacatatgtgggaccacatgtcatcatctctctctttattcttcctcccctcttcctcgcttctctctttctttctctttctctcccctttggccagccgcggggactggagcacggctggagcggcgggggctagagtggtggcggtcggcggaagctgaagcagcaacggcaggctggagctgacggcgggttctagagcggctacgggcagcttgatgaccggcaaggaggcgggagaggatagcagcgccgacgccgacgccgatgacatcgagcggggggacggcggtcgacggcacggcacctaagcgccctaaccccagtcctcacctccaccggcacggcgccctcaccggggaacgagctccctgctccctccgctgcctcctgccgtccgtaataacaagatccggcactctggcctctcagccgattgcaacaacatgatccgggcatccagcatatgcgacaagctgacgacacggccgacatcgagcctgtcaaactggttaggggcgagggccgccatcgagctacgccattcagcattgcaacgacgacgtcgtcaagtcattgctcgagctcgctgcgtggccgtcaactcccgcgccagccccatcatcgccaccaactcatcccccgttgcgtctccttcaactagtgctgctaaggccacaagcatcacaaaaatccagaaataaaattgattcatttagcaactaaccagagataaaattgattgttagcaggtcgttcaccatccactgaagaataggatgagtaggcagaggggagcaattaattttgtctcgcttgaacacgcccaagatggccaccctcccggggatacttgtgcttgcgtgttgcgtcaagcggcaccgacccggacatcatgtcggcgatgagctagcttaggtcgctggtgaagcagtcggcctgcagggcgagcgccatctgccgccgctcccaccgccaccgccgcttcagcttccgccgctctggcccccacccgccgccgctccagcccgtgctcccttggcggcccggccggccaaaggggagagagagaaacaaagagagaagggaggaagaagaacgggtcccacatgtcagtaggccccacattttttaatatatgaatgacaaacgggtcccacatatccatttttaattcaaatggcacttaagcgccacgtcaaccccatagactaggtcaacaccgccacgtcagcgccacgtcaccgaaaccaccctccaaaaccgccaagggagtcaaattgcaccggtttcgatagttcgggggtcaagatatccggttttgtggtttagggtcatggattagattcgggtcacttttaagggagccaaagtggacttattccctttgcaggctgagtggacatcaggacatgagatcgtctcgcaaacttgccatatgtatgtatagcatcaactgtgccgtcgagagataggaaattcaggggtggtggtgttacgagcacagatgaaagttcttggaaagccttaccttgtacggttgtacctacgaggaccgtgatgcctccatcgccgtgtacaaagagtactgctacacgtactaaaattttcttataaaacttttactaacaaatttctcaaccgtttgatttaactagatagaagttacaagaaatctagatttactcacagcttgacatatcagagtttgtaaatattttgtaagaaaaatttagtacgtatagatttttccgtgtacaaatacggacgttttttggccacttagcttgggccgatggcgactacatctccggagaagaacactgagttgggctgaatctaatccagaaatctagcccaaaagtatacatataggacaaggcccaagaaaaggctttttcggcgatagggatgattggagcaaaatgggactcgaggaactacaaacttgtcatcagtaagtcacaactgtttagccgtttaggccacgagaaaaatcagatgaaaaaaaaaaacagccacggaaccttttattcactcatgaccagcaatactttcttcacgcattgagtgcaacaattatgatacaaaacagaccatttctttccctaacaatgcatcaaaacactacactgcagcctccaaatttatcccaaaatctcagctaaagaagctagtatctactacctccgtcccaaaataagtgcagccatagatatgcgtactcagcgttttgaccatccgtctgtttgaaaaatttataaaaaatatttaaaaattagtcacacataaagtactattcatgttttatcatctaataacaataaaaatactaatcataatcttttttcaaataagacgaacggtcaaatgttggacatgaacagtgttaaaactggacttattttgggacggagagagtagctagctaaacgcccggctaggcggctactctaccagtactgctacaaccaccatgtctaggctgatgtgctgcttgctactgctgctactcctccgcgttcatcttcggggtcttcatctcccaggcgtccaggttggtgaccttgacgtccgactcgccgttgttgaagacgaagaggtgcgcgtcgtcgccgacggctttcctcgggtacaccctcgtcaggatgcacgtcttgccgcgcgccccgaagctctccaccacggagtgatcgatctgatgcacaaatatatatatagttcatcaaaagcagagtcgatcgatcagtgtttatgccaagagattaaatccactgttgctgaacacaaagatcgaggtcgatcgacgatcgtgcatgcgcaccaatgtccggagggcgatttgtttgttcttggcgatgtcgacgtcgacgaagccggcgaaggtcggcctgtagatcttcgactcgtacgatgacctgtttatttacgtgatcaatccattgggcgaacgatccatcagttatgttcagtgacgtcagcaaattaaggattgagatctgaacacgggaagcacggaacgcacctggtagggtcgttgcacatgaggacgacgtgcgaggagtcgttggccttgaacaccctgaagaagacggccgtcctctccttgaggtcgccggaggccagcgcccacagcccgaacggccccacgccgccgtcgacgtccgagccgagcttcttgcacagcgcctccgcgtccgtccgccacgccgggtcgaactcctccgccttgctcaggtccttgatcgcgaacgccatatccacatccgactgcacttgcagagatgatcgatgcgcgcacgcaacatccatgtcagtgtaccgggtagattgcaggtgtggctagtgtatgttgctatgtgcaccactgacctgcacggacttgaagccggtgacctcgaagtagttgcccttcttgatgaccttgtcagtgacattgacgtgcttggctcgcagcgccttgagctcctccaccggccactgcaccagctgcttcccgtccgccgacagccagagcttcctcggtatcgcctgagagagagccagcaaaagcatcgtcagtcatgaaaacggaggcaacgtacgtgtgcaggcaggcccacgcgatgctgacctggatgccggcccagccctttcggcggtcgtcgggtacggtgtcggactcgttggcccagccccagacgatgcggcggcgcttggccgggtcgtagaacgacttggatgcgtagaagtcgccgtagtcgtagcggaggccgtagtcgttgtcggggaaggcggcgtcggggacgtaccggtcggtggcgtggtcgtaccagccgacggtgtagtactcgtaccgcgtcaggtcgaggctcaccttgagcacgtacttgacctcctccgccacggcggcgtcgtgcagctcggcggtgtcgacgccgcggcggtagtggcggctcccgcccgccacagcgacggggaagaagtccgggcactcccacatcccggtgtgcgccgagtgcagcgggtggtgcgccttgacccacttcttgaagtcccggctccggtacagcacggcgagccccttcatgttcaccttgctgccgacgaggagccgccagtggccgtcgggcccgtaccaggcggtggtcgggtcgcggaacgcgctggcgttgatgccgccgtccgggttgatgatggggttgtagtcgggcttgtaccactcgcggaggtacgggtcggagaggttcaccgggtaggcgacgttctggacctgccgctcgtcggggtcgatgccggtgtacatgatcaccggcacgccgctggggagcacggtggcggagcccgaccagcagcccttctcgtcgaacgtcttggacgggtagatccccggctccagcgccgtccagtcgatcaggtccgtcgaaaccgagtgcgcccactcgatgttcccccacacggcgcccttggggttgtactggtagaacagatggtacaagcccttatagtacatcggacctgcaccgtgacacgtataccatgtcatccaatgcacattagtgtacgtaggagtacttcgtgccatacgcgaacaaattttcagctagtttttacggccgtgtgattagccgtttacgtaccgttcggatctggtcatcgtgtacggaggaggaaacagataggagagaataacacgaagttagtattatatcgatcaaagaggacaacgcaaatcgatcatcgtacgtaccgttgatccagtgcttgggtggttggaagtggtacccggtccggagcttcccgtcgacgtgcttcgcctccagcgactggagctccgggtagacgacgtgcgacgcgcgcaccaccaccactgccgccatctgcagcagagccacaaacaccagcgcggccctcgccctcgccgtcgccatttccactaacacactacttacctcgcttagtgagacccagttaggactcggatgatcaatgatatagtgaggtgaatggtactattttataggggcttctagcttgcctagcttcttctcatctcggcgcggcggctgcgtccgcgcgcgacgttctttccgttttccgtttgccacgaattcaggacagttttggcgtgccacgtagtcttatctctagtgcaagagcggcacgcgcgcgcgcgagagagatcggtcgatcagatcgcgcacgcttcgttctcccctatccgcccccgctgactcgctctcgatcgatcggcgccgcgcgatctcgccgtctcgtctctcgccatcgcagatatatatagctcgcgcccacccgcgtgcgggcgctctgctagccgccacgtgaaccgccgcgcgcgcgacgcccgtccgtccgtttgtccatggcgccaccaccaccgccaccaccgctgcactgctacaaagcccccgaggagcagcggctcgggccgcgccccgccacacaatcaaggcccccgccgcacctcctcccgtactccggcggcctcgacctcctcacggaggcacttggggccgagagcttcgatccggacgacgacgacgacgccaccgccgcctcccccgccatggaggacgtcggcgccgccgtcgccgcggtcgactttctggccccgccgtgcaagaggccgcaccacgtcctcctcagcagcagcagcgaaggcgtaggccacgacgacgacgacaaccagcacgccgtgatggtgctgaggaggacgaggagcgggagggcgttcccgccgccgatatcggtgatcggcaagggcgggcggccgtggctgagcctccgggcgcaccgggaggccggccggctcgtgctgcgggagatgcggctgccgtcgcaggagttgctgcagccgtgcaaggaggacggcaggttcaagctgctcatccacccggaggccggccgccgtagtggcggcgccggcgcggggccacgcgtaggatcaggaagggaaggacacggcgccctcgagtcttgatcagtagatcagacagaattttccttttctttggtctttagagcaccgtaaattcttcctctccttcctgcgataatgtgcatgatcttgccgttaatcaatacatgcattggcttgcagcttaatctccgatctgttcaaatgcgtctcgtgcctgcatgcttgttccgatctagtattccattgcatgagaattccagacacggctgcgcggagaactgttcagttttggtttctgcaagataacgcgcggaatcacaaggaagaaacagaacaaagcgaattttttttaacgaagttttattaatagagcagaaaaaaattacaatcctagaggatcgtaactagaaaaaaaattacaagattacaataccagaggatttaaaagattacaataccggaggatcgtaacctgaaaaaaaaatataagattacaaagcgaaaattttggttgaacacggaatcaactaacttgatcccctcacgggtgatctctctaacaaacagtataaatcacacgcacgtgagcttaagttgggcttttgaggtttgacaaaataaaactcacatggtgacatggacatgaagaaaggaactggtcacatatgttctaatatctggatccatttcagttgacaattcttcacaatttacaaatatctagacctcacactcttttaacacacagtgggaaacagaaaatgtgcattagctcacatgtgccaaagcttattgtttaaaactttatagtatagttttgtttcgaaaatgaaaattatatatagcatccaaacagccccttaatctgtaccattagacattcacttcttttttctcaccgtttcaacattaattaggagtatttcgaaaactgaaatcatttgagccgaaggctaacatggaggtagttagcagtaaccttgaagataacttctgggacccacctggcattgactgtgacagcaccgagccgttttactcggtagcctcttgttcccgcacaactcgcatcgcatgccacgcctctctgctcccgcacggcgccgcgctgcgagctctcgccacggccatggcgacaccgacaccgatgcctcacactcccatctcctcgcaaaccctaacgttagccccacacgtctcgcggcggagatgcggaggcagtgtccgcgcccggaccctagctctgcccgcaacgccggcgtcggcgtgctccttccgcctccgcgccacggcggcgcgcgactccccgctgccatcgctgttcgacgaggcgttccccttcgtcgccgtggagtggaagaccatagtgaaggggtgggcgtgcgcggccgcggccgtgtactgcctctcgcgcgcggtgcccgccgcggggcggctgccgcgagcgctcgcggcctgcgggggcggggcgcggaggcgttcaagggcgggttcgcgctcgcgggactcgccgctgcgcgctcggccgcggcgtacgtgcagcaggcgttgctctgggaggcggcgctccgggcggcggggcggctgcgggagcgcgcgttcgagggggtgcttgcgcgtgacctcgcgttcttcgagggcagtggaggactgtccgcgggagacatcgcgcaccggatcaccgacgaggcggacgacgtcgcggacgccgtgtactctgtcctcaatgtgaggttccttgagactaacattttcctttgctgcgagtgactcgtctgagttgagcgataaccgtttgtggaaatgcctgcatgaggttctagtatgttgacatgtttctagatctagatgagcatcaatctgatcaaatgtggattagctgtctgtgggaatgccttctcattagtcagcataattgttgattttgtcactgttcctttctacctccttaaaatgcctatacccatggagtaatggatcttgtttactagcttcagggtttaggtgtaattcaaggcatcctgcagaattgctgatgaagtgattacattgacaattggtaggcctccaaaaatggattctaattactcttttccttttgacacagactattgtgccaacaagcttgcagttgatagctatgggacatcaaatggtgacaatcaatcccctgctctcagtggttgccgcaacggtaacatctgaacagatctcacaccttatacagttatagtgccatccttttgtagttgcttcaatgtatactgtttaattctctctacattacatatgcaggtaattccatgtatgtggcttgtcattgcaagtcttggcagaagactccgccaaatatccaaagaggctcacattagtcttgccatgcttacagtctatctcaatgatgtatggtatttcattttctattattcagtgatgtctgtagtcctacagagtttgttttttaaatgaatttccttttaggtacttccatcgatgctcactgtgaaggcaaacaatggtgagggcaaggagatatcgagatttcaaaatttagttattgttgatctaaagaataatctaagtaagaagaagatgaaggctttcatacctcaggttgttcgaacaacttacatcggaggcctgttagtgctctgtgctgggtcaatagcagtttcaggcacct

SEQ ID NO: 57810 - DNA, 2740 bp, Oryza sativa
gggcgaattcgagctcggtacccctggggttttgcaactatttattggtccttctggatctcggagaaaccctccattcgtttgctcgtctctgaccaccattgggtatgttgcttccattgccaaactgttcccttttacccataggctgattgatcttggctgtgtgattttttgcttgggtttttgagctgattcagcggcgcttgcagcctcttgatcgtggtcttggctcgcccatttcttgcgattctttggtgggtcgtcagctgaatcttgcaggagtttttgctgacatgttcttgggtttactgctttcggtaaatctgaaccaagaggggggtttctgctgcagtttagtgggtttactatgagcggattcggggtttcgaggaaaaccggcaaaaaacctcaaatcctcgacctttagttttgctgccacgttgctccgccccattgcagagttctttttgcccccaaatttttttttacttggtgcagtaagaatcgcgcctcagtgattttctcgactcgtagtccgttgatactgtgtcttgcttatcacttgttctgcttaatcttttttgcttcctgaggaatgtcttggtgcctgtcggtggatggcgaaccaaaaatgaagggttttttttttttgaactgagaaaaatctttgggtttttggttggattctttcatggagtcgcgaccttccgtattcttctctttgatctccccgcttgcggattcataatattcggaacttcatgttggctctgcttaatctgtagccaaatcttcatatctccagggatctttcgctctgtcctatcggatttaggaattaggatctaactggtgctaatactaaagggtaatttggaaccatgccattataattttgcaaagtttgagatatgccatcggtatctcaatgatacttactaaaacccaacaaatccatttgataaagctggttcttttatccctttgaaaacattgtcagagtatattggttcaggttgatttattttgaatcagtactcgcactctgcttcgtaaaccatagatgctttcagttgtgtagatgaaacagctgtttttagttatgttttgatcttccaatgcttttgtgtgatgttattagtgttgatttagcatggctttcctgttcagagatagtcttgcaatgcttagtgatggctgttgactaattattcttgtgcaagtgagtggttttggtacgtgttgctaagtgtaacctttctttgcagttcctgaaattgagtcatggctgccaagctagctcgcctccacagtctccgcgaacgcctcggtgccaccttctcgtctcatcccaatgagttgattgcactcttctctaggtgaagatctcaatataatatcttgtgtcttcttggaacctgctactaattgttttgagttttcaatgattttatccatacagttggttagttcttagtcaacccagatgtgaaacgataacatgttagtatgttacaaattcttagctgacaaggttatgcatctctttagttttaatgatggtatctataataatctgtgatgagctctaacatttctgtcttgagtcatgaatcttaaatgatgttgaaatattgtttgttcatagctagattaagtacagatcatgtggtcttaaaaataagaagtaaaaatcaggtttatgtggtagtgccattaacatagttcagccgcagaaaggatgtgagatctaagcattggttctatttcttaaatatcactctatgcaggtatgttaaccagggaaagggaatgctccagcgtcaccagctgcttgcggagttcgatgccttgatcgaagctgacaaagagaaatatgctccctttgaagacattctccgggctgctcaggtaaatttggcaatgagccaggatggttatgatagtcaactcaaagtcaaataccagtctttctaacttacttccttgactgtatgtaggaagccattgtgctgccgccctgggttgcactggccatcaggccaaggcctggtgtctgggactacattcgggtgaatgtaagtgagttggcagtggaagagctgagtgtttctgagtacttggcattcaaggaacagcttgttgatggacagtaagtaccagaacgacgatttgcagattataactgaagcaaaataacagtgactgaattttacttctgtttttcttaaacagcaccaacagcaactttgttcttgagcttgattttgagcccttcaatgcctccttcccgcgcccgtccatgtccaagtccatcggaaatggggtgcagttccttaaccgtcacctgtcgtccaagttgttccaggacaaggagagcctctaccccttgctgaacttcctgaaagcccataaccacaagggcacggtaagcttccaatttgtggaacataccaaatgcttttatactagatgttttttcttgtgtgaattgctttaaatgttagtcctttagaaacccacttgacattctctgtaagttccaccaaatgacgggatccgaattttctattacagacaatgatgctgaatgacagaattcagagccttcgtgggctccaatcatcccttagaaaggcagaagaatatctgatgggcattcctcaagacacgccctactcggagttcaaccacaggtgattactttattatttctccttatcatatagcccatgtt

SEQ ID NO: 57811 - DNA, 15299 bp, Oryza sativa
agaactgtacaacacgagttccctacgattcctttttaacaggaaatgggatcggcagatcaccaattgatgatacagagagatacatgatgctgtcgacatcagaaaaatgacagcataaagctcatcggtagatcttccggcatgcacgtccaagcacattactatagtctctctgccagctacgtactaccgtctaaccatatctaccatttgggcaaaatgcaggcacaaaagccacagattacccaggctgcatgcgctttgatcagtacgtgttctgggggttgaatcgcctcctggcgtcgcgcttgtagtagggcgtgtcgtcgatggtcctcctcacgtactccatgaacggctgaggcgtacgaggtgacaactcaccagtagctggggacgctgggtcagccatcgcggctgctggtgctgacgcaggcgcaggagtcgcgtgtcttggtggtgcctctctgatcggtttcttctccagcaacttcatgaagagcgcaatcgtagcgattggaacaacaatgcatgtcacgattgcagccaatgttgtcaagcctgatgtcgatggctctcttctttctccagtgtcatagataacttctatttcttcagtctggcctgtaggtggaggaaaacaatgttgttagtgatgatcgaattgcaatcaccttgcataggagaggtgatacttaaattgcacattgtatatactgttaaggaggatcagtgcattcaaatgtaggtttacttggttttgacctcagttttaccaatcaccaaaaaggtggttcaggatgatggtcagaccaagacgactacttttattccttttgaaaactaccaagaaatgtcatgactctagtaatctactcattacaaggattttggcaaagatagaatagcataccggtggctggaagaattatagtgatcttgtcatagaatgattgccttttaagtgcttcaacctgcaaaagcatgtgagtcagtacatgtttaccaccgttaagcatcaatttctaaaaatacttccttgtcagttgcaatttacctgataactaatttgacttggaacacctcttccatttgtatcaacacgactggctgacagtaaatctttagcattccagaataactcaacatctggagcagggcaataataactctagcattagaaacaaacacagccaaagcccaaaggtctaaagttcatggacacaatagggttttatcctaccagtattcccaccaatagtgatgatgctatggttgcagcttggagtcagatttaactgcatcagataaccagctttttaataatcagttagaacaaaaagaaatgcacatgagatggggagtgggaaggtggctaccttcctaggttctttaatgtagaaccctttgacaaagagggcgtgagcagatcctgtcacctttggatcttcttttagatttgcatgaacaacaatgtgtaaaaatccttccttcaggtttaacttaacaggcaacagttgcgcaggtgaatatggatgaaataagcagtaagattttttagcagcatcatcactccacggctcaacaaacctaagggagaaaggagaatgagactttaatgcatccctataataatctagaggaaaagcaagttgtatgaccagccgatgatgggaaacatacccaacaaaagaaggttcaaccttgcagtcaaatgggacgttaatgtgattgatagaggagtctgcgctgtgtccagttgaatcacttctttcaacaaggggggaaaggttagtttttatcaaacataagtaaattcatgagtatccaaataccaagacaaaaaaaaaagctacagaagcgctatgttctgattggacttagtatcaaatactacgtacaattatagtaactttgtctattcaatactccctccgtcccaaaatgtagctatttctagcacagtgtcttgtcccaaaatgaagctatttcttcacctacctcctctcaaccaatcacaaccattcttcttcacctactttctcttttcaaccaatcacgcacttcctccaatcattctcacctactttcttaatacccgtgccaacctcaaaaatggcttcattttgggacggaggaagtacaggactatttgtccagttcctgctacaattatacgcctccctccaccatcctgttctctaatgttgctaagaactgatgtatgctgaagtatattctgttgcaagttatataataccatttctatatagacacatctaggaccaccagtttcaggtcacaatctccagctgtgaacctgaatctgaaagtaccaaaaatgaggcatagagaccatcttagcaatactactctgctggtgctccaagttctagtataataggcctaaatgtatggattgcaaaactgtaatagcctagtgtactagaagttcatatctaataaattatcatattagagtagctttggctttgactatattgatcaacaacaatatggaaggaatattgtgaaatgatatgagcattacaaaccttaattttacagagaacttgtatccaccaggtggtccagcagcatttgtcagcgtctccgcaggagcattaactactatctggttcaccttcagcacggtgacagttgtgtgcagttttgtatttggacctttgaatattactgtttagatggagaaatcacactgaaaaataagaatcgggagggaatgacactaggtaatgtattctactcattgaagataatcatagttgcataccttctgctataccttcaccacgtgcttgtgcttcaccggttattctattaatatgcacaactttttcattgctacttaaccactgactggatccacgcacatccatccctacaaaaggaaggccatggttagaaaacaaagcatagaatatatagtagcatgcatgtcctttgctcttacaaaacatgtatgagttaactacctattctggtagtgtggcctttctatgaactatccattttgttttctaatgtagggtgcgtcttcttttgcgcatacactaaggcatgcttgtaaggaagttagaatagtagtatataggggtagagggaacaccattcatttattggaatctgaaataggccctacatttctgaatatgaccagccagaaagggcgtcttacatttgtgaacgaagggagtactatactatcacccttgacccatgtttttccaaaagataagatcatgtactactaactaaaacgtgatgtgtggacagcaatgaatataaaaggataacaactaactaaaatataatcatgcacactgaaatggtgcatcagacgaaactcccaatacaacaaaaaaagatgcgaataaccggtagtatggaaatggtttcactggacgtacggtctccaataatggtgaagttcagttgctgcccagaacgaaggaccacatccctgggatacatctgtgcaccaacagatacctgatatagtggaatgtgttagtcaaaacacaaactgtattccattgtgagcattcaaccgaagaaatggcagttcggtatatggttttgctagatgatgtcaccgccagattctgaaagcatatgctattacagtttagtttgatacattgtgtacaagacatacacaaaaaaaactccacctgaggagcgctagccagaataagctacactgcattcaagtttaaatagctacgagcccattatgccattatggaccagacaaagaactctgggatagtagcattgaactttagcactttaccattatgaaatcggctttcttgggaatatggctgatttgcaaccttacaagagcagttccatgacttcttgcctgcaaaggacaacaaaacacaacacattttgcatggaagtctcactcaaattatccgtactcaagattgactcaaattcttgttacaacttccagaattagtttcaccaaaatattccttgattattcttgtcacagctttaaagcaatcattacaattgagaaagcgttaagatccactaaaaacccagtttacagcctgaacttcccaccagactcactctttttttttcagacttttgcaaaagttcagggttataaaaatggacctttttttccaaaacaatattgaagctcgattagaggggcaagcccatacctgtaacacaaaacgttcatgggtaccatgtgtaccattgccttcttttggcataagaattgacacgacatcaggatgattcgtctcaatctttacagggactattccaagtgcttcactgaaggtataacctggttggagggaaaggataaaaacaggaagaagtaaagttttctagatgaaaaataaaataaatgaagcattgatactaataaaattgttagtgaattacctaattcatcactgtattttatatccaactcaactttatcatgtacagaaagataggctatatggattgatgattctgcagctgctatctgtgcttgtgcaacctgaaaaataatgataacaacagaatcaaggattattttctaaaatacatagaaacatagagagcaatgcgattatagaacatctgtataaaatgatggcccaaaaattttgaaagagattcttgtctgcgacttatttttaggcatccttcagggccacggtggtcttttccaaaactaataaacagcctcaattagatattaaacagaaaaaattactagagtatgcattcccgcatgcattgaaatgataaactgacacatacactcaacatgcaactatatccctgttcctttttttttggtgaactatatgcctactttaactacccagtcacatacgtttgagtaccctttagtcataagtgacttcaatcataccaagggaaacattgtgtatgaaatgtagtccagaaaaacatggaaaaataaataatattacaatctcagagataatagggatgcctagtgctatgctatttgcaatagaaatatatgtaattagagtaccagcatccaacctcagcaactcgtaggcacgatgcaatttctgttctaccagttgagtgatcctttgcctgaatgcaatcaatcgcattgctttctccagtcctaattttacttccatcaataatgttagcattttgcaaaacaagatcacttttaccaatgttccttagcagagaatatccaatagtactctccaggtcatctgagtctgggtcaactgatctaggtaaaaggtccgtagtagtataaaagggtgggaataaccatgttataggaagtccaagtgcgagaggaggatctggcacaacaagaattgtcttggatgcactgtaagctatggacccagaactgccagtcatcaagaaatcacaagtaattgacacagaaattttggttttcccagcagatctgtcaaaagaaaaatattaattaggactcttgcagctaacccaacttaccacataagagtgttttttaaagtgtctcaatcaatattcatttttatttaaaagccaagaatagaaatagtccttcgttaggtccaaaaaagtttcaccaatcactgtaactttgagcaatgcataatgagttctcccaaacagctacttcggagtattagtttagctccctttaatatgaatattgggctcaacagaaacactccactactttcaaaaagttaaggggctaggctactttcaaaatgtacaaacaggcaataaattggcaattcagtatatcattcaatacttctatgtagtaccttccaatcacatgattaataaaagcattgctacttccattcgaaaaccatggatagttctttccttccgaatatagcccttgatcaagtccatactgccaagatctagctaattgaaacatagccacctagtgtagaacagtttgttagttcatagtgctctgaacttagcatttaaaagtatacaaggcaacaagaggaatattctaaccttgtcatcttctataacccaagtgtaactttggcaagtttcataaaaggaaaatagatctccctgaacagcatgtgtaatgttacgtagcagaacttcacaagatagtaataaaaggattattggattaaacataccttgggcagagaagggtagatgggcatgctgcaaccaacacaaagacggtcactttgagtactcaatatcatagccacagggatatccacttcaactcttccaaaagcttcacagatgaaggtgccttcatttgaaaaagcaactgcacgcatagtctaatggtgcaactggtcagtacactgatctgaactcggaagtttgaaaattgcacgaatcaaatgtagtacttcaaagcaagtgcaggtaagcagcatactttatattaaattgaaacaatgataacaaaaatcgcatgttcacttagagcatggtcaagaaaatgccttggatgggtatgacttacagagtttccaacagtctttgcagacagcttgccagtagaattttgaacttctacagtttccacattaagacttgtgtactcaatgacaactccaacttttggaccaccttttacagaaagctacaaggaagaaaaaactcaggacccaaaaaaacaaggacagtaataaaatcagagaaaagtacaaatagttgacataacacagaagatattaatggttaccacaaaagaggcacccggtgtgaggtagatatactctggatgtatttgcagtggtttgtacacttccaccttgacaacctgactcaaaactctttgaccagagtattgcttagcagtgacctgaagagtaaacgtagtaaatgatgcaggccaaataagccactaaaagtaaacaaatatccaccatgaaattgtcaacttacatatagagatgttgtgccaattttcgcagctttaactgaaaattttggtccgtccagcaactcatgtgaattaataagttccaaagtctcatcaccaagatgcacttcaattcccatgtatttgtactgcaaagaagacataaattggcggagtcatggatatatagtgtttagtgataacaaatctgtcaccgacaagatagcttgaaacagagttaagatagtgtatttggtatatattcaatacaggattttatgagcaaagaggaactatagcaacactaccaacagctaaggttccacagaaacttaccaggaaattatcataaaggatgaccaaatggaaagaaaataaaattttcacaataaggaatacaaagacaacactaatacatgcaattaatgtgtaaagatctgaaatacaagagcatggaggcatgggagggacctgagaatctctaaagacttgtccatcttgcgttccagcagaaatatgaaaatcttctgtgcttccttcctataaacagaacaagaagataatgaaaaaaataacccagagatttagcatctgagaaaactgatcacaagagagggaaagcatatctccataccataaggctgatgtgctcttctgagtttatcttaatccagtcaacatttgcaactcgaacctgccatatcgcataacaccaaaaatagctattatcagttaagtgcaatggactataaggaagatcagtacaactgtatttctaagaaactaggatacaatttgttgagttcatgtgtccatcgccaacaggtatataccaagagctttccttatcataagagaaatcataaaataaagatgagatggacgacaggacaggacatagctctggggaggtcaacggctgttatgaccaaaccaaacatggcaagcaataagatcagataaaaggcacttgtttcacataagtaaaaagtggaacattgagaaaattgagaagaaagtaccaaagaatcagttaatgctctaggagaaaggccaatgtcctggattgtaactgtagcagtgcccaagcctctagcaccaagaatcaactgagaacatagtgcctttcctggatgttgaagtatttgcaccacctgcgtgtcattgctagaggcatctaggaaacatgttccaccactaacagctaaggtttcctggtacaaataaattaggcagaaacaaataaggtaatttgcatataagtaggatcatgcaaaggaactataaaatgttgcagttacatacctgtgcttctggatgaaaaactatcaagacataatccggagtgactcgtaaggaagaaacaatctgtttgaagtccataacgattaagatgaaagctatacgcatagaagcataatagctcaaaataaatcaaatctgattacctgcaactgaatagcatcggtgagagtatcacgtgcgctttgaagaaacatgtgctcttcttcacgggtccggccatccactcttgaagaaaagccaatgactgtagcacggacagtgcactaaaagttcaaaaattgaaatagttaaaagagagatcgatttttagccaaaagagggcatacaattcttaatgaaatgtccaggctcctcaaaacactgtactattttgatttttgatatacaaccatggaatggctcgtataatcaacagtacggttcatacacctatctcaatatcagtgtgtgcacatgtgtgcgagcacattattgcaaatgaagataacaacaagcatttaataatagggccattaaaataatgcaaaaaaaagaatttcaaaacaattttggagtggacagtctgtgatgtaaacagtaccgagtactgaccattccagtagaattctgtaggacaagaaatctctcccagaatgagtcatctaacatgtctttgttttggtcaaagtagcaagtcctcacatcaagtgccttcccaactcaggcaaagagaagaagaattggcaaaaaatcttccatttccatgtacaccagcagcagctagacgcatgtttcttccatttgagattacaacaggtgatgcttgcagtctattgtgcttacgttcagctctgcttgcagcttccaaaataacaagtcggctttctgttcaagtgtaaaatatgatagctaataagttttacagaatggagacagcaaaataatatcatcatggacatgtgaatttatgaattatattaattatccaaatgacagtatagtaccattttcattcgcgatcaatgttatggctgacgggaagtcacaaacaactgccaactctgattggcttacagcaggcacaggatgatcttttccaatcatgtttccacgtgagaacagcagtttctacagaagtacaacaaattgaacaaatatatggaagcaacaaactagaattaagaacatactgtacagcataattgtaaacatatgtgaacataactattgacaggaatggactggattgatcaaagtgcaaagttgcattcaaagtacttacaaagttccctttgcttgggcaggatactcggtatagcctactggataatttttgtacagcagtagagctaacaacataattttttgattcaccaataacatcaacagtttcaacaaaatcgaccagttgatcccattgttccggccctccagagagaaatacatccatggttgatccaggaactaagtacagctctttgggagaattgttaaccatattctgaattccactatgtattctagataagtcaacccaatagccaccaaatcggttcccacttcctgcttgaagtaccacaagaggatagtatgcagatattttagaagtggacttaagaaaaataggtccactaaaaatctcagaataggactctgaatcaaaggaaaatgttgcaactagtgtggcttgaccagcagccgacgcatttagagatacccaagcacaaggattgccatattgtgcccaagaaccagcataatgctttaaggtttcggtgctcaaagcatcagctgtgccaacaactacaaaagattcattctcagatagtaggctccaccttataaaagcattaaggcaatcacatcgcgagaatgggtgtcctgcagaaatattaatgctcctaatggttattggaatgaacaaaatagttttcagaacaaagaaaatgagtttaattgttaaaacatagaaagaagttatagcaaatgattcttgtcacgaaatatatgtttcttttcagttgtcaaagcaacatatcagtctctttgaatttcgagtaccatgagaaaatagtatgagagggctcagttggagagaacatatgagaggatttagtaaggtaggttagagtgtggggggctgggggtggttattattatcaggagagtcaatggaaagtagtttagcattcatatatcatattttgtagaatgcatgctacttgctaaacttaaatctatgtcataagggagataatagccaatccaggacatgttagtcaccattagatgttttcaacgtcacagcagcttgaagttgtgtcccgacaggcacttcaacaggaaagtttggcaagatagcctgtgcagaaggagtggatacttcaacagtgacctgcgtgatcaagcaaacccaatgagctgacaaaagcgagaaagaaattcaaacagatggaaggttcaggtaatacagtaggtagtggacttgaaaaataaaataagaaaaaaggacccgcatgagcatgaactacagggtaggtaaccaaaccctaacaaacttttcacactacttagaccaataacagaccttcatgagcatctatcaagattagcggtgcaacaatcccaatttcccaagtcctttggtaacaaaccaaatgggtattgccaaagcccaaaagtttggcattactaaatcaaccaaaacgctacacattatgaaactacaggtaaaaaaaaaaagaagatttgaataagcagcgatttgatcacgtgagtgcgtggataagtgatatactgataccatatgcaagtgtagagtttttgcacatgacatagtgcaaatacatggtagcatcacatacagcaactcaacaaaggtgaattgacatgcgagatgcaaatttccattcaatgtgatcagactcatcttgcatgatagttaaacagaagaaaaggtgtcaagcgaatattttactagagaaaagtggtaaaatttaatatacacatcaggatataccatgatgaataaaaaatcatgcattccttcaaaatcttttttccatcatttataaacctaatactaaaattggttttccactttatttaggctaaaggtatagcagtatgtttgcatggaagaagcactttctttcctgtaagactcgtataacatataattgctagtaaaacagcatttcagataaaatccatcacccaggcaggtgaattatacaaaaactagcggaaagagaggcaaaaggattatttcttgagtttaaagtttttgttctaaaagtaatataagcctaacagatcacaagtagctcagtgctacatattgggaagtgaaataattaaataatcttgctagtggcatcactcttcaaatcttgcagaaaagaggtagttgtgtgcttgcatgttattcatcaaacttcagcttacattttcaaatcaaatagattacagataaggagttcaggaaagagaagaacaacaaaaggatatcaagaaattagattgtggcatacctcatcaaaatttaaggcatcaaaaacagaaactactttgatgacagctcgaccaggcctttttgtgcgcacaatcagtgagtcggacacagaagcaacactttcatcagaggaagatagcttgtagtcctccggcatcttgccacaaccttcagttgaacacaagataataccagtcaactcaatttacaatcaaaaggtgggttaagacttaagagtattaagacatcacaacaatcaacctccaactgccttcagttcaacttcctgataagctccaggaacccagggaagatagatagttctggaattatccatttcttcatcccatatggctttcactttactgcatacattaacttcttgttgaagcttgagaacctagcatgaaatgcttcaatcagcaaactatgatggtttataaatgccaataccatcctgacaaacattacatacaagtacagaccaccccaaaaaaaatgacctagcagacacaagcatggaatgtagtatgtacctttgctggtccagatgcctctgttcggtaagttaaaaaagcatctaagtatccttttcccttggaaattggagttagtaatctagatgtttgcacttcgtaggaacctgcagaactgtctggaacctgtgataagttccagaactccacagtactgctcgccaatttaagctcattttcctaccaagaaaattagattaaataaatagaataggattccatgtagataacaacgtctacatgaagaaacattagacccataatcaaagtgctttaacattcaatatagaagttagtttcattttatcaagataggggaatttacccacatccatagcttacttttttatgtcatagaacaaccaagtgaataaagctgtgtaagagtgtatatgcagcaggagcatgtaccatgcatgggcaccttaacatggattcacatgccagtgtagagatgaatggatctaaagacaaatagtatagatacaaaacttaatgtaaaaaggtgtggttgaaagatatgaaggtaatcactgcaacacagcactgtatgcatattcaaatgaatcgatgtgtaaattttgttcttttggtttttgtgatgcttgaaaatatgtgtaaatattttgttccaagttccaacattacatgttacatgatgcatcagaagatataagtaacaaagacaagaaaccaaatacatcggacgaatgatacctcagtaataaacatctccttgaaatcaaatccctcagcaaaagctttagcaaggaccacatattttcgtccaggaaagacataccaaacttctgaagatggaatacttgttatcccatgaaaatgagcagagtcgtccacaaccggaactagataaaggaagagtgcttgtggaataacaacatgtagagatgatacttgtgcatggccagaaacccttgtgtcttcaacaacaatattagtaaatcccaaactcaaagcatgtaagacacccaaggaactatccacttgggccacagaagagtttgtcacatgccaatgatgatgctgtgatggtaagttaacaactggtgaaaaggaataaagggagaggatttgttagctttcagctgcaggctgaaataaaggaattgcaggtagatagattctaatagtgagaataacaaataagaactccatatggtttttctaaaccgtttcactgtaaagcatagcataatttgctagttgtgcttctctttttttatattgcttcaatatatgacatgggtcacctgaagctgaagtttaactttctgttgcatgaactctggctaaagtttggtttctatacttagagaatgtcttatgaacaagactcaatttgtttgaagtaccttggggaactttttgtcgaaaaaccttgagtttgaactttaccatagcaccgacggtcacaaggactggtgaagggggctctagtgacatagcttcagcaacagttaaagtgattgtatcattcacatgttcaaactgaggttcaaataactgggcattaacaacctcttggccaatctcaatgcccttgaccacaaataaatctgaaccaagattctgcgagaggtatcataaaagagtatgcattttcatgtaactgcttatcggtaaagttaatgaaaaatgaggccatatttaataacagatatacataccctgtcttcaagctcaaatcgtatattcatatcaccacaaaagccactgcagtcacttaaatgtgtttctttcaatggaatatgaaccagatgatggctattagtatcaacccacctcggggtaagctgccacaggaattgtaaccccaccaatgatgagaacacattgtctgaaccaaaaggaaacaaactaagttacaacaagagaagaggattctacagctattagaatagctgacccaatgaagtactagagactagagaaactatgctattgattgtttcagtagaaagtttctagaccaagaatagaataggttacagttgagaaccaacgtaagaaaaaggtaacggacaggtgatggaatcaggaattccaatttgtgcacattgaaattcatgaatatgtggaagtttacggcaaacagtaagaacagtgatggtccataagcatagcacgagctagattgacatattcaagcagtatcaaagtaacaagtacgagttagtggaggtgggaggcctaatggaattttctataacaagagctcatccatattctgagaaccttaaagaaataaactatggaaaatagctctttgcaaacatggaaggctatacgaattaccttcatcatcaaaggcatgaacacgcaaggtggcaacttcatctaggtcaatttttacagcatgatggaaaatcctgatccgagagattctgtcaacaaaaactttgcaatgtattgtgattccactaataatatcagtggcatagacagaagtttccttcctgccactgtaaggagcaattgatgccaaacgagcactagttgagcatctgctgctgtcattgtactctggtttaactgaaataatatcatggtgatcccatgccctgtagatatagaaaataaataagcacgttaacctcatcacattgtgaaactgagaaaacaacaatgtcaaagcatagtagcatggtcccaaaacagttcccaattctgacatccttctgcagcaagatgcagacatacacgaagaattaaaacccaatggtgcatcagcattagcagaaatctttttcaagtttatttgtttcaccataaaacaaataacacaaattcatgcacaggtgacctgtaaattccaaacaagtggcaggcaaccgccccctgatcgaaatccatggaccaagggtgaagcaacaaagcatagataatgtgaaggtgggcatggcattttctttaccgcagtcacttctaactcatcaacagcgatttcaggttacagcaagcaaaaaaaaaaggggcacaaatgcacaattaacttctcattacttgccacgcagttaattatccgaaacga

SEQ ID NO: 57812 - DNA, 3587 bp, Oryza sativa
tctaaagagcagtagaatattgctgcgttgtgccaacacctaaacgggtatctgatgtttgtttcctctgtttcttcagcaaggacactgtggggcagtatgaatcacacattgcattcacccttcctgggctttaccgagttgtgcatggcatagatgtttttgatcccaagttcaacattgtctctcctggagctgacatgagtgtctacttcccgtacaccgaggctgacaagaggctcactgctttccaccctgaaattgaggagcttctctacagtgaagtcgagaacgatgaacacaagtgagtactgaactgctggttccgtccctgttattcacctaccatgtaacaaataattaaacactgatttgtgtgtttggtctagctttggctcttcagtctactaagtgccatgcactagaactttgtagatttgaactgcaattcttaattttctcactccttagtagaccacaataataattattgtgtctgacccagctagtttacaatagtgacttcaatgcttgttttttccccttgaacaattgtttactttctagcagtggagtttggcatctaaacttgaatacacgctgttcttttttgtgtataaaatgtttatttaatgttctgcaggtttgtattgaaggacaagaacaagccaatcatcttctccatggctcgtcttgaccgagtgaagaacatgacaggtctggttgagatgtatggtaagaatgcacatctcagggatttggcaaaccttgtgattgtttgtggtgaccacggcaatcagtccaaggacagggaggagcaggctgagttcaagaagatgtacggtctcattgaccagtacaagttgaaggggcatatccgctggatctcagctcagatgaaccgtgttcgtaacggggagttgtaccgatacatttgtgacaccaagggagtctttgtccaggtatatacatacgctgtcatattctactgctatatttctattctgagcttccagtagcaaatgatttctactatttgtaaagaacagccttgtgcttgagactaaaactgcttttaaaattgttttttagcctgcattctatgaagcgtttggtctgactgtcatcgaagccatgacatgtggtttgccaacaatcgcaacatgccatggtggccctgctgagattattgttgatggggtgtctggtctgcacattgatccttaccacagtgacaaggctgctgatatcttggtcaacttctttgagaagtgcaagcaggattcaacctactgggacaatatttcacagggaggtctgcagaggatttacgagaagtatgtatttcatgatctgcaaatatataacattttttttttacgattgacatataactgtagaaatcatgtgtccaatctatattgatcctacaaatttggacttgtcaggtacacctggaagctgtactctgagaggctgatgaccttgactggtgtatacggattctggaagtacgtaagcaaccttgagaggcgcgagactcgccgttacattgagatgttctatgctctgaaataccgcagcctggtaagttactctcgctgttcaacagcttgttaatttcagtattattgcactgagcatatctctgaattctgttgctacatttctttgttgaatccaggccagcgccgtcccattggctgtcgatggagagagcacatccaagtaatggaggggaaaatatgcatcttcagcaggagaagccgtcagctgcattcgaatttgataattttctgtagttgtcatttggcatccatgtttgccatggatgtgtactatgtctaaggtttcagtacttttgcgagattttgggcagtgcttgcctcaaataaacgccggttcctggtgtttatcgttcagaattcaatgcaatgttttattgccgcgcttcctcaatctgtcatgttgaatgaccactccctagtgccctactgttaaaaaaggttggttcaaagccatggatgaacccaacatttttgttaccttgttcttttcagaatttccttaagagttgtgatagtaggcccagtgcgaccaaaatgttgggttccttgagttttcagtataaaatttctgatattaaatgcagatcttggctcagtacagagtcttgcaaaccatgtggttgcatcttttctactgctgtagtagatgaaactgaagatactacttattactctttagacaaagtttcatcatattcccaaaatcttggtctaggattgggagacatcaagaagatataaacttcacactcaagccctgtttagcaaccctgaataattttcttttgtgtaatgcaaatgcacctgtaaatttgggtgacccaaagatgccagtgaaatataaatcccatgtagccaaactgtttgttagaagaactagaacactcagtagaggttttagctaattacagttcattgctgatcaaggttgcatcagacatagaagtcagaccgaaacatcaatttggagctataatacaaaattcgataaaccaatacgaaattcaaataaaataacattgttcatcaaaatttctggccagaaccatccaagagcagttgtaagcgagagctcgataattcccatggtccacaaaaaattgtgcagaagatcaaatgaccaaaatctaagaacacgatgatttgcaccgcacaattcaaaatctaccagattttcctgttctcttctacttttatatcactatctctactattataaaaattaaaaatgtttttgccgctactttggtaagtcatccgtgttttagtcggttttaatcttactcctcaaaatccgcaatttagaaaaggacgaaaagaatcacgcggaaaagaaaacgcaccataaaaaaacaaaaaaaagtccaattcgtaccggaacgaaaaaaaattggcaataaatgctgggtaaaaaaaaaagccgatcgaccattaaaaaaataaaaaaatcgccaactgtaaaaaaaataaaaaaaaagtaaaaacctttccttttattcatccgttttttttctgtccctatttttttgttcgtattttcttttgcatgcggaagggtgtgtgtacatggtgaggatttttttaatctacacggttttttagtcgtcaggtcgaatcctagctccaccgccacatcgatcaacctcctcatgctttcccttctccgattaattgtaaaaatcaattctccactactccatcgtcattttccacataatttttcttttcagttcctctttaattcactagatttaatctctatttagaaatcaccgtttatatcccacagttttgtggattagctccaattttaataaaaatgaaaagaggagattgagtgaatcaaaagccctcaaccaattttgggagatcgaggaagattcgaccggatttgatgggaggatcagttcttgcatcgttctacacggactatcttccagaggttgaagatgccaatcgactatgtgagctagacctatagttctacttgtgagctggggtcaaagagaagcatatggc

SEQ ID NO: 57813 - DNA, 1799 bp, Oryza sativa
  unsure (1)..(1799): unsure at all n locations
gaggtcccaagctcaggggccagatcaggcccccacgccttcttgtccgcctcacgggacaggactagggttcatgaaatacggttagattccaaaaaaaaaaaaaccaatgttcggacgttgctcaaatgttgttgctgtctagaaattcgataagtttcatcctaattaaaatttcaatagataaataataaaaaatcctataaatagtatgatattggtaggacctattgggatataacttttttttaaaaaaaatatgaattccacgcattttcataggacatgagaggagagggaggggcgagtaggacggaggaggaagacacggccgtctccgccgtcacgctggggaggcacagcccccagtcccccatcgtgccagtgaccgctgctgcgccggtgagacacggccccgctgtgccgttggccgccgccgccatgtcaaggtctcgaggagctgctgacccgctgctgcgctggggagatatgcctaaggctggcagtggcgtgcgtgggctgatgcagctgctgggcaggcccgcaccacttacccacttaggcctaaccacttaggagtaagtgggctgatgcggcaagcccaccacgtccggcggcgccaccacaacccacatcgagggagcatcagaaagaggaggggaacgaacaagttcgtcgctgttgcggcttgaaccctagccgctgccgccatggatttgatgacgccttcaccgncttnctcttcgncgnctttgctgccatctccaccttcgccgncatttctagtgatcttgcagactttcttcagcaccgncgcttccaatgcgtcctccaagggaccttcgtggtcatcgccggtcatgggctcatggcggcgcactcatcgtagctcatcgcacccactccacctgttttgtcaatttctgtgggtggtgctagaccagcttctgcttcaatcctgtcgacctctatgcatgtgagttcttgaattttttttccctgatgtggatcaagtgaaagggagatgcagatgcagtgaatctgagtaggatgaatccagaaagcaaggatgtaattttcagattcaaaccatatttaattttgtaaggatgtacgcatcacttcactaaaaaaagaagattatttagctcctgcttgtttgtgattagttgctttcgtgcataacaatgtgcagttttgatggcttgcctttacataacatgcttgatggtcacctgggatgtaaatatgtgatatgcctgtttgagaaacatcattgaatcttgtacattaatcttatatctttctgactttgttttgagttatatgaatagactgttctatttgctgttcgattcctgttcagcattattatgtataaactcgttacttacacactgcttttttttcacacatgaaaacaagttaaaaaaataatttacatgtaactgcttcttctttttttttttgactgtgtaactactttcggcgctcactttgaacacacaagattagccttggataactaagtttcagcactaaaataattatctgttttgttcatgagttttagagccccctagattttaagctatgtcaattatataatgcagtcgcttggctgtcaaattcctttttatgacaaaagacagtttggagatgtgcatatgactgtgtgcttacattttgcttagacgggagcgcacctttactgacagacagatggtgatgtattcacacctttactgacagacagatggtggtgtatttctttctttgcgttaagtggattatatttt

SEQ ID NO: 57814 - DNA, 1922 bp, Oryza sativa
ttcaagcattctatatataaacacccagtcctctttgtcataggccttctcaaaatctaccttaaaaatgatcccactttgctttttttgtgtgaagtattcaacacctcatgtagaatcacaatcccttccatgataaacctatttttgagaaaagcattctggttctttgaaatgatagaagccataaccctatccaatctattcatcaacacttttgtaatgattttgaaactaacattcagcaaacatattggtctaaatttttgtatttgagcagcgtctttagtaattatgacataatttagtctctcaatgtctagcacacctctatggaagtcattaaccagatccagtaaatcaccttttattaaatcccaaaatttaatataaaaatcaccaaggaaaccatcaggaccaggagccttattctgttttagctcaaaaactacctgtttcacttcttccagagtgaaacgttttattaacatttctgcatcttcttacctttgtgatcccctctaggtttaaaaacaagttattctgtttgggattaccaaagagctcattgtaaaagtgagtaatgtatgtcaaaagctcggcttgcccagtaatgataccttcctattgagataaagagtgaatcagaattttcctcttcctacattagctttggcatggtaatattaggtattacaatctccctccatgatttccctttctttgctcctctggaaccacttcgttttttcctccctaatagtgaatttcagctgcaattccaggctcttctatcttctctatctctacaactcaagccaacattttcagcttttaagtcaattgcatcaattttgttcaaaatttcagtttttctcctcctatattctccttaccaattcttattcaaaccttttaatttcctccttagatagctaagtctcttttgccatttttcaatgctattacctgaaaaggatttgttccaagcttcctgcaccaaagtccctagatcctctctcataaaccaactaaattcaaatctgagcatactcttttttttaactaattccctagtgtccaacaacatgggattgtgatcagagaaggctcttaccaaagattgaacagaggtgagagggtaaacaaattcccattcattgttgatgaacactctatccaatttttctaaagttgggttatcttggttattacaccaagtaaattgtcttcctcccatttgaacctccctcaaattgttctgcttaattattgcattaaagaggaaggtccacttattataacccccaacttttgtttctctcactttctttcctcagaatgttaaagtctccaccagccacaaagggtcccttagatttttggaactccttagccaattcagctaggaagacagccttatgctctggttgagcagccccatatattactaacagatcccatgtttttttgtctcaaatattctacaactttaacctgatatgaaaattctccatagtaacatttacaaatgataacttgtatatgtttacacccactagaatcccccctgacctgccacatgagagtagccattcccattttaatttttttttgtccacttaagctatgaagtaagccagcagagaaatcatgctttatagtttcaagaattcccacaaagtctacatttgaatccctaattaggtcctgcaaatgatctattttttcgggttccccatgcctctaatattccagaatatgccttttcataattcttttggtttctttttccttttcttaagtttaggagtgaccttgaaaatctcaaggtttccctttttttgtttcatttttctagctgaagattgtatttgcttgagcataaactcaatttcctcaaagtcatcaacctcctctcc

SEQ ID NO: 57815 - DNA, 1530 bp, Oryza sativa
  unsure (1)..(1530): unsure at all n locations
agggcatatatgagtataaatacaagccccccaggagaagaggggtcacgccacaacgcttcaaagccacaagccaacacacgtcgccagatatcaacatcagatataagtctagacataccccatccgactcctacggaggctggcaagagggatctagcaccatctctgatctcgccgagtacggattcgaggaggaagactaccctgttgtcgactacgggttggttatctagccgcctagtcgacgacggctagatgagttatcccaattattgtacttgtgtgattcagatgaataaaggagcaacaccagctgcggccaacaggatgtagggctattacctgtcagataaggggcccaaacctgtataaaaatccctgtctccatctcttttacctcaatctggcatataccctggtaccaccgatccccataccatctaaataacgtagtcgcaatatcaaacgttaacagtggcgtgctaggtagggggattttggtgcttcaaggttttgacgagatgggttcgagggatggattctccgacaacaaaatactcgatgacttcggctatagaaagatctaacccgaccggagtatgtccccgcnagagatcaatgactttaccagnaagcctccgttcgagtcgactgcccgggaagtgacatcgtcaattaattttgattctgttgggacctggattatcctcacccctaacacatagtgagaacgtccatcccgacaagtcgtggcgaggagaccgaatacatcattattcaagaccatcacgtactatttgctcctgacatgtgcacctacatatgcatggactcaatacatgcctaggtgtgcattgatttgacgacatgtacatgcacagaagacaattcagatcggctaccaaggctaattaaggtaattagtagattaattaaattgatctactaattccgtagatatattcggcatgtatctacaaaggtacgcaatattttatatacaatttatcgtacctattttccgatctatacaatattgttagataaataatttattatgtttacctagagcatgttttctatacaatatttattgtgcaagtgtttccggtgttaggccgactacggtttaatgctgggggctcgctctattttcttctgtataaatcatgtttgtttatggtttacataatgtccgatatttaatctgttcattatatcctgataatactagaagatccatgcagtcttttgagtatatactcgatattctctgctatacatcttgtcttctagaaaatatttttcaggaacgattgagcactcgagtaggatgtggtcgagtacaccgcattatcgagaacattctcgaaaaatgttgagttgtcgcacccaacctaccaacgaatattgacaacttatctcatgtatagcatcggctacagctagactatttgagaaaatgttgttaatggataattcctcgcgaacattgtcggcttgatcacccgacatgattgcgaatag

SEQ ID NO: 57816 - DNA, 18882 bp, Oryza sativa
cacaagaacatctaaaaaagacctcaaataactgaataaggggttgcacatccctcataatacttacagaatcagcaatcttgaactctgaagatgttctcaaacgcagcacacatccgaaagcataaggacggcttagcattttgtatctgcaaaatgaaggataaaactcaattgctgctttgtaatatataataatctacgcatataaacagtacattgtacttaggccattctgcgcatacatacaaatagttatagtatgtgacattcagggtactgcaaaaccatcatttaaatattcattaggctattaaggattagacaagtcagatatgatccagaacttgaacagagaggaatattaggatcaactgtcaggatacactgaacatcagaattctatcaatttaactgttctgcaaacagagagagaagaagagtacaagcatacataaatcaaaaccttgggctgtggaaaatttgaaggacctatgatcttgaagcaataaagttgaactgatgattacattgagatacacaactcagatgatgagcaaacttacatatcttgcggaagtgttgattcatctgtacttgaatacatgtacaatgagccaccgctctcaacactaagaactttcaaggaagaaagatctgtgtattcatttgtaattgcaaaaaggtccacacatacacctgcttgaacagcactagcagcctgtgatatgccaattaggatatattctagaatattcttgtaatttattgagcaaaaattacagagacttaccagatttgtgtagaaatttgtctgctcggaaatgaatgtatggtcggatcccagcattttagcagcattatggtccacgtcacttcttgtttctatttggccaggcccgtaattcggtggaccagacaaaaatgtgaatatccttgctgtttaaaatcaggacagaacattatagtagaaggcaaggtcaatcgccaccaaacatagtacagccttcaaaaagaagataagccacaaatgaaacaatagaatgatagcgtaatcaagatatcacataccaagttcaaacaaacttccgtactctgtacataggtagttgacaacagcatccattgctaacccaaaaccgcgggcatgatgcaacgcgtgatcctggacttctgaggcagttgctgttatttcccaggaagatgttggtttaattgtttcaagtgcttcagcaatgcgatctttgcacccgtcgacctgttaagacataactgacataagcatacgacagatatgaatattctaggaaggggcagaaagcacagtaaaagacaaaatcatagattaaaggaattgcgaataagggcaaaactacaatcaacagcatggtatacatacaggagccaaaaaggaacgaagcggcatgacatcttcaaggtcgacaagtaaggtaccatcagaatcaggagggatgaaagcattcttcacaatcggtatcggaccttgaacatcatataaacctatcttgctgctaaatgtcaaaagcccaaacaatgatcctggagggatagctgcatgggatcacaaggatcagtgcacacatagttgcacaggaagctcatgaactttatgatgtccacaatagattagtactagctcctaaaaacttgtggctggatctcaccttcaagagctgctaggagagcacttttgactagctccaagaactcctccgaagctaaaatacaatatgattaaacaaataagatctacagaaaatgagtcgggaagtctagaaagattgcagctgaaagaaatcaatgttattttcatgtaaatctcaatactctttcaatagatacagtgagtccaatttaacttatcacagcaataggattaagatggaatgatcaaatgaatttggatgccatccatcaaggtataatgcatatgcaaaaaccaactcgatcaactaaatggatccagaacttgacagaactgttcacagtaatcaacaaaatgttgcaacgctaatttccttttttttctacaattcaagcatgcttgcaaacacacatccacacgtgttacaaacaggaaccattgctcatgttgatcaattactagactaaatccatggcatgagcatagcaagttattatgttcagttcaaattcacgttcctatggcaccccaaaaaaaaaggggctcacatgctgactagtgagtagtgactattaagcaagcttcatgcattttatagccaaccacctctaaaacgtttcgagacgaaggaattttgagatcttacaggacaagtcgattgccgccacgtacactggcgtcgtcgtcgccgcctctccctcttcccctgccgagaggaaaaaaaacatcagctcctcatcatcacacggcaaccacattgcattacatgagaacatcgacaactatgatccataccagggaggaggaggtccacgaaggcggagcgcatctcgggcgggtcctggccgccgtcgcgggcgtaccgcgcggaggcgtcgggggtgaggtcgttgtcggcggagcagatggcgcaggaccacgaccagcggtggagcgggcagagggtgctaaagtaggcgtagcaggagtcgcagcgcgggaggaggtggccctcggcgccggtggcgggcgccgcgccgcgctcgtcggcggcggagaagggcgtcacggcgacgccccacgggatgcccgaggactcctggagtgccgcgtcggaggggaagcaggcgaggctcgcgcgcaccgccattgctgctgctgcggctgctgcggccccccgcgctgcagctttgggatgtggatctgtggttgttggccgcgaccgcgagagggatctgaggagaagaagaggagggaggaagaggaagccgtgcagcgcagcgtggagtaacagtttacggtgtgtaccgtgaggccattcacaatgcatctacatggcatttggcctcaactgtccagctaagcagattgtatacgtggagaagaaaagaatgtggggcccatatattcaccagctccgcgcgtcctcatttggcgcttttttaatcgcatttgcacatgagaaagcaggacacagagagagaagggggagaagctgacccaaaaaagtaaatttttgtggtggggcccacatgagaaacagtttggtggggtccacctaaagacacgcgcccacgccgcattgtggagagaggagcttcacgctgtttcttcgtacgtggctgtttaggctcctcagaaaaacacaacgcagtgctaatgccctgatggtccgtgtgactcgctcgtgtcgtgtcgggctgctctgctgctgcagcaaaacgatcaggagcatccaatgttaatcgtacggcggcgatgtggtacaagttgcaaggattagcacactgttgttgctgatatcattttgctactgggagtatttctgtatttttgtctatttacaaggttgtccaagcgtgttgtttgttgatgacttaggtgctgtttggtttccaggaacttattccaagtccatgtcacatcggatgtttggatactaatttggagtattaaacatacactaactacaaaacacattccatatccttggactaattcacgagacgaatcttttgagtctaattatgtcatgattttgacaatgtgatgctacaataaactttttataattatagattaattaggcttaaaaaattcgtctcgcggattagctctcatttatgaaattaattttttattagtctatgtttaatactccaaattagcgtccaaacatccgatgtgacatgggctaaaaagttttagccccatctaaacaccccctagtgtcaattttttgttgggaacattggacacacacaaaaacacattataaattacttcatctgtcacagaaaaaaccaatttttgaaaaatccggatatgtatttatccaaattcattcttacatgttgttttttaaaaacagatgaagtagttaaaactatataattgaagtgtttgtaaaatctagtttgtgagataagactcgggcttgacaagcctaactcggcaaaacgaaaacccgtgtgacttttcactcctagcgtcttggatggcttaggggctgtttggtttccagggacttattccaagtctctgtcacatcggatatttggacactaatttggagtattaaacatacactaattacaaaacctattccataagcttggactaattcgcgagacgaatcttttgagtctaattatgtcatgattttgacaatgtgatgctacagtaaacttttgataattatggattaattaggcttaaaaaatcgtctcgcggattagctctcatttatgaaattagtttttttattagtctatgtttaatactctaaattagcgttcaaacatctgatgtgacttgggctaaaaagttttagccccatctaaacacccccttaactgaaccaggagtttggcttgatttggacactacaatgttcagaagcatgaagatggacctgccactctaccggaagagcaaggaaagaagagaggatagtagaacattggccctgtttggaagattagctcagagctaattttaagagctaatgtttagtcatgaattggtaggctaaacattagcctaaggtagcatgtttggatccatgggctaattcaaggctaaaaggtagagagagagtagaaagagaggagagagaaggagagagagctgctttttgatggtccctacacaaaattagccccattagcatctcttgaaggggctaatgttttgagaggagctaattcacattagctcaaaattagcccacttgttttgatttctgagggctaatttgaggctaaaagttgagggctaaacattagcccatggaactaaacgcggccatagtagaagacagggtagacaaggaggtagttttctcttacacgtgaatctacaaacattttgcacactagagcaacttaaaccaaattaaactcacatgtcacatgtactctgaccactactctcctagatttgtacatacataacattatactccaccgatctagatctaattacttgttccttaatttcatttaagagatctgagaaaataattaggtttctacggagctgaaacatctccattaccaccgtagtggatttatactaggaaatggcgaaatgtttgcttcaaaattcactgaacaatgcgccattttgatttgaaatcaaaatataccctaccaaattgttagccattcgaataacactttggctaatgtttggtacgctaccaaaatataccaaataacatatatagcgtgcttagatttggaactaccaaaatatgcttagatcttagcattgctaacattttgacatgatatcaaagcaaacatgtcctatataacgaaatcttggcttatttagggggacatggcaaataaatagttcaaagatgggttgaatgggcaacaattggaaatagatgtatcaactataaaatcaattcttttccataaatgaccgtcagttatttcacttcaggtctcgtgattgccggattcgaagaatgcacacaatctgagcttttgttcgaatgcaaacaggcaatggaagggtgcaagcaatgcagttactgtcaaattctcggctaacaagcaaagccttaagcatcagcattctcaaattctcagctcctcaatgcgaaagaatgaaaagcgattaaattatcacaaagtggtaaagaaagaatagtaatcggtacagattacaattgttagccgttgccgagcacaacaagcagcacaaaccagaatccaacatcagccgggggtagacacgcgaatcgacccaacacgacacgaattgctccacaactttggacatcacacacgattcacagctatccatcgccggatccatcatgagcagatggggcagcggacgaggccgttctcgttgcactcgccgcactggaccgtctccttccgctcgccgtccacgcgcaccttgcggctgccgttgcagtcccggcacatgacgaaccgcacgccggcgcagccggcgcaccagacgcgcgcgcgcgggaggccctgcagcagcgccttcagcttgccctcctcctccagcttggtcacctccgccgcgccgccgacgtgccggccccggacgaacaccgccggcacgcgcacctcccgcccgcccagcagcagccgcagctcctcgcggtagcccgagtccatggacacgtcccgctcgatcaacttcacgtcgtgggcctcgatcgccgcgcgcaccgcgttgcactcctcgaacgtcctgcggatgccgcggagggtggtggtgtacaggacgaccgcgtcggcgccgccgggcgggcatttcccctcggccaccatcgccggtggcgccgccttcgggtgcttgggcttctccgacccgaccatccgcttgatgtgggcgccttcctccgacagctcgcgctcgatggacgccaggagctccgggtcgaacagcgggctcaggctccgccgcgacgacgacattccgccgccggtctccggcggcccgggcttccggacgatccgagcgctcaccggagagaatctcttggacatcctggacaatttcgagttgtcgattgaattgtacggccggaggaccctgtcgacgttgacgtcgccggtcttgttgatgttgctgctgttgttgttcccggagcagcgctgcagcgggctgttctccttcccgggcgtgttcctccgcttcgtcgccgacttcttgggcgacggcagggccattgcgatgacccttgccggcgaccaacgactcggctgcttggccggcttcttcgccggcgacgcatccgcggcgtcggcgtcctccagcccggccataatctcccaggcgttgataacctccaatccggagtccagcttacccgccggcgccggcttcttggcgctcgggaccacgagcggcggcggcctcgcgcgcttccactccctgcttatcggcttatcctcctgcggcggctgagcctgagtctcctgcaccttttcctggcacgccaccgccgccgccgctgctgccgccgctgccgcggcagccgcagccccgtgcttggggtggaggtcgagcaccccgtaggtggtggaggtgagggacaccacatggtcgacgcggccacgcacggtggcgcgcgcgccgcttccccctctcgcgtcgcccggcccgggcgggagcagcttcgaggagatgcaccccatctcgtcacggcgacggcgacagcgacggcgagcaaccaaccacctctctctcgaaacggcggcgcttttcactctctcgctttctcgagccttgaccagagtgggcaacgtctatggcttgaccggctcggggagtagtggggcgttttgtggtgcgttttgaacgccgtgtgagtgactgtgcgcgcaacggtcaccaaggagaggccgagaccgagagggcggtgcgtgactgcgtgccgtggtgacgctggagatttgggcttttgtttttaattttctcgtgcgctgcgcggcgatgttggtagcaattccaacggtcgaatccggcagatggttggtgcccgtggcagcgcagaagccaggaggaggaggaaggcccgcaagtcgaaaaaaggtggcgcggcccgtgtcagagttgccccgctggatcgtacggaggcaaagtgttgggccagtttctttttctcagttatgggcttttttagtctcgcgtgcgagcccataaagtttgcaactttttagtttttcagatgtttatatgcctttttgatctttcagattagtgctttagtttttttaattggatttgctttagttggatacctgattggaaatttggaagagaccatctcaagagaatttggttgatgcattgcaatggttctacagtgtagaaagtccagtgagtgattaatctagtctaacatcgacgacaacacaaggtacaaggagcagcttgctcaataaagaaaagtgtcacacatgcacaagcagaagaagataaagatgacttttttcagagttaacaactggatattagcacgggagatgctgttccaagtactaagaacggatggttgtttgcctcggggaccgtgatccgtcgatataccagattcaggccgccgagactggtccctgcccagccactgccatggtctccggccaccgccgtgaagcaaggcgcttcatctctcccagcccaaccgccaccggccgcggcggcgaaagagcggcgaccgtcggtgacgaagtcgccgttgcgttccactcgttcgtctccagctcaccttcgagcggattgctggaagaacgacataggtgacgcagcgtggcagccacgctcgcccagcacccgccgttcctctcctcgtcctccacgggaggcgcaggcgccgccgccgccgtcgccggcgacctctccgaccgcacggccccaaagcacgaaaccttcggggacccgggatccgtctccaccgcctcgctcgcgaagaccctggcccccgccgccgcgggtgcccggcgccatccgcggccaaggcatggggacagccgcttcttctgcgcgaccatctttcccgccggcagaccgcagatcacgacggccgccttgccggtcaccggcagcctcctcgactcagccgacgacggccgtggcccgcccttcttccccttcccggacgcagcggccgccttgggattagagctgcccttggtggagccatccctctccagcaccgcgccgccggccaactccgcccagatggcgccgtcccctatccgcacgcagcgcgactccgctggggcgtcggagcagccggggagcgcgatggtctcgcacgccaccctcgaccccgcctcgccgccgccgcagaagagggactccagattgatttgcggcatccttgccagctactagcactgactgactggtgggtgagcgattgatagtttctggagagtcagagcaagtggatttaaggggagcgccaaacaaaagacgtggagattttgaaaagggggaggcccgtgcggtgtggaacggcagcgagtaccgttggtgggttgagtggttgggtgaggcgcggcttgccggggagttttggaggtgctttctcgttgtttttagtttgcacgcagccatcggtaacatcggcagaccggctactagcagtgtgtcgaatgcccaaacgcgcggcagtatctagttcatactaagtttggttgaaattggtatgatgtgatagaaaaaaattatgtgtgtatgaaaggtttgatgcgatggaaagttgaaagtttgaaaaaaaaaaactttggaactaaacaggccatatgaagtagaagaattttgaacgaggaagtgcatatgggggctaaaagattgtcttgcttattttttatgcttactaaaaaatacccgtgcgttgcaacggtttaatgctattttaatcttattatatacggtttaactaggatgaaattcactgtaggaattcgcttggatttttttttagaaaatcatgagctgcaattaggagtccgatttttatctcaagttagcatgcaagcttttttaaataaatttcttatacgactttttttgtatttccaaagcaatcgaatttaaaatccaactcatacacggatatttatttccaagagcgaacggacttaaaaatcgactcaaatacggatgacttactaaaatatcggtaaaaacatcttcaatttataatagtagagaatagatataagtcaaagattaaaatttaaaactcaattttaaatttaattattttcatcatagtttaatttgcaacatttgattttaagtcgttcaggacacgtacataaaatttttactcgtaaatatttttttatttacttcataagcatatgaataaataaaataattgtgatgtttgagtttgaattggtacttagtactaataatataaatatttaaattttaataatatattggatacgtcacctatacttcaaactaaataggattagataaaaaacgattatgactttttaatattaattttttaaattcgaaagtaaaattagtaaaaaaataaagacataatggaacatcttactatatcttccgttgttttcatgttatattaacattttacaaattttgaattaataagtatatctaattgtatttatgtcggagttttaatttagcatgtttcataattcaataaatatagagttgcgaactgtttagactttggttctaaaattccgaatcaataaactattagtttgtggtagtatttgacatggactcctatttcatccaaacttcttaagtcaaatgtgaagttacacggtgttttccaaggacatgttttatttaatacaaattcacaacatgatctacaattacaataatatattttagttaattagtataatatttgttgttttttaagtagatttagaaaattttttgtgagttgggtccatagctcagtggtagagcatttgactgcagatcaagaggtctccggttcgaacccggatgggcccttattaactaagttttctaatttttctatttttaaaacatatttccgttccaatctggccaaatccatctcttatttttccaatcatcccatttctttcctctcgttaatgtaacaatcgcaatcccaatctggacgtcgttaatcttcctcatcccaactggccaaatttgctcgccatctcgttccggcccaactgatgggcctctcgtctggcccggacgaagtctccgcggccgcgagcccccgtccggccgaggttgcacacaggacgggggcctgtaggcgagtcggcgtgtgctgaagctccccatcaatcgcgcggttcgtgcgcgcactactacgctagcgccccgcaccaacggcaagagcacacgtttgttgagaactcagtagttcttcattagtaggtaattaaagagggtgacaaaagaccggtctcttagtacagaaatcaaagccagttcaagactgctagcaaaaccggggcaaactatggccggtaaccaaaataagaaagcaaacctagacgctataaacacacgacttcagaaacaaactactactgctggacagaacacaacacaagggaccccaaaacacgcagcgatctccatcggccggaatggatcgatggcgctgccagcgcgtcgtcgtacgtcgtcgtcgtcagcctacggggagctcctcctcttcttcttcccccagaacctgtggtagagctgcacggtgcggccgttcatctgctgcgtcggcctgctgttccggcggtagccttcgtccaggggagccatcagatcggcggcctgctgcggtgtcatctctctcggctgcaacattttagtaagcattcgtgctcacaaagttcagacttggcagaatgcgatgcgagccatgttgctgtcatgatgcagctgagatggaaaattttaggagatgaagctagtgcgtgtgtagtatacgtaccatggcagggatgttccagatcacgttctcggcgcacggtggcgtggtcagtgacccaacgtatctgtagtatatgtgcacgtgctgcctcatcgtcagcaagctcacagatccggcagggaccgggctgcctttctctgccttgcagccctccgcgttgagcgcagccagcttatcctgaatctatcatccatgaagggcaaaacaccacatatcaggaacagaggaagacatgctgctataaattattgcctttgaacggtagaatcgtagtgtgcaccgtgcagccacgtcatatgaatcgggtgatctacctgttcgaagaacgggtctggcctgccaaatcggtagagaaaggccagaacggtgatgttgccattttcgttggtgtgaaccatgtggagctccagtgggaacctgccagagaaaaaagttacaacgaattgtgatcactgatcagcacagaaaaggatgatccattccatatttccagccgtcgtctgcatttcgtctctgttatgtgcaggcaggcgcaaacctgaagccgttgatggtgtgctcggaaggagagtgccagtgcatctgcttcagcgtgtacttcaccccgttaatgctcagaacccctgctgcctcttcgtaccgcagctgaaggaaacaaaaacgactaactatcagaagactgcacaatcagaggagggacagagtagtgttcagtgcaagaggtttggttcagaacaaaccgcgacgttgaagatgttgtcgacaagagtagcatttgcagcggtataatttctatggagtggctccatattcagttcatgaaccaggttgttggtgtcgatgtcaattggggactgctgctttccgttcgagcaacgcgtgaagtcggcactcaaattcccccagaagtcagggccgatagaaccagtgtacccaaacttcacgccacctgcttccaatcaagaattcacatatctcacatcaacgataacgttagaaaatgataatattgcgaaacttgattgtgaaattgtccaaattgacagcagaaacggaagcaaggaattctgaatgctctcatgaaggcatggaaacgactgtaacagtagataaatacacaagcagagtagacagggttcagacaaatactcaatgcagggtagaagaatgtaccgctgtcacatgcaagggacgggagaaagagagtgcacagcagcagaacaaagatcgcatttccatgagaagctgccatcttttcctgcaatgcaataaagcctgcaaacggagaagaaaccacagggcaagaacagagagtagtttggagtcaagccacttgtagaatgagcaaatatataggcattgagcttaatcgcattgtcgcaaactggcaatgtcatggaccaaccacaatccatcttacctctactttgctatatgcagatcagcttcaaccctttggagtttggtccctggaaccaaagtggccgtgctccgactagtagatgttcctgcgaaaaggacaggcaaaagatgtcgattctctgcagccatcacaagatcgatcatatataaagtgtgcaatcatgctggggcaatagtgatctgacctctttgctcgacggctgcaggaatcttcgaaggccagaagatttccaagagcaagaacgctgctgctggtgaaggtgctaacttgggcggtttatccaccagagttcagaagacaccacgtatatatagacacagttttgcccctcttttgcagccgttctttcccacttctccctcttttttctgcagtgacatgacatgcaatttttgcgaggaaatggaggtagtgcttgtcgtggcaacaggagcacgtacgcccattaaccacacgtcctgcaagctcgaatgttgcatgcaatgcacgggagaggaggagatggacaaagcgaacggaaaaaaagattaaaatcctggccacgtctaggcgcacgactacacgagcgagcacacgacgacgcacaaagctcggggtgaggtgttcgtgttgcccttgcatttcgagaagtggtggagaggagagaggctgagtggcttcaccgaacagtcgtccaactgtccaaccgaaagcgtcaaagcggtcatggcctttcaactatacagatatcggatcaagcaacaaaaaccatcatcttgcgttgcttaattgagagtggaagaagacggttgagaagacatgttcagctttgtcaactcgtgcaacgccctaaatcttctatctatcttctattatatactaaaagtccattaaacttcctagaaaccctcctaagccgccacataggacccctagaaacgctcctacgccgccatgtggcgatctaataaattatagaaattctaagaaaatattagccatcgattttcatttaatatatggtaggcccattattttcaaccattagatctattgtaaaacataccaattaaaattatctccaaaacccaatattgccaatctttatgtgcatgtgcacataagtacggacgtttagtaggtattccaaaaaaaaaaggtacgtacatatattccaaggtaaaaaagtacgtacatatgtacataagcaggccgggctaacgacatctttttattttcttttttttcactcggataaaaaaccaaactgcccatattaactatgctctacttacgttgtaaaaatataggcacatatatgtcatcgaaacaccaatgagaagaaaaaattaattaaagtatatattatgtaatagttaaattagacttgcattttttaaaataaaaacaattctaattgtgactagcaattctcaaaagttacctactccttataaaaaataatgatatgtcaaactgatatcattaaatttatcatgaatgtgttttctctattcgtataatatttaaatatcaaagattgtatatattcttttcacaccatactgatctactttatcttctacttatgcttcatttgatctagctggatggctgagcttattcaggatacatgaaacgacacatatcattagtgcaagattaattaaatattgaatataataaatccaaaatagatttatttaatttttaaacttttatataaaatatattttaattatacacaagttgcttttaaatatatacgatgtaggttatggttgtcaatttaattatagtgcataaaatggttcagatggatttagatattattatcaaaagatatgtcttttgtaataattcctatatcaatgggtagataactgggaaaacaaggagcaaccaatctgataagtactctagaacttattgcttatttactaaaatgtttaatgtgtagtatataatatactttatgaataaaaaaatatcctaatatataatcatatgccaccacttatccataagtatataaattttatcaactaatcgtcaagtcatattgcttacgaggtattcattcatagtgcacctaataattagctaccatccaacgagcacttatgtcatgaagcaccatatataacggactatgctaagtggagaactatcaacaaatgataggtaaagtaaagcatgccaccaagccacagcaaataataatcgattacaagtatattgtcagtataagcaatagaattctacacttctacaagaacccttaatatatcacgtaatagatctcataaattagaaaaaaagtataaggaaaaatataaaaaagaaaatatctggtcatcaatttacacttcaactggtagatccattatttttaaccattatattggatatattcgagctaaaaaccaactaatctctccctatgtacgtacctatacaagagatgtcaaaaaggaaaaaaaaagaagaatgtatatatgatctgctccgtctggttgtttttttgtttctttctttgcagcactaaagttttcctcaaattatgcatatatatagtgaaactctttacgatgttatcgaaaaagtcatgccaccgtggcatcgcttcatgccatcccacaaaacttttttaaaatatttttttaactaatgatctaaaacgaaatcatagacactcatataaatatgtgcacaaccatcctacgaatatgcgcagtactattcacaaaaaaaaacaaaaatatacatacgtacaataaaaaatgtcgcatggaaacctattatatccttatataagtatgtcattctcatctaaatagtgttgacaaaattagcacaaataattttgacaatatgaattattccttcgaatattacccatgaatatacgtaggtgacttagatgtatagtaaaagaaaaaaatctaaacccatattaacctgtatgtttacgaaagatggtgatatgcgactttatgtatagccatgacaaagtgaaatttgtttgaatataatagattttatcaattagtatatcaaagtttataatttatttcacataataaatatttcttattttatattataaggtaatctatggttcttaaaataaatacggtaacatatggtttattttagtattctttctataaacaaaaaaataaattgcccgcgcatctgcgcgggcttcctttctagttacactaaacatgaatccagtatcaactctctttttttgaggtaagataatgagtcaaaatctagtactacatccagtagccaactggtttgtctggttatgagtatttctgaatttactgtagtccaaacgacaagcatgaaatcctatatcacttttggcagcactaggatagcaagattcatctctacgaatggctgacctgcaaaatggcaaaggacacatcatcactgagcagtctcagctggaggaatatatcccactatgtggggactgcacactgtagggctgcaccgaaaggaaaggaccacaaaattttcaggctccagagccccatagcacattctggatggcttcaaggatgaagaaaatagtatatgtgccttgaagagcttgacattgataaatgctagccatgtctcattgcctaccacttctttctttttttttttcgtcatcttttcttttgaagacttcattgcctaccacttcagcaggcaaaaaaagttgaccctgtcaatatcaagttatcaacaggctagagaatattagaacaggacaagacttaaagagcatatggcaggccaaatatataatcttttgataagagccacttccagctattaaaaacatggggattaccagttttaacttggtatattagccgccccataatcggtaagtggaggaggataaggcccatggcgctttctggtacctgcaaagcatgaagcggtcactattaagccgtccacaggtattattcagcgtgcaggcaaaatgcatggagcacactgtagaatgtggagatgcaacgacgacagcggaatgtgaatagcagagcatgtcaacagctacttgtcacgataaagattgaaaaaaatctgaaaattcattaaactttctatgaatgctcttaaaccaccacgtgacactcctacaaacacttttaagttgtcatatgataatgtctaatctcaccattgattttcacttaaattggtggacccaatattttagaccattaaattagtgtattgtttttgttaaaaaaagtgataccttcctcctgtattctgtgggttggaaaaagaaaaaaaaatgtaaatactttgtacgtatgtaccaactgaaaaaatgaagcttacctactattcaccggaagaaaaaaaaagtaggtaaagaatcgtacgtacagacttatgataaaaacgataaagtaaaaaaaagacgcacttagtagaaaaaaataatggtattttaaattaggtttttctactattttttataaatatattactctacaaatttacgcgaatgcgtcaacctccccggtgtgatcaaggtggaagacgagggacgggagtgggagtggggaatagggcatccaggcaacttcgcgctcctagatccgatggaggcagcgacgacggtccagctcaggattgggggtgggccaagtgatgagtggggtaggggcatgagaaggggggagcgcctcggcgatggtgacaacggtggcgaaggagttttcccatttgagttgatctctagattgtagacgaaagcgcgagcgaggagaggagggagggagggaagtagggagggagggagggctacgtgaggtgctaggggacggcgacgcctcggtcggctggaggctgcctcggcatggtgggcaagaggagcgccggcacaaggcagcacaccgagcgctgcttggcagcgaaatcttcagtggctgggccacttacatgttggcctcacatatttttttgctgactaggataccacgtcagcaaaccgcacatgacatgtcatgggacttactttacatggttttgaatacttgagggtagatatttctggtattggtgattagggatgttatacagattcaagtactcgacgtaaagttgagggatagtaagtggacttattccaacaaagttgaaacacggcctgcaaaagcccattaagaatctagcctgcgagccaaccgagaaaattcgcggggatgttcggctgtttcggtttcggcctgcgtaattgcgtgggggtgttgcccagtgcgcgaggagagaagcccacgccacgccacacctccctcgctctgctctgccctgacctttcattggcctgcctgatccgctcgtagagtggggtcatgctcacacacctcacaactcacaagtcgaatacgtgtctacgcgcgtgattcacctgccactgcccgtggtatgacgattgacgacggtggaagaggacatgatctatatctatactaatatttatatattaatataaaaagtacgagttcatccagcaatcctctaatccttctgatccactgtcgcgtaggacccatctgtcatccaaagaaaccgcaccacgcacggagaaaaaaaaagagacggtgcgaaaaaaaataacgcgcacgctcggcggacctaacccatcgccgcgccgcgccatccccacgctgcgccgcccgctggaactaacccacggcgccgccatcccccacgcacagcaagaaatcgctaatctccgcccccacgccactgctccgcctgccgcgccgcccgccccacgccccacgctgcaccgcccgccggacctgatcccgcctcacc

SEQ ID NO: 57817 - DNA, 512 bp, Oryza sativa
tgagcaaagaagatggcgattgatggcacatttttttttctaatacataggtggggaggatttgatgagatcttacttttttgctccgagaaattgagatttcgccaacacgaggggcaaagtggggagagaaatggagtttctctgcacgactcctgatcatattcccaacgcctagataaagagaggaattattttgggattgcattcaaaagcgacggttaattatacagaacaccatatattgtttgttagagaaaactcttatttaatacctaaagcacttatcagtctacataacgtatgaaatcggttattgtgcccctaaagtacgaaaagcgttccacataaagtattctatagtttctgggaggtacttttaagctagttaaagagatatgatattaggtgtgtgtgtatgtgtgtgtgtgtgtgtgtgtatatatatatatatatatatatatatatatatatatatatatatatatatatatatatatatactatatata

SEQ ID NO: 57818 - DNA, 24584 bp, Oryza sativa
  unsure (1)..(24584): unsure at all n locations
tagaatgacttacattgtgaaacggagggagtaccaatttaaccctactttttggagtttgcttatttgaccctccttttaaaaaacgaagctcctctctgaccctattccttttaggtgagttcatggtgttaagttagaggtaaatagtccattttgcccttgcttatttgaccctattatatcttgcttgtttgaccctactatgtcataccgtgtatatatttgaatactttgacatatttgtaataattttttcataagtttcacattgaagacaagtttgacagatttgtcataaatttggcaaatttgaatcattttgtcaaatttgatagaattttgacaaaataaattaaacaaaatttgacacagttatgacagatttggtgcgcgccttctcgggccccatcgtctccattgtcccgccgaaggcgcgtggtgggagccacctgacgcccgagccgccgtcgcccaaggtctcctgcatcggccaaatcaagaaggccaacgccaagaaggtcaaggcgtgctgcaagaacggtgcatgccgctgccgccccggccgccggccgactccaccgctgccacagcgcgcagctggcagaagagctcgctcgtcaggcggatgctcttccgccgcagcaggtcgaggaaggcgtcgtcgtcgcccccttcctgcgcttcccgccgccgccgctcccttcctccatgagccgccgccgcccctttcctccgcttcccgccgccgccgctccttcccttcatggccgggcgccggcgtggatcccgccgccaccactcccttcctctgcgagccgccgccgccgccccctttctccgcttcccaccgccaccgctccttctcttcaaggctgggtgccggcgcgggtttgccgagcgggggtcggctttacgccgccgtcgcacccgcagacgcctcgccgcttcctcagagcgccgccatcgccgctgcaccacctgccgccgccgccgcaagcccacaagcacgagagatacaaagagctgtggatagggtttggatggatagggtatacgagggtactttaggcattacgaataataatcacatttttttttaaaaaaaatcaaaccttaacggaggagtggagacagggtcagacgtgagctttattttttaggggggggcggggggtcaaataagcaaactccaaaaagtagggttaaattggtagttagagtctaaaacggggtcaaataaggaattgtccctaaatcttttggtcgtgtatattcaaaggggctattttgaaggctaactatcaatttgaccctacttttttagtttgcttatttgaccatgcttttcaaaatcgaagatgaaagtagaccatattccattaagacaagttaacattgttaactaaggggcaaataagtcccttatgcccttccttattcgactctattatgtcaaaacgtgcatatattcagacctttagacgtagttgtaacgaatttgacatatctttcacatttgacacaagtttgatagatttggcttcaatttgataaagttgaatcagtttgacatatttttgacaaaacaaaataaacaaaatttgacacaaagtagcccctcctcgctccgtgctgccaccttgccgcccccctcctctctctgcaccgacacccgcgccgctatctcctccctctaggcgccagtgctgccaccgctgccgccacctccgacctaatgtgaccatggatactatggatacaaccgttgcttatatcatggatcaacaagaagacaacaagatcaagtcctccaagtgctggaattcgattcggccacctactacattgttgacttcaaacggccgccaaatatgcatacgagctccgttttgggtccacgagtacttgatggaaagctctcggagttctctttccaaggatccaacctcattgtgaaattccatttcatttagccgcaattgaaaaaacaatgtgatgtgtcacctgtaatgggtctatgggcttgtaactttgtctgggatcccggcccaagtggggcccacgtagggtgtgccccaactttcacgcgcctacactggtgccacctcccttcattcgaggcataacgttaggcggaggctacgcccctcctccctccgtgccgccacctgcgctggcaccaccgccctcctctcttcgtgccaccaccaccccctcctccctccgcgttcggcgccgccgtcccctctctacacgtgttggtgctgctgttgccaccgcctcaccctccgtgcacctacgctgccaccccgcgagtcggcgccaccgcagctgccgcttgcaccgagagaaacaagagagagagagataagggtcatgtattgaggtcgggaaatgtataagattaaagggaggtaattttggtttgttagagaataaataatttttttcttttgcgaaaatgaaaccctaaatggtttagtgcaaatagggttcgattttgagatgtaggagttcaaattgatagctagcatttgaaacagggtcagataagcaattgttccatatttaaaaaaatacatacagatagatgaaacgaaacacaacttccatgactgcattaagatatcgataggaacaattttttttgaaaggaatatattgataaaaacatatccagtttctttttcccaaatcttaagtcatagacttcctaatcctggatagtttcaaactctaggaagcaggatcaggatacttgttctacaatgcatccgtttagtgcaacaaacagctctacgggtggcaaatcaaatgcaagtgacaagaataggattttaaaagaagaatagaaaacacgtagaatattcataggcatgcgaatgcaaaacaaataaaaaacacaggaatagtcattcaaatataccgtaggaaaaccagaaaaccataggaatcaaatgaaagatagaattgaagaaaatttttcctaagatattaataattgctaactttcctctaaaatctctacatgattatccattctaatagaattttaaaagggaaataacagaattcaatcaaattcctatagaattaaaatcctttaaatttactatattttttctacaaatcaaatgcgcccttaaattggtattcttgatgcataaaatttcagaatctccattacccaacaagattttaaacttatttgctggtcttccaccagaagactctaacgaaagatctgctggtctcatcacccaccggctcagaagaatgcacaagatcggtaaagtcggatgacctgtgcggatcatgcccccatcaacggacatcaatcttagattgtgtttagatttaggggtgtaaaagttttcatgtgtcacatggaatatatacgaacacccatttgaagtattaaataatccgtcagtaaaccacgagataaatttattaaacataattaatccgtcattaacaaatatttattgtagcaccacattgtcaaattatagaacaattaggcttaaaagattcgtctcgcaaattagtcgcaatctgtgcaataagttattttgttagcctatatttatataggtgttcaaacgttcgatgtgacatgattaaaattttggggtgggatcttaacacccccttagtggacaaacagaatatatctattctaaatgcagttccgcaaacccgaccaaaattcacaagaatgtatattagactttctcctgagaaattttaccttcagaacaattgatgataaccttcaaaggcaccgattcacacctatttggcacgctatattaaacacagatcctagttgtggcatggcaggccagtcctatttgtggtcaacacggatcctcggccgaatttgtgtgacagcaatcaagtcaatcccaccgcaaccacattacattttcttcggagctaaagttcctatgcaatcaatttatgtttggagctaaagttcctaacaatcatatttacccttttgagagggttcctaagcaattactaaatcttcacaagtcacaacatgtgttgtgaagactgaagacatacattcctgcgttggaagtcacaacatgtgtgtagcagcctagcaggagaacaggtgatcagatgccaatgcatttaaccagatgctgtttactgcagccgccagccaaacataatgctcagcaaaggcaaccaactatccctctttcatcttgtcttctacttcatcagaagattcaacttttggagcagcctgtgcctcgcccatttggacatctgaagctgaagctgaagctgaatcattcagggttttgaccggtgctgctggcaaggtagcagcaggcttgcctgttggctcttcttggtcttggttagaaaccatggttacctcatcagtgttcacatccatcattttgtgctgctttgggggtttctgctccgctgagctcttatcattgtgcgacaccaaatcaaccacagcctctttagccatacctgctgctctagcagcatgcagaatctgaagcctgtagtcagtttctggtcggcgacataccttcctcagtggaacaatttcctgtcattttaaatggaattttaatgattgtaaacgaatcagagtaaaacacaataaggttttagttttattcaacaaagtgaaataactagcaaaagcccggtaaaatacattattttaggtagttcggcaataaaaaataagaaaggcgcaagacagcaggatgcatgggctaatatcatatgaacttggaaaatctatgcatgcatacttaaattttcagagatgatgaatataaatttgcatggtgtccttaaaattccacatctagagcataaataaaaattgcttaaacttctacaggaacctataggatgatgctacaacatatggtactcacgggtataacgtgcacaagctaatatcatatgcataaggtcgttaaacttgcacagtaaagcgttgatggaattgcgtatgcaagttcaggaacttaaacaacgacgctttacttatgaagtatatcattaaagccataatgtaagagaataaattagattcttagagcatgcattactacaatagtcacacaacattcaacgggtgaatgcagtgagtaaaatacctcagagtgatcatgatcgtagcgaacaagaaatctacagcgacaccctcgtacatcatgtctacgcctttgagcatcaaggacacaagcatcgaaatacagagcctgctctttgccttcctggtcaatttaggacagatgtatttgttcatgttagacaacaatttgagtaaatgtgatacctaatcataattataaatagcatttcatcaagataatcatcgaagaacatatatttatgtttagatttctttatttaaaaagcaggaacctaaatgtgtgttcaattactggtttacagttttacaccccttggtgttttgtgcatcaagtatcaaatatgcatgactttttttggccatgttttaaggaaaatctgtgatacatttttttagaacagaacaaacagaaatcaatcttctaacttaaaattaaaattttgaattcaactacacatcaattctgaatctgtgacatgtagatacagtacataggtcaagaaaagatgtctaagatggcaagacctgaaagcaaagtatgaggtctccaggaagaacagcaacacattcagttgattcacacggaagagaacgttgccgcacacatttacggacatttatccattcatcttcctcggctccaaatccagaaaagcgaactcgtacttcctaaaatattaagaattgctcatgtgagacaaattatttataccacatgttgtaactaggaataaatgtcattgtgtatacacagttttataaaaataccggcacaacaacgcaggcatgtcatattggcatatgttggaaaaaaattattcaactgtagtgccaattttagatataagccagatttttttaaaaaatacagaatgttctgaaagtcatactagaacaccaataatgcagtagaaacttgtttttaaaaaataattaaagaaaaaggattgagtatgcaaccgcattaagataaatgatataaatcgaatcagctacaggttcaaagctagcaaagtgctttcaataaagaaagccagacatgcatttagcaacataaattatatctaataaaaaaactatgatccttactggatcaccagattcgaacaaccgatgagacaggaaggcagcaacatcatacctgcacataaaagcttagttatacacaaaaaaaaatgtaaaaacacagagattacaatttttcaagaacatagtgtagaaagtatctgaactcgttgattcatttgcatttgtagttaatgatcaggcacaatattcgttgagcacaaatatacatttgtttaggatggctaccactaccatagaagtgaacttatatgaatgacagaccataagaatgctgatatacttaatcagatgttaaaagagatcttgcgtaaccagttcccctctacattgggttgaatgaatttagttggatcttcaattcaaatccaaattgaattcgaattgtcatctcaattattttcattgtgattggttgccaaaggcatctcaaatagaaatgacctctcaataaatatccagtttaaggttggatgcaatacgcaaatgaattggcacattggaagcaaacaaacaaaccaggaggcctgatgttccttcttgggtagttgccgaagtggtggctggagcatcactggtgtgctgaccagagcaatcaatggccacagcggctactagggaagtagacagcttaacagcagattttgtcagggacgctgacaaccagagttgagaaagatgaaggatgactgctagagttaaggaagaaggaaatggccactggagtggtgaaagaagggatggcagctgtaggtctagaaaatagaccgtgaaacagtgatagtggcacaagaaattggtgaatggtcaccagtgaaagatccagtgaaagctccaatcatagtgctctgaattggtggaggaccaatttagttgtccaccgattcagtcggaaatggcctacaactccaaatcagaagagcaaccaacgacggaattgagagatccaattctaattccccttttctagcctcagttctggcatccaaatggggtcttgtattcaactttgtagatatgaacacaaacataaaaaaaaaacacagatcaataaagaaaactgaaacctaatttaacagtatctgacaattctatagcaagcaattctcttcataataaagtcagcaaaactgagatacaaacctatataacaaacaagtatgctgcttagaagttagaatggtgattaagaagcaatcgttaaacttaaactcagtatagagcatattataaagaatacagaacaaagaaaaccatccaaaacagtgaaatactaaattgcaagatatgacctgtgaatcactcagtcacagatggatcattcggccatcagtcaaaccacatgctctattttataataagaaagctatcaatttgtgatctgtgcaggcaaggttaatagaacttatatttctcacttacaatgttaaccaataacacaggtgcatctggaggtttactgttgtccatgctatttttgaattttactgaannnnnnnnnnnnnnnnnnnnnaaccccaccaggctgtaggaaaactggtcagttcagctatgatttgcaggccaatatgggaaacaatccaattagacgggctgatcaagccagaactttaggttcagtttattccagtcagaccactagtttggtccaagtctgataactatgtgtcaaacagcaagcaaaacgccatgaacctactcgtacatggaaatcaaaagacaaaagacatagaagtaacatggataccatgcgccatctctagccgactttgcttcaaattcaacctggccgctctccaaagaacccttccctgattttgaacaccaaagatcaacaatcagaggataaaaaggaatgataaacaatgatcatgatgcatagatggaaggttactaacatagaaccaatacacggatctgacatatggccgaagtatctcattacttatagggttaattggatccatgacattataaatttgcctgttttgaaaaataccattactattcgtctagtcggaacggtgccattataaaattgttgaaaccggagatataccactacctactcctaatagcaagagtaacatgagcaaatgacctgagggcgagccggagtgcgcagaggcagagggcatagccctgaagggaggcgacttgtgctcgtcggaccccgtgggcagcatcttggtctgcatcagcgtcggggggcccctggagctcctggagcggtgcgagtacctccggttctggaaccagttccacacctgcgagtgcggccggatcgagatgaggcggcgaattccccgccagggagggggaagaggaaggaggaggggggaggaaaaccctaatggtaacctgcttgggctggacggcgaccttgccggagcgggcgggggaggaggtgaacttgtcggcgagggcctggatgacggagcggtgcgggatggcgttgttgagctgctgcaggcgggcctccatctcggccacctccgcctgggtgaaccggaacgccgggccccccgtgctcggcggccgccccatcccgaccacgccggcgtctgcggctgcgaggggaggggattagttggatggatccatgattccatgggggaatcggagaggaagcgagcgagcgagaggagagatagacgttaccagtgatgcagcgatgagcgattcctcgttcaggcaggcaggcaggcaggcagccgctgagagaggggatcggtggtggtgtggtgtggtgtggtgtggtggctgcccccctattactcgtgccgaattcggctcttttttcttttttcttttcttttttaatcgttggatgtgtcacgtgggtggcctatacattggcttcaggtccatcaattgttgtaacgcgtatctatgcatctgttcttaaaaaggttaatttgattcataccattataaatgtgtctattcatataaatatcgttataattcgtttattcataaccatgtctctcgaattttataaaattagaatcataacagcactgtcactttttccatcttcttcctcatctacacgtgggaagcacctgtcagattcatcttcttcctccatcttcccctcttctcttttcttccctattctccaccacttgttagcatcctccccaccaatccatcccgaccccctcctcgctgcagagtatgcctctaccctcgccaacgcgggagtccacgtccctgacctccgttgcctactcaatcaatgcaagaactactcgatgtttggtgcacgactgtggcaacgagttcgacctacggccgggagaagcaccaatggatgcacgatgacggcacgctcgcctactcaatcgacggcgtctagtagcgaggtactcccacttgctctggcggcctgttgctgtgtgcggcaaggaaggatcaggatggatgtatgtggaagaggctgagaagcggtggataaagatgggaaaaaaaggaatatgggaggatgaaggaagaagatgaatctccaggtgggtcccacgtcaagatggaggaagatggaaaacatgaccgtgatgataatgttctaattttataaaatttgagtagcatagctacgaatagataaattgtattgatatttatctaaattgtggagattatggataccccatacccacatggcatgtatatccgactgggtatgggggtaccatgtatagatagatagaatatctttaaagggtttcgggttaaattcctaaacttgtatatcaaggaagcacccgggatttcagtcggttacaattgtattttatctataactgcctattccgttaggaatatgggctgtactttgtaatacggactccttcccctatataaggaggggtccgggtgcctcttggggcacgatttttctctcagatcatacgatcaataatatactcggcggatcaatcctcggacaggagtagggtattacttcttattaagaaggcctgaacctgtataaaattccttgtctctaaacccatccacttttctagcttgatagccacccccttttagtattgccgaaatcttgtttcgacagttggcgcgccagataggggtagcgtcaagttcttcgccgactagtgcgatgggtttcgtctccggcatcgacgacttcgtcttccctcccgagcaggtgttcctgttcggcagcctcgacttcatcaccaacgactttggcaagatttctctccttgactcggatccgaaccagtcagggagaggccaggtctccgtcccgttcggtatcccaaactcggccgagatctactccaaaatcatctcaaccgagttggcttcaaaccactcgaacgagatccaatctactccgacacgacctgatcaagatgatggggcctatccctcaatcctgatgaaactccccgacgatttggccgctgttttcaccacaaggacatcttcttcccgtaggcctagacgggatccggccttggccccgatccaatctagctccagggaagtcggcgttatactccaacctctcgggacggttttgacggaagaattagatggctaccttagcaaccccggtgtcgattctcgaccgacggagatcctcgagtacgacgacttcggctaccactacgactacagcaacctcgacgacttcgacgaaagctacgaagacaactacacgcctctcttcttcggcattttcatggctgacaacgagacggcagaacagcgtcaagcccgagaagcagaagaacagcgcgcacgacaagaagccgagcgttgccgactggaggaggagcgactagcataggagcgagaccggctgcagcgtgagcaacaggagcgtgaacgggccgcaaaggaggctgaggaccggcgacagcgcgccttggaggctgggcgacgagcacgagatcttatcggacaacaagacattgaaaggacggcggtttttcgcaccctgcagcagaacgcggtagccgcgattacccttctggacactctacttcagcaagatgcacctgaccacgtcgtcaacatcttaaaccagaccaagaccatgatcgtcgcctcggtcccagtgattttctcaagcgtccgtatgccgactgacagccgagttccacctcttcgatctaaagactatcaccaaccaagccttagcgttgccggcgcgggatctagtcgcaggagcagggatcatggtgaacgatctgttcactcacctgccgaccgacacagggagcgtccggctgaacagcctcgctctccacgttgcaggcgtcccatcgatcttcgcgatactatcaaccagcgtcgtgcggcgagaggccacattccctaccaatcactagatcgttacgacgacgatgtggatggagttgccgccttcacaagtgacttgcgtcgagtggattggccagccggcttcaagccgactggaatcgagaagtatgacggcacgacaaatcctgagtcttggctcaccgtctacggtctcgcaattcgcgcagcaggaggagatagcaaagccatggctaattatctgccagtgaccttagcggactctgcccagtcctggcttcacgggttaccccgtggcacgattggatcttgggcgaagcttcacgagcacttcatcgccaacttccagtgcacctttgaatgccctggtacctagtttgatctttacaatgtcatccagaagtccggagaatcccttcgagattacatccgacgtttttctgaacaacgtaacaagatttctgacatcaccgatgacgttatcatcgccgccttcactaagggtattcgccatgaactcttagtcggcaagtttggacgcaagcctcccaagacagtcaagcaaatgtttgaaaaggccaatgagtacgccaaagtagaagacgctgtcactacatccaagcagtcgggcagcacctggaagccaaagaaagatgcgccgactacggggggagtggaagtgccaatcacaaagatcgcaagcgtaagcccgaggaacttgtggcaactactacaccatcctcccgacagcggtcacacatcaacaccttcgacaagatcatgaatgcccaatgcccgcatcatctgaattcaaaccacgcagccaaagattgcttcgtctacaaacagttcacagagcaatatgccaagaacgcacggaagtcgattgacagagatcaaagcacgtcgaagaagaaggatgatgaagacgatgccccgactggttttcaagactctcgcaaggaactcaaccatatctttggtgggcccctagcttacaaatccaagctgaaagcaaaagctgactgaatgggagatcaatgctgttcagctcgatacgcctcaatatcttcggtggtcagagacagctatcaagtttgaccactcggatcatcctgactgagtggtccactcggggcggtaccccctggtactagaccctgtggttcgcaacgtcaagctccgacgatccctcatcgatggtggcagtgcactcaatatcctttttgccaagactctggacgacatgcagatccctcggaccgagttgaagccaagtagtgcgccctttcacggagtcattccccggctatcttctactccactcggctagatcaccttgccagtcacctttggcactcgggagaactttcgcacagagaacatttgcttcgaagttgctgactttgagacagcgtaccaagctatactcagacgcctggcgttacccaagttcatggctgtcccacactatacctacatgatgatgaagatgccaggacctcgaggagtcatatctctgcagagtgacatcaagcaagccgtcacctgcgacaaggaaagctgcgagatggcacaaacacgcgagatcacgctcgctcgagaggagattcgactggctgcatcaacagcaaccgaaggagaagtgcctgcacccaagatatcaaagagcggagaaagcgacggcaagactaagaaaattcctcttgatccctctgatcccaccaaaactgctgtaataggcgccgagttagactgtaaataggaaagcgcgctcatcacctttcttcaagctaataaagatatttttgcgtggaaaccatctgatatgcctggtattcttagggaggtgattgagcactctttacacgttaaggaagacgctaaacccattaagtaacgactccgccgttttgtgaaagataggaaagacgcgatcaaggaggaattaaccaagctgttagcagccggcttcatcaaggaagtcctacatcccgattggctggcaaacccagtcctggttcagaagaagacaggacaatggcgtatgtgtgtcgattacaccgacctcaataaatcttatcctaaggatccctttgtgttacctcgcattgactaggaagttgactcaacggccggctgtgagttactcagttttttggattgctactcgggttatcatcagatcagcttgaaagagtccgactgcttgaggacctcattcattacgccttttggggcttactgctatattactatgccttttggattgaagaacgccggagcaacttatcagtgcatgatccagaagtgtttttcaactcagattggtcgcaacgttgaagcttatgttgatgacgtagtcgtgaagaccaagcagaaggatgacttaattgcagatctagaagagacctttgctaacatccgcgccttcaggatgaagttgaatcctaaaaagtgcaccttcggagtaccgtcagggaagccgcttggctttatggtatcccgtaggggcatacaagccaatccggagaagatcaatgccatcctcaacatgaaaccgccaagttcctagaaagatgtccaaaagctgactggatgcatggcggcgctcagccggtttgtctcacgactcggcgagcggggatgccctttttcaagttgctaaagaaaaccgacaatttcgagtggggacccgaagcccagaaagcctttgaagacttcaggaaacttctcacaactccaccagtcttagcttcaccacatccgtgagagccgctgttgttatatgtgttggcaacatctcaagttgtgagcacggtcctggttgtcgagcgtgaagaagacggccatgttcaaaaagtccaacgaccaatttacttcgttagcgaggttttggccgactccaagacaagatatcctcaggtacaaaagttgttatatgatgttttaattaccgtcaggaaattatcccactattttcaaggtcactcggtcacggtggtcacattgtttccactcggagacatacttcataatcgcgaggcaaatggacggattgtgaagtgggccctagagttgatgtctttggatctatccttcaagccacgaacctcaatcaagtgccaagctttggcagatttcgtcgccgagtgaaccgagtgccaagaagacacacctacggagaagatggagtactggactatgcattttgatgggtcaaagaggcttttgggcactggagcaggggttgtcctaatttccccgactggagaaaggctaagctacgtactgtggatacatttttctgcatcccataatgtggcggaatatgaggcgcttcttcatgggttaaggatcgcagtatctttagggattcggcgtctaatagttcgtgaagattctcagttggttgttaatcaagtcatgaaagaatggtcctgcttcgatgataatatggctgcttatcgacaagagatacgcaagttggaagacaagttcgatggcctggagttaacccatgttctccggcatgataatgaagcggcccacatactggccaatttcggttcgaaacgagaaacagctccttccgatgtgtttgttgagcatctttatgaaccaaccgtaccaagaaaagaaacgaccgaggcagtggacactcaagaagtaagcatgatcgacaccgactgcagagagcccctcatcaagtttttgaccaagcaagaactccctcaggataaagacgaagccgagcggatttccaggcgcagcaagctttatgtcatacatgagaccgagctgtaaaggaagagtccatcaggaatcctgcaacgctgtgtttctttggaggagggaaggctattgctaagagatatacactcgggcatctgtgagaatcacgctgccgcatgaaccattgttggcaaggcttatcggtagggttttttcggcccactgctgtatctgacgccaataaaattgtgtgaacatgtgaaggttgtcaattttttgccagacaaactcatttaccagctcaggagttgcaaactatcccattatcctggctgttcgcggtttgggggctcgacatggttggccctttcaaaaaggctaccgatgatttcactcatctttttgtagctgttgacaagttctcccagtggattgaagccaagctagtcgtcacaatcacagcggacaaggctagagatttcttcatcaacatcgtgcaccgcttcgggttacccaatcgaattatcaccgataatggtactcaattcactagtggtgtgtttaaagatttttgtgaagactttggcatcaaaatttgctatgcctccgtagcgcaccccatgagcaatggaagttgaacgcgccaatggtatggtacttcaaggtatcaaagcgcgagtctttgaccgactgcgtccttacgccagcaaataggttgatcagctgccatctgtactttggtccctacgcactacgcctagtcgggccacggggcaatcaccgtttttcctggtttatggtgcagaagcaatgttgccgagtgatgtagaattcgaatccttgtgatttctcaactttaaggaggagcgttacggagaagactgagttgatgatctcaatcgactggaggaagctcgagaggcagccttgatctagtcggcccggtatttacaaggattgcgacactatcacaaccgcaacgttcgatcgcgggttttcttagtcggagacatggtcttgaggaagattcaatctacacgagatcggcacaagttatctccgttatgggagggaccgttcataatttctgaagttactcggccaggttcttatcgactcaagcgtgaagacggttctctcgtcgacaactcttggaatattgaacatcttcgtcgtttttatgcttaggcattacttttgtatcttttttccctcttttgactactaacatcaagttgcttcttgagttatcagtcaggggctactatagtaataatggagtgtgattcttatcaattcaatttggttacttggtttatcattgccttgtttggttttttggcttagtcaatgaggtctgagagttttttaacaacttttacgggttctaggctcaataaggtttgacaaaaacttttaagaaatcaggagctgagtttaaattatcaagcacagcataaatacatcagtactgtacaaattgtgcctccatcatcacaagtcacattacacaatgtcaatcagactcagttttttcatcatcagatacatcagccctagtcggaccaagattggtatcatggaatctctctacgacatctacaacgatcttgtccgcagttttctgggcatcattaataagatcaagggcatcttctttacttgttccgtctgcaaagccatcaatatcatcaatattgatcttcggatacaaggatttagtcatcgccaaagccatgcttgctcccatactcccagcttctttaatgttcttgaaatacacatccggagcggtcctcagcttgtcgaagatttcaacagcgttgaataaactcggaccattgttattaaaaaacatagcctggatgagtggtgtagcagtgtcggtgatatgggcccgggggtatcgtgtttagagggaggaggctgccccctaaaggtggggtggcggccactccctcccaaagactagtcggaggaggctaccccccaattccacgtggccctcccccgaggggagtaaggcccaaggtgggatggcggtcactccttcccaaagactagtcggaggaggctgccctaaaatttttacattttggtcctttttgaaaacttattttacaaatagacccctgggaaaacttaaaccggaaatggtcctttttggggcgctagagtggctggcgccgtaccccaacatggtggcgccagccatatttgcgccgtgcccgtgccaccatggcactagggctgttgtggaggtgctaactgggcagaaggggggcgctagccacactggcgccgcccctcataccacggcgccagcatggctggcacgccccttctctgtgggccgcccccttaaaccccatgggccccgccacctttctcctccccactcccattttcgcccaagcactagcccgagctgagcagcggcagctctccccctctctctccccctaacctccccacctcaaatccactccattcgaactagtttttcgtgggattttttgtggaaatcgaagagaaaggtagactcctccattcccccctcttttttttcgtttttattggttgaatttgtagatcgaagggtaaccctagaaaccctttttttgcccaaatttgtgatttttagcatttgttcttgggatttacttgttgtagtgctacatgtttgcaatgtactcattggtgtcacgatttttttaaccatatatgtggtaatgttaatttttggattgtttggttggatggatggatgaaaaattagggttgaggcatgaaagtaattttaatttgatggagttgatgctatagcctataggttaaacttttaaccattaattatatgaaggggagaaaactttgattgcattatagaaattgattatagttaattagaactaggttgggttgtatgacggagtatttgtaatatttcgatgtgtaatgcactagtaaacttgctgatagttgtaggtggattaaatattttttttggagtagtagctttgggacaaattaagttatgcattggttataatatgtcggtttggactacgtttaggaatgaagatttaatttttgttgcaaagttacatttgattttttggtgtagatggatagaattgttcgtgtttactatggtggtagagtggtggaaccttatgttggtgcacatgttgagtttgaggatatgtcattgaagaccattttgtttcccacccacccaactctagatgaactaaggtcacgagtgaaagaagttcttggatggactgaggataatgtggagattcgtttttatgggagatacgatgttggtcaagggcataagtatatattaaatgtgataggtcagttggaatgggaagtttactttgatttggtaaaagagtctcagtttagatctctagaggtgtttgcatcaaagttggtacgtaccgtagaaaatttggatctaaacaaatctccttcttatcattacattgagaagaattttgtgacatattcttctcgtcgtggaggggctgcaagtaagactgagttggtacgagaagacttggagggggaaggagataagaagagacctttgcttggaaatgatttaggggaggcaggaccatcaaagaaacattgcggtagtgatgatgtggatgcagcgaaggagatgaaaagggagttagtacaagaagggcttgatctaagtgacatttgtcggagagtgtgcattggtcgttgtacagaggcaaccctgaatacccgacagaagtagcaggccaatatgtggatccagatgattactttgatgtcgaattgagtggtggccacgattctatctcagtagaagtcaatagagaggaggttgacgaggaggcaagtgctgagcaatatgatgttgaatttgctgaagactctgatgatgaccgtccattccctccactaactaacaatgacaagttagcattagaggaatgtcgtgcgtttgagaaggtgtttgggaggaagccggacattcctgagtttagggacctaacacatgcccatggtgcaatactagatggcggcatcaacctagatctgttgccagaaccattccaggtggatggtctcagaaagggtttagagttcccatccatggtcgcattgaagctatggctccaggagtacgccatcgtgcaccatcgtccataccgtgttgtcaattttgccgcaaataggaggtacactgttaaatgtgaaaacccacggtgcaaatggaaggtccatgcaactaagaggtctagtggcacgtggaggatatcacgggttggtaaggaacatagttgtgctactgccgaaggttcagggagccaccggcagctgacatctaagttcatagcaaataggttatgcaatgccataaaactgcaacctacactctctgcttctgcgttagctttatatatatttgaggttttctagtatagggtgaagtatggcaaggcttggagggcacgagaggaggctatgaagctcatttacggtgaatggggtgaagcgtacgtccgtttgcccactttgctgcaagccattaagcagagaaatcctagtatggtctaccacatcgatactcatcctgatagggttgtcaacgttgatggagtgaccaagaaaatttttatgcgtgcattctggtgctttggtccttccattgaggcttttaagcattgcaggccattactagctatagatgcaaccttcctaactgggaaatatggtggtgccttgatgactgcattatcagctgatgcggaggaccaacttgtacctttagcttttgccttggtggagaaagagaattcacgagactggcgctggtttatcgatcttgttcgacgggttgtggttgggccgcatagggagctttgtattatctcagatcgacatgctggtataatgaataccatgaggactcctgttctaggattgccaccggttcaccaccgatggtgcatgaggcacttcagtgctaatttccacaaggccggtgcggacaagcatcagacaaaagtgctcctaaggatatgtcagattgacgagaagtggatatttgagagggatgttgaggcactactgcagcgtattcccgaaggtcctcgtaaatggcttgaagatgagttgttggataaagataagtggtctcgtgcatacgatagaaatagctgctggtggggttaaatgacaaccaacatggccgaacagttcaatagcgtgctagttggtgttcgtaagcttccagtgacggccatagtatcatttacattcatgaagtgcaatgattactttgtgaacagacatgatgaagcagtgaagcgagtccagttaggggagcgttggtccaccaaggttactagtaagatgaaggtgcaaaaaagtaaggcgaacaaacacactttaaggtgttttgataagcagaaaaagacatacgaggtcacagagaggggtggtataacgcgtggtggtgttagattcggcgcaagagccttcaaagttgaagatgaggggaactcatgttcttgccaaaggccattgctctaccatatgccttgctcacatcttatccacgtttatctgattcatgcaattgatgaggaatctcccaaccgaatgccgtatcatttctcttcaagagccgttgtgaacacataggcaagtcgctttgagccatacctcgaccccacacagtggccaccgtatgatggtgaagaatttgttgctgacccaaatttgaagattaaacaagagggaaaaggagatcgaagcgattcaagaacgaaatggactcgggtcttggtggttctggaaggaaaccaccatcatgtgttcaacttgatgctgcgccggtgcaaaatagatgctcgttgtgtcaccaggagggtcacaagaaacctaagtgtcctaagcatccaaaaaagaagaagtccaaaaaaaaatagaagtgttagggaggtaaatattttgttttcctacttaagtcaatgcatgttttattcttgtctatttaatgtctatttatttattttggattctcgcattcattttcttttaatatatgtcatattggtaactaacggtgaatttattactttttcatgtaggatggccaaggagggacaaccgccgacttacccagccttggaggcgtactacgaggcccgtcatcgcggggctgcgatcgaggcggggagggtatgaatcagcattgattcacttgtacataagtatcggtagcgtgtgtttgacattatattaactaattgttttacaattgctactgcaggtacttcaaccgctccgagttagagctcatgctcccccagtgttcgacgataggtacatcccatacctaagggcggccgggttgctcggggtggccttggtcgtgagcagaggaatgccagtgttcaacgctcctgtgttgacagcacttgtggacagatggaggcctgagacacacagcttccacctccccagtggtgagatgaccatcactctacaggatgtggctatgatcttggccctcccattacgggggcatgccgtgacgggcagaacaaagaatcctggatggcgtgcacaagtggagcaactgtttggcattccactgaacattgagcagggcaagggggcaagaagaagcagaatggaatacccctgtcttggctgagtcagaacttctcacatcttgacgatgacgctgagccatggcgtgttgagtgttatgcccgtgcatacatcttgcacttgttgggaggggttctgtttcctgatgctgggggtgacattgcttcggcgatatggattcctttggtcgccaactttggtgatctgggccgtttcagttggggctcagcagtgttggcatggacatatagacaactctgtgaggcctattgtcgtcaggcaccatcatccaacatgagtggttatgtgctattgattcagctgtagatgtggttaagactaccggttggaaggcctaagtggaggcaaagcttcacttcttggtcctacaatgagcccgacatggagaagacagtggcctacctttttgagagtactgccactgcacatgctcaccgggatgtggcatacaagcattatgtcaatgagatggactgcttacagcctcaacatgtaagtacttccaatatcacttccagttagacatttacttctttaattgagatactaaccaacgacatctcttcaatttttgcagattgagtggttaccataccacacaaatgaggcttcaagcctgaccctgaactcaatgtgcaatcgagactctgactacttcatgtaccagtgcccattgatttgtttctgggcagttgagtaccaccttccgcaccgtgtcatgcgacagttcgggaagaaacaagactggccggttgaggacatctcaactggagttgaattacacaagtaaatatttcttatctttgtttgctttcattgtcaatgttcaattttgtaccatttaacccttgtcgatgctcactattatttcatcaccttccacttgtctaggtatgacagggtgagaacaaagaaggtgaaagactgggggctagagcataacagatacattgatgaatggaggacagccggaaggaacgacaggtacatcgagactatacaccaaaatcatcttttctcagagtaccttcgttggctgcataggacatatagactgttcctccgccctacttggacggaagccgacatagaggatgaccgcgattccgatgaggggcggaatccctatgatgtccggactagagttggatatcaaatggagcacgccccacttagagacagagtcgtaagttttcttgcatttgtcaaagttatttccatttgcaccctagaccctaacatatatcttctcacgctttccgtcgagagagctcctcaggagtgtgaatgaaatggggcatgccctccaagctccgaggggtggtgagaacacggagaacacactccgcaatgttttagaggtaaaatttatttagcactttgcattacttgagttatgcctaacaaacttcttttttttttgaaatgcagaaagttcgtcaaaggtgccggaaacttgcagcaagattaggttgcaggtcgattggattggacgacgtgtaccaaccgcggagattaccaccaccactacctcaatccacgcgtccaagtaccgctcgacactccatcaggatagaagagcgtgaagaagttggtggctcgtcgtcgtcacgcattccgcaagggagggcaaaggggaaggcgccggctccacctagcgacgacgatgacgacgatgacgaggaggatgaggactacgtcgcaccagacgctgaggagatagacatgtcgtagcttcccgacgcgcctcaggggacgcaacccacgcaatacaacttgcgatccactcgggcagtgaaaaagaggtaaaatgagcttaccattctcaaatgttatttgattttcctcattttgtttttaaaatgttttaaacattggattttcaaatgtaggtacactccgggtttgcaagctattcggcgccaacggaagaagtgatttgtatgaagttaatctatttgttggtagtatgacatatgtggtgcactatgtgatataaaatgtgatggactatgtgaggactatgtgatggactatgtgaggactatgtgatggacttttgacattgtttcatctgtggaatataggatggacttttggcattgtttgatgtgtcgaatatgtgatggacttttggcattgttatttgtgcaattggaacttgttttagtctgtatgaaactgtgaattgtgatttgaattgcgaactgtgaattggtacatttgtgcaatatggatcttcaatttgcagggaggcagagggcggcgccaatcaccctggcgccacggttggggagggcagcgccagccactgccacgaggcagaagggtttcggggtggggggagggcggcgccagctacactggcgccgtggtccatgagggcggcgccagccgaggcccggaggcagtagggtttcggtggggaggagggcggcgccagccaccctggcgccgtggtccatgagggcggtgccagccgcggccaggaggcagaagggtttcgggcgtggggaggagggcggcgccagccaccctggcgccgcggtcttgggggggcgccagcctttgcccggaggcagaacag

SEQ ID NO: 57819 - DNA, 1510 bp, Oryza sativa
actatttttcttgttcattcttgttgacgtacatggttctagttgctgtagctatataataacttagctgttggtaaaataatgttcttgtgacttgtgagaggtgattattcaatggcagccttgattccaggatctgttacgaacaccaaattttgagctaagcgcataagcaacttttctcgtatttaaactgcacttgaaagaggaacccttttaagttaatactcccccggtcaaaagtatttgtcgtttaggacaagatttggtcaaaattttaaaattccaacaaccaattttatgttagaataaatgtataaaatctaataagtttatgatattacaatagtacttttcgaggcaaatttatgtatataatttcttttatttttaaactaagcatttaagaaaccaatgatggttggaattttcaaagtttgatcaaatcttggtctaaacaacaaatattttgaccagaggtagtattaacgttaaaaaattaatatgaagtagcttcatggtacttggaaacagaatatagaatgtaagttctatatgttttctatagggactatctatatttatggcaccatatgaaaaaaatagttaaatgttttagcatgtactatttacaccgtaaattccatatcttggtccatatatttacactgtaaattacaacttacactgtaacttaaaacttacacagtaattttctctaatacttacatatatacaataactagaaagtactagtgcaaacttacattaaaaggtgatggatccaaaacaagtagcaaaagggcaccaatttcaatcatccagatgcatggtgaacctaagctgcatgtgaacctaatcatattggcatgaacgtccagatgcatggtgccataggctcaaggcaaaaacgagcggtagaactacgactgaaaacagaccaaaacagaaatatagcaaaatcgttttctatatatttattctccatatgtaagatcattgggggtgccaagttacccactatcccaattccgcatccttggtcacgtgggtggctcatttgtgaacttctaatgtatcactggatattattctgctgtttagcattttagatcatcggcaatttccttatattccaagcagcttcattgcatttcaaaagtaaccacatgcatctaccaagttcaaatcaatacaagatcaagtgcctatgtttggcgcgatacaaataagtgctgtgcactctctgccctgcattattttgaaccacaagaactacatagtcttcagaacagcagaatacatgacataaactctgttctggttgaatgggttcccagcaacttgaacaaaaaactgaactaaactgataaattgttcatgcagaaaatattgcatgggtaatgctttgaagtttagcttcgaggttttatagtgacaccaaagaaaatatgccattagtcacttaatcttagcgtttgccatcctcacttgggctgaagtctgctgc

SEQ ID NO: 57820 - DNA, 8038 bp, Oryza sativa
  unsure (1)..(8038): unsure at all n locations
gcctctcaaatatctgagaaaatggtaggaacaattgcttcaccctgcttttgtactgccaatggagtgccaatgctctgcatctgatgcaatttttacttatcttatgtaggtcggattgtcgagtggagtgctattcctgctgtttggtatcatgtcatacttgtcaggaccagaaggagaattataatgcccccagaaagtcatgcataaggagaattatcatgttcatcatggccggttaacaagcttgttttcactacgacttgatctcatcttagtaggtggacgatggcgacgaaagcgctgatcctttgcaaggaggatggcgattacttagcttagtcaacacattgtaaacatttcactcatcattcataaataacaagatggtaccaaagactctactggttgcttcgtgttagtcccagcaccagacaacattcagccaaaactgtcggagtagttgctgcatactaccatactatttttttggtcgcaactatgcataagaactgctagtcttcggactaaattgcctggactgaagaggggttacaaatcataaaaagtgatttcagaattagttgtttttctaacatcacccttcacatttttaaaatctttattctttgggatttcggatttgtcctgcagagactacattcaactggactataagacaggcaatgtgtgtgctgaatcagtcggcatgaagccagactctgtgtctgggagctctgaaccacaggccagaattagttgcttatctcttgtaggaataagttcatctgatgtcccttaacttgtttacgaatccgattttcgtccttcaaccgaaaaaccagatacaacgggtccttcaactgtgaaaaccagtgcaaaataagttcctcggcggtttgaacggcggttctagctgacgtggctaatttaacttggtcttcatctgacatggaattgacgtgccgctaacgtggcaattcgatccgaaaaaatattaaaccctgtgggacctacatgtcagtatcacacataaattaattaaaaaatggtggggctcacgtgggccccacatgtcattctcaccccccaccacttcttcctcctccatccccatctcccctctccggccacggtcacggcggcgccggggacaacgacctcaagaaggcggacgaggccagtcttgacgcccttcccacgtcctccgccactcacctcggcggtgcgctcggccggtggagagaggaagcgcagtggagatggcccaggcggcgggagtggagatcggagggagttgggggcgccgccggcagattgccgccgctccgtcccaccggcttcgcgcgccgccaccgccccactccgtctcgccgctctgctcgccccgccccgccggcttcgtgccgctgcgcgccggatgacgacgacgacgaggctggcgcccttcgcttggctccgcagccccgccggcttcgggcgccgccactccgcccgcgccgcgcgtccgccggccgctgccccactccgccccgccgatctgcccgcccagccccgccggattcgcgccgctgcgcgccggaagacgacgacgacaaggcatgaagaagcaggagcagactacaaaacaatggcattaatcatgttaggattccacattcagagagtgagctggagcacatcattgatttttgtgcagagagccagagatcgatggatcgattgattctgtcgccgatgactctaccaattctgtccaggctaatcaactcagctgaagtgcttgcaatttacatcggccgtcaggctgccgctgccgtcgccggcggatggctggatggtggtggccacgctgttcgctgccatgacnnnnnnnnnnnnnnnnnnnnngccggggtggatgccgaggcccagggactggttcgcggtgcttctcgccgccgatccgacacgatggaccaggccgggaaggcgatgctgtacctgatcgtcaacccgtgcaccttcgcacctccacggcgccgccaccctcctccacgctgccgccggtcaccgccgttcgcattgcctgctaccgcgccgccgacgctgagagggaagggagagaaacagatagagagagggggaaggagaggatgtattgacatgtgggccccacctttttttcctgacatgtggccccgccattttttaattatttttttttgtgtagctgacaggtgggcccatggtttttattatttttatgatatataattgtcacgtaagcgccacgtcaatgccacgtggtaagagaccttagtcaaaccaaccacgtatgcaccacgtcagccaaaaccgcctttaaaaccgccgagtgacctcgtttgcaccgattttaacagctcggggaccggttatatctggttttgtggtttaaggacgaatatcggattcggtgtaaaattaagggacctcagatgaacttaatcctctcttgtacactgtctctctttctctcaactcaactgggccagagaccgggatttctaacctgggccaaatttgttcacactgtctctctttctcttaacttaactgggccagagaccgggatttctaacctgggccaaatttgttcacttccagtggtagtttgctggtggaaaaagtacactgaaggtccctcaacttgtcatcgggataaaaaatcgtcttcgaaccgcaaaactagatatgtggggtcgcttaattatacaaaaccggtcacaagaggtccctcagatcccggttttgtcctacatggctgctgagtcagcgtgggacccacgtgtcaggtgctcctcgcgtggagacgaagaagccggcgatggctgcctcagtcacacgatgagcccgcgcatgaactcccactcatcatcatcctcggccacgccggcggccgacacctccgagtcgctgctcatgccgctgctctcccctctggccatcgctgcggcctccgggtagaacgacaggtacggcattgcgccgaacgctttggcgagtgcggcggcggtggcgccgtcggttctctgcttgaacacctcgtgctcgtgctgcatcgagcggaccacgtcggcgcaggaaggccccgccgctctacgacacgcgcaccacgctcggcccgccgaacaggttgtggagcccgccgagggcctcctggtaggtgccgccgaggtagtagccgcgggtgccgtggacggggagctcgtgcagcggcaggctgtgcctcccgctgatgaagtggtcgaccttgccgtcgctgtcggaggtgaggtcggagaggacgccgtcgattgcagggcgctcaccaaggcactggattgggatgattgggaacatctgcccgattgcccacatgtccggcagggaggtgaacacggacaggttgctgtggtacgtgaacacgaacacggacagcgaagaatcaaatcaaaggaaaaaagaatgaggtgtttggatggatggatcgagattagcaagaagaagaaatctaaagcaagaaaaagaaatggaaagaaagaaagggaagggaaattgtatcaaggatgccaaaagagagttttggaaggggaggtagaagaactccaggacgggattttggatctcgggcaccccacgccggcggtcaggagagagcctcgtcgaagctatccacgggccaagaacccaaccgtcgtcgccggcgtctaggagggtggtatgacccggcgctgagggctcctcctcctcgcgcgtgtggctccagctccgccactgctcatcctcgttggcgagcacggagaggaggctgccgccgccgccttcctccccacccgtcggctggtggcgccggcctgcccagagccatagagagaagagtgagagagagagagagaaggggaagagagaaaagaggggaaagaaagagaaggctgggctgacatgtggggcccacgtgggtcccacgctgactcagcagcacgtaggacaaaaaccggaatcaaaactgccgagggacctattgtgaccgttttgtatagttaagagaccccgcatatctggttttgcggttcgaggacgtttttctatcccgatgacaagttgagggaccttcggtgtactttttcctttgttggtggaagttggaacacaccatgatgttgcgtggtgacgggctagagtctaagcatactccctccatctataaaagttacacctattttacatttgagtttttccaaataagtttttcctgagtttttccaaataagttgttcctatttgtaatctttatgcattcaagaattaaatgaagagatgttttattagaacacaaggagtcatctaaatactcattggttgcatgcttacattcactccttaattttgtaacatctaaggtgatttagtttttccttggtcttgatgtcaaaataatatgtgtaacttttgtgggtggagggagtacattggtgcgacctaattttaatttggttacaaatttacaagtctagcaagatgttgcgttttgaaacacgagacacaaatgctgatatactccctccgtcccacaataattcaactcctggattcccaatgcaaacttagtacaaccatgaaaataccaaaatgccctcaacaacaacattacacagaattgtactgtgttctctacactgtcctcactgaaaaaaaaggtttaactgggttctctgcacccatcgattacacaggtatccagaaaaaaaaatgaagttttaaaccgaatatgctaacaaaaaattaagaacctctagtttgaaaaaagaaatcgttaaaaaaatactactccacaatctgcaagatggtttgcatccacaatctgtcaaaaaatacttctccacaatctagaaggagtatgaattaatctgcaagaactagaaagaacaaagaaaggtgtttgtatccaccaaggtggcctgtagtcatgtgtgtatttatccagattgaccctgcaagaagtcatcaccaaaatccaagaacttagtatagttaacaaggtgaaagggtagaaataaacaccagagaagaaagagtgatggaaaaagagtagtagaaaagagtacctgggctcattctaatggcaaagcttctcgaaccacctcagctttgggagacacaaaatcgttggctccttcatcagatccgctattgcaaaagcttgtgcatcaggctccctgcaacagatccactggcgctggagactataggcttgcgcctccgccggcgtagccgagcagcacctacacgttgcgttcgccttctcctgcatcacaatcgcaagcccctacctctgccgccgtgctgctagtgcctcatccgagccatctcaatccgccggggccggcgccgctcccgccgacctgtcacatccatgacatcacgggaggtcgcagggagggagagatggatggagcgtggagggaggggaagcgactcatcgccgtcgagggatgggtgaaggtcgtgaggagaggaaggagatgagaccggtggtggtgggttttttttagcgcggttgtgtggtgggcgagaggagagagacgggcagggataaggatcattgaatatttctcgggtgttgcgcaggagtcggttttttctgggacaaatcctcacccccagaaatcgcttctttctgggacggagggagtacacgcacacacgtatcccaattgaacgcatatatgtatgtgctgctcttatgataatatatgaagactgaggtcacagtgtatcgctgtcatgtcaacaagtacattatctatcattgaaaaataattataccctttaaaatctattataaataagaaatgttaaaatatattacatggaaaaataaataaataaaatttgctttcgaaaagccgctgaaagaagcttttcaattattctttttatgaaggggaaatgccttttccatgacttgatcgaggaatgtcctctagtctgacttcaaaatatagttgcaaatcatatctctagcctactctttggttaagaaagcgcaaggtgctagccagacttctgggttgcgcctagtgggcatatatatcataccaactaatcaaataaaagaaattagcaatcatattacataaaaaatagaccataataataaatagcaataaattaaaacaccactaagatagttaagttgcctaatgcatcaaccaatgcctaattgcgacgactaccagctcctaccttaatggtcgcataagtggcgcctagagttgaatttacaaacgctaagcctactataataaattattaatgtattacaattagattgttaattatattatttaattctgacttgttcaatattgtgcttacatttgctatacaatcaattagagaggcatcaatgattgttactttcgtcctcgcgaaaaaatgattgttacttttgtgctaggctcgtctgcatcctttctatgtatgttttagagctcattggttgccctaataagtgaaagcaaaaactggaatttaaatttaaatttaattttgaagttgattttaagatattttcaacgtagtttctttttcagtatagacttttaagtcactaagaacacatatataaaatttttacttacaaattaatttttattacctaataaatcttttggcttattaataaatatgggcaaatgatgatgaccttacactttaattgttatctgctttaattgctagataacaggaataatttcatttaatttagaaaataaaattacaccctgcctttgcgcctatcaggatgtgcgcgcaaaaaaaagtaaatttcacaaaactacatatattttgataaaattatcacaaaactacagatttaagaaggtgtatcccaacactacagatttaggacaaattttatcaaaaaactacaaatttaagatgggcaatcaccacactatagatttagttttaaaattatcataaaactaaatgttttataccatgttaaatgcaaaattacaacatttataacattagtggtaaggatttaaactacaaaatctataattttgtgataactctagtattaaatctatagttttatgatatttgaccttaaatgtgtagttttataatatgttgtcttaaatctgtaactgtacgataatttgatcaaaatacttgtagttttatgaaatttactttaaaataaccataagacaaacacgaacatatatattatcttgcaacaattcagtcacatatcgaaagaacacggagacctagttaactacaaattaaacaacaccgcctttatgaaagaaactatagcttgtccgatccgttacaatcgtccagagccagaactagattttcatccataatctgagacgatagcttgaacaaatcatattgcacataagcatcgatgttaccagatcaggacacatggggttctctcattactcctcatatagctcagtttgattttcgattgatgtttctacgcttcatagtttagtacatcactgttgattagtacggcctatcaggagcacaaagccacaaatccacatcatttgatcgaactacataccactttaattatagcacatccacaacacataccctaatattcctccaaagcagaaaagattgagcatgcatgcaccctctcatgctgccacaaacacaatcaatccaatgtgcttcaatgtttcattgcctctctaataagacaattaatcaaacccaagctagcttgggcatgatgataccattagtgttcactttactttcccctcctagctactccctccgtttcgaaatgtttgacgccgttaactttttagcatatgtttgaccattcgtcttattcaaaaaattttagtaattattattcttttcctatcatttgatttattgttaaatatatttttatgtaggcatataattttacatatttcacaaaagtttttgaataagacgaacggtcaaacatgtgctaaaaagtcaacggtttcaa

SEQ ID NO: 57821 - DNA, 29882 bp, Oryza sativa
tccagatgcaaaaagtacggccaaacgatttttctatgttatgttaatattaaataaagaagtatttattggtaaaacttgttaatattgttataaaaatgtattgaagttggttgtttcgcaatttcatatgttaagtaaggtagtattttgtaaattattcgacgtattagtactcggataattaatataggcctatcgcagtctcggtcgtagaaacattatatggacttaaacaacgagaattatgtaacatgaagaaatagtagtacaatttgaacatgatacaactattttcattgcggttacatagatgatattagattcgaactaggagggaggtaatgcaatagttgaacacaacgacgatgtagtaatgggacaaggaagcatgacagtagaaatttcaatatgccaagttgtccgacaatagctaacccctacgtgaggatccctctcctctctcaaaacgcgttttagtaactctgtattgctctggtagttcaagctacacaacacggctaggtggagttagaacccttatggtgtctatccattctctgtattgacatctccttggtggttcctgggaggaaagaatagatgtaaagcgaacaaagttagtaaatgttgtgagaaaataaggattcatgtaatcaaaatattcttaccatgaaatcgccatcaagaatatttggacaaacgttgtaggctttatggaacgaagaacctgacaatgatcaccacacctgcatcttggacgggtttcccatggagggagtgccgtagttagcacccgccagtcgctctgttgttcacgacattgtcattcataagccgcttttctctgtaagtattgctcagtactttcggatacgaaataccagcgaccttcttgtaaacaagtggttaggtcgagaacgggattttctgtatcgacccacttgatgtatgcgcaagccgtagtgcgggtctgccgaatagagtagtgttacgaagaataaagcgattgcccatacggaatgaataagcatatgcagataataaaatacctcacgatcatagttagggcacctacaaaagcgccttcctcgaatattaggattcctcaaagccattagttggcatcgatcaccgcataggcagagaggacgctggcaccaaggtggtagtaggtatacacaaggatcgctacgccagttcggatcctcaacaccccggcgtctagccattgacgaaagccggtaggatttgtaatgaagcaagtgggaagagagtactgaatgtgactgagttctgaaagattgtgaggcctcactcgttaaggcgacttatataggtgcaaaaaatcgagtgatatccctgacatgtgaacgtggcggggcatggtgggtacgcctgattggcgccgaaagttacatgcctgatcggcgccgaaagttacattggtcgtatgcggcaaatggcgggcaaatactcgtatcgcatgcgaataaaggaggatgcatcggtgcgacagaaagtagtcgtgcatgcgccgaaaggtatcgtgcacatataacaataacatagtcattacacaagcatacagtactagaaagtgaagcaaataaacaaagagaagactgctctactggccctgccccacgccgcgaccacgcttagtcctccgggcctgtgctcgcacgtggtcctgggagtaggtgaaacgatccggtggcatagcacaggtagcacgagtgtctggcggcggagtggcctgcgcctggtcctgcgtctgcttcggcggtgcgcctcccagctgtaaggggccgatgacgtcctctgttgagcctgaagcgaagtcgaagtcagtgatgtcgaagagcaaggtggaaggcaccaagcggtccgacgaggtcccagcatggtccagtggtggaccctgactcgacgtgccggctgcctgtgacgaagtcccggtgtactgcagaactgcgctgagtgcaaggtcgatgcagctgcctgagacgctgaccctgcagcctgggagaagtgggcggcctgcatcatagcgaactgggcgaaacctacacatcgacaacgggacccttgtaagctaagacataaaatgcatgtaaattgattgtcgaagtaatgttgtttttttaagtacctgtggggggcacaacagaaggcctagccgaggaaggcggggtgctgaacggtgcacgaaaccctgaagcgatcggcaagtgaaacggctcacatatatgtgcgaggcatgtacagaaaaatccttaaaaatacagctgcggagggggagtcggcctaggaacgtgcgcagctggacggggaccagtcggtacaggtggccgctgtacagctgcgtctgcccgagcaacgttgtctgcacgacaggtgagcactcagagaatcgagcgcatcgactccaccatccgcgtgtacgtcatcaggtgctcctctacgggtaccggaatccccgcgcctaaacgttggatcatcgttgaaccgtcaacgacgacccggttgatgtcgtcgacctggatggttaatttgttcgtacatattcgtaaaatttgacgaagagaaagacatgaaaacataaaggaatggtgcgatgcagggtactcacagcacgagcgaagtcctggtcacggtgcctggtgtagaggtctctagtgctcgcaacgtggggctgctgctccaagggagcgaaggtgaccctagtacgggtgcatggttggtacccgcgtaggtaggcctggtacgcctcctcagtgtgtggctctctctcgtggtccacgacctcctcggttgcgaacaaccagtcctcaataaaagtcgtcaacttggcgggccagtcgccagctgactgctgacccttgcgcgagtacctgcaaattaatgtgtcatattagtgtgaatcgacagatgttgcaaattattgtggacaggtagattttaatgcaacaactcaaagcgcagtgaaagatcttaccggtgaacagcagctgggacggtcgtcggaaacagtactggaaagggctgacggaagccgaactgctgcatcacgcggaaaggggcgtgaggctcaacgcagatgtcgaagaccatcagaaccgtagtcatccagtatgcctggtccctagtgcagagtgtggacagacccaacggcgcacgagcctgggtagccgcggcactgtagggctcccacacgacgtcagtcggcagaaggcggtcaaactccataacaaactcaagatacgaccgcctaacctggacgtgagcccatcggcgctgcaatacgagacgatcgatgtgatgtacaatgaacttagcaattaacttaacaatacgagaagatcgatgtgacgtacctgacgacggcaccacagagtacccatcatatggtagtcgacctctggtcgctccgcgtacagtgactcctcgtacgcgtgctggtccacctcagggcggccgatcgcaatcctctcagctgcccagatagaaagaaagagagggcacccaccaaaggtcgcgctgggatccgtcttcgtgcaaacctcacaaaggccacggtacagagccgccaacaacgcggaaccccagctccactgaggcacctcgcctaccacggcgtcggcgatgctcctggcgtagtgcacgagtcccttgtcgaccgcgtgcccgtgaccgccacagaacatcacccagccaaaaagccagagcaagtatgcctccaaacagcggctgtaggagtactcgtcggcctccgcctgtagctgctcgacctgcaagcgttcgataaaatgttaggcaccttaactgtggactaaatatgtagtacgcttgtcatttcggtacgaaaacactcatggtgaactgaagcagccacctcttcgtaggtccggtgttgcggtggtgtgccaacggctcgagagggagatgcggtgcacgctgtactagtgcgaaacgtgttgtcagatcgtcctgccagtccacacccgtggtcactggcccaacagcgtctcccgcgagcggtagccccaacaagtacgatacgtcctgtagggtaggggctacctcaccgcacggcaagtgaaaagtgtgcgtctctggcctccatcggtcgaccaaagctgctaggagggaccggtccacagtccatcgtctggccgggtccgcgtcgccggcggtagcctccaccagccgacacatcggtaggaggccggcctcacgcagcctgcaataacaaattaatatgtcattataaaaattattacatcacaactaatttatagtaatacactgttcgtacctctcgacaaaggagtcgtgaaccgtaagtagctcaccgcacgtccgtgcccggaacgtcccaagctgagccccctgcaccgcagtaaggtgagaccggtgtcggtgatctatcgccgggtccaacaactgaggtgtatcctgacgtgccatctctgaaaaatatagtgtttcgtgttagaacaattcaaaaagtagtaatgtaaaacaaaagataacttgtaaaattatgaaatcgtaataaaatcatgagaataattatgtacaacaagagtacaggctatttaaatatagcaaacgttactaagggtacataacgatgacgtgcaatttaacatatatgtagagttcgataatataacataacataacataacattatgtatcgaagtccgacattacatcagcatacctaaagacactaggtgccttagtctgacgttacatcacgagacctaaagacatgacatgccgaagtctgacattacatgacgaaacataaacacatcgataagttcgaaacaaattacaagcaaagccacatgccaacatagaacataagaactacaccacgtagccagacgtggcacgacgacgcctaggacgtggtcgagtggaggtagtgccttcacccgtagggcgagctccatctgctgctgatcctgatagtcctgcctccgccgcacttggtttctccttgtctttaggacaatgcttgtaggtgtgcccacgttcatcgcatttgctgcaacgcttcaccctgccagcctccgactcgtccatatcgttgcggatgcgacgagtcttcctccttccagccttgtctcggagcttcgatgggtcaggaatattgagtacttcatcgttagtctctgtgaactccccagctatgccgaacccataaatctcgccgctccatgtatgatatattgcttgcttactgaactactgtgacacatatactgcatctggtatgccacactccgctgcggcagcaatgatatgggtgcatggcctgtggagcagcttctgctttgcacaagagcaatgacatgtgctgtcggctttgagaatacactcctgcttcactctcttgcggtagatacccctgcatgccttatcttgacatagtatctcaaacctgtgctgttgggtaccttgcactagagctcgatgtttcatggcctttttacgcaactcctctagctttttttgcatgaaagttccaaacaaaatgctgttgttcggcatagagggaagaactgcctggaaccgatccctaaaatacctgcatgtcccatgtaaaatgaactccactatgccaactagtggcagtccacggacaccgcgcatcacccagttgtaaacttctgccaaatttgttgtcattattccatatctagcaccacctgtgtcatacgccttggcctatttctcttttggttcatgcagaatccactgagaaaatttccgaatctccaatctagttcttctaaccaatgttggactatccgttgggagaggtccaagagcttgaggagggtcagcatcggcagtcgatggagccgctgcacgctgatcactgcatttggctgtcaactcatctaatctcttccaaagctcattgatttttttctcctggttttgattgcatagcctcttaaacatgttcatgagctccttgttcttgaattgcttgaagaaattagctcccatatgatgcatgcaccacctactctgtacatcttcccactcaccagggtatcctcattccatactcccaaactgtaactcttctatcgctcgcagaatgccagcgtgcctatcatgtatcaggcacacatttggcctcataccaacaacttttgttttaaccaatttcagaaaccagtaccagctatcggtattctcactctcaacaaaagcaaatgccaagggcaatacctgattgttcccatctacccctattgctgttagtatctggccccgatactttcctgtcaagaatgtcccatcaatgcagagaacaggacgacagttcacgaatgccatcttgcatgcatgtagagctaagaacgccctttgcagcacactcttgccaggatgttcaattgaggggaatttcttcacttcgtaagagctcctagggtttctttcctcgataataccaagcaggcgtggcaaattgtcatactaggcttcgtaagttccaaatctcatctctattattttctgtttggccctccaggccttggcatagctaatagtatacttgtatgtctcttcgatgtgtcggattattgaccttggtttatatgtgagattatcgatgacatgcgcatacatctcagatgcaacaaatgcacatgtaatgttcctgtggtatttctgaacaccaggtagaaaacatgtatgcttggtaacgactgacactgtccaataatccttccatttccccttatatgcgtgcactctccaaggacaaccatctttttccttaacacaccgaacttcatattgcgaccgattggacttggcaacccaaaactctctatgaagtgacactgcaaaatgttttaccgcctccttcatatcttctgctctactataaatcgctccttgaataacctcattttctttgtactcccatctcacactatccttttcagagacgaccagcccagaaaaatcctcactagcccattctgctggattaatatccgtctcatcatctgacgaatcaccttcctctacacgctcgttgtcagaatcctccctctccatttcatccacaatggcaccacagtctccccctcgtcggccactctacctggttgaatgcccactggagctactacgcccctgtcctctcgtgcgttgacctcctccacagaagtctcatttacttcagcacttggtccctcgccatcatccatgttcatctgcacacctggatccttcgggtgaacaaacagaaccatagctagaggccacccgcgttgcaatgcatttttcacataccatctccacactcgagagttttgaactggtattagttcccaataaaaacccttagttgcccaacttactataacattgattgttatgtcacttgtctgtggatcaactctcaagcccctcattaaccatccttttatagaaggtacactcctctcagccggtctatcaattccccttttctgatacaataaaatctgacagatctaccccagttgacccgtaacggatgtttcctgggccatggtaaacttggaatatttgtttgttcgacatatctgtcaacgaaataactagattatattactctttcatgcaataaacatctacaacgtaatatcttcttgtgtatgccaatgcaacggtaaagtattgattccaaactagcagatctacgtagttaccgatatctgcaatacgcacttctagattagtacaactaaaaccctaaaaatataatgcatttattcaaacaaagttttaaaaaatacacactatttaactcaatagtcacatataggatctatgaatattacctgaaatcggcgtctgaatccggtagggcttcgccccttcttctcttctcctcccctttcttcttttttttcactggatttgagaggggaggaatgagggctgggagctgggcggcaggccttttataggcagcgaggcctgccgcccggccagagggcggcaaggggccgcctgcaaaatgccggccccgactggttttttttgcattcaggccccttgccgccccaacagagggcggcaagggctttcctgcaaaaaaaccctccctccgtcaccgcccgtcccttccccgtttgccacgtcagcttgccgctccaaaggtgggcggcagggtctatttttgcaatttttttggccgatagattacttctgtaaatattttttaaaaaaaatctaaaaatgaaaaaaattcggggcgtcactccaagtcgcttcttttatttgggccgggcagtttctgggctagacccattttactgttttggcccggcccatttagccgccgctactttccagcttccaaggaggccacaccacgcaccgcagctgcagctcatccccacgaccaaatctcgccgtctccgcctcgccgccgccgccgccgccgccaccgccaagagggggggaagcaacccgcagccgccgcgcggcgagatgaacaccgacatcaccgcgtcggtgaagccggagtacccggtggtggaccggaacccgcccttcaccaaggtcgtcggcaatttctccgcgctcgactacctccgcctctccaccatctccgccgtctccgtcaccgtcggctacctctccggtacgtcctccccccacccctctctacgttccacccctgggaggaggaggcctcaattccgcgcgtcctttgcagggatcaagccggggatccgcgggccatcgatggtgacgggagggctcatcggggtcatgggagggttcatgtacgcctaccagaactccgccggccgcctcatgggcttcttccccaacgactccgaggtcgcccgctacaagtacaagctgtagtgagaaactttatcgattcgctgcgttctctctctctctctctgctgctgcaagcgtttacatcttttttttctttttcctgatgatctcgttttagcgtcacttgttgatgtgcgagatgtgtggccttggctgaataaatgttgtacgctgcacgcttgtgaggaattcgtgctacaatttagctccctttgccatggtttagtggcaatttggttgccgatctggtaaaaatttatggaactgaatgtgaccccctgcctgtgaaatttggggattttgttcttaagtgactctggaagtcgtttcaggaactcaggatttgggaggttgatttctttacatgtagtggtagtcttgtggtactggccagatgcggggcaaagtctgcctgccaaatagttcgtagatagttgttgtgagaggggaattataacttgcatcttggagaatcgtaaggaagtaagatgttacgatgagggagcacagtgatagttcttgctaacctaagaatacataaattgctatgccacatttagctaagcggtctctagtggttttgctcttagtttattctctcagatgttatatacactgaaaatattatttgaggcaaggaacactcagcggtgaacagtactgcctcaaattttgccgcaaaaggactaatattagtttttatatatgtaaatctgaaggcatgatacgataattatttgattctgagtaccatgatggcatggttgaactagtttaagacgccatattagactagcaatgccatgctgcatagttgtcttattcattctcttatgtaggttagcaagatatatgagataacatatcagtaatcaggacgcataacttgattcagttgtttgtttttcatactcatctcatcccaatgcttttgataccaaatcacgtgcagtgtttagttcagagaatcggatattggctcctcctatgtctcaaactgcttggctgcctactagaaatgagttgataattgtagcatttaaaaaaaaaatcgaccgctgtcctagctttggtgatattcagtcgtggatttagaattttttttagcctaagcaagcctaatgatagataagaagtacacataaacccatataactacatagaccatttatcataggcataagcaaaaaattacagttgttgagttctaatttacaaggaaaaccgatgtacaaaattatattgatgaaatgatggccgtgtattatcttaaatagaaattatatagggcttgtattatcttaaaaaggaaaaaaaaagatgatgaatgctggacagttaggtcaccttgccttcatattgcagacatatgatgatgtaagtatttgctttgctaatttacgttgctgatccactgatctgacattctgatctccattagaactagttgattaaacatgtcaaattacttgttgttccaaggtttgtcctaagtcaaacatttgtatctttgaccaacaatttctagaaattcatatagttcaacatcataaaattaatgtttttaagatgcaccatgagaaatgtttttataatatacaattcacatgttgttaaactacacgaatttctagaaactgatgatcaaagataaaagtgcttgatttaggacaaagctagaactacaagtaatttgaaatggagggagtacctattattagtacttaactgcacgcggctcaacgcctgaacctatgatgataactaagtactgctcactgcgctgcatgtggcaaagtgacgctaattaagtattactggtcacttgatgcatgcggcggagcccgggcacctgtggcggcctgtccagggtagtcaattcctggctccgcaactggtgatattcctgagctgatgacttgttcagccaccctgcattgtacaagaacatgcagtccagagatgttgattggagagtgtgagttactttttgcttccccatgcttgatcacattaagtagttctttaggaaaagaggacaaacctatgtatggtgccagcttccatcaaaatgttttgttttagaaatgatgtgtgtgttgtaatgttattcttgcttatcatccatatctaaatcgttatgttcttgaaaaatggaaatcagaaacatagtttccaatctgaatcttttgggaaggttctagggactacatattctggttactttaagttggtataatttaataatatagctctttggcgtcctagaaagtatcataatttcatatttagtatggtaaatgaaaaatattggtggaatgaacaaagaattggtcaaacagaggacctcacactgattgtttttggatttgcatgttgcttgacaaatagaagtataatttacccagaatgcctccatctatcttggaagatttggtaaagtacggtgtcacttctatctatgctgaatgcctgtatgtgtgcaacctgagtatatagttgtatgctgtatgcctgtatatgcgcaacctctatgttgttgcagtagaacgtttgagaagtttatctgaaaccaattgttttccttttgctacataattacatgagcttgtgactccgttcttagttaaatgttgcaccattgttagtaattaatctgcaggtaaaaatatgaccaggaagtcttctgaataacaggtgttatgagactaggacgatgacattgaactctggaatttactgcagtaaaccaacgcgtctattagtggatcatcggattcgttccctgtccctcccacagcagtagaggcgtgagatgacatagaacatccgcgctcatccctttgccctcaagaacattgcagaagtagacagtgaacacagatatagggtggggctctctctttattatagatttcatttggagtacaagccagccaatcttagatgtctcgccctgcccttatatatataggggtcttaggaaggaggagatagatcttacctctactccgtttggattagtccaaaaaaaaaagatcttatctccccgggagataatattccgtaacatttgcatctaccaaagttagctgcatagtttttctgtatttgctgatttgcattttgcagtaatttcctcttggcacaaggttttggcttctacattagctttttaattagaggttagctatgcgtttatttcacaagtcagtgcggggggcataatttcaaaacttattgttcagtgtttgagaaatcagcttaatatcaaacaaattgtgttataaaaaattctgcatatgaaatagagccctgttttttttacaaacattaacctctctaagctgcgtaggattgctgaaatccttattatcaacctggtcagggaagaacgcaacgacccacgaaattcgtgggctagtttaggttcacttctggccccgcagagatctttgcggcccataaatattaatggaccgaaagttccggttggaccaaaatacagatggtccaccatgaagacgggctagattaggtccatatatataggtgggccgagaataccgtatgggccaccagttgacctagctagtggacataaaaggatggtttgtaaatttgacttcccgttcaagttcagggctacaatttgggagttttttttcatttttattttttaatattcacagaaatattataccggtgaaaatatttacaaaaatagaaatattaaggtgacgtggcatatggtgccatgtgtgtattttgcgctgaggtcatatgcaattttcgccgcatgcaaaattcgcatgcccgctcagcagcctccaatacctggtcacacaagtcaccctgccaccctccccgagagcggcagggtttatttctgtaaatattttcaccggtataatttttctataaatattaaaaaataaaaatttaaaaatgaaaaaaatctacaatttggcgcatgatatccccgtggattgggctaaaagtagtaaggccgaggaaaaagctaataactggataaataaacaagatgggtaccacgcgcgttgctgcgggagaattgtgtgataatataatatatatatgagttctaaaattttctttcttacctactatacaattttttttcatgttttatatatttttatacctttatcaattatccaaaagttataaatgattgggttgtatggtgtgccttttaggagaaagagatgcaatttgcaagaaccgcatcaatttgcgtcaaaggtcctagatacataactgcccaagatattatcttaccgccttgatgaatcatccaaatactaaaataaattgaggtgatgtgaaaagaagcaatttacacccttgatgaataatccaaaggctaaaaataattaaggtgatgtggtttcatgagagaagagagaattagcattaactatacttagtggggataaactttatagatatataggataattccacttcgattttcttaactagcagccgaatctgactcatttacaatagcagatctctcaacccccaattattaaaaccagtgcaatttgattccctcgactgttttggaatttggaggatagtttcgttgacgtggcggtgttaacatggtattcatccaacatgacattgacatagcgcttatgtgacattagaattaaaaaaatatgagacccatttgtcatgtaaaaaaaagttatgggacccactaacatgtggggcccgcataatcatcttctccttccttcttcctcctccctctctcttccttctctctccttctcacatagctggggctgagcggcggcggcggcaagagatggagcggcagcggcgggtggaaaaggagctaggtggcaaaatcaaacagtgcggcgacgaggaatggttgcgtgccctgagcacaattccgaagggagacggcgcgcggtggaaggcatcggtcatcgaggaagatgggaagcgtgctccacaccgcctctcctcgtcgccgctgctccacgctgccgctcctcttccctgctccccatcgtcggtggaaggtgtcggcggaaaccggtccacaccgctgctcctcgccccctctgctccgtggagccatcctcgtcccagttccgcgctgccgctcctcgtcgttggtggaaggcgtcaacggaggcgccgcgagttaggatgagatggaaggaaacctctgctagaacggccacgtcgtcaacgcgtggaccgagcgcctgatctactcctaactcattccaacaccatagtttggtatgccactactactttgctctctagtgccgccatggcgccattgccaagaatgccaccttactacgtgcttgtgaccagggtttcccttatcgtttggaggggggttatcgcacccctgctataaggcggttactgtggtaaccgctgaaaaccgtgttaatttcggcggcaaacatttgaattaaaaaaaattgatggtttcgcggtttggttgcggttatcacacggtttgacacggtaaccacgatatttgcgcggtaaccgtgagttgtgtagccgaatagaataatgctaaaaaaattgaaaaaccacctaaaagtagaaattagggataattagaagaatatataggatacttgtaaacctaacttttggatgtaaaatacagaaaacgggcatgactttttctatattatggagatattttctcctctattgagccggttgcatggtacaacttaaggcccaatacctttttttattttttttcattttctaaactattattcattttgccctcaaatatgattttattttactctttttcaaaaaaaatcttcaccatctacctttttttttaaaaaaaaacaagaactacattcatgctttttttttggaaatgttgaatttggtcaaaattccataaaaccctattgacggtaaccatcatcgtacccctgcggtaagcacggttatcgtgctaacagcacagttttcgacggtaagggaaaccttgacgacaacctacggccccccaccccccacagccttggctctactcaactcttcatcatggatggcgcttgcatgatccatgaccttcttgcttccatcaatgtcaacgaactaggtcgggcagggagggggggggggttagcggaggctaggggccggaggcggttgctacccgtggcctgtcgacaggaggttcccaagctgtcactgtagacgtacaccatcatcacctccacgtggttgcaactcttcgccctgctggcactggcgagctataaaagttattgcggaggatgattcatgggagaagaaggggagcccgccgcggattaccggagctccttgtcgctgacctcacactgccactgcctcctcccgttgacgggcttaccggccaccaccccagcggtgaactcctggggaagagtaggagatgagaggaagagaagaaatgaagggagggaaagtagaggaggccatttacatgtgaccctcatatggtttttctattttattcttactgactaggatatcatgccggcaaaaccacatacccatagtgttataggagtatgacctaatttgacccggttttaagatttccggtattgacgttacataaagtttgagggacgtgaactagacttatttcttatgtgaatgggctatatcgtttcgtttgtaagccttccggcccatcttctgaccagtcggcacaaaaatgggctggaagcctctttcaaagacgttccctgtcttcgtcggcgacggcggcggacgacgccggcggcgagtaggcttccagcaaataccgcggcctaaaccctagcccactccggcgatgaccaggtctcgccccaccccacccgctcgatgggggcgcccgctggatagaggagcagcggccgaccagccgccagtggcgaagctgtcgccgccaccgattcgcgcgccgcggcactgttcccacctagagaatcgcgctgttcgacctcgtcaaccacgacggcgctgccccggcctcccggtacaccctctccgtggctttcggtgacgagggattaaggtattcgttttcgtagttcttatctgttctacttttttgatagtttgatgcacatttggggttaggatgctgcccaccgcgagtgctgattcaaagctaacttactgaatttaaaatgctttgccgacaccggacggcgcagctgagcaactgcggcgccggttttgagagactgggaatactaaattggagtaaatatcccactacgtgagctgaatgcatagggacgatgggagacttgttgtttattatgtgctaaatcgccgacttaatgacagttcattagctgttggccacattagctttaaaactaggaggcttagctatgattttttgttcacttgttaattttttcaagttatgcgcctttttgtgcatcatataatttagagtaattgaaaagaaatgtggtctggttcgttccttcaattcatcccaagaaaaggtctcgcaaagataaatcgtaatgcgtgtatcttttgcagttgggagtgttctgtccaaaagatttctaatcatcataactagcccaactaatttcccaaatcgcgaaaaatctttcagcacttcataaccatcaactacttgatacaaatgtgcaataatatatgtcctctaaagttaagtcctattgttaacatatgtcgaaaagctttccttctttgcttaaagaaaggtgaaggcatggaatgttttgggagtatcaaacactctctcacatcaccaataatgcaccattaaaaattcgtaccatcaactgttgcccctgtattaggacacccttagacatttgcatcaggaacctgacgtgggtgcagaaaattatattaattgtttagcctgctgttgttgctgtctcagttcaaaatgctaattatcagcaatttgtctacctatatttctactaacaacttgtcaaaagttaaaagtaaagcattactcacaacaattgcattggatcatgcattcaactatggtatcaagttgatgaaggacaaaattatatatgattcaactttctggagctgagtctgacagattgaaaagccataggaaacggctgccagttcgcctgtttgtttgtccagtgattccattttggtgatgtttcatataacccaatcaagcaacattcacgaaaaccacatatgttttgatcttgggaacttgttgaagcaatgatctggttatctgaatctatgtaaagcaaatgcactgagataatgatgcacaccagtagactgatatcctcttacttcttttttccttgacagtataacaatgtacaattgttttctttcagaaaaagatgggagcatgcttttaggttcctgtgatctgctttcttcataaattcagtttatggttcatgttgaagacatcctgatgatgtaaatgagatattagttcactggtgggagggacatcatcgcaagtatttaattgggttttgaaggctgatagaatggaactaagatctggagctcatgcaatgctacaactgtggtaatagatgctctttctggattaatgtaattactatggtgaattggcagatgcacattaatcttgtgagtttatattctactgctgattcagatttattcgcttgtcatttggattgcttggttttctgtgattcgatcttgcaactattaccatccattctgtcaggtgcatgatttgaataactctcctgctagattgaaattaaatttaagagtacgaaatttgccgtttcaacttttgatcggcatggcaagctctcatgcattaggaagggacaacctaataaaaaaaatcaatgtagtgcctcatcagcagcattaatgaagtatgcacattagctgtagctgcaccattggactttgacgagtcaaattgtcatttgtgaactactgtaatcactgttttccttttctaatgaagctgattgagatccaaatgctcgtgatgaaaagcacagcatgggatggtgcgccctgtttaagggcagcatgatgagcagaatccaataggtgaaaagattcggcaccatggtgtccctcgcacgcagcttcagcgaagctgcagccagcccaaatagcaagagtaaacaaatgcagccaagtacacagtataggtacatgtcttatgcatgtgaatttgttattatcaatttaccatgttccaacacctgttactactattaaccatgactggtgattgttggctttataatgatatttatatgacctcaccctgtccagttagaaatatgtctgatttagtcagccccaataagccacagccaaacaatatagtttggtattacccagtatcacagtataagtctatcctcctggcacacgatacaagtccatcgacaaaaccaagaggttatttaaccacttgatttttcttcaggtttttgcacgcacaagatcatacctaacgtacaggtacaaaaatatttttataagagccatctatctgtctgtcagtacctgtttctgctaattattagttcttgcttattttttttctctgtacacaaagccagtgcaaattaaaaagattgtactaattttaaactgggcagcatccaagcagagtgaagctactccacgcaagtgggagtttttcctgtcagcaaactcaaacacattggaattaataattgcatcctattgttccctgttcccttccttgtttttccccccgctgcctcctctcctcatatctgcccattcggttataaaagtagacctggtctcgtcccctctttgcaccaacacagcattcttcctgctccagttctagtcttctagggttagaagtgatgagaggtcaagataagctgtgggtaaacaagctcaatcactatggtgtgggtgtagagatctgatctatatatccaggtaattaattaaactaattacgttaagtttactttcgagccatctgtgatcttggcatgactgctggtttgcagctatggctttcaaaagcttgctgtgtcaatctcctagatctaatggttggcacagcaagtatataacacatattttggtttgttcacctagatctgctttcctttactgttccatgtcaatattgatccttgtggaacatagaatataaggggcagcacagatcttgttaaattacatagtgtgcttgatctgtggtaccagtttgattttttctgatacatgggaatctcatactaaatgccaacgttacttttcctttccaaaaatcttgctggttcaggtattatttacatatcaggtgcacttaacatgcatgtacgcttgatctaccaaagatgtcttcagcaagtttattaccatctatcataaaaaataagtatattacaagatgcaacaaagcaaaggtgccactatactgcatatggaaccttaagtgaagtcacctcactgggggttttagagttggagatgcctccattgtgtgtgatgcatattttccacttcggatggctaataaagtaataataacatagcaaaactatatttgttattgacaatacttgacacttgattgtgctaacatttactagttcttcttgtaggttttgtaaccaggggcaataagctagaggcagcaactgcataacttgcgagaaacttgtaagatttctttacaacctatggaaaagataggtttacttgtcttaattttttgctgttcttgttaactaggaaaccagaagaattattaacaagagagaatttataacaaacaaatttgatgccaattctatccttgactctttttttttctattttttttatctcttgagtcatctagtcatttcactgtttgaaagttgggaacatctgcatcacctaagatatgatcctacctatccctgtggaatgtgttatctgtgtgttcagtttacaggctgtgttactaaaataatgcatgtatttgtgagtagtagtgttctgatgtgatgaccttcaagctagacctccacatttgcgagaactttcaccatcaagacaaaaaaacatgatgaaacaacctatccaatacatataaagcgccataggatgaactcactcataccaaactggcactctcatggtatggtatgacatgtggaaatgggtatacgcatgagatctcccggaactgaattcactttgatataataacaccttggcatgtaatagcattagtaaatgacgtccaaggaatattagagtaatcatagcgttaatactgtaaaaggaacatattacttgtactagtccttgattgacattcagggtctgtttagttcccacaccacaccctgtcacatcgaacgtttgaacacctgcatgaagtattaaatataggctaaaaaaataactaattgcacagattgcgactaattttgagatgaatcttttaagcctaagtgctccatgatttgacaatgcgggattaattaggcttaataaattcgtctcgcggtttactaacggattttgtaattagtttttttattagtgcccaaacaccccatgcgacaccctatataatatccgatatgacacgctaaaactttacacctctagatctaaacaccccctcaatacgtactgaaacagctaccggaatccagaagtaaaactttttcacctgagtatcacataagctcagccatttcgctatggtactctaaggtctaaacatggcaaatagtctaagtctgtaacaattattatagatatcagtacaaacaacttaatggtgaggagacagttatatcatgattttcatgctgattattattcctatatatgatgtgcttccttcaggttggatgatgatcttgccaatgattttgccgcaagttatgcagttgctgcctcaagcttactgcctttgtttgctaaaccatgaaaccagcacaacaataagagactccaattgcaagagaccttccaggaaatctttagtaggcatcatatgttcaatacaaatatacctgaggttgttagagcaaattatctgctcatgtacgattacactatctctattatcagaaaatcacaagaacttttgttgctgggttttgcattagtacaagtatctggctcctgatttttcttgacgtttatcattttccattctgagctatacgagcaataggctccggattgtagtgatctcctgtgcaagttttacctcttcggcaaaaaataattgtcggcctacggggcaaactattctgtcccctctaactaataatgtctttgaacattttgatcatataccctcccattttatcaaaaattgaggatttattcttctgtcactgacatgtagggtttatctgagggcattgacatgcggaccatgagggtaaatcctcaattttaatctaatgggagggcatatgatcaagatccacattaaggaccagctatttaaaatacggaaattaaattcttaaaaaaatagtaagtagatctgtatacttgtaacatttcaatttattaggttactgcaacaaaattgatggagaaaatactccaaagagtcgtgtgtgaattatgaccagatatttgtacctttcaatacggtggaactttcctgcttaatgacagtagaaatcacaatgtaaatgaactagtcacttgattataaagcctcatttagaggatcacaacccttacatgggtttctttggaattcagatagaataggctcttccatagggattttggatttaaattttgtgaggtcatatgtcatgttttcatttctttgtttttgtaatcttatatttctagactttgtttcctacaaatgccttgtaaagttttcacgagttgttcattcctctggattttaaaggatgtgacgctattatattttttctttaagccacaaacaactaaatttcaactcatttcaagtgacaagctaatgccaacgcccaacgcatcattcgttggccattttcttgtgcatttgcctatacacagtttgttcttaatctagccttattcagatttatgtgaatggaagtcctctacgttatagtgttcatggctgtgtggttaacacttaacagtctataggattgtttaattcatggtaaaacctggttcgatggaaaaatagccaaattattttcccggtccttgaaagaggtaccgagagtgttgtgctgaatggatgaataactgtatagtttgtgataataattcgaatgtacaaacgaactaagggtgcgttcgttggattgggtgagaaagccccatcgtattccgcgcgcacgcttcccaaactattaaacggtgtattttttataaaaattttctataagaaagttgctttaaaaaattatattaatctatttttaaaatttaaaatagttaatactcaattaatcatgcgctaatggctcacctcgttttgcgtatcttcccaatcttctcaaactccttctcctcaaactcaccctaactatatattataaagttgaaatataaatttgaaatgtttttttaagaaatttatatatataaagtttttatgaaaattatgaaccatggcagtttgaccaaaccatcgtcaacccgacaaataagccttcctagatttttattgagaatctcactatcgcattagccactgataaatctataaaggaaagggaaaaaaaagactttgttagagcatccattgcttgaactcctctctctcaaatatggagtagttacttaggactattttttagtaactatagtaatatgagtgagttgtaacttgggtcaatttttattaccaaagtttaggaaaatatataatataaaccatatatgtagtgtaaatctgaaaactaccatgggatcgagaaatagacgtatgatatttgtccatgtcacctggagtaaaatttttactcttataattaaccagattactgagagtaaaaaaaatatcaggcttctacttctcaatcttacagtagttttacactagatatgtaatttgcaccatatattttctcccaaagttttattttggatcatcatttacattttttttaccttttttaggttgaatgctacaaggcatttgccccgtactgtttttttttccctttagcctaggttttttttttttcaatttggaacactccgatcactctcctttagcacaccaacgacatcaagcacatcgccaccacgcatcagcgaactctcctacgaccaagccatactttcctggagaagacgatatggatggttaaggaatagagtcagggtagtaaaataaatatagagttggccaaaagttactttaacagtgaaagatgccccaaaaatgcaattcactctagtaatattttgacaactacaacaaaaagtgtctttgaataattatccaatccaaaaaatgtgttttgagctaaactaggcacgaacttaaaatatcaacaagtccgaatcaaccatataatcttagaagaaaaagaggtccaaaccttaacccacttgtcaaggaggaaatcaactgctgccacatgagcttagttgtaagtatgaagtagccaaactagatgccgacttcaacttttcactagtcaaattatactggcatttatttatatactccaaaaaaggttcaaagaatcaaagtagagcaaattatctatctatatgtctggtcagtgctgaatgttcaaaccagtatcaacttgttaaatttaataatctaaacgagcagagagtgcaaagaatataagatatttttaaaaaactatgaaaattatgaaagaaagccatggtataaactatcggtggctaaaagcatgtgaactttggcggcgagctgcatctgtgctggcacaaactgttttattctgcactagtaacgtagtttttaacacccatctgattaaaaatcgacaaaatgagtagctacctactttgtttaaaggtgtgtaattgaatattagcacataatttagatgggggaatatgtcttgggatgtgtgaagagaggcagtgtcttaacattgccaatatgttattagcaataatgcatcattaagaattggctacattagaagattccggtagtaaagcgtatccagcagacacacatccgcatgtagagtatcagacaccatacctcacgtggctgctgaggaaaaggctaattattggcctaaatgccgcgattggggtgcgtttacactagcataattttattacctcgacggttagtaagatcttattacctcgacggttattgaattggaaagaagtccatttcacccttggcttttccttgtcgactgacgatggcaacacatcaaattatccgtctaccagagcatcctaaaatttaactcataaaattcttggattgggaccatcccaaaagaaattgggcccaaaaatcactttctactacaagagtgcccataaatttggttttcaataactttaaaatatgccacatcatctcaagtagatcctgcttcaaccgtttatgtctttccatttttccggtaagagggagattggcgctgggaattgccaaccaatcacgcactagcggctcagctatgctgtgcagtagggtgatctttcgcgtgcctagcagctacggcagcccacggcgagggcgtcggcaagtctgcaaggcacatcgaggaggcaggtagggccactccagggttcatccatctcgtcataacgcgtgacaagggaagaaaaggcgtgagcggcaaaaacctcccgtgatttcatcaattgggagtgcgtggaggtgtccaaaattggttcagattgattctagttttaggtgtaggtaaatagtgggaccatctttgggcatctcttggagagatggttttagactggattcctaaaatttatcttttagactagattcctaaaagagtatctccattttttaggcgtgtcacatcaggtattatatagggtgtcgcatggggtgttcggcattaataaaataataattacagaatccgttagtaaaccgcgagacgaatttattcagcctaattaatccgtaattagcaaatgtttactgtaacgccacattgtcgaatcatggagcaattaggcttaaaagatttgtcttgcaaagtagtcgcaatatgtgcaattagttattttttagcctatatttaatacttcatgcatgtgttcaaacgttagatgtgacagggtgaaaaatttttgggtgggatctaaacagggccttaaacacaatcctaagtccccaaacaattctgaggggttaaagctaaaaacaagttatagcaaacacctacaatgagagcaaaattaaaaagtcctccgtcggtatccctgcaccaccggtccttctctagctagctatttctacaccatccaccctccccaccctctcaaacctctaccacaccttgcaaactccaataccactgtttgtgcagaccttagcggatgaagagtgcaacaatgccatcttcggctgcctcccgagctaagcacctccaccattctctctgtcctccttcatgtcccttgcaccgattaggctgtgttgcgccgtaggccctagtttaaggcagggttgaaatagaatagaacaaaatagttctaataaatgagagtagtgctgaagtttgaggcattattccttaggaaattggataacccctatttagtttttaggagctctaaactatgggctattgctagggatgttctaatatggttggaaatctttataagggttggaagtgttccaaatactttttcctcatggcatgcttttgggtcgcaatctcttgttacgaaccttcggcactcggtgctcgagctattgcttagctgcagtaagcaaacacaactgctctttactttgtagatacatgtgcttgcctgtagcgatgacgtggcgagaattacagacaccagtgaggaagaacaacgactatgtttgcttgaggggttgaagttgacctaatagtttaaactcaatatcgatccaaagtgtaacagaatacaaagatttatgatattgagtgaaaatattgagcttgatctaatgtacttttaaactttgagcaaagtgatagtgggcatgttcgacttagattgctctagtagcagtggttgctgtaaaacacgtatgctgctatcgtgcagctgtaatcaagtggtaccgaacaatagtctaatgtaaagttttactccataatataataatgtatttattgataccgtcatttttttctatttagactaaattgtactcacgatacaccaacttaacatgtggatgcaaatttagttattttgagcatctttttatatacatttagtttgtaagtgtttattttgtcaatgtacttgtacaaatatgtaaaagtatatatttttttcaatctaatcactaaaagtcaattaaattttactatgtaaaaaatgtatatctcagataagatttgagaaggtttttaaaaaaatcctgaccgctggtgtaaattgaatgaggaacgcaattcttatatgttaaatccaagattttaaagtaatattcgcacgattgctatatgatatcatattggcatcgtaagaaaaactcatctagcacccgtggactaaaatagcacatattgagctaagttattgtatcaaaatactagtttgataagttcttatactagaacgcatccacattaccaggttgtttcccttcgacgttcaattctcaagttcttaactaaattgttgcatcattttttaaagagtaaattatatgttgggttcttacctaagtttcaccatgaaccaggtgtcagcacacattttcatttaggactagtcattattaccaaaactttcaatttgaactagaggaccacctgccatcaagacaagttgtctcgaggaggaggaggagaggagaggagattgagataacttggaagtgatttattaacgtgaatataatttactcttttattccagtgatcgaggctatgctttcataacttatcttctcattttttacgtgcatgctttccaaactactgaacgacgtgtttttgcaaaagttttttaatacgaaagttgctttaaaaatcatattaactcatttttttaataatttaaactaatattatattagttatacggtaacgagtgtttcgtcgtatgtgctggacatcccgaacacagcctatgagagttgctagcttgctatacgctctctggtctatgctgctctgcctgtcttgctcgtcctctgccgcggagacacttgctccctctgttctgattttgacatcttgcttgtaatattttaccactcgtcttattttaaataaatatataaatataaaaaacgaaaagttatgcttaaagtacttttaataataaagtaagtaaaaaataattctaaatttttttaataagacgagtggtcaaacagtaaaatgtcaaaatccctaataacttatactttctctgttttatattataagcctttatagcattacccacgttcatatatatatgttaatgaatctaaacatatatgcgtacctagattcattaatatatatatatacatatacatatatatatacatatatatatacatatacatatatatatatatatacatatatatatatatatgtatatatatacatatgtatatatatatatatatatatatgtatatgtatatatatatgtatatatatatgtatatgtatatgtgagaatgtgaaggatgctgggaagttttataacctgaaacggaggtagtattagtgacggagggagcataatagataaactcgttgtcgtcgtcccgtgcggtgcggcccccgctacccgccgcgcgatgccccctcttctccgcccgcctgatctagggttttactggagccgccgcgcgcagcgaccagccgaccacggacgaggacgaggggatcaggtgagcccgccgccactctctcccccacccctccgaacccgttcaattcagctccccgcggatgtgatcttggttaggggctagggttgggtcggttaacgaagatcggttccgcgtctcatcgtggcgtgtgtcttcgcgtgtgtgtgttgggttggggggagtccgcgcatgcgttgtgtgggtttttttttttcaatgctggatgcgattgaaattgagcagaatgcccagtttactcattcagaccgaatgagcttcatttactcattcatctagtgttggtgttggaagttttgaagacctgagtatgcggtggctatataatgtttttgttgcagatcagttagctttgctggttggacaaatcgagtcctagatatcttggatttttcttttttccatagcagaaggttgtgggtaaaggtggtgcaagacaacatggaatataaaaggccattgtattcatgctggctgaataaatactagtttctcgcacacattatccaatggactctgttttttcattgtgcataggcgaagggggttatgttgtttaaataaagcattagggcaccattatatttccatatgcacggactatttctcattatatattctataattgacactgaaccagtagggtctgaaaaggtcatataagcttagctgtgagtagctcagatattcttttcctatttattttggctgaacaaatttaacaattttagctaatattcgtttcaatatatcttagatgcaaaaaaaagatatgccttgatgcaaaatttagtcgcttttgcttgcatcgtgtagatttattgctattgtgcccctatgctctggcctccaggcttactcacgacaggtgatggaactaccaacatctgtagctttccacccatgcagtcttgtgccaggctggttgcatgctttagctgttttgcatgtgtcgtctgtcctatttttgttttcttgatgtcagttgaccaatggaaaatcttatgagtataggattaaacaatggtctaaaagtcggtgctaggtactgggtagccactgtaatttggtgcttccctgccttgggggctctatattgctatgtaatgttatattgtcttctttcatgtcatatgcttcccaactgcttgaaactccatagtcaagtttgttctaggctgtaggcaccgcctagttgacatctaggtgctaggtgccagccttgctgaccctctagcgcctagcggcttcttgaaccaatagtattaaagtgaataagtgttttagcatttgttttggaagatatagctttactacggggtatgaataccattatcccaaagagttgattgcatttttcaaatttttttagatgattgatccgtaattttcctggttgatcatgatattctttacattgcacatgccatgatatagatttgaatgttcccaaccaattagttaattgcactgccatcctgtcctatgagaagttgaaaatactggctgtatatgactaataagcacttgattgagttcttccctctgttatttcctttggtatgtcttagaggtagatctatagggtgcttttatgctattctcatatcaccaaaccaaaaattctgcgcattcttactggataacactaaacagataacatgtcaaccacttttgcagagaaaattatgtctgtgacacgagcaagcattaaaagtatcacatgtacttttgctgtagttgatatatgacggaactaaccttttaattgttctgattagatatgcaattgggggcagcaagctagaggtggcaactgcataatttgcaagaaattgtaagttctcttggaaaagtctgaaatgacatgtattcataattttattgatcctttagttctttctag

SEQ ID NO: 57822 - DNA, 1112 bp, Oryza sativa
aaaaccaacagaagaaacgaaatcttttaaaaactatcacatcaatcacactgtctccacatacgtcgcggtacttgggcttctcggggaggttggcgacgcggccggaccgccggagcggggcatcctcgccggcgcccggcagcgcacgcgccttcctcttccgctgcttcacctgcacccaccggcaaccgcccagatcaggaagagacccacaaacaaaacaaccagagagaatcaaagaccgagaaaaaccaggggaaatccaaaaagaaaagaaatggtgaggggaatctgaccggcgacggcttggaggcggattcgcggacggcggcggagaggtggtggaggcggagctcctccagcttccgcttgttcgcctccacctgccgcctccgctgctcctcgtacgatgccgcctccgccatttggctttccgcttcgatcattggaaggtgaagtgaagtgagcagagagatggaaggaaggagataaaaatcgaacctttggatggcaaagagcgatttttttacgtggacatggtgtatggaccatgagggctaatgcgttggtggtggatactatgggtgtatggactgggtgtacggagtgtgagatgagaagccgaaagattcaaactttcaaacagtccagctccccttagcttttttcctccgagaaacaagggagggtttcctttatttgaaagtacttagtgggcccacttgtcagtgagacaacgaatctgaaagagagagaaagaatcgccttgtgggctactaaaaggcttgggccatctctgtaagaatcttttttaggcccaacccattcgaaacatgtgttcgggagattttgggtctgtttagaggaggttctagcaacgcttctcacaaaatctccagctccccctaaacagattatattgttacccagattttgagaatatatagttgtagaatccaaaaaataatctagaagctagaagctggaaaacccaacttcttcaaattctcagaacctggctttcaactagtagatttttagaatcttaagttcactcaaacaggtcatttacatcggcttggttatctaaccaagataactaacactag

SEQ ID NO: 57823 - DNA, 2636 bp, Oryza sativa
cggaggaggtattctttgaacacgtgttaaatttatcatcctatacatagtataatactcctgtattcaagggtacaatgttcttctagcgctcaagagatcaaccttacattaagactacgatgttcttctagcgctcaggagatcaacttgcgacaaaaacactagtaacaattcaattattgggatattaaatatgtgaaggaatataccaaatatatgaatgggatgtaagttgagctatcaaaaggacaataccttattaaatcaagttgatcaattatttgtactagcacagtagcagcaactaatggtccagcagaccagcaccaagtggtggtgtgtgatggcccgcgaattgtttcttggcagaaatgtcatgtccaaatggtcacaaattgatcgacgagttgatggcacgcctcaccaatctccactctggagtgaagcaaaaagatcacaaaaaggttggctgtcccatggaaaaagtgcagatgcgtcacacaagctgctgcaactaacacaaaacacacgcattactaaactccaggttgtatgtacttgttggttattctgcaggcaaaaatcaatacctttcgcagctgcatagtgtgtatgtatatatgcaccaatcgaattggttttcagtgcttgttactctcaaagttgtcgaacctgaaatatgccatttcaacagacatgtttcatggtttggctgctaccatattgcggaataacctttattctgatttctgaatgagaattacagtgatgtagtaatcaattatgaactcaatttaattaccggtcaaaagctgagacagtatccaggtctaggcctgtcttaggtgttgactgtgatgagagagttgaggcaagacaatttaacacattgacattatggtttcagtcattgaactttggcactcacctaattcaggaggaatttgaaggtagctatgcccaaaaaagtttgatgtttggcacatacttgccctttttgacatgttgaggaaaattgctgactttgtaaagatgcacacaacaaatttaatttgtgagcatatggactattccttatcagaaagtttgctttgctaatctagcatatactcccaagtatatgaaaaatttggtaagataaatttcatatttttacaagctttactccctaagatttctcatcaataactaaatggaaagctttcccatttaatcatctgaaattcttacctaattaggagctaaaactcaagcaagtaaagaagtgtcgtcaggacaatctcattttgtcatctctcatttagagcaggtacaatagcatactataagccagttataaatatttttttaagaagataaaagaggagagataatagcagcaggctacagatttatagcccattgcagcacggattccaagacgcaggtgggaccagatattgattgtgtagcatatgtttatagataactattgtataaattagctattaagttgattatagatgatttgaagccagcagttggctatactattaaacttgctcttagacgacaaaaagcctaaaatgactggtggaatcttcttttgagaccatatatacacccaagggacaaaaatagtaagacaatctagagaacattttaatacgattgttgccgtgactttgtaaccccaagtttagtgttttagttgcctttatcaatgatattgcgtgcgttgaacacatgccagtaataacagccgtctctccttttcagattaaaaaaaagaagtgtacacccttctttctccatggtcgtcaaaggcttttcaaaactctttttttttttctaaacaaatatgctcccttcgttcttaaaataattggcactattaactactgctatatcatttttaacttttactgtagatgactagattataataaataaaagatttatgattatattcgtaatgctacataatttgatatgatatgtttttatattttatttgtcaaaagataggttattaaagttttaaaactgaatatatcgtgaagtgagcgtaacacaactggttagtttcttgtggtggatccagcccatattgataaacgacgtcctcactgataacgagatatccatgacgatgtgtgtggctaacccatgaactcacttatagaacaaaataagtaaccgtttattttagcctataggtaagtttgcgggttagcaacttaccactaatctgagccgtcaatctcgcatcagaaggtctccacctgtcccacgtggaccaatcacactcagccagctggccacctcccctaaccaccatcatatttaagccccaaatggccaaatcctcctcactctctgtaaaaccaagcaaacaaagaaagaaaagcatcacaaatctcacgcactgtctctcgttcgcgcaaagcacgctgcttttctccgctttgcgagcaccatagcctagcccaccatgtgcggcggcgccatcctctccgacctcatcccgccgccgcggcgggtcaccgccggcgacctctggctggagaagaccaagaagcagcagcagcagaagaagaagaacaagggcgcgaggaggctgccactgcgccaagaggaggaggatgatttcg

SEQ ID NO: 57824 - DNA, 509 bp, Oryza sativa
ctttgtattgtctgtctatgcccgtacgtgttatggttgttggtactgaaagtgaatttcatctttgttaaagtcttttgatctcatataaaactatgttttcacctttagtgagtttcggatccttcataagagtcttgctcccttgttcatagaactatggcattctaaatcaaattaagaatatagtaataaaaatatgttctatggtttaaattgttataagccattttgttctaattaaattgaggcatcaacacgtaccttgtactggggtaatcattctctatttaagttgttccatggctatttctttttcttagaacaatgactaatcctgccaattctcaggttgacacatctacaggggaagttgatgaggatggtgtggaggatgaataccagatcgaagacctggaaattgtttcggctgattacatgctgagggttgcagtctccaacttcaggaatgcctgggaaaatatggacccagaaagtgagcgtgtcga

SEQ ID NO: 57825 - DNA, 6064 bp, Oryza sativa
acaccgatcttgttccttgctccaggtggattgaaaaacactactgttgctggtgctgatgggcctgcagcaaggtctgctaaaaggaagagaaagaaccaattcaggggtatccgccagcggccatggggcaaatgggctgcggaaatcagagatcctcgcaaaggtgtccgcgtctggcttggcactttcaactctcctaaggaagctgccagagcttataatgctaaagcacgaagaattcgaggcaagaaggccaaggtcaatttcccagatagggctccagtggcttctcagagaagtcatgttgagccctcctccatgaacatgcctgctttcagcatcaaaaagaagccggccgtcatgtcagcaggcaacaaacccatgtacaacccaaatgcttatgcctaccctgctgttgagtaccccttacaggagccatttgtgcagattcagaatgtctcatttgttcctgcaatgaacgcgattgaggatactttcgtgaacctgtcctctgatcaagggagcaactcctttggttgctcggactttagccaggagaatgatatcaagacccctgacataacttccatgcttgccccgaccatgacaggtgttgatgactccgcattcctccagaacaatgccagtgatgcaatggtacctcctgtgatggggaatgctagcattgatcttgctgacctggagccgtacatgaaatttctgatcgatggtggttcggatgagtcgattgacacccttctgagctctgatggatctcaggatgtggccagtagcatggacctttggagcttcgatgacatgcccgtgtcggccgagttctactgaggggtttggggtgtagcaactggtgcctgtatatataaggacaaatggtaagcatcagcaatgtgaaaacggctaactctttgtgacatttcgatctccatttctctgatctttctccgcctctcgtttcaggaataaacattctggacatccaagaagcggcatgtgtctgtcgggcgctgcgaattcgagctatatagctatgttagtatgttagtatgtgctgtgtctagcttagatgctgaagtctcaagtactatttggcagtgaaactatctatctgtaactgctatatgaggctggaacaagttacttagcttctaccttatctgtacttgctatagtggctgtgaaccttgtggatctgaactctgaagccaatgtttactatataatgtggttggttttataaactctagttgatttggacccctgtcaatggtcatgctatggctggggataagaaccattgatgatcatatttgactagaaacgctgcttccaaaatatcccataaagtaaagctgaacttgtactaatgttcttgcacaagttgcaataatgttgccttatggaaaaacagtttccggaccaagtggtatctgtacgaattgctattgtaggctaacaacttgtgctcaagtggaagatggtgagtatgaatcatctttccttcagttgcacttaaactccggacctacatatacattgactgataggccccagccaaaatcttgtcttctacataggaattctcgggtagtttcttattacttggtaatggttgttgcctaggaaaaattttggttgccactcagttttgattgttcttaggttggagaaaatttggccgttctttgaatttgttgtagatagtagagcatcatgttcgattgagaattttgaccgattacacttcatgaattgtacaaaattttttttatcgggctcctttctatgatttttttttacgcaagagttagaatccatgttggaatgagtttatttgagcctccaattctccaaactatggttatcaaatcttgataataaaaacatctgtgctgtgtatccaaccattgtgcactaatgcactatgatatttatgtatgtttggtttgctgctagtctaggatccttgctgcaatatgctaaaactctagtggagtattttacgttggttgttgctggtaataggcaccatcaatattgaccatatgggtatcattaccctcccaaaatatctcaaaagttaagcagtacataacaaattgcaaaggactatcttaagaaacaccgtcttataattggatttttgggcagcttcattgttgatttcgtgcagaaagtggtcttttagttcaggaagaaagtgaggggaaaccaaagagagaaataatcttccttcttcgtcgcactgctgtatgtactcggaatagacctgtcagtttgttgaaggtttacggccctctcctccatcacatttctgcagtctggtgtcgcatttcctggtgcctcctgttcctacaccatgggattcccgctaataggctgtccatcaggtttgcctccaaagaaggctcagaatgaaaggttgcatacatgaatgcaacactaataatggaagctttagtaatgtgttatatattgcctccaaggaagtatgtgttgtgttgtgtctagcttatcagctcaagtctcaagttctctctggcagtggagtatctatctgtaacaagttacatagctttccagtttattacacttcgtgaacaatacaaagttttttatcacagtcctttccatgtttctttctagacccacaaaagaactgaacatcatttaagcttcatttaaatgttggaataagtactttcgaacatcctgactatgctagtcttaactctaaaagtcacaatgatacgaagatgctatatatgaacttgagctagaaccaaggggccagaacatcacaatcctagccaagatcaaagaggaagctgtagcttgggtgaaggcaggagcatatagactccaagagtttggtattctaggagatatcacctaatgcctttttcctgggactgtcgtcttttgacaatccctgtgcataacctttgtatacttttattccttatctatcaatatactaggcaaatcttttgcctttctttcaaagaaaaaaaaggcataacattaagaaagatatttggtgccaattcattcttcgatgtctctcatccctaatgtagaatggttggatatatttcaattgcatcacaaagaactgtatcaagtgaatcaacttctctaaacttcatgctggtatcccttctccccatttataagaagagaggagcagcacaaatgtgcttggtctgaaatagcacaataaccatacgagtcatagttatgttttacttgccatattaagtccacatgacatgttcattgatcctcaattgtactagagtgtacattgtttggtgattttttgacagcgttgatgtagagtttcctgcaggatagagtcctctgtcatgattcatgagctcttcacctcagcttggaactcacgatgaaagattgtcttcactttgcagctagcatagttcgaagtgctttgtgcaagcccctctacatgtgcagtaggcttagtttcatttcaacataattttcccttgcgaggatttcaacagaaattttgttaacacatgtttacctctgaacatgcctagaactccaacctaaaatctagtgttttacatagaattctcgggcggattatacttttttcgaattatacttagtcctggcctttgggtagtagaacttttggcccgtcctcgattttgaagtagatcgtgtagcatattgtgttatctaattttgaatgttcatcatgccattactcacaagtttttatggggtttctttccatgcttttctagaaataccttcaagtaaggtacacggttgagggtatccttagatcaaaccataggggttagaacattggcaatgaggtttggtgccacttgcttctccgatgcctcccatccctagtgtacaacattataatggtatattccatgtcattgcaaagaagagtgtcaagtcagtcatctcttcttcagcttgtctgaaacatcaagggtggtatgccttctccttctctccatttataagaagagaagagaacacagatgtacttggtctaatctagtgcaacaattgtacaagccttaattatgatcattgatcaagtaaggtacatggttgagggtatccttagatcaaaccataggggttagaacattggcaatgaggtttggtgccacttgcttctccgatgcctcccatccctagtgtacaacagtataacggttgagtatattccatggcattgcaaagaagagtgtcaagtcagttatctcttcttcagcttgtttgaaacatcaagggtggtatgccttctccttctctccatttataagaagagaagagcaacacaaatgtgcttggtctgatccagtgcaataatcgtacaagccttaattatgaccattaatcactcaattgacactggagtgtactttgtttagtggtttttttttgattgacttgatgcagagattgcttcaggacagagccctctgtcatttgctcatcatacaaatttgaaactcatgatataggaaggtgaatagctcattgagagtgtgctatgctataaagtaaagctgattgctgaacttgtaatagtgttcttgcacaatttgcaaaatgttgctatatggaaaaacagtttccggaccaagtggtgtcgtactaattgctattgcaggacaacaacttatgctacagaggaagatggttagtatgaatcatcccttcagttgcacttaactccgtagcccggacatactggtagaccctagctaaaatcttgtcttctacataggaattgtcgggtagtttcttattaattggtactggttcttgcataggagaaattttggttgctcctatgttttgatgattctttggtaggagaaaatttggtctgttttcaaatttgatggtttccactcctcggttcttcgatatctcccatccgtgatgtagaatggttggatatatttcaatgacatcacaaagaacagcatcaagccaatcaacttctctgaaacttgatgctggtatcccttctccccatttataaggagagaggagtagtgcaaatgtgcttgttctgaaacagtgcaataacaatacgtgtacgttgtttggtgattttttttatacagggttgatgtagagtttcctgcaggacagagttctctgtcatgactcataattatgttagcatgtgtttgacttcttggtgtttttgcccatcttagttacaacttgcacttgcttaccttcggacatgcctagaccccagcctaaaatctagcgttttacacaggaattctcacgtgaattctttttacttgatcctggccttcgggtagtagaacctttggtcactccttgattttgaagtagattgcagagcatcatatgttggtcaagaattttgaatgttcttccctcatacaaacgtccagttcttattaagtttctttctatgtttttttcccagaaatacaagaagaatcagcacaagtttgagtagatctttagctcaaaccataggggtcagaacgttgacaaggaggtttggtgccaattccttctttgatgcctcccatccctagtgtacatcagtataatggttgacatgttgagtgtatttccatggcatcccaaattatagtgtcaaggatggtatcaccttctctacatttataagaaggaagattaacgcaaatgtgcttggtctgatgcagtgcaacaaccatacggactttgctcattgatccccgaattgataatggagtgtactttgtttggtgattttattttgatcggcttgatgcggaggttcctgcaggacagagctatctgtcattagctcatcacaccaatatgaaactcatgattagaacttagaaggtatatagctcaatggaactgtgcagccaaattaacttagttgaaggatagcatctagcatagtgagaagcgcttgtgcaggaccctctatctgtgcatcaagctttttttcttcttgacataaattttgttaccatgtgcttacttatta

SEQ ID NO: 57826 - DNA, 2486 bp, Oryza sativa
cgccaccgccatcctccctagccgccgccgccaccgggggcggttcccaactccgcctcccccaccacgcctcccacatcgcgtcacccctaccgccccgcatctaccggccgacggttcctccgcgtcgccgccggctcctcccgcggcaccccacccccatcccggcgcttctgtccgtggagatcggcggggtagccggctcgcaaggtggagcatcgatgtgacgtgatgcagcatttggggagtctttggtagaggtggagcggtggagattccgacgccgccgaagccccacccagtgcacatcggcgtcgcgactcccgccgacgccccgccatcttccgaccggcgccgccgcccgcatcactgccgacgcctcgccatcgcgcggccgccacgccaaccgcgacgcccgcctcgccgatctcctccgcggtcgctgccgccatctccaccggccaccgctgtcctcggtacgcactgctaagtcctaacccacccatgcctctgccttgccgccgacaccaataacccctgcgtccgctgtgcttcacgttgactggtcatggaaccagtgcagcccactccactggctggagctgcttccctcaggctgccggaggtagctcgctgtgccaggttatcagtcatctcaagcaatgtgctcattaggctattgtttgattcacgtacagaatctgttgcagtagtttagacgatcttgcactatacattcctgtatttacaaaatctgttgcagtgtttgattatacattcggcatcatattttgcattatattgttattttcaactcctgtatttacagagtgttgacatgttatttgtatttagatcccagccaatgtgaattctagagctctgttctaaatgttggtaaactctaatgaattctagagctctgttccaaatctttgagtccatactttagtccatgctctgcaccttagcaaaaatgaaaatgttatctgcagctagcccaaggaatccacctgcatccagattatgtttcttcaactatttgttatatggttccctccagtcattcttttgtacagcagcgtgctcactatttgtttgctaaaatgttgaccatgcatttgttgaaatactcaataaaaatttgttcgaccactgccaccatggtcactattaggggctccacaccgatatcttcagcaagattgggtaaaatgtcttgctgctgatgtcagtaacattttttttcttcatgtgagttgctaattgttcctcataaggtccttgcaggttcaagaaatacaggattcatgtgatgagaaaaaggaaaatagggttcaactgaactctgaatctaaagaaaaacgaaacatacggcaaaaaaatatggcaaaggccaacataaaggtaatttgtatggagttaggtgtcgtttctacatgacaatactttattgttggaatttcctgttaccttgctatggtatgatatttggcttgaattgatgctaattttaactgtacttgctaaaattgctatggtttgatgggtaacaccgaagcaggaattccatgtctttcagatctactgtgctgcatcttgaaaaacactattgctagcatgtaggaacaactcatgaggactagcagtaggtatatcagtaacagcttatctatatccctatactatattatcatcactatcattggtgtgtttagttccaaagtttttttccaaacttccaacttttcccatcacatcaacatgtcatacacacacaaactttcaatcacatcgttccaattttcaaccaaacttccaacttcggcgtgaactaaacacagcccatatctatattcagaattatttgaagatgagacgatgactagcagtaagactgctcctattcatgtcaaactctgtccatcaagattgctagatatctctattggatgctgttagtaactcctattagatgtgtttttttttggctgttagtaactcctattagatgttaccattggactaaaatatcataagtatatctgtactcatatatgaaaatctcatctagaattgctctttttttactatatttacagctatataattttgtacgaaatcatacaacaactgctctaagtaattagttagatagcaaatgctcttcgtaattgtacagaatcatgtgatgtcatcttacccaatcctggatttctgtcttagctaagatgggtgctttgctttacataagacagacgtgcatgcatatctggatttaagccgtatacttctgccttaggattttgtaggatgtgggctttcatgaagaaggtttgcagctcagctaagttgacgcgggggcagtaagcttctgcaaacctgggctctattttgcacagggagaacacaatagcagaggctaccatgagaagatctgataaatttccatttgagaggctcggttattgatgtttcctaaggat

SEQ ID NO: 57827 - DNA, 1654 bp, Oryza sativa
gggcgaattcgagctcggtacccaatactccatatttttgaagagaatggaagagaacttgtgatccttgccaccagcccgccatgcctgaatcagcattagcccatcggtggctgtcgatacattttgacaaaaaaaaaagagagaataaaaaatgaaggataggcacacacgttttgctaaatgcttgaaagtaacaagagatttgcggatgtcaccaagtgaacagaacatgtagatctgcaactcttactccggaataagagccaatcttgaattaatcatcgccaacatgttacccagcttttcgggaaggttccgctctatatcatttccagatgcttcctattcttattttgtttaaatagttttcgtcaaaaagattaaaaaaaaaggtctgacgggagttctccatcagcattatgaaattatcagctcttctctgttctttctcacttacgttaggctgtttctgtgattctgcaccaccatctcttctcactcttaaattaatctgatgtttcttggtgaagggtactaatcatatatgtctcagagcagttctctcttctcgatatttttaaatatttaagatataaatgaacattcgtagctaactttgaccaactccaactctccgagaaatcagccacactacgacgctgttgtagtaccctgctctcaactctagcttgatcatggacatcagctcttctcctcccacattaccttagtctcaggatagcgcaacgttctaattagcttctcatgtgagccatctcatctggtaggtcccggacgaaatagattgcctgttgaaggtgtgctgctatctcctccagcataagttgtccctctgctgccgtatttcctagtacctcctattcctacttcctgcgccatataattcacactaatggactgtctgtccatcaggtttgccatgaaagaattttcagatgagtatctcttgctctcttcacttattttgttcaccttggttgagtctgttgtgatatatgtaatgatccaggagcatccgtttgttgtgataaccataaagaggctggttgcattgcaagcatgggggccaaatggttggcattgcaacaaggacaacttctgtaagaagtcagaactagtgtattctcaaggtggctctgccaactgctattttgttctccttgattgcctgacatgtgggcctgaatttctagagctttcctaacaccaagtgcgtgctcgttgaactacttgggtcatgagtgcaatgtgcaatcttttctaacttattagatcaaataaatactttccccgcaaaaaagagatcaaattaatacatttaaaacaaatacaatgtgtgttcaatcacaaggtggtgtttgtttgtaatgaagatgaaaattaagttagagcgcggaaaacaagaaagccactatcttttaattaattgagttaagtattataaatgttaaaaaatagatttatctaatattataaaggtacttctatatagaattttttttcacaaaatataccggttagcacaaaaagtacctgacccattttattccgattaagatgtaaattccacctagatttccattagcacgctttttaaactgttgaacgggccatttctttgattgatgga

SEQ ID NO: 57828 - DNA, 699 bp, Oryza sativa
ttggtgattaaagttgcaaatatataatgcactcttacactctctcagtacaaaatactaatttgttcatacattttgtagatgcatattaatgtaactggaaattaaaatggagcaaacaatgtgttttctgttgatcttatgcatatttggtttcatcaaaaatatttctcgagttgacatatctctaatttgctctagcaccccctcaatttatattctagattcgccactgtacacgggtattagctgtgatcgaagtccatcgatttctcacgaaatgacgttttggtttgatattgttaggaactaatcaacccaagcggaagagtattttgggtgcgtgtgtggtgaagtgcacgcacacttaggaccctgcaacagatggatccagggtttacaaaatcgttttatagtttttaaaaccacgatatgtctcgtggttatcgtgataactatattactatggagtttcggtaaccgtgccgaaaatgataagggaaatcctagacagatccaagacgatcttgaccgttcatgctgcttatcgatacatccggttactgttcatgctggcatcccgtcaaaataattctagttttaaatttcaaataaaaaaaataaaaattatgttcttaccttttatgtcgttggaaccatctaaggatataaataaaaaacatttcgaggggatcgggt

SEQ ID NO: 57829 - DNA, 9463 bp, Oryza sativa
gaggcggagatgagagggagaaggagccgaggaggaggaggaggaggaggaggccgctggtggatcgagaggaaggggaggaggatgagagactaagaggaaagtggcggtggatttttttaatctgatggggtttttaatatggcaatgttttcacagtgcagtgctcttagtggccgtcagcaaaatatctaatttttgttaggtgtcacttaagaggactgcttgcgaaaatgacatatctttgctggcggttcacgttacacaaccattagcgaaaatagtcacttaataggaccgcttgcaaaaatggcatatcttcgctggcagttcatgtttcacagcagccggtgaaaatgcattttcgctgacggttcttagcctccacccctcgttacatttttgctagcggcgctatcgtctggctgccagtgaaaaaaaaaaggtgccaccttgaaaaaccttttttttagttgtggcaccggcatgatttcatcttccttctttgttttagtttctatttgattcattgtagtttgtgtgttcgaatggaattgctatgaagtgtgtatatgaactgcaagttcttttgatcctgtcctgtgtgtgtgatcgctaaagaaatgtgtatgtatggaactaaattgttgtcgattacctcgggaaaaaaatgttgtcgattaacgataaaaaaaatgtcatataaatcaaattatattttcttttttcctttaaatgagtatcaatggcggtttatggttatcctgcatacactgtatatataaatgtcaccgaacaaaatcgaatgttttgaccatgatgcttatccaaaacgacagtgttcatcaacagatcatcatcagaacggtgaattcctcttacttttttttttttgcctaaaagagtaggttacgttgttgtacgggatcagagaactccggcctctttattctttgcgtatgcaacaattttggatgggcatgtgcgtgaatgaggcgaattttgagctttgggagagaggaagtagataggatcatagaaaacgagacaggttgacgatctctttcggagtccacaaaagtgctgaagacaaatgatccggccggtaggatccacggacggaggaacctaccaggaaatccctcctacgacaatgatttaattcgatctgacaactgtgtcatctggagacatatactagtagtgctccatatgggcccacgtatttgtactctttttcacacatgtgcatgcaaatagtatcaaaatcgttataaccgataataatattagtacggtatcagtttaatgcctcgcaagtactcatgctaattaatcttgttgttgaggcaggtaattcacttgttcgttatttttcctagtcaccaaaaacagagcatttaataatgttagctctactcattgatcaaatcaaacaggaggtcgatcaattttctttatgcttattactgctccctccgttttataatcctccgttttatattataagtggtttgacttttttatagtacctttgtttataagtttatagaaaatttaataacatctaaggtggtgtttggatccagggactaaactgtccctatcatatcggatgaatttggagtataaaacataaactacttataaaactaattatataaacgagagctaattcgtgtgacaaattttttaagcctaattcatccataattagtgcatgtttactgtagcatcacataggttaatcatggattaattaggctcaatagattcgtctcgcgaattagtccaggattatagaataagttttattaatagtctatgtttaatatttataattagtatctgtgataggtagggagttttagtcccatctaaacaaggtcaaaaatataaaattagttttactaaatctaacattaaatatagtttgataatatatttgttttatacgaaaaatatttctgtaaatataatcaatatataagtttgattagaaaaaaaccaaacgacttatatgaaacggagggagtgcgtaattggttgcgtacttagacaatcatgcatattcagaaggtcaagaagtcgtttaccagtgaagtcacgcggttggatttagtaaacagggagctctttaattacttcttcctttttttcaatatatataacaccgttaacattttgaaataaatttaaccactcgtcttattaaaaatatatataattattatttattttgttgtgattgatttatcatcaaatgctttttaagtatgacttaaaatattttatatttgaaaaaaattaaataacacttggttaaacgtttgtcaaaagtcaacaatattaaaaaagtggtagtttttgctaaggctttgtttttccaatatattttttatgagtatgagaggggcggggatttatccgtcccttacttctttttcgcttgtatacatacatgcactcttttccaatagataacacttttaaataatgattttgctatatctcacacgaaagattttttcttatctctcactcgattttctcactcaaatttacagtgcattttcttgtaagttacagtgtaatttatgaaacttacactgtaacttttgtaagttacactgtaatttttgaatcttcgcatgtaaattttaaattttgtattggatttggtctttttcttgaggatatggtaatttagtgtccattatggtgtttcttaattgctttttgctttttattatatctatcggattttaatctaaagattaaaaatctgtgtgatacgatcgtaaaaatctttcgaaagatgtataggtactccctttaaataatatctaatcatttgttttattaaaaaccattgcaaatatgctaaagtgtaggtcatatttatattttttaatgataaaacatgttgcaataaaataaataatatttatatagatattttaattaggaagaatggttaaacatcgtgtcaatagtaaatattttgctcgcacgtcactatggcaaaggccaggataaaatacatcttgtgcaacgataaaatatcttctttacctacaaaaaaacactaaatcggacaggaaggacgcaatttgcagatatagtacagtttggactttggaccaatgattaaatcacaacaatccagtgggtttgctgttggcttccaacttgcaggcagcatttgtgacaactgaaaactaaacataaactgccctctcgtggataatcctgacgtcttgacgcacgtggtggtccatccttcacattggcgtcagttcagatttgttatatcaattgctgatgcttttcttttgtctcgtagtactaaactaaactgaatctggttttgacaatttctttttccaatgcagatagtgtttttcttttttcttttttgatttctttcttcttgatttgttttgcgtggagtacaaatagtgttttctttttctggaggtgaagcactcctttctcaatccgtacgtcaaatcactcaaggcgtatatacattatttattcgtaagattcgcagccaaacgcgttttatgtggtatcatgatggttgtagtctccgcggcgactttgagtaaaaggagaggcaaaatttggctcgttttgatttgattattgaacagatttacagattattgctaagaattagtactatctttgtctcagtgcagttgtgagattccgaattcaacttttaaccgtatgtcttatctgaaaaattatattttttcaaaaaagaatagtcacacataaagtattattcatgttttataatctaataacaacaaaaaaaaatactaatcataaatttttttaaataagacggacggtcaaacgtttgatataaaaaaaatgaaaaactataatctttctaggatggaggttgtcaggttacggataaggtataccctctattcttagatgtacgctatacgacaatataatatatctgcgcgtatacgaacgttctctatatacgctaaggaaattcatcatggagtccacagatggaaagattcctacccggataggaatgggtcgttactgtatcgtgtagggtccgatgtctccgagtcctacttggaaaccacctgacctgcggtataaaagggacccccgggaggacataaggcatcgaatctcataaataagacaaccaccacagcctacgaagtcaaagcctacaggagccaagccgccgggtgatctagccgaaccaactcgactacgatctcgtcagtatcatcgagttctgtcattccctttgtaatttgtggttttcactatataatcccataccaactgaattagggctattacctatcaaggggcctgaaccagtataatctttgtcttccattttcttgatgtcgtactacgtagatcctcgtaccagcgtacccaataccctctatatctggtctacgggtacccactgtcgacagtggcgcgccaggtagggggccttggtgctcaaggttctactgctatgacatcaagcttcgtcgacaacagcgtcaacaccggccccatccaaggagtctctacttcaacaatgctggtgtggactcaagtcggcgaaatcgtcttctcggtttacaccacggtactaatctcggctggtccatcaatgaccggaaacgagaacgccgtggctataaccccgggcgactccatgtcgaaggatcctcccgccgtagcggagaacggaacgtcgacgtcatacgagcccgagaaggttcctagtgcggccaaaccttgtccttccgacaagaaccacgagccgacaaggacaacttccgaggtaacaaagccctggtgtcctatccacaagtccatgaaacacaacttgcaagcttgctgagtttttctcaacgtacaagctgaaattcgtgcctgcaaggagcatggaatccagcgtacttctccaactcgtgatgtctattgtcccattcacaagacgaagaatcacgacttctcaagctgcaaggtccttctccgcgccatgaagacgccgcttcctaaggtccagcaatcagaaatctctcttaaggatgcagataaggaacaaggagcgacgttgatctcgaatcgatttattggagtaatcaacatcgatccccacgagccgtcagtcctacacttgcttgaagactatggctcgtcatcctccagcacaccacgtgacgtgtttgccatcggtgggactagcacgtctatgcacactaacgcagagacggggaaccaggcggtcacgctggcccaacacctcgacaccatcaatgcaatactgagagaaactccctatgatcctatacttaacgatgatctcgcacgatagacagaaccactatgggaatcggtagccaatctcagtaacgcgttcgaggaggccgctaccagagcacaaccagaacatccgacagctggcggtgccgacggcgaaccaccggagcaacggacgtcgcctagacgagctacccctccacctcgcggcaccggcgatctccatgaccatctgaatggctgccgagaagcacgacgcgcgcgagacaacgagaatcgttcccgacatcgtgtctcttcatgacgtcgcgagaacgaagagcgaggaggccgctcgaacgaagaccgactccatgataatcgtcacaaccgccatgaccgcgacgatcgcgaacagcagacgccggacgatactggtcgaggacgccgacatgacggtgatgataatggggatcggcgccaggaaaacaatggtggacgacgacagaattctcgagaacccgaacgtcgctctcggaatcggacaccggagccgagtgacccatcgtcatcatcatcatcgtcatccggtagacatccacggaggacatatgatcgccaacaccccaccgcccccagcgccgggtgtagagctttcaaccgttctctacgtgatgtccgatggcccgagagattccgacccggggcaatagagaagtacgatggcagtaccgacccagaagaattcctccaggtctactccacggtaccatacgctgccggagcagacgacaatgcgttagcaaactatttgccaacggcgttgaaaggttctgcgcgttcgtggctgatgcacctcccgccctactcgatttcttcatgggcagatttgtggcaacaattcgtcggtaacttccaaggaacttacaagcgccacatgatcgaagatgatttacacgcgttaacacagaatccgggcgaatctttgagggactacgttcggcggtttaatgattgcagaaatacaatccccgaaatcaccgacgcctctgtgattcgcgctttcaaaaccggtgtcagagatcgctatactaccctggagttggcaacaaggcaaatcacaactactcgaagattgttcgaggtcgtcgatcgatgcgctcacgcggacgacgcactgagacgcaagaacgacaagccaaaggcggggggagagaagaagccagccaaggacgcacctgaaccaagcaagaagaaaagcggcaagagtgggaaaaggaaagctcaagcggaagtcttcgcgtctgaatacgagcgccctcccaaacacccagacccacaaggcagtgacacgaagagaatatggtgccccatacacaagtcggacagacattctctggaggattgcctcatcttcaaaaagtcgctggaaaagcaattggtattgaagaagggcaagcaagtacgtgtcgtcgagaaagccgttgaggcaaccactcaggactcagactcggcatacccagattccgatcttcatgtcttgcacatcttcggaggttccacggcgtactcctcaaagcgagaatacaagaaagtggagcgtgaagtttgttcgacatggcagggggctgcacccaagatgaagtggtctgaacagaagatcgagttttcatatgaggaccaccccaaggctattgttatcccaggatgatatccgatcgtggtcgaacccactattcggaatatcaaggtagcgtgagtcctcatcaatggcggcagctccatcaatcttctcttcgccagcaccttggacgcaatggggattccacgaagcgagttgacacccaccgatcaacccttccacggaatcactcctcagtcatcgtccaagccattgggaaagattacgcttcctgtgactttcggccaagcgagcaacttccgaacagagcaaatcacatttgatgttgctgagtttgacacagcatacaatgccatcatcgggagaactgcactcgcgaagttcatggccgcatctcactacgcatatcaagtactcaagatgcctgggctgaagggaacaaccactattcaagggaacgcaaagctgacggtccaatgcgacaagcggagcctcgacatggtcgagcacacgcccagcctacccgccacagccgagccacccaagaaagtgagcaaaacaactaagacgccaaaaccagacggcgcaatcaaaatcgttccactctccagtgccaatcctgacaacacagttaagatcggggcatcactaaacgagaaataggaattcacgctcatcaacttcctctgcgacaatgctgatgtgttcgcttggcagccgtccgacatgccgggggttcccagggaggtgattgagcacaaactcatggtgcgacccgatgccaagccagtaaaacaaaaactgcggagatttgcaccagatcggaaacaggccatacgagaagagctcgacaaacttctcaaagctggtttcatcagagaagtactccacccagagtggctagccaacccagttatggtgcggaaggccaacgggaagtggaggatgtgcgtcgacttcaccgacctcaacaagacgtgccccaaggatcacttccctctccctcgaggtccgacacgtataccaaaaggacaacattgaaccagacgatctggcacggcgtgcgtccagacgagagccactcgaacccggcacctttctagacatcctgacaaagccatcagtgaaagaggcaaacgacgaagatagcccagtcgcccccgacatcagctcgggggctacagaggcagagcgcgccgttgccgacatcgagaccacggacgactggcggaccccactcattaaattcataagcagtgacgagttgcccgaggacgatgcagaagccgagaaaataacccgtcaagcaaaaatctactgtatgatcggcaacgatctatacaagaaggcgccaaacggggtacttctcaaatgcgtctcgtccgacgatggcaaacacctcctcctcgatatacatgaagggatctgtggatcgcatgccgctagtcgtacattggtcggaaaagcctttcgacaaggatttttctggccaactgccctcaaagatgcttgcgacatggtacaacggtgtgaagcttgtcaatttcgtagcaaacacacaaagctaccagcataagcactgcaaaccatccctctcacttggccgttctcatgctggaggctcgatatactcggtccattcccacgaggacagggcggctacaaattcctgttcgtggcgatcgacaaattcaccaaatggaccgaagcaacacccacgggggaaatcagggccgataacgccatcaaattcattaaagggatattttgcagatatggattgcctcaccgcatcttaacggataacggctcccagttcatcagcgccgatttccaggattactgcatcggactaggagtcaagatctgcttcgcctcagtttctcaccctcagagcaacggacaggtcgagagggcaaaaggtatagtactacaagggatcaaaacccgagtctacgacagactcatgtcacatgacaagaagtgggtcgaagaactcccctcggtactttgggccgtgcgcaccacaccgacaacgtccaacaaggagacacccttctttctcgtgtacttctcagaagccatgctccctaccgagttacgacatcagagtacacgagtacagaagtactccgatgaggatcaggaggaatagcgaaacgatgacgtgaacctaatcgaggaacatcgagaacgagttgccgtcagggcagctagctaccaacaggctgtcacatcctgattttcgtttcaggatttataaattatttaataaaataataatagaatttatattaaatgacctttaatttacaagtgaagttaaatgtgggaaataaaatttcctaaatataaagcatggatggatttaattttttttattaaattctccatgattaagtcaactctctgaaattttctcggatttttcagagctcaattcctaaatgttacaaagaacagttcagtaataatttgatcattaatgatctaattataattgttaagagtttttcttgt

SEQ ID NO: 57830 - DNA, 1128 bp, Oryza sativa
catggctggcaatggcaagtttgcaacagggccagctgctactttatcctccttggttgactggcatgtggggcgaatttcttagctttcatgagtcatgacgccaaccaaatgatcgttaaacactggtggagaaaccatctttggtcagtcagccaaaatcccacaatagtcccggttgcaataaaaaccggaactaaagattatctttagtcccggttcaaaaggttagagctacttttttatatttagtcccggttggtattctcaaccgggattaaagatctattttgagtcccggttggtaacactaaccggaaaaaaagatccctattatctttagtcctggttggtttctagtcccgattggtagcctaaaccggaataaaagatcggcatgcacgcatgcgtggcggagaggacgaggcgtgcgcgagatcgaggagttaataaattctattccttatctcttcctcctcacatctcttcctcttcctcctcctcctctccacattctattcctcccctctcttccgtcagcggccggacggcggtggcagtagggcgcgtcggcggggccctcgcgcagcggggcggaggtggcctcgcgccgcggcagccgagcggcggcggatccggaggggaggcggccggccgccgccggatctgaagggggaggtggtcggcgcggaggccggtgcggcggcaggcggtggagccggtgctgccgtggattttttttttctttttttccttaatgtgcgattcgatctgtgttgattgatacaatctgtgttgaatgcgtgatttgatttgtgttgttgttgtgaatgatttggggatgaactattgtgtgaatgatttgggatgaactattgctgtgaatgatttggatgaactatattgctgtgtgctgtgaatgtttgatatgagataatgctgtgaatgatttgctatgaatatttgatctgagatgatttgggcaaatagcaaaagaacagtgaaaaaaaagagaaaagaaaaaaaaaagaaaaaaaccatccaaccgggaccacatctttagtcccgggtatttgaaccgggactaaagatagcgatctggggatcctctagagtcgacctgcaggc

SEQ ID NO: 57831 - DNA, 29111 bp, Oryza sativa
gagcctatactatgccatcctctggtatccttgagcacttgcatatttgctgtgtggcttgctgagtatgtcatatgctcatccttgcaataatcaatcatcctcagttgaagtcaagttgcgaaggagaagacgtttggcttataccccagttgagctgcctgtgggagtggagccggagcttcgctagattttatttttccgctgcagttttcttcttggtgaggactaagtgcctcttaagtaagtatttatcgttttagttaatttgatgaatctgtatattaaattgtcaatttgtgtacctcggctgattcctggacgaggattttatgcacaaataagtttggaaattactagtgaatttccgggcgtgacaagttggtatcagagccatctcgactgtaggataagccaaatggtcaaaccttaaggactaattttccgaaaacatgatttttgaaaattttcctttcttccttctctagaattctctataaatcattttatcatcctcttccctcctgctttcaacttgagtagttctaagacattgaaacttgaagacgccaatgaggtctacttatggaggttaagtaaagtggatcgaggaagaactgaagtgcccagatgtcaagatggaatgaagttggcatcctaccttagaacctatgccgccaaagtgtccttggagaatagttagtagggtagaacgcttgttgcttgcttgtgtgtaggtatggttgcattcccgtcattggagtagttcagtgatgagcgtgtaactatactaggttgcttgcttaatcaacttaaacaatataatggtctacacacatcagatcagtgttaacctggttaaggtcttgtctttagtgtaactcctctcctcctatcttctctaatctgcaacagatggtgaacactcgtgccagtggaagtggaaacaataacaatgaagggaacccaactcttgctcaagttctggctcaacagactcagttaatgaacatgatgatacagcagatgcaaaaccagctcaaccaagggaacaacaatgctccaccgccgcagaacaagttagctgattttcttcgtgtgaggccacctaccttttctagcactaccaacccagtagaagcaggtgattggctacacgctgttgagaagaagttggaattgctccagtgcacagatcaggagaaagtcgtgttcgtttcacatcagttgcaaggatctgcttcagaatggtgggatcatttccggataaacagagcagaaggacaaccaatcacttgggcggacttcacggaggcattcaagaagacacacatacctgtaggagttgtttctttgaagaaacgtgagtttagggcattgaagcaaaaggatcataccgtggcagagtatcttcatgagttcaatcgtctggcacgttatgctccagaagatgtacgtactgacgaggaaaggcaggagaagttcttggaaggcttaaaggatgaactgtcagttacgttgatctcccatgactatgtggattttcagcagctagttgacaaagcaattcgccttgaagacaagaagaacaggatggataaccgtaaaaggaaaatgactgtattccaggaggcacaaggtagtagccagaggcagcgtatcaagccactccaaattggtggatcttcttccgctggtcaaggacagtcgcaaccgttgaacatcggtggtgagatcaaattagagactaatgaaagcaatgaagttaacattgagcaagctaatcagccggtgccagttcagcaggatcagtctcaagagaataacagtagtggaagggagcagcaggtatgtttcaactgttacaagccaggccactttgcaagagagtgtccgaagccgaagcatcagcagccgcaagtcaacaacattgtcgtcacaggagccaatgcagtgccagttgcgtcttcaagagttgcgttttcaagtgttacagctcagccaccagtttcaaagcggcagtagttttctttaaagccttagaataattatcggagttatggaataagatagattgcagtttacctatgcccttttctttctagccgttccgaatctcgggacgagattctttgtaaggggggtagtttgtcacatcctgattttcgtttcaggatttataaattatttaataaaataataatagaatttatattaaatgacctttaatttacaagtgaagttaaatgtgggaaataaaatttcctaaatataaagcatggatggatttaattgttttattaaattctccatgattaagtcaactctctgaaattttctcggatttttcagagctcaattcctaaatgttacaaagaacagttcagtaataatttgatcattaatgatctaattataattgttaagagtttttcttgtttaaaaatccttaaattataaattgttgtttaaaaggaattattagaaatgattttaaaagcctagaagagaagatctaattttaatttgttaaatctcaatataaaattgggctagataaaatttcattaaatactttgcttaattctataattcctagatttttctgggatttatttgagctaaggaagtatttttaataaatgggattgcatttcatgaataatttaaattgaaaaaggttttaaaaagtcttcttttggctttgggccgaaagccggcccaaaaccctctctctctctccctcggcccagtccggcccaatccgccgagccgccgctctcctctctctctcagccgctgacaggtggggcccgtttgtcggagccgtcttcctccttcggccgccgccgcccgaaaccctagccgagcgccgccgccgtctccttccaaaattcggtcgatcctttccttctccggccgaattgatagaggggaaatgatccttgagatctcctcttccttttctcttttggaatcatcgcctaattcggtttggaaatccgtggattcgagttcgattcggatcgacctctctcctccgaaccctagctttccttcgccgtctccggtcgccgtgggccttcgtcgccgcctcctagcccctttaaaaggacccccgagctctcctctacccgctgcctctctcgccttcgcccgccgtcgtgtgtagcgccctagcctcgtgagcttttgcgccgccgtcgccgccgttcgtccagccgtgcgccgccgtcgctacggtcgtcgtcgtcactcgggaaggccaccgtcgggatcgccaagtcgtcgccgtcctcgtccgccgcttcgccgccgccgaagaccgccggagcaccgtcgccgccgtcgacccgatctccgccgccgcttcttcctcgtcgccggcgctgtccgttgcccttccgccgtggttttggtcaccggtgagttcgccgcgtcgccctctacccgttggtgccctccgttcgcgtcgtcgagccgtcgttcgccggcgagcttgcgctcccgagccgccgccggagctgacgtcatcgctgacgtcgtcgctgacgtcatcgtcgtcgccctctcccgtgagccggtcgtggaccgatcgatctcggccgtccgttttcgtgaaccgccgtcgtgcgcccggtccaccgaaaccctagcccgctgacgcaataatccttcttttccttttcaaaaataattcattattgcgtcataattcaattaaaatccatataaaggttttaatccgatttaatctttaaaaattcataactaattctttgtaactcagtttaatgtggttcaagttgcaaaagttgtataaaataaagatctacatattaaaattgtccataaattgaattaaatttatttaattctttttaaatgggctttaattatatttaatcttgtaaaattcataataaattcatttgaagtgagaatgaggccgttcaagtctcataattcatctaaaattatgatctacatgtttgtttactttttatgtattgtttatttggttttttattagtctttttcttcgttttgcgtgttagcttgtcgtttccgtcgttgcgaaggttcgcgagtgcgccggaagtgttcaagaagattaattgaagaccgattattgcaaggcaagtcacacagatcctaaacacaatcctttaagcatgttgatcctatatttaaattctctatttatttcaactgtgcatttattttcgaatgtcaccgggtggtgtgaacttattcctttgttatggccaatttgcattgattactttattccttgataccttgggttattataacttgactagttgggctttatatattggttcagctagatattagatatgattgcttagccatgcttagaaacattagcacacaattgggataactaatgtttcactatcacttatggttatatttaatgatagttcacgatggtcaatcgtgattgattaattaattacttgccaactaaaacttgataatggtgggttgtgagcacatggttttgagagtcgtgctcatgacaattaaggaccggttcgcgagctactattgtgaaacattaaccgtgccaaccacaagccagcgtgggcaacggctttaccttttgtataacatggttcattgcggagcacccgactgagaagtggcggagataagcccacgggggtcgctggggagtccatgccttgttttataagggggtgattatgatccaggaatggtgcactgtggtgagttgtgttgtgcaaagggtattgtcacagcctctattcgggtactttccagtatcgcgacgcatggttgacatgatgttgaggctgtgtcttgtgggtacagtggtacacctctggccagagtaaaactattcgaatagccgtgcccgcggttatgggcgggttgagcaatgtttttcgtgattagtcccacacctctcacaatattttttgatgttatacctggtaataatttgcttagctcctggtttggagattagatctgtacagccgggtatggttgttcaggatggttgggcctgtgcagcatgggtgtgctgttcagtgttgattaaaatttctgattaattactccactgttttatttctcttaaatattttgctaaacgctgcttttgcaaatgagcctatactatgccatcctctggtatccttgagcacttgcatatttgctgtgtggcttgctgagtatgtcatatgctcatccttgcaataatcaatcatcctcagttgaagtcaagttgcgaaggagaagacgtttggcttataccccagttgagctgcctgtgggagtggagccggagcttcgctagattttatttttccgctgcagttttcttcttggtgaggactaagtgcctcttaagtaagtatttatcgttttagttaatttgatgaatctgtatattaaattgtcaatttgtgtacctcggctgattcctggacgaggattttatgcacaaataagtttggaaattactagtgaatttccgggcgtgacacaggcctccgccggtatcacgagaagcgcatccgagcacgcatactttcgatcggcgactacgtcctccggcgagttcaaagccaagcagggcgaaacaaactctcgcccaaatgggaaggaccgtacacgatcacacaagtcttgcggctaggcgcattcaagattgcagacggtgatggtcgcgagttagcaaattcttggaacattgaccaattgcgtaagttccatgtataagtcaatagtatccatacttgtaagacatcttacaacttcaataaagcctgttttcaggtacagatttcaatcaaagtgtcccttcccgatgatcccttacccagatgacacctagcgttgaaacctgtagacccccgattttggaaatcggaaatcttctgtgtttatccatatcaatccctggatcagtagttggtacacacatacatagttggatcacaacatatcatgaatgaattcaggctaaaagagttaaatacttacattagggccaggtaggccaacaactatcagagaacaacagcggaagacaaaataatataagggcccggttaacatgccacaggcagtcgactggggaacgagacctagaacaagaccgcactccgatcatcttgttggatacgcaagcgtaccaacaagggcttctcttcaacactattctaaaagatatataaatagcaagggtgagtaccaactgcactcagcaagccaccacaacaacaatgcatatgatagagggtatttcaaggaagggctccaggttcttttgcgtaaagcaagcttttgcaaatcttttcacaagcctgagacctagcatagactgatcaagttttaataccagtgttcacattaaacaacgacggttctatccaccatccattgtaattccaaggatagcttcccgccattgagtcgtcatggttttctgaggacgtccaccttccctcctctcaggaagtggctccatcagcataaaatcatcatgcaataacccatcccacacaagttaagaatttagagtctagccaagtgtaatacacgtcccggtgctcagtaaccgtgagcacggctattcgaatagatttggtttactcacactgcagtggatgtacacttcacccgcgctctgcgactgcccaacacatgagccttgtcccaacacatgaaacacgtcacggcaaagctttcgataacctcgcattggcagtacccgctccatgaactttagccctcatgcactctaggcgtcatacgtttctagcagtgagaggagttctggcgctcccggaaagggaaaaacacacacattcctacgttgcttcttgtcgttgaacccagtccatcatgattgttctcttatgggtatcctcatgtactattgccaagccagcctctgaccatccggaacgggcatccgccatccacctggccatccgaactgggcatccgctagcagactgcttgccgcatcacacacctaaaagaagaccactacgcatggatactgcctccgctcagctatctactccgctaggtctatacccatacgagaagtgcggttgtacgggggtcgtttcatgcttaacttcatggctcggtccttaactgaccagggacggcactagccttttccggacaccacccaaatcctctagccaccccagtcgaaaacaattgtttcactttattttcctttcacaaatcatgtcatcaatatcatggcaatgtggcgctcatgtctccacatgccgcatctcaattaccttcccaaaggtaattgcccaagcatatagcatttgataaatatgagtatgcatgattctagaatacatttctaagcaatggtcatagttgactggggactcatacgtaatcatggttacaaagatttaagggtaaacaataatcaaggcatggcatattaacaagtaggatgttcattattgcatgcaattttatttgtaaacaaaacaatttcgcaattgggttcaacatgttcaaggaatagtgatgacttgcctgctcaggataattcttattattgatataatcttgatcaaccttcacctcctggaagttgcagacgttgcctcacgactaaccgatacacaaggtctataatacgcgagaaaaaccaatattcaaacaacaagcaaatatgcacaagcaaaatacaatgtcggggtcgaacctagggttgctcgtactattattgcttgccaggggatttcaatcatgctaagggctaaaattcctttaatctctttctatcgtcatcgttgtctatttaggagttaaccaacatagcatttatgggatacatatttggctaatatgtggtttagtctagcaaatggctatatatgcatctatctaaatagaacagttatacactagaggttctgttgccggatggattttggatcggtcaaataattactgtgaatcatttgtattattattttattgatggaggctttattttaattatgtacgtattttacttgtcaaaataaattataaaaggttaacaattacccatgctttgtatgttagaattgtttaggttaatcatattatggttacggattatcccatcacataattttacaataaataatcctgatttacagttgagctataattatatgaggtcaagatttataactagtatttatctaatatacatgtttatcatatattcctttaatttaatacatgcaacaagcaaattgatactataccgtatagctataatgtgatgtacagtatatgtgtatgcacaatatctatcttaatattgaatcatttatttgaatagttgctatttactacaagctactcactgcatgtgattttaagtggatttatgagtgggttaccatctatacaacttaagggtcaattttcaacctaaacatatactactatataggaaatgccgttaactaacttcgtgcgggtgattttagtcacactagctctgttattatctctcatagacatgttattatccctaataaacaagttgaagactcatctacgtgtgttcaaatttagtcacaaagtatgaggctaaacattatttatacaatttggacgtcatgagtatagttatatattgacatatattaataaatggcactagtatttccaatgctttaattaatttgaaacaatgctcctaactagtttacataggttttatagtgaggaagcgtgttaaggacaattatttgacatctactttacagtataatatcaattttatttattagcacatttttaagttaactattatgcatcatcttgatattaattatttaatatttataaatatattttatcaaatagtgaattatataccattggaaagcttatgaatttagatgaatttaggttcaagtttcactcaaatccgagttaaaatgagagagttatgctagtttaaagattcaaatttgaataattgcaaaacagtactgttcctaactcatttatttttattccataatttacattgactgacctgtgggaccggcctgccatggacacaacatatataagtgaattttcatagattttaatcatagggaccccacatgtaagggacttaactaataaagaccaaggggaggattactatttactaatcacgtggggcccactctaacctctctcctccattctcttttctctctctcttctctgttttctctcttctctccctctctcacggccgggcggcgcggcgcggctaccagcgacgaagggaggagggagggcttaccggaccgacggcgacggcggcggagacacggcggcgaggtgcggcgcggcggcggcgaggcgccagggcacggcagcggcggcgcggcggcggaatgcggcgtcggtggaggggaagaaaagggaaaaaaaagaagaagaagaggggaaatggcgtggcgagggaagggaaagggaaggggtatttatagggcacgggggaggggcggccggctttaaacggcgacgggtcggcgcggcgtcgtggggctcagggcgatggcgacgcgcggcgacgggacggcgcggcgcggcgatgggacggcgggcacgacggcgacagtgcgcggcacgggcggggctcgaggcttgttggcgacggtggtgacgcgatggcgcggcagcagcacggggctcggcgcggcgcgggtaacagcaacggcgacatgagcggcgcggggctcggcgcggcgcagccgacggcgacggcaacatgagctgcgcggagataggcgacggcgacgggcgacagcgacgcgcgcggcgcggcaggggcgcggggcgcgaggcggggcgacggcgacagcacgcgctgagggaaggggcttgaggcgacgcgacgcgatgatggcgacggcgacgtggccggcgacgcgacggcgatgggacggcgcatggcagcacggggctcgggggcgcggcggcgatgggagctcggggctcaaggccggctagggcggcgcagcagtggggaggaagagggctaggatggctaggaattccatgaaacacctcatgtgcaatgaatagtgctatccctaattaaaccctattttagccagtcttctatactattttaatcctataaactctaattttacttagttaaatgttaactaaatttaggcactaaatcctcatgaaaatttatccaaaattattaccacccatatttatttatttatcacacaaacgagttctttttagattaatttagattattggccctaaagtgaacttatatatttttgaagactttggggtaatattgaaattaatataacgatgtgtccttattaatacaatggcatatttgtcgagtttctttgtatagcattatattttacacggatagttttaatctatttattctacaaatagcaaattgagactcggtacaatattaatctaattgtttaattaaacacccacgtggacctattttatgtataaagcttattttatttatatgaccattattttatatgagtgttttgatcaagtgttcaaatattaatgtatatatattcccatgaaatactcatttgtaaataggatcattatagtggtgatcgtcatttcatgtggatttataatacttcatgtgagattggatccaaatacattagatttaatcttactatcccattagttagttaaacctgacatcggcctatcaaaatggttcgaatatttaatatttgatttgtgatttataatagaaattaacatttgacttgtactttatttggcttgctttcttgtgcactaatatttgtagggttaaacgtaaataatatattctcgtaaattacatctattgattaaatgtagatcttttctttactttctttgtgattacttacggtttggcaagcaacagcaatcataacaaccagcatgatgcaaaagtttttaaaaagttcgaaattttagtgatttttattgtcgggaattttcaggatgttataaaacctatcctcatgtccctttacgcagtcttgataaggcctccgaggaacctaagggaacttcggctggggacgcctagtgctgataaggccttgtcggatcctatagagacgaaagaccatgtaagatctggtcgtgtaagagttctcgccgtgcgtattaactaggacgtgtaatcggaaatggactttccaacttcacggctgggggttaggatcagtgcttgttcgagtaaggcaggtcaaaggtcccagagccttatcttccgagaagaattctccgatgataaggctggggcctagggagagtgtataactcaagtgactgatcgaagtcgcgaagtgagaaaacactcgtacacactccatccggagtaagaaagcttagctagatagattccttctctattttcaagtatttcttacagtccacaaaaattcaaaatatattacactctaccctgagatatttatcacaagatacggagactaccaagaaggccaacgccagtccattgactgaaagactttctccgcaagcggcgccatcgacttcgccagctggtctatctctgcatcagttctccaagaacgtgcgaacccctcgtggaggaactcaaggcgcagctgtggatggtgatctcgtatacaggccagcacatgccctcctgcatatcggctcgaccgacgacactcctgcttcaagacctcgttgatacgcttgtcgataccttcaagctgggcgttggccccgttcagccacgagatgtaaccggccacagactcctcaggatcctcgcaaggtactcggagctccttgcaaactcccgccatggctgtgcagcaactccggaggtacgagttgaaccacacctcgcgacctcgaagtgcttccacggcccgatccctcttcacttctaacatagtcctctcgagttccgccacctcaaacttcgtcctccagtattggatgtgacgatctcggtcggcaagcgcactctcgaggtctgctcagcatggaaacgactaagtcaagctatcttcctctctcgagaacatggtgaactaagtcaatacatacggaagaacgaaggggatcgaaacaaaaagaaccaacctaaggaagtcgtcgccatgcccgtctccacgggcagatcctggtccacgccgtcctgcggcacatacagctcgagcgcgagtgccggagcgattacaggcaactcaggctgcccgcgctgctggacatcctcgacatcgacgtctctacaagcaatataaagtactcagaatcaagacgctaaagaaaactaaggcgataactgcacacacaaaggcagttggaaccaacaaaagttttactaagcgggattggttaaggggtacaggcaagttgcagtcctactctttaaaaagtgggagaacagactctcccagatcaccgacttcttccatcacgtccttacgcgcgtcgttagccgccccctgatccaagatcttctggagatcgagtttagggtgcaccaacctcacgcacgtgaggacgtggcacgccccgatgtggatcccgttggacgtctcctccccgatcctggccgcgtgcttggaggggatcgcctccatcgccatcaccagttccgcgagcgaagacgtcagcgagaactcgtcagggttcgccgggatggtggtcgtgacaccacactccttggctagctggtgtaggccggtgtagttgacccgcagcgaaccacagacctccgacaggttgttctcgagttccgacatgcggttctcgagcccctgccgttgccgctcgttgcaggccaccagctccctcattttctggaggtcctcgcgaacctccgccaggtcacgcgccagcttgtcggcgcgttcgttaaccgacgacgccgccgccgcccttgcctccgcgatctcgcgacttatgccacgagcgccggcctcgaggacgcgccccatctcgacttggagctcctcccaggtgaggacgtcagcaggcgggcctcgagcgggcataagatcgctggcagggccgctgggcgtcacctcacggctcatgggcacgaccacgacatctgtcgaggccactgcaggagatgcgctggaattccctccagacccatcttgcgccgccttcgcccgcgtcgccctacgaaagattgccatgttggtcatcataacaagctactagaatccgatcaagtcaatgaccttaaatttcgtccacttacttctcgccgagtgtcaccagcctctgccgtcgtggaggcgggggagacgcatccgaggcctaagtaaaccaaagaggcttaccgatggggtgggcgtcttccgacggttgccgagcacggaggaaaacttcctccctttcctcggaacttagccaccactggtcgtggtagcagcagcggcaatggccacgtcggaggcctcctgggcaacgccctctttcaacgaagccgccgcctggtggtccacgagcggcccattgacgtcagtcagagggagagcctgcacaacatgaagtcacgatgcgatctaaggggtaaaagataaagggtcatcgattacactcacgttgattgcggcttcgcgctcagccgcccctttctcgcaaagaggggtgggggtgttgctcgccgtcgtggggccactgaccatcacgtggccgacacggcgctccacggttgcgctgttcaaacctgtagatcgagaaccaaatttcgataagtcaggaggaatgcgcacgtaaggaaaggaacccagaatgcaagaaaaataccccgaggagaaacacgggtcgcgtcctccggcccagattagtcaaaggctggatgggctcgagcctggagcggctggatccgtctaccaatgaagtcggcagcgacttcatacccccgacaaccctcgtactcggaggtcatcgatgatatcgataaaagactgaagggatggggtcaaggcgggtttggcggtccaagacggaatcttgtctggttgctcctcaggaacaacaaagactggatccgaatcttctatctgaagatagaaccacctcgcccgccatttactacgagaagaggggcactggaaggggatgtatcgcgacttcaggccatcccgaagtcgaaaaccaacacacccggatacctttttaggttccatccaacgcaactcatagtaaaaacgaaagaggtcaagaaacagctctaccccaatgtaggcctcacagagatgggaaaaaatgctgaggaaggctatggagttggggttcagatggagtagagaaagaccgtagaagttcaagacgagaaggaaaaactcagaaggcggaggaagaaaaccacagagaatatagtcctcaaccgcaaccatgcggcccaggacggattcaggttaagtacctcctggttccctctccatggtcccgcgaccggggagagcgccctcctcctgcaacttcttcacggacgcactagtggaattggacttgtcgaggtccattgccgttggagatcgccggagaacaaaccgaggcaagcgagttagggtttgcgtggaagcggagaagacgaagagtatttggaggctagaaagttttcgcaacagccggactccaaaatggattcccaaaactcccttaaataggcgcactactgacggtgcgaattccaaggaaaggagatagatggccgccgaaaatttctgggtccgttgcgcgaggcggtttttggacttcaattttaattcactcataaccgttgaacttcgcatggtgttgtcgaccactccttgtctctacggttctcacaccgagatcaaccagtcgagaacgacaacaactccgacatcagaagtcgctatcggttacatgagttcatttaagcagaagtcgggggctactgtcagggttacggataaggtataccctctatccttggatgtacgctatacggcaatatggtatatttgcggtatacgaacgttctctgtatacgctaaggaaattcatcacggagtccacagatggaaagattcctacccggaaggactgggtcgttactgtatcgtgtagggtccgatgactccaagtcctacttggaaaccacctgacctgtggtataaaaaggaccccctgggaggacttaaggcatcgaatctcataaccaagacaaccaccacagcctacgaagtcgaagcctacaggagccaagccgccgggtgatctagtcgaaccaactcgactatgatctcgtcggtatcatcgagttctgtcattccctttgtaatttgtggtttccactatataatcacataccaactggattagggctattacctatcaagaggcctgaaccagtattatctttgtcttccgtttccttgatgttgtactacgtagatcctcgtaccagcataccccaataccctttatatccggtctacgggtactcacagtcgacagaggtagtatctactcgatcatagtgataaactaaatattttatttaaaaataaattttataaataacttataataagtggtctaatcaatatagtatgagatttctttaaaaaaaacatatttcttaaaacatggagcaattatccgtttttcacaatccgataaataagttgaaaacaacaggacaggagagttaacacagtaaaattttcatggttattaactttgtaactctgcgatgaacttggatgagatattgttagaaatatggtcataatttgatatattttaatctagaaattaagataataaacatgatatgtgcagcaggaattaatctagtaaaagtgctaaacattaacatgctaatgacttgaaaagtatcatctagaaacatgtttagcactatagttagaaatgtgacatacccaaagaacgctccggtaccgtataatgcattattggtgttgctgcttccgttgatattgatgttctcgccacgacgccacctccaggtgtgtcattgccaccacctctaggtgcgtcgtagccgccgcttccaggtgcgtcgttgccgccagtgcctccaccattttctcctcttgtagatacgccgatgtagtgaaagtagttgaagcggatgatgcagaggaagaaaacgacgacatgcagaaccaatgtagcagagtagtcgcattaggaagcgctccttaggatgtgtttggttcacggtcaaggttctatgggatatagcggtccatattttgttagatatggtgatccagttttttgtttggttgaacgaatatggtgatacagtcttttgtttggttgtagggatgaagatggatttggtgattcaatttttcgtttggttggagggagtaggatgaatttgtaggtgtggtcacctctcacttgagatggtgagtataacccccccccatcaaattaatacacaatacaaataataaaatttccaacaatttacactacaatctcgattataaatacacgtaaaaaaagaaaaaaaagaaaaacaaaaaaataaaaaaaggggaaaaaagcgtttggatctgggccgccgggggctcaccgccgccgccgcctcctcccgccggcggggacctcgcgcctcctcccccggccgctgccgccgcctcctcccgccgacggggacctcgcgcctcctctccccggccgccgtcgctgcctccttccgccaaccgccgcctcgcgcctcctccacctggccgccgcctctcgcctcctcctccgccgcctcctctcgccggctcgccgctgctccctcctcccgccggctcgccgcttctccctcctcccaccgatgcagcacgtcgtcgtcgtcgttgtcgtcgccgggcacgcatcggcatcgccgtcgccgccgcgctcgtcgcccacgccagcgctcgccgctgctccctcctcccggccgcagcacgtcgtcgtcgtcgtcgccgggcaccggccaactcgctccacgcggtgacgcgaccgctcgcccgactcgccggctcgcccgggcggccaaatccgggcaaatcggtcggatacatccatccggcatctgaggggaatattcccctccgggccgccctatcccactcccgcccaccaaccaaacacccacaaaaaatgggccgccatatcctatccacccaaaaccctccatccaaacacatccttaaatatttgatcgcctgcctatccgcgaaggtactcaagcgagcggaatggagtttcgtaggcatgctcgtcccaaacacttgtgcacgcacttgctcagaactggggaagcagagatgcaacgcaggaacagagaaagaaaatggcgataatgggagaaagcatagcaaatcgggacaacagtccttgtatatgtactaggcagttaataattaagcttgctgtacgttcaaaaaaacaaattctgctcgttcgaaaataataataattaagctttgtgggcttacaaggccatggcctagcgctccgcccgcccacaaaaaaatagaacagccccaaataacatctctcccgttctcttgttggtgtgatatagggagtaccacctttttcttggcaggtaaatttttgtccaaatttgattggacaattattcattgagttagattcggctttgtcatttgggcctaacaagattttctctttggaataagtctattttgcctcctcaactcatgctcctagttgaatcgtatccctcaaccgcaaaactaggtataacccatcccctaactcccaaaaccattgcaaattgactacccggacaattttagaggcggtttcgtttgacgtgacagttgactcactgagttattaagtgagaccgacttgtcagcggccttcacctcatcccatcttctctctcacctctctcccaccctctctctttcatatcttcctcttctctcaccttccatcaacacagaggcaggacgacaaacgacagcacacaagggaggagcttgtcagccggccggccggaccacgcgctggggaggagcaagtcgatcggacgtgcactagaaggagctcatccgttggctgtgtgtgaggaggagctcgtcagcatggtggcagccgacacccttgtcgatcttctgcgacgccccggctcgagcatgcttaggaggtgggagggcgccggggcattgtgcgagagaagggaggagggggtcgtggaggacgaggcgaaggtcgcgcaggcaaacccctctaggttgtcaaccggccgtgtgcaggggaggagttcgtcggccgtctacacgcggggaggagctcgttggcatggtggcgatcgatgaaattcgttgaatgggctgatcgcgcgacggaggcggatgggatataggaagggggcagggagctagaggaggctggctggggatggaggagagcagcgcatgggagcttggggtcctgcacccaactctcaagcaatgtggggctcccgtgatggagatggaggtgagcagcgcaggtggcgtcatcgagctcccaagtggtgcggccgtgggatgtcgacaacgcctccgtggtaaggtaccacatcgccagggacacccgcgtggaccatccaccgtgaccccttttctgtcgctacagtctttcccacgcgccgcccctcgtggggatcgaatttagctacgaaatgacgggttcactactaaaaaaacatttttccgtgtggaggatttgctcgtctacaccaaggagtctgggaaaatcaatatttttgtgtgcgggtagcccaaccacacgggaaaattatcttcccgcgcagtcggttcaatggactgcatgggataatcgattatcccgtgcggtcaaattataccgcccgcacgcaaacaaaaaaaataaaattaaaaaaaataaaaataccctaaccgtaaccctagaattgcctggtgccgctcccggccgccttcatcgcgccgctgccacgaccagcagccgccgcacccgaccgtcgtctgtgcccgagaccgccaacatcgcgccggccgcacggatccgggcgggggccagttgcagccgccgtccgcgctcgcgcccacgcccacgcccaccggccgccaccgccgctcgtagtcgccgtggttgcgccgccgccgctcccgatcgagcccgccactgccggccccgccgcgaccggccaccatcgctgctagctcccgcgggccgcctccactcctcatcgtgcgctcggtggggaggagaggggaggagaggagaggaaagggaaaagtaggagaggaaattggaaaagtaggtgtgtagagagagagagaggagtgagagtaattgagggatttaatataaggaaaaaggaagagagaagtttgaaaattttgaagtgagtaggagggaaaaggaggagaggtatgtttgcgtgcggttcacttaagaggcccgcacatgaaaatcgattttcgcgtgtagacccttaagatttttgcgtgcgggcctcttaatggtccgcacgcgaaaatgggacgccgatttttccatgcggacgcgaaaacggtccgtggttgctctcgcgtctccgggaagctctcgttgagtgtcgggaaaggagcaaggcggagacacatcttcaagctgtggaggcaattttgggagtagctcccaaccgccgctcccatgcgagcttgccgatgtcggccaccgcaccacccaacgacctcggtaaccggggcagaggccggctggagcggcgcaagggtcgcagacgcacgtcattggtctgacgtggatggagccggaatactgccacagtgacctccctgagctccagtgtccttcatccgacatttttttgctcgtcttgtcgccgggagggattgaaattagaggagaggaaaagaagagttgctaacagaaggagcctacaagctgactcggtcaacgtagtcaaagatgccacgtcggatgaaagtgcctcccaaatcgccaagggaggttattttccctggttttcaaagctgaaggaggtgttatacccgctctttcggtagaagggacgtgattcaaccatccaagggcaagggttgagggaggcaaaatagacttattccattatcttttgatcctggcgaaattggctcagtggaactaaattttcggattatattcagggatggaccaggtttcggcccattggaagccctattcctggagatattcacagatccacacatgcaaggctgttagtggagtcgtgaactggcctaacttctttttggtttggacaaagaagatttgattacacacgttcgtccctctccagaacttgttcactttgctaccatttttaaccttgtctttttttggtaaagttaccaaaaacgaggctacatttagtttgttgccaaattttagtaagtatatatgaaatcttgcaaaaattttgcaaccttgccaaaattttgacaaccttaccaaaatttagcaatatcaaaacttggtaaggttgaaaatggtagtaaagtgaacaagcccctagtttcctaatgtactaatagtatgtgtcaattttgaacgactataaaatattactactatactttatagccttaaacattttaccatttggttttactttcctttggaataaattactttgaagtgcggcgtgctcaaatgtacgtataagggaaaagtatcgattgacagttaggcatatttcatagtgaacaaatcagacaattaattatgtaaaagatttaagttccctgtgccaaatctgcctatctatttatctacctacctacatatactgtattgagtactttcgggaagctttcattttaattaaggaagatatggtgaatgattagataaatatataatatatcatgaccgcagattataattgtgaatttatgttatataaaacatttaaaatactgtttttactttatataaaatttattaaattcaaaattgggaaatggtaatatgaaattttacccatctttaactcaatttagtattttatttatccaattataatattagaaattaataattagaaagttgtaactgatatgtggatatattcttggtttaatttaaactgcaattataaaaaacaaccaaattgaattattatatcagctcgtgcaacgcatttccttgatggctaatttatttgaggtgcctttatttgattagtcattagtacgttgttgaaccttgaagaagagaaacaatagactgctttttcaacacattgtagcccaaataggttcttttttgaagatctgggtgaaacaacgacgcataatatatttagctacgatgaaaattagatgaactatataagaccaaaacataatgaatatattcagagatagataaaaatatttattcatttcattgaagataaaaagtctgagataataattaactaaaagtaagttctacagtagatgtgactactgcatacctctaattttatccatatcattcactaataaattaagaggcctatacaatatatcacctctaatgcataaataccaaatacctctaactaatactctcacatgcatactacttatagtttgtgtgcattttgctcttgcatgatgggtgtttcatcatctctcttcttacttctctcctttaattaccttatcacttgatgctatgtgacacttttatataatcaacagtataatagtacttgctctaaacaatttgcgcttgtggctccttaatgatcttttttctagtaatttgattgaggcatgcacccttgttttctgcatgtgagccacatagtcatgcaaaattctaaaatgattatatatttcttccgtttcaaactacttattattattttaagaaaatatatatgcttaactttggcaatcaaattttagaaatccatatagtctaataacatgtgaacatatacattgtgaaaatatttctcatgatgaatctaaatatctaaatcttatgatattaaattataaatttatagagaatgatgatcaaagttagaaaattaagtttgagtgtttaacttgggacaaaactgtagaaaagataggtggttgtgctgctatctccccgaacaagttaaacattaggatggaaaaagaaacaaaataaagagaagaatactctctggagtttgtgatttcaacaaaaaagctgaagcaaaattagcctgaaataattaatataacttcaatcgatcactgtggttattatacaacttaattggagatttacactaatgaactcgctatttcgtgatactatgctatatctatacatcgatcgagctagctaattaacggccggggcgccgggcatctcctagacagagtcaccattattagcattcatgaacctaatcaattaagtgatccaatcaagtgtgtatctaacaacaaaaatttcaacatctacatgcacaatgtgcatgcctcacctaaatacaccaattaagttaagaagcaaaacgagatctaataataatgacatcagagaggtgagactgattgatcagttatcacgtcgatcgtgagaagaaaaaatgccgtccatgatgctgctgctgccgctgccgccggagttgaacatgacgtcggcgaggtccgccaccgggtaatggtccgcgtccctagctgctgcaccgccgccgccggccgccgtggcgcccattgtcgtcacctgcggcgcggtggcggtagtgctagtgcttccctcgcctacggcgccggcgaggctggccggcgtcatcggccatccgatgccgaggtggatggacgtggacagcggcggctgcgcctgctggtgctggggcggctgctgatcggcggcgggcgccatgacgaagtcctggccgagcacggcggcggcggtcggagagtttgtcaccgaagtggcggcggcggcggggagtgtgagcagcggcgtggtggaggtgaggcaggtgtggttgccgcagtaggtgacctcgtaggtgaaggggtcgtcgtccagccgctgcaccttcttcttcgcctcgcacccgtagtagttcttgtgagtgcaccggtagtagctcctgtaattttcggatattgtcgtatattaattagtggaactatcttatatatatttatcgataaaatttaacagatataactgtaatacagtcgttaaatataaacataatacaatcataaatcataatgtaattacactaattatacatatataattaagtgtgtaatacaacttatacgtaatttaatttcaaaaattccgcggtaacaatcgttaattagttcaccacagtttcagattttgattaaagtatcttaatattcttaaaaatttatgccatgcattaattatccacgaaggtcttccatttaattattacaggaaaatgaacacataaatatacattggttgtatatatatttatccagaagcagtagactgtttagctaaaggtgatcgattgtacgtttccaggaaacaacgtcggaacttgtctattttattacctaaacttttcgtgacatttgaaaattaaccattagcgtaaagacttgaatgttttttcactggccaagactagaaattcttttttaccgtcaacgataaaaagatgtaacttttcaacattcgcctgcgtttagagtggtttctatgatgtttcactgacactgacacattgcaaagtgcattatgtttaaactagttttgaattgtagcaagactaaaggaaaagtagtgtgtttttttaaaaaaactcttggcccattaaacttgagaagtgacttaattaggatcatttggcaactcagtttttcaattatttcgaaacctagcctcggaaaaaaattgtttcaaaccatttaataattcgaccaaaagttgaaatcattctatagttattatttcaatatttcaaaattgaaaaaaaaagtcttcaggaattttcttgaataaaacgccaaactctccaaggcatgtaataatgattgattttccattgcatcgctcggtctcttcaatttctctctgtaagtaaacgtacagataaacatagcaatttcaagacaagtaaagtaaaccgaccaaataattttaaattttcaaatataagttcttctaggcaacttttgttgaactttaatattaattactcgacgacaagctagctaatctagcaactggtttcttgctcatcacaaattaatacacaagctaggttatctccacgaagatttttctatctccattaatcgtttcatttacaactgattatatgccataatacttttagtgataaaaaaataatccattgaaaaaactttatttatatgttcttagtgaattaaatcctatacttaaaagtaaactatgataaaaaaataaaatcaattctacaatttaacttttaaagtttaaaatttagctatacggctaataagctaaaagagtaaactatggagctatctatttttcctacaaaaaataacaatatagttaaccatatgcatatatatgttgcattcttggttcacttgaattggacccacaccatgctgaaagccaactaattcaaaaaaagaaagaaaactcacgtggaaaagaaagaaaactgatactaggttattctgcgcgcatgctcgatcttttcctagataccataagtgaatttgacattgcaattagcgatatattatatactagaaaaaaatacccgtgcatagcaacgggtgaaagctattttaatcttattattattgtacggtttacctatggtgaattgtgcgaattcgcttgtatattatttttataaaatcatgagctgtaaattggagtccgattgtcacaaattagtgtgcgagtttttttaaaagagatttcttatacgactccttctgtatttttaaaattgaacgaacttaaaaatcgacttaaacatagatttgtatttccaaaaacaaataaacttaaaaaaactgactcaaacaatatggatgacgtgcacatgtataatagtattgatatagatatagatatagatataaatgtgcacatgtatatatgttgctggactttcatacccccggtgctaattgagttagtatatacgtacacacttgcgtattagccatcgatcgggctacgtgtactgtactatagtatatgtttctttttcccaaaaacagaaagatatgaatatatgatgctttgtgtatgcaataatactactggtgtagtggaggaagcggaaaaaaaggtgaagaaaaatcgatatgaagatgcgaatgttagccaaccatacacactgccagacctaaatatgtccagccaaatcatatttaattaatcagctatagttttactttccaaaaaaaagctatagtagttttactcaacaaagcccccattacgatacacgttattaaaatacaatttgaaaatatcaaaacaaaataagtataagcaaaattaaagagttccaaaattaaattaaattaaacattagtaattctgtggtacctgggatatctggagccgaggatgtccttctggccgtacttgcgccacgtgtacccgtcatccggcggctgctccgtgttccccgtccgctgtgccgccaccatcaccgtcaccttctccccgctctccctcctgatacacatacatcatctagttaattatttactcgcttcgacctgataaaaactataatttaaaattagatttgatacaatctagtgtaatgaattttgatttttattgggatatatagagtgagtatctatgacgaaaattcactaatcaggttaatttaaccgatcgatcagcctattcagtaatcaactaattaacagctgatgcgccgcagagaacacagtacctcgtagagtactcgtagttgtgtgtaaaccctcgtgtaacttgtgtgcaaagcggaagcgccatgacttggcaagcaattcggactgcatatatgccgcttagccgtcgccatcaccgcgaacaagaaaatcaatactccctccatttcgaaatgtttgataccgttaactttttaacacatgtttgaccgttcgtcttgttcaaaaacttttgtgaaatatgtaatattatatgcctacataaaaatatatttaacaatgaatcaaatgataggaaaagaattaataattatttaaattttttaaataagacgaacggtaaaacatgtactaaaaagtcaacggcgtcaaacatttcgaaacggagggagtattaattacggggtattagtactagttaagctaaagtctatagttaattaatggcttggtgtactgcaggtaggagaggagagaaggagagatggatatatggctagtgcgacgaaaattcggtggcgtttctttctgacccagctgcgcgcgcgcgcgccatgcacggcgcgacgtggtaaaggtcaacgtgtctgaacagcttgaccgccaaaagacttcaccaactacagtagcgcaggcgcgccgcgcgggccatggccatggcgtgcttcgacctgatcgaatcgattaaccctagcgtacgccacgacgacgaccgggtgacgcacgcacgcaccaacggagagggaagagtgacgtagtgatgtacctcctcctgctgccggcgccgccctggcgcggctggaccggcgacggcggcgagcgcgacgacgacgacacccgcctcaccgggccacccgacgtgccggcgcccgcgccgccgtacgcgtcggacggcgcgcggaacgccgccgttgttgcgccgccgccgccgccgaggaacgggttggcggcggcggcggcttcgtccggcgccgtgccgccgagtacatgcggaggaggtcctctgctggcgatgctggtgatggaggtatccctcgccgccgaacgacgttgacgccgcgcccacgccgccgccgccgtggcgcgccccctgcagcacgcgcgccgcggcggcgtacgcgccggcaatggcgtggcagcgcgcggccaggtagtccgggtcgttctgggtcgccgcgagctccgacatcagctcgccggcgagccggaacccctcgctgatctgcgccagcacctcgtccatctcccaaccctctcggccgccgccgccgccgccgacaaccctgctccgatcacggcgatcgaaaccaccaccagcagcagcagcgagcaacaccgacaacggggtcacctggtgcggtgcaaagacgtgcatgaacaatggttgcaaggtgctcgacgacgatctcgtatttaatcttcttatgcccgaggttaataaggtagctagctaggttataagcaaattaaggttactatatgcatgtgtagagggtgaggcagtgtggtgtatataggaagcagccgggcacgtacatgcggtaagaaagggagaaactgaattagaacgggtcatgcatttggtcgttggggttttattgactaatttgctaactaaataataatcaattaaaaacgaagagagatacggtatatagttaattgaatatctttggtgtgcattttgcctctcttgcttggtgctgatcgagtcactttctgactactctttggttgggtcttggggaagaccatgaaagttgaaaagggcattcaacatggaaggatccaatcttaattctggccactggggtttgatcctccgttctttggccgaagactcggtgcagctttaattttccaccagaagagtctccggccaactctaattaaatgaaaatggtgacgtcacggtatgtgacacctcatcgcacaactgataggcacctgcttggagccacaaatgaattaactgaagctcggccagttaattttggggtaaatatactaagctggcaattgatcttaggcaacttatcacataattaacacatattatatatatatatatatatatatatatatatatatagtaaatttgtttggtactccatggtgcccgggcaccatgattgaaatttactatatacccaattcaaatgagtatgaaactttttcaaatatttaggtattaacgttaactactttactaactagttcaaagcaagtttgaactgaattcaaacttacttttgttagattttgattctaggtatatagcatccaaacatataattagttaggtatgtaataatggattgtgaaataaagttaaatttgagttgttttgttgctaggtataggtatgaaatgaatacttataagtaggtatatactcacaatttgaaaattttgaaacatttgggcgaatttgtgtatttcataccatggtgcccgggcaccatggtgccccatatgagtgtcctatatatatatatatatatatatatatatatatatatatatatatatatatatatatatatatatatatatatatataaaacatgttttttccgatactttggtacgtcatttgtgtgtgattcggtttctaagttcgtacgtttttagaaaaatatttccgtatttgagtcgatttttaagttcgttctcttttgaaaatatggaaggaatcgtataagaaatttcccacgtgctaacttaagacgatgagactcctaactgtagctcatgattttctaaatatatatatatatccaaactaaaccatataacaataataaatttaaaacaaccttcacccgttgcaacgtacggacattttctctagttattataaaaattgaagatgtttttgtcaaaattttggtacgtcatccgtgttggaatcggttttctaatatttatctttatctctaatctatctatatacctaataaaaataagcaagaattccgtgtatttgattttgtacgtcatctgtatgtgtccgaacccagcgaagttgggaagaatcatatgtaactttttctttagatatccatggatatattatttgcctgattccgagtccgtatgagaaagttatgcccattttaatgc

SEQ ID NO: 57832 - DNA, 1761 bp, Oryza sativa
tttagtgaccaaaagcaataaatatatatttgtgttttttaacttcatgagagcatggaagttgtttttcccttgttttgttttctttacctttaagagtttttttttaaaaaaataaaaaacttttttggaagttcttcctttcgtagtaacacggtagaaaaagaaataacttatacaagaattttttttataatcgaagaaaacttctgaccactgaagcaatgctctttaattgttggtgagtggtgacatacacaatgcaaacgatcgaaagacaaccttgccacaccacggctcactgaaaattagcccatcgtctggccgttaaataccttttgacaaaacaagacaaaaaaaattgaaggatgcgagcacaagttgtgctaaatgcttgaatgtaacatgagatcaagtgctgtcactaagtgaccagaacagcttggcctgccacacgtctgaactttcccggagtaagaatcagtcttgaactgaccatgacaaatatgttacccagctttgttggaaggttttgctctgtagcactttctgatgcttcctatccccactatctctatctacatagtttcatcaaaacgaaaaaaataatgacaggttttcatcggcattgtcgatctatgagctcttctcttttctcccttaagccacctcccatggtctaagctgggtcactccctgtctcttttcgcgaatgcgtaaaaaaatggcccgttaatatattagaagaaaagagtttttgatacataacgcaatgactagaagaccattattgccaggggacaaggaaaaaactgagaaaggttaaaaaactatgaaagaaacttaaagctgcgactcctatatagcgggagaagggcggtggaggaaacccgctatgctctcaataggcctccaaaagaagcggcaccagccaaagaccagagatggccctcctgaacgatgaactctaaaaccaccgaaactggtaagagagaggagctgaaaatcctggagttctgctctttccacagctgtcaggaaaccaagagaactagagagtcaaaacccctacgaagatgctcacgcaggcaggtcctaccagacagccactagtcttggagagagtagccacgagaaggagcgagacctagccaataagagggggacatgatatgatgctagacctagcgtgcgaacacacagtagaggaggatatggttcatcgtttcaagctcctgggcgcaaaaaggacaaaccgagtggctgtcgatgccgcgctttttcagtagatcagttgtctaacaacgctgctggaacacaagccagagaaatagattgcacttgacagggcctttagcctgccatagcagatcggcgcaagtaaaggagtgctagcctaggaagaaagcccggtaagctgagctagctgagtagagctggtcgcctgtcgaatgccggacaagacggtcctctgtgcccgaagagagctggacggaacagtcactccatgtcagatcccttaggcttgagtgtgaggttctacttggctaggtccagaacgagttctaagtttcgttgaaggtgcaaagccctctcctcaatttgatgtcctgattctgctgacagatttcctagtgcttcctattcctactcttcctacaccgtgtgttcgtgctaatggactgtccatcagcatgcctctaaagaagtttcagatgtgttgctctcttcacttccttcgttcacctcgggtgagtctgt

SEQ ID NO: 57833 - DNA, 20075 bp, Oryza sativa
ctcccctgtaaaagccccaccgttctcccctctcctcgctccatcttccccctcctctccctcttccccttctccacgcgccgccgtcgtcgtgccgccgcgtcaccgccttcgagccgccgcgccgccgccctcatgctgtcgtgccgccgcattcgtaccgtcgcgtcgccgcctcagtgtgccgcaccgtgtgccgtcgtcgccgccgccgtcgtcgccaccgccgccatcggtgagccgctgcccccccctgtttgtcgccgtgccgccgggtagtgagggagccgagagagagagaggaagggagaagccgagggagagaaagaagaaggaaggaggagagaaaccgggagggagagagagagaaagaaaaagaaaagaaaaagaaaggaaggaaaaagaaaaagaaagggagaaaaagaaaaggaaaataaataggaaattagagggagattagggaagtttagaaaatttaaaataattacaatttaattatagattaattatagtcgaagaattgcgaaatttaatataaattatggattattcttggtaatttctataataaatcaattcgcggtagtaatttagatgtaattaataactaaacaaatagatgaattcttatagattattatagattatttttgggtaatctctataagtaatcgattcacggtagaaattcggatttaattactagggattttagccgtgtgttatatttaatcgtttaatcatagactaagttaaatcgtacaatattataagatgatttttggattttgtccgatatttagctcgcgatacaaaattctaacatatatataatgctcgggtagattaaattaaaaacttatgataatgacggagcttggggctcctcaccgggagaccgcgcaggcccccctttgccggttcggccgggggcgctatgtgaggttcttcgccctcgatctgaggaatgtcagcgagaaaaagcacacgagacacgggcgacgtagacagattcgggccgctgagaagcgtaataccctactcctgtgttctggtggatctgtgtgtgaaggaatacagagagctccagagctagagagctcgagagcgagagagagttctcgctctggaatccagtggccagagtccccctccctctctcgcttctccctcttttcttttaggccagggcctccttttttttttaaccggttcggggtcaccacatgggcctctagatgcctaagaaaagaaacatgatttttacaatgagggctaatctacagccggaaatgacctctgacaagcagtacacacgcctcctgctccgctcgtcagctctcccggtggacgcccgtttcaaccttcattcaatggccagcgactttcttgccatgcttgcgctgaagcctggaatggatctgaccgggactgacataccaactccagaagtcagcacgccagctccggctagagacgagagccaggaagctctcatcattccgacgggacggggcgaggcgtgcgacaggccgcctgttgccacctaacccgcgatctgaccggtctgtgaccggtcacataccgcgactggtcatagaccggataagcatgcgctgcgccgcattgaatgcggcgtggcgcgctcgtctaacccgctataaatgcggttaggtgagcgccactgtgctcacctaacccacacacgtggcgccaacaccacagggggtcggggtgccccagccctcggggccgaaacaggagtggcccgacccctcggggagactgagggaggggcggccacgtcaccctcgggcccgaccccccagagggggtcaggccacgtgggtgaccgcggctacccaagcctctagtcacgatacccccggccccatgtcaccgacagataacaaaatatttatacccgcaaaaattgtttaggatgtataaatcgagattgggtttgccctagttcgcgaatagtgaagttaatataaaagagtcgactttcgcattcgacttccatttggatttatttggatttttatttgaattctaaccgaattcaaatcaattttcgcacgtaactatagagcccgagggagttgcggatccaagtgaaggccaagacccgcaagactttgaacaaggcaagtcatcactattctttgaacatgttgatcccaattccgaaattatttttatttacaaataaaaattgtatgcaatgatgaacatcctacttgtgattatgccttgccttgattattgttacccttaaatccttgtaaccatgatttacgtataagtccctagtcaactatgacaaatgcttagaaatgctactctagatttatgcatactcatatttatcaaatgctatatgcttgggcaattacctttgggaaggtaattgagatgcggcatgtggagacatgagcgccacattgccatgatgttgatgatatgatttgtgaaaggagaaataaaattaaacaactgttttcgactggggcggacggaggatttgggtggtatctggaaaaggctagtaccgtccccgatcaattaaggaccgagccatgaagttaagcatgaaacgacccctgtacaaccgtacttctcgtatgggtatagacctagcggattagatagccgagcggaggcagtatccctgcatagatggttcacccctgagtgaggcaggtgcgctacggtgggacaaccattgaggtagggccgagaggcgtgccctacatcggtgtcgccatcggtaggactgccatgagtgtgtgagagagagaacttaacttgaaccataatttaatatgtgtgtgagacttctctttcccgggagtgccagaactcctctcactgctagaaacatggacgcctagagtgcatgaggatttaagttcatggagcgggtacgaggctcatgtgttgggcagtcgcggagtgcgggtaaagtgtacatccactgcagtgtgagtaaaccaaatctattcgaatagtcgtgctcgcggttactgagcaccgggacatgtattacacttggctagactctaaattcttaacttgtgtgggatgggatattgcatgataatttctatgctgatggagccacttcctgagaggcgggaaggtggacgtcctcagaaaaccatgtcgactcaatagcgggaagctatccttgggatcacaatggatggtggatagaaccgtcattgtttaatatgaacactggtaataaaatttgatcagtctgtgctaggtcttaggtttgtgaaaagaattacaaaacttgctttgcgcaaaagaatcatagccatcctttgaatacccctgtcatatgcattgttgctgtggtggcttgctgagtacgggtggtactcacccttgcaatatacaaacttaatcagaggccggagatgaagcttcggaggatccctatgcctattaccaggagggtgatgaagacgatgacgcccagtaggtctcagttacggtcgttgcctgtggcaatggcgtgccgctgccttaactccgctgccttatccacttctgtttttggaatgtattccggaccgctcggtccgatgatttaagactatgcctgcgggcttatgatataatgattcgtactagacactcgtgtatgtgcacttggtatctcagctacgaattcgtgtgtaccagactacttgatccaggaaaatggtactgtttgcacgattgactcctgttataaaaacgggggtcgacatattgtacctgctcttattaggtggggagggacatggccctttattttcttctttttcaggggataagcattgttttatttttcttttgaaaaaagtggtatcaccaggatttcccttaccgtcggcgccggagttaccgcaccctgacgataagcacggttgccacgcggtaaccgtggcaaactgtataaaatttatcaataatttgaattattttctaaatttatttgaattttaatggggtttccgcggatttatctttatcgtaccctggaggtaagcgcgataaccgcacggttaccgctggttttgtaaacattgggtgtcacaaacttatgaactttgagtttttgcgtaatccatttgcaatgtcttatggtgctcaatattagcaattttttccttctaatttgatatctcttagccaaaatatagaaggaagcaatccatctgacatagagttcattttgtagttggaagtagcttttaggtttcttatagtattagatatattgaatccatgggttgaaaaatccttagttgatgcggtaggttggtgttgttagagttcgaatgcttgagttgaagaaactatttgtcctcaaaagtaaagaaaagttattttttgtccaaaggtaaagaaaattattttaaagtagagtaaatttcacaaaactacacgttttgtggtccaagttacagacaaccacacacactttgacacttggcgtttaagttatattttggtagtgtagtttcacaaaaccacactatcaatgaatggattcacccgtgatatgacgtggctgttccacttaggacaaggacgtggcaccctattacaagccatcgcatgaaattaataggatgccacgtcctcatcgtaggtagaacaaccacgtcatctcacaagtgaatccattcattgatagtgtggttttgtgaaattataatgccaaaatatatgtatttgagtgccaagtgtcaaaatgtgtgtgttttatgtaacttgtatcataaaacgtgtagttttgtgaaatttactctttaaagtataacataaatcttggcaataaaaagttttatatgggagttgaaagtttgtgttcgttttacttgaaagctttttctcgagatgaaaagtgatttggtggtggcaatctaaacaggatgaggcgatttttcctttactttcagtaatataggataattgctaaaagcaacatagtaaaacattttgttaattcaactattataccattattcttttattctaaaagagacctttcgatgatctaccgttggatcagcatcacatggatctatgtctaccctgtaccctttatatagccctcttcctccttcacaccctaaccctagtccaatacctcctccctccaccgcgctgcgccgccgccgccaccaccaccctcatgcttagatcttgccaacaattcagggcggtaatgatgttcttcctcaatagagtagagatggacgcgatgtactcactagtttcctttgcaggtgctctttctaacttgatctatagtattcttctaatagtaccaggcctccttttgcacggagggattttgcgggaatttcacgggaattgagttgattcctgaaattcctgtaaaattcttgtgttccaaaggagcccttgatgttgatatccctggccctgccccctagatctgagactccttagcttctataacttcgatattcatcggttttccaagaccgaaggtggaagtgcaaacgttgcattgccaccggtagattccacaaaaaagagcatcacgatgcgaaaatcatgatagccgccttcgaagcccttattggagcatggattaaaacaacaatcagttggtaagaaaatcaactattttcactataaagttcttcaatttattcattgtgcatcctttagattgtataaattttctattgagatagtagtagcgcggtatatattttcaagggaagaaatggaaataaaaaataagcatggatggcaagacatataaatttctttttcaatactcatttgattgtctatatttattattgaattcgttcaataacataatcagcatgatgtatcattttcccacacatatatatatatatatatatatatatatatatatatatatatatatacatacacacgcactatatatcaatagatgtatgctaattactaacacacatggcaagtggcccactacatgcaacattcaagagaaaaacagagcaatttgttgttgtaggattgctaattttcctgttttatattgacatatctagtaaaaaaagaacgtgtgaggtatatcatatatgccctcttgacctacttgtgataaacaactaattaatttaagattcacctctttattttgaactttgaggacggacaaattatactagaatgagggaaaacttagttgtccatctgaagacaaagatcctaatattggtgactccatttcttttctaatcagcgagggataattatatgtagcatacccttgctagttaagccgctttcatcgtgtcaattcataccattgacgtttagaaaatgtcgaagatgccttctgttattttccaatgaaaaaccttgaatttttcgtccgttagacgcccaggtggaaaactagcattaaagtaattaagtaaggctaatgaattaaccaggtgatgctaagaaaatatattttgaatcagatcagcttttgatttcgtatgaatattgaaacatgcgtgcctgcattttgattccgattttatttatggacaccattcacgtgcatatataatcagaagcagcaatggtgtctttcccagtataaaagacagaaaacatttgctctatttgatgacactccggtgacgtgttctccatacagtcaattctagtagtccacatggaagaattctcatcttaatttatctgattatctggtttttcaaattcaaaattccatactcaaaacaacacgtgttacaaatacagtggaaacctcacggtgtcattacgcgtaagcatggctgttaaggtggtgctagccatgtacctgccatattggcaatgccacagaaatcctgatacaactgtgtttgtatctgtactaggggaatttttattgcaattcccaaaacaaaggggggaaactcaactagaaaaagggaaagaaatcaatggaaaatcaatgcggcccattttttttaataaaaaaagggaagcgtcccggtagccgccagctcagcgcgcacgcagccatctcggggcagaaaaggcgcccccaccccacccgcagccgcaagtggaaagcagagagagagagaggcggccgcggcagcagtagcaggcatcattagctgctaatccctcaccccctctgtcgctaattaatccctcggatcgccgtatttactaggtttactaatcacgttttggcgatttagtcttctctcttctctctctctcgtctctctctcccccacctcttcttccctttcccccgcctccctctcctcttcgtcgtcacccgccgcctcccgctgaatccgcggcttgggaggagacgccggagtcgggggcgtggacgggggttggatctgcttgccttgatggtggcgattggagcgtgaattcgtgaggggggcgtggtggtggtggtggtggttatacggttttcggtttcgtgggcgggggagagatggcgccggtggaggatggccgcggggtggagttccccgtggggatgaaggtgctggtggtggacgacgaccctacatgcctcgccgtgctcaagaggatgctcctcgagtgccgctacgacggtgagcaagctctgctttcgcctctgcctctcccgcgttctctgtccttgtagtctatcgcttgctgtgctgcggttgtgtgggcgtgacatgattggttgcgtggaggcggttggtcggataagtttcgttgtttcggttagtgtttcgtgttccgatttgtctggggttggggaggagtcggctgctccgtgggttgatttgcttttccgtgaattctggggagtttttattttttttctgcacatctccgttattgggaatttttgcccttattgtcggttttctcaatctgggaatagattgttgagtttatatagattagtgattgtattggagatctgagcgagtttgcggtgtgaaatctgaaccgtgttgctaatatctaatcctgcctttttgtttgtgctaatataagcagtagtttttaagattcttaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggccttatattctgtggattcatgcgggcttcgaattactattatatcatcccaacctaagacttgcaatatattgggaatatatcgtcgatgctcctagcttttgttccctatcccgataacattttgttatgcctaatgactgtgaattatcacccatagtaatgactgcaaattatcacggaaagtttagcttaggatcaggagtttattagaggcgctatgcatcacccacctaccccacagttaagttttgttgcaacaggaacgaatactccaaggatgcaatgcggcatatctaggttgcagcctatatagaatctttgttctgtaaagtgttgctattcctttctagtttctgttctgggcgccaatagttcacatatgcgcatcacagcttaggggaaataacaaataatataatgggtttattactgatctattttttcttattatattacagttgatttatttcctactataagttgaatgtgtgcagcatgagaaactgttggattttattccttatccagtcttctctattgaatgatctctgctttaaaacgaacgtgaaaagcattaggcatacccatggaggtattcagtattcataatgtaatgcaattgtacataaatatcatctgctgcttttatgccttcaaatacacttttaagtttatatcatgttgtgtgcagtactttttcgttgctttgttttgttttcactctgttgtttccgaaaattccactcgttcgtgggaagctaatatcgtaatttgcatctgcttcatttgtatgtctgaatagttattttgtttactttgttttttttgggcagcgacaacttgttctcaggctacaagagcattaactatgctgcgagagaacaggcgtggttttgatgttataattagcgatgttcatatgcctgatatggacggattcaggttacttgaacttgttggccttgagatggatctcccagttattagtaagtagattaatattctccaccctgcttgttaattctggtttgtcaaaggcattactgaaatctgttgataatattgcagtgatgtctgctgattcaaggacagatatcgttatgaaaggaataaaacatggagcatgtgactacttaattaaacccgtcagaatggaggagttgaagaacatctggcaacatgttataaggaaaaagtttaatgaaaacaaggagcatgagcattcaggtagcctagatgatacagatcgtaccagaccaaccaataacgataatgagtatgcttcatctgcaaatgatggagctgaaggtagctggaagtctcagaaaaagaaacgggataaagatgatgacgatggtgaattggaaagtggtgacccttcttctacatcaaagaaaccaagagttgtttggtcagttgaactccaccaacaatttgtaaacgcagttaatcatctggggatagacagtaagtttttcctacttttggcacttattttcatcaacagcaatgtttggtcggctgtacacttgctaatttatttttcttttggtgttgtttaccacatttgaacacctgaaccttgcaattacatcaaatctttccgctttcaagcttacacaaattttataattttctcttcagaagctgttcccaagaaaattttggagttgatgaatgttcctggtttaactagggaaaatgtcgccagccatttgcaggtttgattctggttttcatttttaatcacgggtcctttttcttgtatcatatttagcatggtgtggtggatgttatgtttactggcaccatggaatatctacccttttgtattatcctaattgttattattcgtatttattttacacatccttgctctacctgaatgtatctactctgatttaattagcagtagaaaccaactaaccaaaggacttgctcctggaatgatcttgtaattccagggacttgtacatacactattttagtgctgttacactcttttattgtagaatgaaaccataccaaattatagatcattcaaccagtgcagatggcaacgaatcgctctataatagatgtttgataataaacattgtttttctgttgttcttattgtgttgcctggggatcatccatttgaaggttttgtctacagagtaaaattccattggttaccttgtgcatttgtgctgcttgtctgttgagctccaatctccctgttaccttcatttttttaatatataccaggacctgtttaagtgcttagttcaatagtcatgatatacagtagcttagaccctgtttgaactcaggacgtccctaagttatcttgaaacaatgtcgtttttcttgggcatattgaagttgctgaaacagtaatgaagtatctgtttgctcttgctgtaacttccagttttttagttatgtaatgataatcatggtgatgcaatgagttttttttttctattttcagaagttcagattgtatctgaagaggattgctcagcatcatgccggaatagctaatccattctgcccgcctgcttctagtggtaaagtaggctcactgggaggacttgatttccaagctttggctgcctcaggtcagatccctcctcaagccctggccgccttgcaggatgagctcctagggcgacctacaaatagtttggtattgcctggaagggaccagtcatctttacggcttgctgcagtcaaaggaaacaagccccatggggagagagaaatagcatttggtcaacctatatacaagtgccagaataatgcatatggggcattccctcaaagcagtccagctgttggaggaatgccttcattttcagcttggcccaataacaaacttggtatggcagactcaaccggcacattgggaggcatgagtaattctcagaatagcaatatagtcttgcatgaattgcaacagcagccagatgccatgctgtcaggaacccttcactctctagatgtcaaaccttctgggatagttatgccttctcagtcattaaatactttctcagccagtgagggtctctcccctaatcaaaataccttgatgatacctgctcagtcatctggttttctagcggccatgcctccatccatgaagcatgaacctgttcttgcaacttctcaaccatcgagtagtctgttaggtggtattgatttggttaatcaagcttcaacaagtcagcccttaataagtgcccatggaggggggaatctttctggccttgtaaatcgtaatccaaatgtagtaccttctcaagggatcagtacttttcatactccaaataatccatatttggttagtccaaattctatgggaatgggctccaaacaaccacctggtgttcttaagacagaaaactctgacgctctgaaccatagctatggttatcttggtggtagcaacccccctatggactctggcttactctcttcacaatcaaaaaatacacagtttggtttactgggtcaggatgacatcactggtagctggtcgcctctgccgaatgttgacagttatggtaatactgttgggctaagccaccctgggtccagttcatctagttttcaaagttctaatgtggctcttgggaaattgcctgatcaagggcgaggaaagaatcatggatttgttggtaaaggtacttgcattccaagccgctttgcagtggatgagattgaatctccaactaacaacttgagtcacagcattggaagcagtggagatattatgagccctgatattttcggatttagtggacagatgtgaaggcttcttgaatttgtaagtaggtaggtacaatatcctaattttggtagcagatagctttggtgttcttaccccaaatattgctttaatgcattttgtcctctctataatgtgatcgtctctacctagtgatcccatcaattttggcatatcattcatgttgcttctttggacaatagtagaccttggttatgtttcaagctatgaacaccttgatggcttggttgctatatttattttacctcgcgcatttgttatggagtatttgatttgttatgcctatggtaatttagcgaactagcagtatgttcttcgtgagtcatgttcataattgatatttcaagttgactgtaccttttgccttttatgcaaaaacattgtttaattgtgcaattaccgaaacctcatttttctaatggcattgtttatttgtttatgcagggtaatcactggaaacaatttttagtgggttgatgaacggttgccgtgtttttcatttcatccttttttttttccttctgtaattggtttataaagggaataatttatgtgacagcatgtcgaatcttggtttatagaaggttgttcggtttaaacaactttggattatttagcctcatgtgacatagctcattttcctttgttcattttttgtgtacagttttctgattttgttgcaaatcttcttctctcactagttcttcagcttttctgttttccttgcgatcttccacttaaattgttaccaaattagctattcatccttgcatctcccaatgagcaggttgcaattcatttgctgtacatgttctaatcactcttactcttttcatggagaagatgttctccaagtgctcgttacttctcccatttgagttaccttgcgacatattctgcgcataatgatagctgctgaaatacaatgttttgcattccgtaaagttcaaatgtatcttaagtactactccgtccaaaaaaaaaaaaaacaaaccctagctacgaaccatatgttacgttcaagttcatagctaggattaggtttttttgggatagaagggtagaacaactccatttgcatgtacatttatccgagctagtgggtctggaccatttttatccgtcagttcatcatttaacagtctgttttctagtagtactctcttccattcagtatatgacatcgactgcatcagtatccatctaccaaccggaagtgaaatcagacatgcagatttgctccagatgaaggaccatgcattgattaagcagcagatttgtcgagatatagttcaacactagatcacgtgttgctcggagaaaaatatgataattgttgcggtaacccgagctttactagatcaataatactctcttactgatgacaaaccaattcatgatgctctaaccaaggactaaatcactactccgtacggtacaataccctgaagaatcataggaaatcatgtacacctaactagcaactacgacccatcaaacgctcaaaccggggggaactaaacgaggctctccggtgcaccgcactgcctaatcctttccatggcacgcctcgcgcgccctatgggtgctcattcgtcgtcgtcctccggggggctcgccgcccgagccagctcgttggagacggaggccaagccctgcatcagcctgacgacctccgccgtgtcgtcgaggtagtacttggccttgctcggcttgcggccgacggtgcaggcgaagacctccgccgtggccgccagcgactcgccgcaggtggagcttgtgatcatctggaacatttcctcgtcggagcggtcgtccccgatgcacagcacgaagtcggtgcacatgcccctctcctgcatgctcgccagcagccgccgcgccaccaggcccttgctcacgccctgccaatggcaaaggtatcaaacaccgcgaacgaccatggcgctcgatgctaacaacaacgaagatgacgaggattaggaggaggattcacctgtggcttgacctcaacggaatggccggtgctcttcaccgagacgggctcgttggcgagcacgctctcgaggtggtcgacgagctccttggcttggcatgaaccgaagtcagggtctgcgtcctcgtagttccagacgagcaccgtctccctgttctcgatgatcgagccgtccgtggtctccctgtacaggcacatcaccggctccgcgatctgcttccagctgcagtccgcggggggaatggaaatctcccactctgcatccctcgatgaccttcagaaacatcatacagatttgtcaaagtgttgaaaattgctcccctttgcaagaaacatcaaggcagaaaaggcgtttatagtgttgaaaggttttctcatttggccatttcaatgttactactgaaacatttccccatccatgtgacactatgttttactagtgcagatcacaatcatgtagtactacgcttttcattaagtaaaaagaatgtactaatcttttaattcatttctagtcatgaatcttgttatcttagaatcaggttagctagatggtccgtccacatgcacaattcggtattttgagtcatgaactgtccttgcaagaacacaaaccagagtaagtcacaggatcatacctcaggaagtaaccgtgctcagccgccaagccaaggttctcgcaggggaaccagtcatggagtgttcccttctcgaacccgctgcagaggaaaaccttgttgctcttgtccctgcacaagctggtcagcgtttcgacggaattggcgctcgggctcttgttgatcgcctgcggcatgagcgtgccgtcgtagtcgagcaggatggcgcgcgtcttcgccctccggtacgccatgacaatgtgctccatggcgagcttcctgaagctgaggtcaagcgacaccaccctgaaccgcagcccgaagccgatgccccagcaccgccgctgcgcgtgatccttgcacgtcctctcgaggtcctgcaggaagctggtcgcccagtagcccacgtcgtgggtgtccacgtagcggtagtgcttgtcgtggcgcatccgcttctccttctccggcagcacgagcgcgctctccatggcgtccgccacggcctcgatgttccacgggttcaccctcaccgcgccgctcagtgacggcgagcacccgatgaactcggacaccaccagcatgctcttcttctcctccggcttgctcggctgcagcatcctgtcgagcgcctcgttgccctgcctggacacgatgtactcgtaggggatcaggttcatgccgtcgcggaccccggtcaccaggcacacctcggcgacgacgtagtacgccacgcgctcgtagaactggagcggctcgtcgatgagcaccaccggctcgtacccgggcgcgccgtacgcctcgttgatccgccgcaccatggcgtacgtctcccccttcacctcgtcgacgtccttgccgcgagccgcgcgccgggttcgcgacctggacgagcaccagcttgccgcgccactcggggtgctgccgcagcagctcctccatggcgagcagcttgaggctgatccccttgaagatgtccatgtcgtcgacgcccagcatgacgaccctccccttcccggagtaagtcgccatcagctctgccaccttcgcctccgtctccggcaacgcgagcaccgtcttgagctgccccatgttcacccccaccgggaggatcttgatgctcaccgtccggccgtagtactccaagcagatgtggccacgcttggactcgtaggagagccccagcatccggccgcagcaggagaggaagtggcgcgcgtagtcgaaggtgtggaagccgatgaggtcggagttgagcagcgcgcgcaggagctcctcccggacggggagcgtcttgtagatctccgacgaggggaacggcgagtggaggaagaaaccgagcttgatgcggttgaagcgcttgcggaggaaggttgggagcaccatgaggtggtagtcgtgcacccacacgaagtcgtcgtccgggttgatcacctcgagcaccttgtccgcgaagatcttgttcgccgacacgtacgactgccacagcgcgcggtcgaagcggccgccgaggtcgggggagagcggcagcatgtagtggaacagcggccacagatgctgcttgcagaagccatggtagtagcgctcgcgatgtcggggggcaggaacgccggcacgcagttgtacgactcgaggagcgcctgcgcgacggcgtcctggtcggccagcggaatgtcgtcgcggaggcagccgatgtagatgaactccatggcgggggaggagcacgagtgctgaaggtgccgaagaaggaagtcctcgtcccagaaaaggtccacggctccgacggcgacgccgggcggtgagcccggataggaaggtggttggcgaccacgatggtgcgcgccccggcgacggggacggcgtcgagggggacagcggggagtcgtcgatgagccccgcggtggtcaccacccgcggcagccgccgccggagcgcgccgagcgccgccggcgccggcgcttggtccgccgcgccggtggccaggtccagcaggttggagtaggaccgagaaaccatggcttctatctggttcaaagttttggatcaaagatttgggctctcggttggggaagaacagttgctgctggggaatccaagaattgcgaagaactgaatccaaacagcgccgcaattggggtttaattagccaagaacagagccggtgtgttcggctcactgtttcttgcaggaaagttgcacactcgcactcgcagcagtggttttttttggcctttcgggagaggtggcacacgcacctggattcaacaagcctccaaatgccagtatcctcactgtgcccttctctttaatctcgaatcaatatagttgtggttataatacaagggagagaaccttctcttgcaaattggtgatggtggtgttcctttccaagttctagcttggttggtgcaagaacatgggaggcactgagaaacacagctcagatactgtctctgcggtaaaaatccaatccttttcagctaataatgaccatcaagatttgatctcctgcaaataaggcaccacccggcaagaagaaagaaggaaaaaaatatcaggtaaaagtgccagaagaactcaaatgaaaagaacccaaaaaggaatctgggagcctccgtgcctcacacaacagttgctccaaccccggacgatctagggctgctcatgtcgtgtgagagggagcgaggagggagcaagaaaaacagcttttaataggagaggaaggatgactcacctcatcaccagcatcatctcgttgagttgtccttggattgatcaaacgaccgggacaaaataatcgcatgggacagcaggagtgatggagactgcaaaatttttctcttcctctcttttttgtggttgatggatcaattcaaaggcgagcaagcgaagggaagtacaagaaaaggcgcaaaagagacgcgagattattcggagattgagaggggctttgcttggtttggttttggtggtggcgtttggatctttcggtggctcacagtcacagccacgcagctgctagattagttgaactgagcaagaaatttacggaggggaaagagagaccagtggccgttccaatcaatcaatttaatcgttttatagtaggacacagtgaaagagcgtgcaggtctaacactttatggatttgtttctcttgtggaatttgttccattatggttaggataattttcttaggacaatattccaatcactggaatttgtttcatagaatttgtttcggaggacaatatggcatggcatggaacaggtaaagaactgaaatagcaaactgaactgactccacccacttatcagagccaaatacaggctagattatatgctctctacccaacagagagaatattgcttcctaatttaagctgccggtagatgagatctatccatcaaggcacagtcgccatcctcatcagttcgcaccaaagggataaaaaggactgcattactaatctaggtttagcagcagggaatcttgaattcttcatcacccttaagtcttagggctagtttggtttgtgaactaaattgaccttaccaatttttgactatgtcaaattttagtaagttttggcatgacaaattttgggaaggcaaagttgtatttggattgaagccaaaatagcctaagttaactattgaaatggcctattttcgtaggcatgctaaaatttggcttcaaaacaaatagacactaaacattattaaaatttttaaatattggtaagtcaaatttagacctcaaaccaaaccagcccttaacctcacgccggtcaaaacaaggagataggagatgcctcacgcatttggttggagccaccggacaatcttttgtgcatcacgattgtttgtttaatcgaagtggattccgctctccaccgatgactcttctgcccattgaacactgacaaacctctagcctgcgtgaagatgccatgcgagcgagccgcgatcgggagagcgagcgcgaacggcaggggagagagcgagcggcgagcggcaacacgtggcgagcgcgggggccgcggctgtccgtgcggcggcaacagcgacggggccggcgtggcgcgctgcggtacgtccgcggcggcgagtccggtcgggccagtgcaccgggaaaaggcttgacaagtgggtgccaggcgcgcgctgttcttttttctcggggagtgcgatagatcgaggaagagtgacagtgactagtggtaaatgtcatactccatgttggggacggtatctgaggctgtgttcagtcccaaccaaagtttaaaatttggttgaaattagagacgatatgactgaaaagttgtgtatgtatgaaaggtttgatgtgatgaaaagttgaaaatttggaaaaaaaaatttggaactaaatacaccttgattgggtttccactttactgtcatccacgctggatctggcgttctccagaattgtctcccaaagagtacaattcacccattttaagccactcctcgtttaattatctcctcatcgtatatataatactccatatatcgcataacactctttatacgcccaaaatatattttaatttgtaccgaaaaatgatttattattgagtaaatttcacttcgggccaccttttgttacctatgtttcactttggaccaccctttaagcaatattttcactttggattgggtaaacttacatttgtttcactttggaccacccaactctcttctcaagcatatgaacgatctcgattacgctgtctcctactcgtcaatgaactaacacagctatatgtaagactatttcttcgacatattacaagttggatgtagatggataaaagagtgagggtggtccaatatgaaacaaaggtaaaaatatccggtccaaagtgaaaacattggttctaaggtggtccaaagcgaaacgttggtaataaaaggtgggccaaagtaaaattaaccctttattttaggatgtgtgcactaccagtctaccaccaagttattatgcagagaacactaccaccaagttacaggactgaaatgtgatgtcattggaatggtactcttcaatctatatagtacagtactgaaatgcagagtagccgcatcctgttctgccgagcctgtgacttgttgcggtgtcaactgggccacaaagataaggttccagc

SEQ ID NO: 57834 - DNA, 13150 bp, Oryza sativa
  unsure (1)..(13150): unsure at all n locations
taatatgcaagatagttaaaaaataaatgaaaatatggtgatacctgcaacgtgaccactggcgcaagcgtcagcaaccgcctgggtatccatgattgctccacgagcattgttcacaatggtcacacctttcttcatctttgcaatcctctctttgttaaacatacctctgaacaaaaaagcatacaaattcagataagacaatgtgctagcacagaaattttggaacaataaacaagaacgcaatgaaggacgataaaccttgttttctccgtaagaggcatgttgatcacaacgacatcacactttggaagcatggcatcgagatcctcctcatacttggccccaatctccttctcaagctccgggtcaatcttcaccctgtcatggtacatcaggttgcagttgaagggcttgagacgctgaagcaggagcctgccgatgcgaccagcaccaacagtgcccacagttttgccctcaagatcataggttctgtgggcaatgcccgcgacattccattcgccattaacgatctgatgggtgataataaaaaacctaacattttagtctgcgaaattcaaggactgagtttaaaataggataaactgaatttctatttctatttaaactaaaaatatacgagggctagatagggttgtaaaaggactagtgaagcttaacacattacctgatggtgaccaggcaagaagttcctgagaagaagcaggatgcgcatgagctggtcttcagccacggagacggtgttgctgccggtgatctccgccacggttagacctgctgccgcggctgctgggagatcgatgtggtctgacccgaccccggccgtgagaagaagctccaggttcttggccttcttgatcctctctgcggtgatgtaggctgggtggaatggggtggtgatcaggacgtgggcatcctcgatgtgcttctccagctctgggaattgatgtacaacagaagcgtcagttgtgtgcgcaattcagacttaagacctatatatttagtcagagaaattttatgatccttcagatacctcaaggtatttagtatctggagatgtactcagacgtactaaattttactgtaaaaaatgtgatgcctattgatatgttgttaaggatagaaaaattacccattatgttgttatagggtttattttttcaacgaacagataagacatcagacaaaaaaggaaaaaaatataatgcatgtttgaaacatttgcgcaaaaaactggtcatacaggaatttgaattaactgaacatcaggccagcatgaaaaacataagataaaattaattccagccggctgccaaccaaaatacacgtctacatgctgatagatgctacggaatgctcaaaaaaagtttatcgaaattgttcgtagaaactacctcttgatcacagctaatactccttcagttcaacaacataagctttgactaagaattactcttaatttcatgacataaatttgatcttatttgatttgtattcaaaagtagtctttaagtattatgtgaaggctttattgtactgaaacaaaatacatacttcttaatttttagacggagggagagtactactaaccgcagtttatcccctccttgtcatcggtgacaatgtagcgatgccccttagattcaagccagccgcgaatgccgagagcggagtcgacgcagccgacgaagttgggattcttgtcggcatactcgccacccttgtagaacacacccacgaccttcttgctgcctgctgatgtctgcggtacaaagagggaaaccaaaaggtgtcattcgtcatatcgagctgcatagaacaaatttgttgatcaagtggatttgttatatttaggggtgtaagtgggtcagttgtgaacaacttataggttaaaataagcgggttgatggcttgttttagcctataagtggatttcgcgggttagccacttacactcctagttatattggttatgattatttgtccatcaccattcctgagaaaaaaaaaggaaacatttctcgggaaataaagaaaacccgacaggcaggggtataaacgtgacaggtattttcagcccgtctgctgaccagatgtttatggcaaggatacggtaaagaaaaatgattacctggtatgatccgtgtccaaatccaaattcgaaatatatgaaataggatatgggaaaatttgtattagccgaaatgttttgtattatcaaacatacaacaaaaattatgagtttatgatttcacttgtgaacatggataaaagatttgttaatcaccatttgatgagcttacaaattaacaatattgtgtattttttctgatatgtcattaaatagtttttaacactctacttgcattgtttggtcatatatgttatatgtagtgcagatacaaatgtgactgtctgggcctacccaaaaatatggaatgaaatagtgtgttcccatcgtgtgcaaggtaattactattttataaggttggtgctgtgtgacgaattaaatgtgtctaccaaagaggagcaatagttaaaagccgattacattgggatgaaaacggtcagaaacaatattatttatacagaaccgattctcgatcggtcaaaaattctcatatttatcaatttatcaatttagtggcgattgcaatatgaagtgaaaagaaattaaaaatatatataaatgttatatatagctaaaaacagaaacaatcaaaaagtgtaccagaaacagattttcgttgccattttctttttgattacagaacatttggctatgttcgattgtatatttttcaacttctatatatactttccctttttcacgcgcatccttcctgaatagtgagaaacgagaggactggagcatagactggtcattgaatttttaggtgattccccgtgcgttgctacggaaatttctggataatggctttttgatttttttggtggggctctaaatgtgaagtttgttagtataaatcatgttgtacagttgtttatgtggagtagaatattaattacttctattggaatatgacaacacgtgaaaggttactgcttatttctcaacgcgcttagtacatgtgaatagcaaagtaaatgagtaatcaaacatgaaatgaacttctaaacatccaaatgaaattcaacggatgataaattgacaatgacaagagtcaatgtggtggcttctttaccagagtaactaggtgaaacccccgcgcattgctgcgggaatttagtatgataacaataaaaaaataacgtgtaagatagctagataatatcagattaagtaaattaatgtagtttatgataatataaatttaaatagtatgtagaatgatgattcaaacgtaaaaagtaaggtggtacgactttatgaaagaagaaaagtagggatatagtttagaccgtagattaatcatctaaaagctaaaaacaattgatgtgatatgacttaattagaggaaagaaggagaaagataatttggaccatagaatattataaaacataataaagatatgtattgaaacattatatgaattatgttggatgataatttaacatgtttgtatttgaaaagctcctaaattataaaaactataaagatatagcatgtttgcatgatgtttaaatgtgatgattgttagtggataatgatgtggcattttgttaattagtggatgatgatgtggcatctttgcatgttaagcttaaggagttagtgggggataactttatagtaagataggattatattaagtgggttgcaactatatatatatatatatatatatatatatatatatatatatatatatatatatatatatatatatatatagaggtttgaacctagaggttcggatctcatctcatccgttatggaaaacgagatagttcattagtacataattattaacttattagtacatgattaattaagtattagtaaaaaacataaaagttaatataacttttttatagaaaatatttttaaaaacatattgttcaaccgtttagaaagcccgcgcttgagaaacgatgggccagggtttacgattccgacaggcccttccgtttcgggcactggcggaattcggaatttcgcgaaatccggtggaaaactagtaaatttcgaacaaatttcataaaccaaaatttgaataaaaattccctaagtttgccgacaagttcttgaaaaccggtcggttttggcgaaatttcgatcactaatccggtccatctaagtgttttcctttttttaattctttattcttttctttcctgatgtaagtttcagtaaatacacacaatacatcatttttttggaaaaattatatcccaataggttctatgaatatcatagtatttataagattttatttgattttttttctttttttatcaattcaaatttaaatttggatgaaacttctcgaaatctcatacggtttctactttcgagcctcgtcgaaatatcgaattttcgcgaaatccgaccaaatgtcgtcggaatcgtaaaccctgcaatggctataagctgagataggaagcgcggaacatagctaggaaagagaaggatacgtacctgcgcagccgtagatgcaagcgcgcggccgagcagctgccccgccgccgacggtgccctccacatcgccatggaggaaaggatatgaaattgagctcagcaacggcgagcaagcgagagagtggcacaagaggcagtgagtgtgatggaatatcgatcagtattcagtgcaggcaagcagccgactcgatcgatgcgatggaagtggaagcctggattggaagggatggatatttgtagctccgcctccgccacctcgcgccgcccgcgtggtggcccctcggctgctgcgaccgtgcagtcagcgtagtgcatacccccagggccttgcctttgtcaggtaaaacctgagcataggtggattcatggaaaggcaaatactcgcgtgaaaggtgcgttctaatctatattttctcaacttctttctcgttgtctacatacacgttttttccaaattattaaacacgttttttccaaattattaaacagtataattcctctattccaaattagacgtcgttttgactttttttaacgcttaatcattcgttttatttaaaatatttgtgcaaatataaaaagagacaagttatacttaaaatacttttaataataaaataagtcacaaacaaaataaataataattccttaatattttgaataagataaatagtcaaatattaaataaaacttaaaacgacaagtattttgggatagagttaattttttaaaaaaaactattaaaaggtatctttgaaattttatattaatctatttttctaaagctttttaagctaatgattaataataagccactctattttacttgcttctttagagaaaaggttcataacacctactgccacagaccgacatccgtgacatgtactcaacaggccagggcccagggccagtgaaccaccgagtccaaggtaaaagccatgaggcgctggccgcctgtaataattgttctgttccatacgtctctcgcggtcgttccaatcgaatggctcttgtttcacaggaggaaagctaagaattgatttttgattcctagctaggaggaaagctacgagacacatgcaggcaaaacctaaaaacgcagatgccacgaggtgttagccgccctctagctagtatggttgtttcaatctgtttgctgtaactaagggcagggcccgtttagttcccaaaaattttttctaaaaacatcatgtcggtgacatggggccgggggtatcgtgactagaggcttggatagccgcggtcacccacgtggcctgaccccctcggggggggggggggggtcgggcccgagggtgacacggccacccctccctccgtctccccgaggggtcgggccgcccctgtttcggccccgagggctggggcgccccgaccccctgtggttttggcgccacttgtgtgggttaggtgagcacagcggggctcacctaaccgcatttatagcaggttggacgagcgcgccacgccgcatttaatgcggcgcagcgcacgcttatccggtccgtgaccagtcgcggtgtgtgagaccagtcagatcgcgggttaggtggcaacaggcggcctgtcacacgcctcgccccgtcccgtcggaatgatgagagcttcctggctctcgtccctagccggagccggcgtggtaactcctggagttggcatgtcagtcccggtcagatccattccaggcttcatcgcaaccatggcaaggaagtcattgtatgaagaagggcagacgtgtggcatgctaaactgacgcgtggtggacaagaatgaccggtttgtgactggtctaacaccggtcacgtcatcggcagacaaccgtgctcccacgttgcatctgcttccggcggagtggaggcgagtgacggcgctgggcctcactcaaggacaagctgtgatttagcttccaggcgaaggcgcgagccaagttttggtcaagatagggtgggtccccacccaaaagaagagtaggtagaagtggtgcatgtggtatccccttgagatataaaaggaggaccttgcccacgggaactctgagagagggggactctcagacgactctgggaatacctgagctcgtagaggagagaaaggggaagaggggttctagagcctgaactctcttgctctccggctctctgtaactccttcacacacagatccaccagaacacaggagtagggtattacgcttctcagcggcccgaacctgtctacatcgcccgtgtcttgtgcatttgctctctcgcgaacattccacagatcgagggtgaagaacctcacttagcgcccccggccgaaccggcaaaggggggcctgcgcggtctcccggtgaggagccccacgctccgtcatctggcgcgccaggtagggggcgcgtgtgtctttctaagccctcgtcctctttcgtgtgcgccaagcttctcccgctcagcccaatggccgaacgggcagtggcgcacaacctctctccgagcgctagcggtgacgacggggagcagaacccgcgccgtcgagctcgtactccaccgtccccctctcgccgaagtcttgggcgggaggaggcgctcgagagggtcgaaagatccgcgacttcgccgcctgcgggcgatggagaaggacggcgagacggggagcgtcgcctcctcgtctacggcgatggcagcacgccccagagcgcgctccaggctgcgggcgcactcctgcgtcacccgcccgtcgtccccgatccagagactccagcccgacgttggctggatgacatggccgacttggtcatgacggcgccgcagcgcctaggcgccggcgggcggtcctccgccaccaaggcctctggcgctgctaccgtcggctccgtgtcgtcgaggcggagggcgcggcgagcggcggccgttacccgccgttcgtccgccattccctcgtcaacgcctccgacccaagaagatgtgcgtggggggccagatgcccgcctcaatatcgagcgccggcgcaatggtcgtcatgctgcccacgcaacggagggcgcttcctcgtccggagcgccacttcggtccgggcacgggggccagccccccgtgtccccggttggtggtgccggctgtcgagcctttgtggcgagccttcggaacgtccgttggcccccaaggttccggcccaccatcaccgaaaaatacgacggaagcgtcaaccccgccgagtttctccagatctacacgaccgggatcgaggccgccgggggtgacgacagggtcatggcgaatttcttccctatggccctgaaaggtcaggcgcggggttggctaatgaacttgccacccgcgtcggttcactcttgggaggatttgtgccagcagttcaccatgaacttccagggcacatatccgcgcccaggtgaagaagcggacttgcatgcggtacagcgaagggacgatgagtctcttcgctcgtacattcagcggttttgtcaagtccgcaacaccataccatgcatccccgcacacgcggtgatctacgcattcagggggggcgtgcggcacaaccgcatgctcgagaagatcgcctccaaggagccccagaccaccgcggagcttttccagctcgcggactgtgtggctcgcaaggaggaggcctggacctggaactcctccggttccgatgtggcagctccggccgcccccgggtccgccgctcggtcagggcggcgggacaggaggaggaagaagaggtcggcccattccgacgacgagggtcacgtcctcgccgtcgagggcgcttcgcgggccacccgaaaggggaggcctgcgagcgacaaaaagaaggaggtcggcgctcccagcagtgagcgcccgaccggcaagtggtgttccgtgcacaacacctccctccacgacctcgcggactgccgcgcggtcaaaagtttggctgagcggacgaggaagtgggaggaggagaggaggcaggagcgctgtgagggcaaggccccggcggctcccacaggcaaccgtcgaggtgaggccaagcagaaggccaccgccgaggacgtcgacgatggcgacgatgacctggggttccaggagcctgaggccaccgtcgccaccgtcgatgggggagcgtgcgctcacgcttctcgccggagcctcaaggccatgaagcgagagcttctggccacggcccctacccatgaggcgacgcggcgggcgcggtggtcggaggttgccctcaccttcgaccagaccgaccacccgccgtgcgttgcccggggaggacagatcgcgatggtggtttcccccaccgtttgcaatgtgaagttggggcgtgtccttatagacgggggtgcagccctcaacatcctttcccccgcagcctttgacgctatcaaggccccggggatggtgctccggccgtcccagccgatcatcggtgtgacgccggggcacacttggccgctaggtcatatcgaccttccggtcaccttcggtggttctgccaacttccgcatggagcgggtgaactttgatgtggcggacctcagtctgccctacaacgcggtcctggggaggcccgcgttggtgaagttcatggcggcggtccactacgcctatctccagatgaagatgccgggccccggtggccccatcaccgtccatggcgacctcaaagtcacgcttgcttgtatggagcagcgcgcggaccacctcgccgcggcgtccaagcccgcgggtggcgacgagaggctcagcacctccgtcccagccgccccgaagcagcggatgatcacgtgcgacgaggtcccggtcaaggaggttgccctgggcgacggcccgtccaagaccacacgaatcggtggtcttctggacgacaaataggaagacgcgctcgtctccttcctgcgggcaaacgccgacgtcttcgactggagaccggcggacatgcccggggtcctcagggaggtgattgagcaccgtctcgccgtgcggccgggcgcaaggccggtccggcagaaagtgcggcggcaggccccgaaacgtcaagccttcatctgcgaggaggtggcgcgacttctggaggccggattcattcgtgaggtcatccatccggagtggctggcgaacccggtcgtcgttcccaaggcgaacggcaagcttcggatgtgcatcgactacaccgaccttaacaaggcatgtcctaaggacccttaccccctgccacgcatagatcagattgtcgactccaccgcagggtgcgaccttttgtgttttctagatgcatactctggttatcatcagattcgcatggctagggaggatgaggaaaaaactgcattcattacccccataggaacttattgttatacgacaatgcctttcgggttaaagaatgcaggtcctacttttcaacgtactactcgaatttctttgggtagccaaataggacgtaatgttgaggcctatgttgatgacttggttgtgaaaacgcgcaaccaagagaccttactctcggatctagcggaaactttcgaaagtctccgctccgcccgcataaagctgaaccccgacaagtgcgtgttcggcgtgcctgcgggcaagcttctcgggttcttggtctctgcccgaggcatcgaggccaaccccgagaagatacgagctatagagcggatgcgcccccccaacaagcttagggatgtgcaatgcgtcaccggctgcatggccgccctaagtcggttcatatcgaggctgggagagaaggcgctacccctatttaagctcctcaaacgctccgggccgtttacctggacggaggaggctgagcgggtcctcactcagttgaaggcgtacctcagttctccccctgtcctggtcgccccggagccagatgagccgttgctactctacctggcggcaaccccgcaggtggtcagcgcggcgttggtcgtggagcgcgacgaggacaaccctcactccacgcatccccaccctgtgtcgactcgacccgagaaagagcagggaggagaggcccccgagccgaacggtggcctaaggcccccgacggccggagctggccctccgcctgcttgtccgacggtgccaggcgcccccgacccccaggacggcctcggggccactgcgcgagggccgcgcctgtcgccctttgaccccgaggtcgtcggcacagaagccgagtgctacccgcgtgccctctcggacgaagagcgccctggagatacggcccctagcgaagaggatcggccccgccgaaaggtgcagcggctcgtctacttcgttagcgaggccctccgggacgccaagacccgatacccttaggcccaaaagatgctttacgctattctgatggcttcgaggaagttgcgccactatttccaggcgcatcgggtcacggtggttacgtcttaccccctcggccaaatcttgcataaccgagagggtactggacgggtggtgaaatgggcaatcgaactctctgaattcgatctgcgctttgaaccacgccacgcgatcaagagccaggccctcgccgactttgtggcggagtggaccccagctcccgagcccgtctccgcccccgaggccacctcgggcccctcgcagctgcctcacaccgcctactgggtgatgcagttcgacggctccttgtctcttcagggcgccggtgcgggggtcacgttgacctcaccgagcggagacgtcctcagatacctggtccgcctcgactttcgggcgaccaacaatatggcggagtacgagggactccttgcgggactcagggtggcagctggactggggatccgccgcctcctggtgttaggcgactcccagctggtcgttaaccagatctgtaaggagtaccggtgctctgacccgcagatggacgcttacgtgcgccaggtgcggcgtatggagcgccatttcgatgggatagagcttcggcacgtgcccagacgggataacgcggtcaccgacgaactctcaaggctcgcttcctcgcgagcccagaccccaccgggcgcctttgaagaaaggcttgcccagccgtcggcgtgacccgaccccctaggggagacggacgcgcctgaacggcccccgaggcccgtcggagtccaggcctcgggacccgaggggagcgctcccagctcccttagattgattgcttggatcgctgagatccaggcgtacctcgcagataagactctacccgaggaccgcgaagagagtgaacgcgtccagcgcatctccaagcgctacgtgctagtggaagggaccctctatcggcgcgcggctaacggagtcctcctgaagtgcattcctcgggaacaaggcgtcgagcttctcgccgatatccatgaaggcgagtgcggagcccactccgcctcacgcaccttggttggcaaggcctttcgccagggtttctattggccgacggctctcaacgatgcggtcgacctggtccggtggtgcagggcgtgccagttccacgccaggcaaacccatcagccggcccaggccctgcagaccatacctctttcgtggccatttgctgtctgggggctcgatatcctgggtccgtttaggcgggccccgggcgggttcgagtatctgtatgtcgctgtcgacaagttcactaagtggcccgaggcttatccggtcatcaagatcgataagcactccgcgcttaaattcatcaggggcatcactgctcggtttggggtgcctaaccgtatcattacggataacggcacccagttcactagtgagctcttcggtgactactgcgaagacatgggcatcaagctctgcttcgcctcccccgcccacctcagaagcaatgaccaagtggagcgcgccaacgcggaaatcctcaagggcctcaaaaccaagaccttcaatatcctcaagaagcacggtgactcgtggattgaggagctgccagcggtgctctgggcgaaccgaaccacgccaagccgagcaaccggggagacgcctttcttcctcgtctacggcgcggaggcggtcctcccatctgagctcaccctgaggtcccatcgggccaccatgtgttgcgaggctgatcaagatcagcttcgcagagacgacctcgactacttggaagagcgaaggcggcgcgcggcctccgagccgcgcgctaccagcagagcctgcggcgctaccatcagcgccacatccgggcccgatcactctgcgtcgacgacctcgtcctacgccgcgtncaaacgcgtgctgaactgagcaagctctcaccaatgtgggagggtccgtatcgagtgatcggcgtnccccggccgggcttcgttcggctggccacgggcgacggcacagagcttgctaacccgggggacatcgaacaccttcgtcgcttctacccctagtaggggtcgggtgtcaggtttgggcttgggccaccccgcaccccccgggcatgcagggttggcccggggctaccacatgcatatacttatcttttttctct

SEQ ID NO: 57835 - DNA, 5055 bp, Oryza sativa
ctcaaaaccagaccttcaatatcctcaagaagcacggtgactcgtggattgaggagctgccagcggtgctctgggcgaaccgaaccacgccaagccgagcaaccggggagacgcctttcttcctcgtctacggcgcggaggcggtcctcccatctgagctcaccctgaggtcccatcgggccaccatgtgttgcgaggctgatcaagatcagcttcgcagagacgacctcgactacttggaagagcgaaggcggcgcgcggccctccgagccgcgcgctaccagcagagcctgcggcgctaccatcagcgccacatccgggcccgatcactctgcgtcgacgacctcgtcctacgccgcgtccaaacgcgtgctgaactgagcaagctctcaccaatgtgggagggtccgtatcgagtgatcggcgtcccccggccgggctccgttcggctggccacgggcgacggcacagagctgcctaacccgtggaacatcgaacaccttcgtcgcttctacccctagtaggggtcgggtgtcaggtctcgggctcgggccaaccccgcacccccccgggcatgcagggttggccgggggctaccacatgcatatacttatcttttttctcttccgtatttcaataaaagcattttcgatttcctaaggactgtgtctgtgccattgtttccttttaaagaatcttggcttgaattagcacgctcgtgctcgatcctgccctcggtggcccaggccggctaaaatcgccaaaaggggcccagaaccgagccatgccccggggcgtggtgaactccgggggggaatcggcaaaggcccacaatcgggtcatccataaccctcggtcaccacgctcccggcctggccagtctcgacacgtggatctccccaggcactagccccgacccgcgccgtttgaggctgggacctgggcacgagcccttgttcaagccaagacacagaaggaccgcggcacagaccatcctcgtctcatacacacaacaaatagaattgacacagaaatttcctctttatttgattgcagattaaattagtctatacaagaagggggcccgaaggcctcggaagaagaaagaaaaagctatttaagattggcgggggcctgggggctcactccgacgcgcccgggtcaccagcctcgtcgtcgctgtcgtccgcaccaccgtcaccgccctcctcgtcggagtcgagggcgaacgcgagccgaggggccgtaccttcgaagctgtggacgatgtggtcggcggcgtcccggacctgcgcgcgtgcgccatcctcggttccgggagggaactcttccagcgctgcccacggggagaagtcagggtccctggcctggtagcttgccagtacgagctccaccgccccccgggcgaggtccctcgaggatgacttgatcgtctcctcgagctcctcggggagccgccggagggccccggccatctctgagaggcgctgggcgagacccccctggttggcggcgtacttcgcgcaccgcccgccctagaggcccgcctgccgcccgacgcggtctagatgggagacggcgtcccgaagcatgccgggccctacctcgctcgccaagcggagggcctcgacctccccggcggacgagtccagcgcgccctgcagcttggcgatggtgtgttcggcagctgcgaggcgggcggctgggtcgccatggcccgcggccgccccgccgctgtgcgctctcgcatccagctccttcgcccgcgcctcgagctcagcggcccgctgatccagtacggccccctcggcgcgggcgccttccagatcgcggcgcgcttgctcctcccgcgctgcctcgcggagggacaggctatccgccagccgctgcgccgcggcctcggcctccttgagagctcgccaccgctcggtgagcacgtcctcgcggaagcggagtgcggactccttttcggcgcaggcgacctcgtgcgacgccagtgttgcctcccgggtggcgacgacggcctcgcggtccgctagccctctctccctcgcgtccagggcgcgggcgctctcctccagcgccgtggcgcgagcctcaagggcctctttgcgctgcctggacgccgccttgttctccgccgcccgctgttcccgggcagcggcggcgtcaagtactccccgggcggcgtcgagcttcttctctagctccaccgcccggctcccgtattggaggcggaggtcgtcccgcgcctcgttgagcacggcggtggcgatgaggacagtctcccgctcctcctccacctccctggcgatctccgccaggtccctacgacgggcctcgagctctgaggcgtgccggcggtgtgccttgcggcccgcctccaccatggcctccaccgagcgccgcccctcttcgacgcgcgcccacgccgcgtcgagttccgcccgctctgcctgtaggacctccatctgggcacttaacccgtccaacaccgtggtgttcgtggcggccaaggcctgcaggaggggctccgcgctcggtggggcagcggaaggcagaggggagagccgcctcggtgtgggtgccgcgcggctcggcccgctgatcgacgtgccggactcgggggcgtcccccggagctggctcgtcccaagcgtcgcccgaggggtcgggcccgagcggcgcgcccgcggcctcgtcgtgggtggcctcggaagtcgtcgtcacctcgggcggagtcgggtcgggggcttgacaggccgcctggcgtgcgcgccgcctctgcctcccggacggactccccggcccggcggagtctggcctcctcccgagcggcctcctcagcctggcaaacccggacggcctcctgggcagcctcctcggcttcccggaggcggtccgtggcttctcgccggtcagcttcccgcctccgggcctccgcggtcaccgtctcctcggcctcagaccggccggacttggaatggcggggggggcgcgacgggatctcgctgaggcagaagaaaaatcagaagacaaaaagaaacgggtgagtgaaaactcgccttgggagatgggagaatgaatacggccgcggtgggcgcggggacgaacctacggggaggtcggctaaacgaccacctcgggggcgagatgaggttcccccggcatgactcggtcccccccatcttgcggagccgtttcttctttcgctctccctcgggctgcggcgtcggcacggcaccctccgggcgcctgctgctggcacgcaccgccccgccccctcggggaggagatgggggaggggtaccctcctgtttcctcttcccccgggcgtcggcagggcggctgccccccgggcccgattgttcccccctgcggctcccggccgcgccatcgtggcctcggggggcccgctcccccgacgccccgacctcctgcatgatggtcaggatgttagcgcgctctggatcgcagcagagggggaggaccccttgggggatgagggatgcctccacggagctgagattcagcacccgttggaccaccatcctgaaatcctcagggtaccagtcccatgtgcgcccctggtgggcctcatggagtcctcgggcccggtgtactcccaggcgccccgggcgcgccgctggagcggcgcgatccggcgacgaaggtagtcgccgaacaccatggcccccgtgagcccctgggatcgcagacccgccaggcggtcaagaacggcgtcgtagccgtctcccagatctaccgccgcccgccagctggaggcatgcgccggaggctggctcggaagtcggaggcgcgcttcgtcggcgaggggggtgtagaaccaatcgctcttccagtcgtcccacttcttgcggaggacgcagggaatgtagcggttcagcacctgcccccgcggctggaagtagcagccaccaactaccgtcggcggcgacaccggctgtacagtggagaaccaccggaacagccggagagatgggcgcaccccgataaacatctcgcacaggtgcgcgaagatggccaacgtcattatcgcgttgggggtgaggtgcgccatctggagatcataaaactccagaatatccatgaaaaaattagagaatggcgggaccagccccgccattgcgaaagagaggaagaagacggaccgccccgggtagtctggcgtcgggcgtccctcgcccagcgcgaccaccttccggccggtggcagattccggcatgaatcggcgcggcagcccggcctacctctcgctcacgatgcgggaaggcggcagcacgctaccatcgagcggtgcggagccccgtgccatgacgccggtggaggaggagcttgagagcgagcgagtgcggcaagggtagggcataggaaacgaagagttagagcgcaagtggcgaaggcaaggggaagagtggcgagaggaaggaaacgaatcccttcctcggcgtctttatttccttgccaacgctatgcccggctcctcgcttcccgcgcccactacctcgccctctcgtttctcgcgcccacgcctccactaaccccattcgtccgtttgcggcgcacacggcagatgtgcggccgtggcggttgagatggggcagatcgtgcgcgcattaactacgctcgccaaccgagaaaaacgccatcatcacgtctccaggcgaaacgaaccggctcgccccgattcgcgcgctgctcgagtaatgtagcggtcttgaagaggccgctcattattgtcggtcggttttcccttgccgatgcgcgcgatttgcgaccgctgggtttctgcccgcctgtagagaccggccccacctgtcaccgggcctaaggagtggcgtcacgcccgagcgcttccctcgaggggggcgatcgccctggcataacgccgggggctactgtcggtgacatggggccgggggtatcgtgactagaggcttggatagccgcggtcacccacgtggcctgaccccctcgggggggggtcgggcccgagggtgacacggccacccctccctccgtctccccgaggggt

SEQ ID NO: 57836 - DNA, 73777 bp, Oryza sativa
cgacaataccatagtcgagttggtccgactagatcacccggaacttggctcctgtaggctccgacttcgtaggctgtgatcgttgtgttggcggtgagattcgatgccttaggtcctcccggggggtctgtcggtgacatgggaccgggagtatcatgactagaggcttgaggcagacacaatcgcccacgtggcctggcaccctcgggggacgtcgggcccgagggtgatgtgtggcccacctcttggtctccccgagggggggggtcggaccactcctgcctcgcccccgagggccgaggcgccccgacccctcgcgtttctactccacgtgtatgagttaggtgagcacagcggggctcacctaaccgcatttattgcgcctcggctaagcgtgtcacgccacacgaagtgcagtgcagtgcactcgattatccggtctgtgaccagtcacagaccggtcaaatcgcgggttaggtggcgacaggcggtctgacgcacacttcgctccatcccgtcaagacgagagcttctaggcactcgtccccggctggagctagcgtgttacatcccagagatgacacgttaaccccgatcgatatatgccaggcttcatcccaaccattacaagcaagatgttatttgaagaagggcaaacatgcacgttgctaaaccgacgcgtggtggacaagaatgaccgatttgtgaccggtctgtcactgctcatgtcgtcagcacacagccaccttcccacgacgtgctcgcctcaggcagaagtggaggtaggtgtgtgctgtcccgtcaggaggatgttcggaggacgaccgtgcaaatctccgtccatttatggagagaagaaaagtccagtttggaaagggaggggtgcatgtggtatccccttaaaatataaaaggaggaccttgcccagaaaaaagggggggatggctgccagattcagaacctagaacaagggagaggttggctcacactttgtagctccttgatacatagatccaccaaaacacaggagtagggtgttacgcttctcagcggcccgaacctgtatacatcgttcgtgtttcgtgctctttcgatagctggcaatctttccacatacagagagagcttgggatcatcaccctgagcccccggccgaaccggcaaaggggggcccgtgcggtctcccggtgaggagccccgcgctccgtcatctggcgcgccaggtagggggctcagcgtgtgttttctgagctctcgtatttttccgtgtgcgtcaagtttttcttgatcagcctcatggctgagcaagcaaaggcgcccgacctctctcccagtgtgagtggcgacgacggggagccgaacccacgccgtcgagctcgtactccaccgccccctccacgccaaagtcctaagcagggggaggtgctcgaaagggtcgaaagatccgcggcttcaccgatcgcgggcgatggaggagaacggcgagatggggaccgtcgcctcctcgtctacggcgacggcagcacgccccagggcgcgctccaagctgcgggcgcgctcttacgccatccgcctgtcgtccctgacccggagtctccagcccaacgatggctggacgatgtggccaaattggtcatgacggcgcggcagcgcctagatgctggtgggcggtcctccgccaccaaggcctctggtgctgctaccaccggctccgcgtcgtcaagacagagggcacgacgagcggcagccgctgttcgccgttcggctgccactccttcgtcgactccttcgacccgggaagatctgcgtggggagcaggacgcccgcgccagcatcaagcgccggcgcaatgaccgaagtgctgcccacgcaacggagggcgcttcctcgtccagagtgtcacctcgacatggacgtgggaatcagccctccgtgcccccggttggtggtgtcggctgtagagcctttgtggcgagtcttcggaatgtccgttggcccccaaggttccggcccaccatcgccgaaaaatatgatggcagcgtcaaccccgccgagtttctccaggtctacacgaccgggattgaggccgccgggggtgacgacagggtcatggcgaatttctttcccatggccctgaaggggcaagcgcggggttggctaatgaacctgccccccgcgtcggtccactcctgggaggatttgtgccaacagttcaccatgaacttccagggcacatatccgcgcaccggtgaggaagcggacttgcacgctgtacagcgaagggacgacgagtcacttcgatcgtacattcagcggttctgtcaagtccgcaataccataccatgcatccctgcacacgcggtaatctacgcgttcagggggggcgtgcggcacaaccgcatgctcgaaaagatcgcctccaaagagccccagactaccgcagagctttttcagctcgcggaccgagtggctcgcaaggaggaggcctggacttggaacccctccggttccggtgtggcagcttcggccgcccccggatccgccgctcaggcagggcggcgtgacaggaggaggaagaagaggtcagtccgttccgacgacgagggtcatgtcctcgccgtcgagggcgcttcgcgggccacccgaaaggggaggcctgcgagcgacaaaaagaaggaggccagcgttcccagcagggagcgccctaccggcaagtggtgcgccgtccacaacacctccctccatgaccttgcggactgtcgcgcagtcaaaagcttggcagagcggacaaggaagtgggaggaggagaggaggcaggagcgccgggaaggcaagtccccggcggttccttccggccgtcggcgaagtgaggccaagcagaaggcccccgccgaggacatcgatgatggtgatgatgacttaggtttccaagagcctggggccaccattgccactgtcgatggaggagcgtgtgctcacgtttctcgccggagcctcaaggctatgaagcgagagcttctggccgcggcccctactcatgaggcgacgcgccgggcgcggtggtcggaagttgccctcacttttgaccagaccgaccacccgccgtgcgttgcccggggagggcagattgcgatggtggtttctcccaccgtttgcaacgtgaagttggggcgtgtcctcattgatggaggagcagccctcaacgtcctttcccccgcagcctttgatgccatcaaggccccggggatgatgctccggccgtcccagccaatcatcggcgtgacgccggggcacacttagccgctaggtcatatcgacctcccggtcaccttcggtggacccgccaatttccgcacggagcgggtgaacttcgatgtggcggacctcagtctgccctacaacgcggtcctggggaggcccgtgttggtgaagttcatggcggcggtccactacgcctacctccagatgaagatgccgggccccgacggtcccatctctgtccatggcgacctcagagtcgcgctcgcttgtatggagcagcgtgcggaccgcctcgccgtcgtgtccaagcccgagggtggcgacgagaggctgggcacatccgcccccgccgccccgaggcagcggatagccacgtccgatgaggtcccggtcaaggaggttgcactgggcgacggcctgtccaagaccacacggatcggtggtcttttggacggcaaataggaagacgcgctcgtctccttcctgcgggcaaacgctgacgtcttcgcatggagaccggcggatatgcccggggtccccagggaggtgattgagcaccgtctcgccgtacggccgagcgcaaggccggtccggcagaaagtgcggcgccaggccccggaacgtcaagccttcatccgcgaggaggtggcgagacttctggaggccggattcatccgtgaggtcatccatccggagtggctggcgaacccggtggtcgttcccaaggcgaacggcaagcttcggatgtgcatcgactacaccgaccttaacaaggcatgtcctaaggatccttaccccctgcctcgcatagatcagattgtcgactccaccgcggggtgcgaccttttgtgttttctagatgcatactctggttaccatcagattcgcatggctagggaggatgaggaaaaaactgcgttcattacccctgtaggaacctattgttatacttcaatgccttttgggttaaagaatgcaggtcctacttttcaacgcgctactcgaatttctttgggtagccaattaggacgtaatgttgaggcttatgtcgatgacttggttgtaaaaacgcgcaatcaagagactttactctcagatctagcggaaacttttgagaatctccgctccgcccgcataaaactgaaccccgataagtgtgtgtttggtgtacctgtgggcaagcttctcgggttcttgatctctgcccgaggtatcgaggccaaccccgagaagatacgagctataaagcggatgcgccccccagtaaacttagggatgtgcaatgtgtcaccggttgcatggccgccctaagtcggttcatatcgaggctgggagagaaggcgctacccttatttaagctcctcaagcgctctgggccgtttacctggacggaggaagctgaacgtgccctcactcagctgaaggcatacctcagttctcctccggttttagtcgccccggagccaaatgagcccctgctgctctacttagcggcgaccccccaagtagttagtgcagcgttggttgtggagcgcgatgaggacgatcctcattccgcgcaccctcaccctgtgctgacttggcccgggagcgagcagggaggagaggcccccgagccgaacggtggcctaaggcccctgacgaccggagtcagccctctccccgctcgtcagatggtgctgggcgcccccgaccctcaggaaggccccgaggccactgcgggaaggctgcacctatcgccctctgaccccgaggctaactctgtaccgattcgacctgggagcgagcagggagaagaggcccccgagccggacggtggcctaaggcccctgacgaccagagttggccctttgcccgcttgtccgacgacgccaggagcccccgacccccaggacggccccgaggccactgtgggaaggccgcccctgtcatcctccgaccccgaggtcatcggcacagaagacgagtgcgccccgaggggccacttggacgaggagcgccccggggatatggcccttagcgaaggggatcggccccaccgaagggtgcagcggcctgtttactttgttagcgaggccctccgggacgccaagacccgataccctcaggcccagaagatgctttacgctattctgatggcctcgaggaaactgcgccattatttccaggcgcatcgggtcactgtggttacgtcttaccccctcggtcaaatcttgcataatcgagagggtacaggacgggtggtaaaatgggcaatcgagctttctgagttcgatttgcgctttgaaccacgccacgctatcaagagccaggccctcgccgatttcgtggcagagtggaccccagctccagagaccgtttcagtctctgaagccagctcggaccccttgcagctgcctcacgccgtccactgggtgatgcagttcgacggctccctgtctcttcagggcgccggcgcgggggtcacgttgacctctccgaatggtgacgtcctcaaatacttggtccgcctcgactttcgagcgaccaataatatggcagagtacgagggactccttgccggactcagagtggcagctggactggggatccaccgtctcttggtgttaggcgactcccagctagtcgttaaccaagtctgtaaggagtaccggtgctctgacccgcagatggacgcttacgtacgccaagtgcggcgtatggaacgccattttgacgggatagagcttcggcatgtgcccagacgggataacatgattgccgacgaactctcacggctcgcgtcttcgcgagcccagaccccaccgggcgcctttgaagaaaggcttacccagccgtcggcgcgacctgaccccttaggggagacgggtgtgcctgaccggcccccgaggcccgtcggagtccaggcctcgggacccgaagggagcgctccaagctcccttagattgattgcttgcatctccgagatccaagcatacctcacagataagactctacctgaggaccgcgaagggagtgaacgcgtccaacgcatttccaaacgctacgtgctggtagaagggaccctctatcggcgcgcggctaacggaatcctcctgaagtgcattcctcaggaacaaggcgttgagcttcttgccgatatccatgaaggcgagtgcggagcccattccgcctcgcgcaccttggttggcaaggcttttcgtcaaggattctattggccgacagctctcaatgacgcggtcgacctggtccggcgatgcagagcgtgtcagttccacgccaagcaaatccatcagccggcccaggccctgcagatcataccactttcatggccatttgctgtctgggggctcgatatcctgggaccgtttaggcgggccccgggcgggtttgagtacctgtatgtcgcgatcgacaagttcactaagtggcccgaggcttatccggtcatcaagatcgataagcactccgcacttaaattcattaagggcatcacagcccggtttggagtgcctaaccgtatcattacggataacggcacacaattcactagtgaactcttcggcgactactgcgaagacatgggcatcaagctctgcttcgcctcacctgcccaccccagaagcaatggtcaagtggagcgcgccaatgcagaaatcctcaaaggcctcaaaaccaagaccttcaatattctcaagaagcacggcgattcatggatcgaggagttgccagcggtgctctgggcgaaccgaaccacaccaagccgagcaactggggaaacgcctttcttcctcgtctacggcgcagaagcggttctcccatccgagctcaccctgaggtctcctcgggccaccatgtactgcgaggctgatcaagatcagcttcgcagagatgacctcgactacttggaagaacgaaggcggcgtgcggccctccgagccgcacgctaccagcagagcctgcggcgctaccatcagcgccacgtccgggcccaatcactctgcgtcgacgacctcgtcttacgccgcgttcaaacgcgtgctggattgagcaagctctcaccaatgtgggagggtccgtatcgagtgatcggcgtcccccggccgggctccatacggctggccacgggcgacggcacagagttgcctaacccatggaacatcgagcaccttcgtcgcttctacccctgagggggggtcgggtgtcaggtttcgggctcgggccaaccccgcacccccccctcgggtgtgcagggttggccgggggctgccacacatgcacattctcattttctcttatttcagtatttcaataaaagcagtttcaaattcctaagggctgtatctgtgccgttttttcctttttgaagaattttgacttgaaatgaggtcacttgtgctcaaccttgccctcgggggctcggttcggtcagctaaaatcgccaaacggggcccagaaccgagccgtgccccggggcgtggtgaactccgggggggaatcggcaaaaacccacaatcgggtcacccataaccctcggtcaccacgttcccggcctggccagtctcgacatgcggatctccccaggcactagccccgacccgcgcctttcgaggactgggacttgggcacgggcccttaaatcaagctaagacgcaaaaagaggaccacggcacagatcatcctcatctcatccgcatagcaaaataaaattaacacaaagaattttttcatcatttttgattgcagattataagttgatttatacaaaaaacaggcctgaaggccttagaagaaaggaaaagaaagaaattgaagattggcgggggcctgggggctcaatccgatgcgcctgggtcgccggcctcgtcttccacgtcgtctgcaccgctggcatcgccctcctcgtcggagttgggggcgaacgcaagccgaggggccgagccctcgaagctgtggacgatgtggtcggcggcatcccggacttgtgcgcgcgcgctgtcttcagtcccaggtgggaactcgtccagcgccatccacagagagaagttggggtccctggcctgatagctcgccaggacgagctccaccgctccttgggcgaggtccctcgaggatgacttgatggtcttctcgagttcctcggggagctgctggagagccccggccatcttcgagaggcgctgggcaaggcctcccaggttggcggcaggctttattgtctgccctttccagaggcccgcctgccgaccggcgcgatcaagacgggagactgcatcccagagcatgccgggccctatctcgcccgccaaacggagggcctcggcttccccggcggatgagtctagcgcgcgctgcatgtcggcgacggtgtgttcggcatctgcgaggcgggcggctaagtcgctttcgcccgcagccgccccgccgatgcgcgccctcgcgtccagctccttttcccgcgcctcgaggtcggcggcccgctggtccagcgcggccctctcggtgcggacggattccaaattgcggcgcgcctgctccgtcagtgccgcctcacggagggacaggctgtccgccaaccgttgcgcctcggcctcggcctcttcgagagcccgctcccgctcggaaagagcgtcctcgcggaggcggagtgcggactcctcttcggcgcaggcagactcgtgcgccgccagcgttgtctcccgggaggcgacggcggcctcgtggtctgccaggtccttcttcgcgacgcaggcgcgctcttccagcgccatggcgcgcgcctcgagggcctcctcacgccgccggagcgccgcttcggcctccgttgctcgctgctctcgggcggcggcggcatcaaggaccccctgggcggcgtcgagctttttctttagctccgcctcccagttcccgtgttgaaggcggagggtgtcctgcgcctcgttcatcaccgtggtggcgatgagggcagccccccgctcctcctccacctctcgagcgatctccgccagcgccgtcttacgggcctcaagatcagagacgtgccggcggtgtgccttgcggcccgcttccaccatggcctccaccgagtgccgcccttcctcgacacgcgcccatgcggcgtcgagctccgcacgctccgcctgcagggcctccacctgggcatttaacccatccaacaccgcggtgtttgcggcggctaaggcctgcagaaggggctctgcgctcagcggggcgacggaaggcgtggggaagagctgccttgaagaagacgccgcgcggctcggcccgccaatggacgcgccggcctcatcgcgggccacccccggacctgtttggtcctgggcatcgcccgaaggagtgggcccaagcgacgcgcccgcggcatcgtcgcgagccacccccggacctgtttcgtcctgggcatcgcccgaaggggtgggcccaagcgaggcgcccgcggcctcgtcgcgaactgcctcggaagtcgccgtcgcctcagcctggcgaacccaggcggcctcctcccgagcggcttcttcggcttggcgagctcgggcggcctcctcccgagcggtatcctcggcttggcgagcccgggcggcctcctcccgagcggtatcctcagcctggcgagcccgagcggcctcccgggcggcctcttcagcttcccgtaggcggtctgcggcctctcgccggtcagattcccgcctccgtgcctctgcggccgccggatcttcggcctcggactggccggacttgggatggtgggaggaacgcgatgggatatctctgaagcagaaggaaaaaccagaagacaaacaagatgggtaagagaaaacttgcttttgggatagaagaaaagcggttgtaatgagcgtgggacgaacctgcgagggggtcggttaaatgaccactttggaggggaaatcaggtttccccgggatggttctgtctcccccatcttgcgcagccgcttcttcttgcgctccccctcgggctgcgatgttggcgcggccccctccgggcgcctgctgctggcacgcaccgccccgccccctcggggaggagatgggggaggtgttcctcccagcttcctcttcccccgggcgtcggtagggcggttgctccccgagcccccgacgcggggcccagaagcacgaccccctccgggggtagattgatcccccttgcggctcccgcctgcgccgtcgtggcccttaggagcctgctcctctgaggccccgaccgccgccataatggtcaagatggaggcgcggtctggatcgctgcagagggggaggattccgtgggggatgagggacgcctccacggagttgagattcagcacccgttggaccaatatcttgaagtcctcaggagcccaatcccatctgactccctggtgggtccgaatgtagtcttcggacccggtgtactcccaggcgccccgagcgcgccgctggagcggcgcaatccgacgacggaggtagtcgccgtacaccatggcccctgtgagcccctgggatcgcaggcccgcgaggcggtcgaggacggcgtcatagccatcccccaaatctaccggcgcccgccagctggaggcttgcgccgggggctgactcggaagtcggaggcgcgcttcgtcggcgaggggggtgtagaaccagtcgctcttccagtcatcccacttcttgcggaggacgcagggaatgtagcggttcaacaccggcccccgcggcaggaagtagcagccgccaaccaccgacggcggcgacaccgactgcacggtgaagaaccaccggaacagccgaagagatgggcgcaccccaatgaacatctcgcacagatgtgcgaagatggccaatgtcatcactgcgttgggggtaaggtgcgccatctggagatcgtagaactccaggacatccatgaagaaagaagaaaatggcggaaccagcccagccattgcaaaggggagaaagaagacggaccgccccgggtagtctggcgccgggcgtccctcgcccagcatgactatctcacggccggtggcagactccggcatgaagcggcgcggcaacccagcctgcttctcgctcgtgatgcgggaaggcggcagcacgctaccatcaagcagtgcggagccccgtgccatggcgccggacgaagaggagatggagagcgagcgcgtgtggcgaaagaagggtgcagggaagaaggagttagggcgcaagcggcgaaggcaagggaaatgatggcgaaaggaaggaagcaaatcccatcctcagtgcctttatacccttgccaacgctgtgcccggctcctcgtttctcgcgcccattatttcgccccctcgcttctcgcacccacgcttccactaaccccattcgcccgcttgcggcgcgtgaagtggatatgcggttgcggcagtcgagatagatcgtatcgtgcgtgcgttaaatacgctcgccgaccgaagcgacgttaccatatctccaggcgaagcaaatcggctcgcccagatttgtgcgctgctcaggtgatgtggcagtcttaaagagaccgcccattattgacagccaagttaccattaccgatgcgcatggtttgagaccgttgggtttctgcccaaccatggagaccggtcccacctgtcaccaggctttaggagtggcgtcacgcccggccacttcccatgagaagggcgatcgccctggcataacgccgggggctactgtcggtgacatgggaccgggagtatcatgactagaggcttgaggcagacacaatcgcccacgtggcctggcaccctcgggggacgtcgggcccgagggtgatgtgtgcgcccacctcttggtctccccgagggggggggtcggaccactcctgcctcgcccccgagggccgaggcgccccgacccctcgcgtttctactccacgtgtatgagttaggtgagcacagcggggctcacctaaccgcatttattgcgcctcggctaagcgtgtcacgccacacgaagtgcagtgcagtgcactcgattatccggtctgtgaccagtcacagaccggtcaaatcgcgggttaggtggcgacaggcggtctgacgcacacttcgctccatcccgtcaagacgagagcttctaggcactcgtccccggctggagctagcgtgttacatcccagagatgacacgttaacctcgatcgatatatgccaggcttcatcccaaccattacaagcaagatgttgtttgaagaagggcaaacatgcacgttgctaaaccgacgcgtggtggacaagaatgaccgatttgtgaccggtctgtcactgctcatgtcgtcagcacacagccaccttcccacgacgtgctcgcctcaggcagaagtggaggtaggtgtgtgctgtcccgtcaggaggatgttcggaggacgaccgtgcaaatctccgtccatttatggagagaagaaaagtccagtttggaaagggaggggtgcatgtggtatccccttaaaatataaaaggaggaccttgcccagaaaaaagggggggatggctgccagattcagaacctagaacaagggagaggttggctcacactttgtagctccttgatacatagatccaccaaaacacaggagtagggtgttacgcttctcagcggcccgaacctgtatacatcgttcgtgtttcgtgctctttcgatagctagcaatctttccacatacagagagagcttgggatcatcaccctgagcccccggccgaaccggcaaaggggggcccgtgcggtctcccggtgaggagccccgcgctccgtcagggtcccttttataccgcgggtcagttgatctccaagtagaactcggagatatcggaccccacacgatatagtaacgacccagttctgtccgagtaggactccttccatccgtggactccgtttctgttacgtgacggattacaggaaacatctgtatacgcgcaggtataccgtatcggtatacaacatacatccaagggtaaagggtatatcttatccgtaactctgacacatttattactaatatgaagagaaaatgaggaggggaagaaaacaaggaggatgaaggaacactattggtttagttaatgactacaaataaaaagaaaatgatgtaaagtggtctactacaccactctaaagctaaattcttttagggataaatttttgactaaattaacacttatttagggacaaagtgagtactcgataattccttaattatatgccacttgttacctcacttgacttatacatacggatctatgagagggatacaactaaattttttacattttaaatttatccgaatgtaaaacttcaatgaagaaggaaagatcagtaatttaaaaatgcataaaacattgaaaatacataaatacagtaactttaagcctatttctattagaaaatatgttttctctatcattggggaaatagtaaaaacattatatcgattctgttcatccctggaacatggcatataatatctcattatttttagaattattttgaatatttctacaattaatactccctccgtccctaaatatttgatgcctataacttttttaaaaatgtttgaccgttcatcttattaaaaaaatttaagtaattattaatttttttcctatcatttgattcattgttaaatatactactactactcaagtttttttaataatattcacaaaagtttttaaataagacgaacggtcaaacatgtttaaaaaagtcaacggcgtcaaatatttagggacagagggagtattactcaagcataacattacttgaaatgggaaatctatattgaattacaaaccaaacttccttttattactccagttatctatttatatttggtcggacacctcaactttgttgacactgtttctttggcaattatttggttcattatcatagttattatggctagccacaagttttactcatagctaggaccctatatatcaaaggtttgttgtagtgttggctgagttgcggctagcaaaatgcatttttgaaaaatgacagggtagcaaaatgcatttttgaatactagctgcggcaaaacgtaaccttgcccaaggtgtggtttgacaaagtaaccaaacaatatatatgccacggtttgtgatgggtccatgttgtaagattttgctcatttaattaccctttgttcctcgcgtagaaccactagtaacaatccaaatgttgtcatctgaatacgtgataccttccgcatagtaccagctagtatggctttacctccaagaatggaaagttcatttttcgaaaagaagagcgaatggatgtattgtgcacattgtattttattagtgttttaaaatagctgtataaaaatcaaatggaagggttataaaccaaggtaatatgactatgtgttcgcataaaactctctcgtttctaaacttggaaactaaagtggctcaatggagaaactaaaattgaaatactccccctttcagatttaagtcgttttgattcgatcaaagtcaaactatttcaagtttgattaagtttatggaaaaagtggtaatatttttaattcaagataaatatattataaaaatatttcaattgtgttgtaaatattaccatatttatctacaaatttagttaattttgaagtaatttgacattgatcaaagtcaaaacgacttatattctgaaacagagggaatagaaaactatcgtgtcaacaaaattggtttaagcatggtagcttgtaggttgtgctaacaaaattgcaacacgatgtggtgcctacctgcatttatctataagcttgtaagcaaaaagatacaccttttaagatgaaggagattgggcaacaaccattccattacataataatttgtttagatctccaactttgatctcatgatgaatgatatatagtaatataatcatgtagtccgtgaaatctatatactcctataaaaatgtctccggcatgagatggaaggaacaacaaacaatgaaacccacaacacatatgatttatgctactcattaactaaattacttgtagcgtgccattcatggaactaggtaaaataaaacaaaatgttggattgaaccaacaaatcatcatctgcgattatgtagctgttggtttgatttcacattgcacctagggcagtcgaagattgtcttagatactcaaacctttaatctcacaataaataatatatggtaatataatcatatcatctgaaaagtctatacaagaatatctctaacatgggatggaaagaacaactaaacaatgcaacccacgcacatgattttaccccacccatattaatggaactaggtaaaagtggacaaaatccttgttcagatcaacaaatcatcaccctctgttcagttacgtagcggttggttcgatttcacattgcatctagcctaaggtaacgtttggaacagagtactcaccatattattcatacgaattatctactttaaatataggaaggaataaattaaatattttgagacataaacctaataaagaggttaaaacaattgatctaaacaatatagtagaagaaattgtttttcttgagaaatactacctccgtcctattttaagtgcagtggtgagttttcatgtccaatgtttgaccgcctatcttatctaaaatatttatatttttttttaaaaaataatcacacctaaagtactattcatattttattatctaataacaataaaaatactaatcatattttttttcaaataagacggacagttaaattaaacatgaactgtgtaaaatgcagtctttttaggacgaaggtagcacttacttctaaaaacgtggagcaaatggttgtcataatatgatgaataaagtggaaagcttttacaagtacggctagtgcaataattcctttgagaaaaatataattgtagggtcaccaagaacaacaggagctagcacaacacatcgcttggtttagctcagtggcagtgtaggccgccccgccggcgaccatgacgcgagaatcaatcgagatcctggtcgacaccacatgccacatgcagcataagcgaatccatcaccaagaaatattccccaaccaaacccaggggaagaaaaaaataaaataaaaaaacgaagtgagattaacttaactagtcaagttttttaatgacagaatcagcccatccaagtttacattctagttttaacacggatgctttcatgtatgattaattatttttttactgataggatgctttcatttatgattaattattcttttactgatagatgagttttactgatagatgaggcagccatacacctgttgctcataggtgcagagagtgcatgtactgtgtttgtttaaaataaaataaaataaaataaaaagcctctttcctgaaaatgtccggtccagatgccactcggccacagggcagccacagaaaatctcgcggggaagacccccactccaccttctcttcctccctcgacacctctccccacgttacgctgcctcctcctcctcctcgcctccctctcgtgggcgtcgtccccctccgccaccgccgccgcccgccgcagcagccgcagaaggggactccacctcctcccggatctgctcgatcgcccccgattctgtagcttctcctctgctcagatccgcccccttgcttttcatccagctcgtggcacccgagatccgctgccgccgccgccgtctctgcggtcctcctcccccctcgccggtggggaaccccgccgccccgaagcgcgttgcaggtaacgatgctgacgtggcatcggctcgcttggtgctctgcttgctcgctcgcggcgcttcgattccggggtagctcgactttttacggcctgatgccggaaagggcgtggcccttgtagctcaatcgtgatttccagattagagcttagtggctatggcttgcttgcttgctgctaggggacgacgagtgtataaccctgagctttgtgctagctcagcttagtagtattggcagagtgaactaaaggcgttagcgattcttgtcatggatggggcgattagcttgatcggagtgctgagtttagaaagaggagtttggagtatagcccgtcgtctaagtaaatgcctcatgtttccttgagcttgggtttgctgaactgaactgaactgaacggaagatccatttaagctaggacggtgtgatcgatcgttgagttgatgaacttggtctatggctagctggcttaagcgtggccttccaatcagtttgtattctcgtgattttctttttatgttctctatcagggcaagtaggttctgtagtttctctagtgttacagctgttggtttctctttcttaggtgtatacatgatgctgaatatgactaccttttatttgcagcgtgtactactgccggactgccaaagtacgcttgctgctagccatttcggtagcttttgtggtttctacttaactatcgtgtttggcaatacaacaccttggaccaaaggatgcttgaaagatagactggataattaagactggatgccaaagtacgcttgctgctagccatttcggtagcttttgtggtttctacttaactatcgtgtttggcaatacaacaccttggaccaaaggatgcttgaaagatagactggataattaagaactatattggactgtacattcgcctatagacttagtcatgctgctggttgttctctgtcgctgctacaaggtgttcgtgctattgccttctgcttctgtgtgctatggtaattgtaactctgtggttattgcgcatgatgctctttgaatttgagccatggagcatgcaaggagatttccaacagatcccaaagaatataaattatgtgaggaagttggagatggtgttagtgctacggtgtacaaagctctttgtatcccacttaatattgaagttgccattaaagttcttgaccttgagaagtgcagtaatgacctggtgagtgttttgtcctttgttcattttttgtgccaaatttcattttgtatagcattgccttgttgatctatttcccccaacaaaataatttctttttttacaaaagcaattttttacttgtattatatactttcctaattttaagcaatacaaatttcgaatatttatttgttttgtcgattctcagatgctctttgtgaacatgggttcacttttttcttgctaatcgctttctactgtactgtcctattactgctttatattcttgacatgcatgacattctattatgcatgaaacaagaagagaaacattgatgccaacaaaaataaatagatgtagctcatttccaaggatgtctatctcaacagaaggctcagtttgttcttgcagaatatttatgacatattgacatgattcgatcatttgagcagaacataccttgtatttgttaggggccattgtagtactattctaagttgtcactgtaacactttactacatgagagttaaacctttttaattgtaagttagttggatcagtgtttgtttagattctttctttttttaggttgcattattatggactcccctctttataagaagaggttgtgtgtcatttggattaagtaatggaaatgcgttagtttagtcttttcaacctgcacctgacattgcctggtgaaggttgtctgtcattcattaagtaatgaaaatgaattagtttagtcttttcaacctgcacccggcattgcctggttaccctctgtgtggtatttaccctgatgaaccaatattcaacacattttattttaaacatcaaatttttgagtgagtttctactgtcccaagtagaatggaagcacacatatgatacaaatttgtcaaaatatttacaagttaagcataacataatatccatgttttactttattggtgaaatgtggtagtgatttttatcagagcttgcgcatgctttctcattgtacgcaccttatgctgaaagtagattaataataaatccttgaagagtattcatgaagagtcctgttgaaaccaacaagtgttatagagtatggattatggaatacagttattagacagacatggtactgccaaatgaatagaatacgaacaaataattcgaattatactaattttgtgtttatcccaatatatgtttatatttgataattgatgcggttagagtattaaagatatcagatatctgcacacgttgtattgtcatattatgagacttacttgtaatactctcccgttatgatgtagaatccaatgaatgggatgggatagaaattcttatctgttctagagatgcaaggtagacaaagtagctggttttgccatctaattgggccgctagttatcgggctgattcaggatcgctcagtgggtttctgggcttagttggggattaccagtttaatcaagcaattgcatggaattggtcggttaatcaggtgaggtggctgttttggcattcacacaagctaattcctttccaattcgctggtttgtgatgttctcctctgcgactctgcgtacttataagcgtcaaagtaagcagccattctggccgatttttacgacattggttgagactaggcttcctacaatttggtcattctttccagaacaactatttttctaccttcagtgatatggtttgagtgctggatatcaggatatgttattcctgcaaatggcatcgttcaaataacttatcttaaaaaagtttgacttgtgatctttaagtgaactaacttttgtaacaatctaaacttccttacttgggacatggcttttcgtgttaagataaaaaaaattgtcctttgaaatatagatggaaatgttataagctactgagaaagtaacatttctttttgtgccacaagtgcatagtatcacctccttcagttcattgcttttcctgtcactaaacatactaacttcaaatcagctgcttacattttggtgagcttgtgtttctatccttacggaattgccattctttaggatgggataagacgagaagtacaaaccatgagcttgattgatcatccaaatcttcttcgagcatattgctcgtttacaaatggtcatcagctttgggttattatgccttacatggccgctggatctgctctgcacattatgaaaacttcttttccagatgggtttgaggagccagtcattgcaactcttttgcgggaggttcttaaagctcttgtctacctacactcccaagggcatattcacagagatgtaaaggtaatattgaatctccaccattctattagagtggaagcataatatgtagcagcacagaatttgcataatgcgttgcactggactcaatatgaaattcaatcacatttcacctgtccatgttttagacttagagacattgggatgacacatgattaatggagagacatgaggcatcacatttttgttgctcctgtgttatattgagggtacagctaattgacagccagtgtgatttaaggcttgggaacaatcactgactcgcatatgcctcaccttgggatggttatgcacccagaagtttagtgccacatctgaatcttagatgggctttattctcaaaaaagaatgaaaatacctataatggtccaatattatagtaattattctaaacaaagtcccccacagagtactgttcatcttaatattatgtcttaacaatttgtactaggctactagcagaagattgggcatggattctatgtgaactaaaagccattagtggatatttagatgtcactagtttattataacctagatgtttaaacttgtttaattacttttatcatatgcatgcataccttctgattgtttcacatgactaatcatttcaggctggaaatatcctaatagatacaaatggagctgtcaagctaggagactttggagtgtcagcctgcatgtttgatactgggaataggcaaagagcacgaaacacttttgtagggaccccttgctggtgaatattctgctgatactccctccattcacttttacaaaatatgaattaactttgtgtggtccttttaattgaactttgaccatgattgttccagtatgtagttattgatacaaagtcatgaccatttgagatcacattgaaatacaaatctagtggaacaacttttatttcactaccctacaggctacatatgttagccaaattgttgaccaaaaacttaagaagtttgaagtttgaatgccagtcgttgcattattatattttatgtaaacatatttatgttaagattgtgtaaccccatactttttgcaggatggctccagaagttatgcaacaactgcatggttatgattacaagtaagttcataactggcaatctaaatctgatttgttaagctaccacaactgattaagttttccttttgtcatcatgttcaaaacatagagctgacatttggtcctttggtataacggcattggaactagcacatggtcatgctccattttcaaagtaccctccaatgaaggttagcactgaagtatagtttgttttcttattcttaataaatttccatgaggttagataacgatagcggtacatttatcacattgtaggtattgcttatgaccttgcaaaatgcaccaccaggtctagactatgagagggacaagcgattttcaaaggtttgttgtattcaccatgttccttttgtcgacgacttagactgtatattaatcataactgttcttttttgtagtctttcaaggatttggttgcaacttgcttagtcaaggatccacgcaagcgtccatcttcagaaaagctcttgaagcattctttttttaagcatgcacgtacagctgaatttcttgcacgaagtattcttgacggcctccccccgctgggtgaacgctttaggacattgaaggtgcaaatcactatttatgagatggcattcaatttgatttgacttgtctaatctttattatactcaattgcagggaaaagaggctgacttgcttcttagtaataagcttggttcagagagcaaggagcaactatcacaggttagatgctgctcttttgttctaagaaataatattgtcagaatactactctctctgtgactctgtcctaaaatgacttgatttctagccattccatggagtagtcagtgaaattttctagagatctcatgtcattggagttaacatgtgatgagagatctaggttttgcctatgttgaagcaaagactagagatagatatatatgttaaagttgttgatctgttcatccacatttcttgatttaatgatatcattaaacaaatagttttgctagcttgtttttcatcatttcctttctacatgtgctagattgagttgagttttattggatttattaactaaatggtgactgcatttctacaactgtggcaaatatatatatttttaaataataataagaactatagttagctaatagcaagctcatattttgaccataagtaagctcatatctcacatttatatattttactgtgtatttatatattttactgtgttgtatagaaatgacttattgtagtcatgaattgcacggtgcatatagattcaagtattattgaccaataggctattactgacttttgcttttcagaaagagtacatacgaggaatcagtggttggaacttcaatctggaggacttgaaaaatgcagccgcccttgtaagaattcgattcgaagtgctaaatctttactactgaaattttgaagtcatgagctataattaagccgtaacttttgtttgcagtgaaccttttctaatcttgaaattttgttcttccgcagatagacaatacaaacggaacgtgccatttagatggtgttaacagcaaattcaaggatggtttacaagaagctaatgaaccagaaaatatttaccagggacgggctaaccttgttgcttctgcaaggcctgaggtaccgaggtcccatcgtcttatttatgcaactaagaccccatgaactagctggaaacaacaaatctattgcattatagctttactctaaattttacaggatgagatacaagaggtcgaagatctggatggtgctctcgcctcttctttccccagccgcccccttgaggcactaaagttagtagtaaatccatgtcttttgcaacattttccaatcatgtttgaagaacctttgatattgtggaatgatgtggtttatagcttattgtttaaataatctacttgtcatgtttgaattgtcagaaccctgaacaataatttccttgctttttgaaccttcatttacattagatttatcaatatttcgcagtcaatctgagagtttggtaacttaaccccaatcaggtgatatggtaacaatggagccatgtttcaataggaaaaagaaaatcttaattgctaaatatattggtgtgaagtatcttaattgcaccacatttgtaataatgaatttgttgtgtactccttccgtcccataaaaaaccaacctagtaccggatgtgatacatcctattactatgaatctggacatacatctgtccatattcgtagaaatagaatgtgtcacatctgctcctagatttgttttttatgggacggagggagtagcttgcaaataaattagtacttgtagtgtgtgaatcctactgctccattctgaagtagtataattttgaactggagtggccaccttaaattgttttggttcgctgtattgatgtgctgtcaattttgcattttttgttctcttcgatataaaaaaattgtgagctgtgaagaatctttactgactacagtgacacagatcttgctttgatgtttgtggggatgatgatccccctactgctactgatttgagggagcaaccaaatatggaatctacatcacctatgcagcagttccaacaaattgagaatcataaaagtgccaactgtaatggtgaaagtttggaaagaagtgcctctgtaccatcaaatttggtcaatagtgggtcccacaagttcttaagtggttccctgatacctgaacatgttctttctccttacaggaatgttggcaatgacccagcaaggtgaattaatttcctttgttttctttatttattgttgaacagataacttatgattgtgttttcatctcaagtctgaagtatgtgcttaacttagtttaagttcgataatccccccaccccactcctacaaagagaacatataaacatgccttaaagtgaacagatttttttttgaatcaagtcattgctagttaccaaccaagcacaatgaccactctatttcgttgatgcaaactcttagatgatgcaaccatttgcagtggcatacagcaggctctgctgcagcacctagctgagcgctgagcttgcctagctcatgagtcatctcattcctctgtcaatgtgctcacttgatccgctgccacaggaggacaagttccactgcatcacatgctttcttttttccaaatcaggtcatcacgtgaactagtcagctgaccagcttacagttttgttggtggttagcaaacttgattatccaagtgattatttgcattaagctttgttcagttcaaaaatatattttaaaatgatttgatagattatttagcgcctagaactgaaacagtgttaaactagctcagtttgtgtggaccagctctctctgtgtgtgtatcaagtgtgtgggtggttgcatgaattcaagggttaattctctgtgttctgcagttgacagtctagtatttttttctttgattccttgataaatcaatgtttatagaaaacaagatggaccaagctgtggttctttttatttaagattaaacgagttgtcaggtacagtttcaaaagcttgtgcctagtgcctatgatactgtgctcaccttgtgccacaactttgtccctgtcattctgcctggtttgcattgcgatccttcatcatgctacacatggccaaactaggtcttgtcgagattggggatggtaatcctgctaggcggaaacgaaaaggatcagttctatacacatggattttacttcgcccatatgagaactgtagtgttcacttcaaattttgaaatacctgcatgaaaaatgtgggatcttagcatgcatttttttttatgctagtgaagtcaaactattgaaattggtcattattgtgagaagatttatattgtattgtgcattttagatagctatgcgacaatctcaattcaatttgtataggcaaagtactctttgccctgtaaaatcatgtttatgatatgctgaataggctaaaaaaactactatgggaatttagattggacctagaaaacatgatagaaccaaaaaaaaaaaagaaagaatgaagcatggatttacatgtacatatttgacaaaagtaacacttgtaaaaaaaacctttggttctttttcgtggcctcctactgtagtcttaatatttcactctcattttgcttcttatcatatcgtactaacatatcccatattgtctaatattctagtcggtgtaacacatgctattttttttttgcttcttttctgatttaggaatgagtgtcatcagaaaaatacatgcaacaggaaccgcagtgggcctttattccgccaaatgaaagatccacgcgcacatctgcctggtaagataatcatgaactctatcaactaacacgttacagtttttctttttttagaatagcaagaaaaagctttaaacctgtctcttttatttgtcattgatgtaatttggcttgttatgactgtttttgagagcagttgaacctgaggagcaatccgaaggaaaagttatccagcgaagggggcgttttcaggttacatcagatagtattgctcaaaaggtactggtttgttaattgagcagtcacatgaaactaacatggagggacgtcatatgcattgactattttgatcaatactccctccgtcccataaaaaacctagtaccaaatgtgacatcctagtactacgaatctgacacatcctagtactatgaatatggacatacgtgtcacattcggtactaggttcgttttttataggacggagggagtattaattaagcacagtatgttgcagttcaggactttgatttttaattatttatatttatgctaagcatgcctttaactgctacaatttatattatgtcaaaacatattcgaatatcatttaattgatacctgtagtgattggcaatgtttaagacttttgaagtggagggcaagaggacacaaatattttcttgaaacttttgtttgtttcatgattttcagctgctatatagcaatggctgctgaaatattatttgatcagtttgctagttgacttgcaaagagacaagcatgttttgcctgctctctgactgcaaaagaaaagatgcagaaatgggattctgttttctgattcatgttatttattgctgttccttcaaatttatttctcacagtccctgcatggtaatcctcaaaaggatttatcaccaatgctattctgatatcaatatttttgtcaggcttaattagtaaagtgcaaatatttttttcacattagtttgacaattacaaatgtcttaggtagcttcatccgcaagcagcagtaggtgctcaaatttaccaatcggagtaacacgatcaactgtccatccatcgacaattcttccaacactacaattcatgatacagcaaaatactatgcaaaaggtattcacacacttgttatttcacttggcaagaattgttcagaattttcacaattcttcgttttgacaggaagtgataagtagactgatttcttcaattgaggaaatatctggtatgtatgataaaattacttttgttagactttaaagagataatttcattagtatactgatgttatggttttaatggggcatgtttctgacagatgctgctgatgcaagtacaactggttcatctcaggtgtgtatcacgaactgtgggttatactgtcatttggtcttcaggtgtaaactttagatagttaagcagctcagagataaccatgccgtgtggtagtaatttcaattttaggttcattttaatgttgcacaaacatgaggtttcctcctatgtgtttattcagagttagtataataagtgcggatatatgtgcagccatctggagtgcatttcagagagaaggaactgcagtcgtacatcgccaacttgcagcaaaggtataaaatatttcttgtaggagtaactttttgcatatttatgaatacttgactgaagtttatgaaatatttccagtgtcaccgaacttgctgaggaagttcagagattaaagctcaaaaacactcaggtaaatctatttttaaacttcaatttagatttggaatcatgaacaccgtgttattttgtctaaatattggatgtattctctacattacagctcgaggagcagatcaatgcattgcccaaaaaagatgaaaggttacgaagagaggatacccgacaacaatgatatgcacaatgcacttgtaacccccgctgtaaaatcagttccccaattttgaatttggttagcaaaattatttgtattttgttcgaagtcaggcctggtgtatctttgtaatttgtaattattttagcaaggtgaaattatagttattttcatttgtacaggatatttcaatctataccaaagttaaaagcttggtactagaaaataccaaatcatctttcctaagggcccccttgatttgttggaaaaatgtaggaattttggaggatttcaatcctatggggaaaaaaatatcctatgaaggtctttgaaacaaatgattgaattctatccaattctttaaaaatcctatggaatgggtaatcatatgtatatttggaaagttagtaagaggtttaactttttggaaaattttctctgggtctatctctctcatctgattcccgtgtttttcctgtggtccaatcaaacggttattcctgtgttattcctgtgtttttttttttgtgtttcacaatcctctattttataattgtattccttttagaattatgtgatttttctattcctctgttttttcatccttactattcaaatgggtcttaaaccagtagcagagtgcatatatataatggtcaaagaacgaacatacaagtattgcaatcaaaatcagtcatggcaaaagaagtatatctctaccatcttaaatgcagagttctccactcgtgcaatgtgtatgcatgaaaaagtaaccatcatctctctaattatatcagcttggcctattaacatgcgagcttttagtctacccctaatatctactattataaaaattaaaatatttttaccagtactttggtagatttgtatttgagtcgggttttaaagttcgttcgcttttgaaaatacagaaggagtcgtataagaaatcatttttaaaaaactagcaagcaaactcctaattaccgctcatgattttttagaataatatatatccaagcgaattcctacagtgaatttcaacttaactaaactgtgtaacaataacaagattaaaatattaaaataactttcacccgttgcaacgcacgagtattttcctagttatatcaatatgcgtctgatccattacaatgtgcgggcatataactagcaaaagtaaaaaaaaaaaaggattgtttgcaattgtggaggtagaactagttcagtaattcaatacgcttgctagcaaagcttgctttgtttttgatagttgcggcatgtcatgtcctgtcgtgattttttttacagggagtaactatatttacggcgtcatattttttataaaaaaaatagtcgacatgtatttacattataagtccataaattacatatgtgattttagtgcatctacaatgcaagtcctaaaattacatatgcaagtcctaaaattacatactaattatataactaagtgggggtgtaactatggtgtaaatttatataaatatataatggcttgtagttgttgcgcaacagtacgtgcgaaagctactcacacgaagcagcactaatcttggaaaaaatctgaccgaacaagaactgactgtaatgaggcagaaaaagtggcgagacaattctagcaaagccgttttgttatacaacatttactggtcgagtactacctttactcttttagcattaatatttaatatattcttaagtattgcaaaagaaaagtattgaacttgtataattaagtgaaagtatgcttcggttacatgagtataattaagtgaaagtatgtgaaatgtataatatgtggccttaaatttgaaaattcatagagacaactggtgtattttaccatgaatagtacttctctcttttttttttcggggatatgaatcgtacttgtcaaagagaaaattcaagccacagtactattaatgagattgaagaacactattaataggaaacccattagaaagctagcataatatatcctgatagtaccggacaataccttgtgctaactcgtgatgcttcactgagaagtttggtactggtcgagtactacctttactcttttagcattaatatttaatatattcttaagtattgcaaaagaaaagtattgaacttgtataattaagtgaaagtatgcttcggttacatgagtataattaagtaaaagtatgtgaaatatacaatatatgaccttaaatttggaaattcatagagacaactggtgtattttaccatgaatggtacttctctttttttttcggggacatgaatcgtacttatcaaagagaaaattcaagccatagtattattaatgagattgaagaacactattaatagggaacccattagaaagctagcataatatatcctgatagtaccgaacaataccttgtgctaactagtgatgcttcactgagaagtttggtagattcagaatttctatttcgtgaaattaatatattggttagcatggaggaaatcgttaatgatgccattgtggcctttcaaggtgagctagctaagagcgctgatgaaaatggcaatgatgctgacggaaagggcagctggcgtgtggccaaaatgaaacatgtagcttgctgctacattgatggggcaatatggattttttcctatgtatgtatctctatgatggtgtttgaatctcccgaagatgaagatgaagattaagtgtttcacgtaaaatgaggtggtaataacatgtgattaattaagttttaattattacaaacttgaaaaatggattaatctgatattttagaacaactttcatataaaaagttttcacacgaaacacaccgtttagcagtttgaaaagcgtgacactttaatccagaattttagcagtttgaaagattcgaacggggccatgtatgcaactatcatctgtaggactatggacctgttggctgtgtgctaaaccatatgtggacacgttgatccatggtatgaccttgtcatttgtgtgcgctaaatatattataggtgaactttatgtatgtatgcacctgttaatctattatatgtgcaccttcatgatatatgaaccataaatgttatgttttgtattttgtcggtgtgtcatatttgtcttgttttttttgtcagtttttgaaattttgctacctattaatcaagctaatgtggtatgtacatgagagcaattatgaaatcatattacttaggtcataattatcgaatcatattacttaggtcataattatgaaatcatattatttaggtcatagcaagttttgatgcactatctaccagttttactttggaaaaagctactagacagtttattacgctcatgttgttcatgttgagacgcccaactagacagtttattatgctaggttgagtgagcttctcatatgggtaagtttaactagcatctccgtgcaaactgcgcatagctgatcatctaagtgccttatggccctattgcaggtatgcatcagtaattgagctctctcatttttttcattcataatgatcgatggttaagatgatactatctatgcagagtctgatgatacaactgaaccttagtagtattttcttagcattcagttcttttttaacctagtagtgtttttctcctcatatatgtatgcaatcatatctccatgcacaggatgtttttcaaacatggttcatatgcagcaggacaaactgaagcacaaattaatttaggtgcaattgtaaatttaccactgctttcaatcgttattgcaagactgccactagaaaattgcaaaaataccactagaactgttattcgagtggcatctttgcaaaattgaaaaaaacggtggcaaatttacaaatgccccattaatttagaggcttgctaacccacggtataccgttagaacgatataatcattagtcggacacctcaaccctaatgcacatggcgggcacgcaccagcttgcgtgcatgtgctagtgctggtcgtggatactgtatattttttttggaagcaattcacatacacaaatacactagctaattactactctgcgcatctgccatgcatgacatgacaagtgctcctcactcatgcacccatagattatatgaatgcctatccttttggtcacacataactacaaactcctctataattgcgtgcttagctatatgacatgttattgttattatagctatactcagtggttgggctggtacctcagtatcttatattatgatactattttttacatgtcaaaatatgattatctataatagtacctcgaaagtatcgtaaagtatctatcatgatacatgtgggtagcaaaccaagcacatatcagctggtatatgtgggtctcagttttaacatatacccagtctgataccaaggtatcacgtatgatacctattatctctggtatttgtggtactaagcatgatacatatatgtattatgttgatacctgtaggtaccgggtctgatacttatatgtactagacataatacctaggtatcggtcgtgatacatgtagttaccaagtctgatacttataagtatcgtatattatacccaggtatcagtcgtgatacatgtaagtaccagacatgatagatgtagataccagatctgatacttatatgtactagacatgatacctaggtaccgatcatgatacatgtagttacgaagtctgatacttataagtatcatacatgatatctaggtatcagtcgtgatacatgtagataccagacatgatacttataagtatcatacatgaaacctgggtatcatgtctggtacctcgtgatacatgtaggtaccagacatgatacctagatacgactcatatactcacgtattttaccttgaaacaagaccgtttatcatcaggtcacataggatcacatatagcaatagagaatcaagtcattttctcttgctcatggtcattggcaactttaacttcgatttgatgcaaatagcatcatcaaggcaggagtagtcattttttgatcgtgacaatagtagactagtagtgcatgtactcctcctatactactagtgcatgcaatagtatatggcaggcagtagtatagtacggagtactactagtactgtactagtagtgcatgcgcaaagagttaatccgtggggctcgtgggacccatgcgggaggagagatgggtggttcatttgcgacgctgggttggacggtttgatgccgtgcataatttgtactgtcctaacggtataccgttttatagcttttctcttaatttatatccccacacctcagaatcaggaggtaagtctttcattttcatctatttctgtacatacggtttccctaattaatctgcatcattgaatcacccttctttggcttcatcttcaattacttttagactttattggtttactttcataaattgataaatatctttggagtaatttaatttaatctaaaattaatttacatatatgataaaagtaatatttacaacatacatttttcatcgaaatataatcgtgtaaaatcttgttttaaaaatttaattgtaataaatataacggtgtaattggattaaaaaataatacctagtttaaaagatatactacctcctttttaatatatgacatatttgactttttgtgtccattcgatttattaaaaaaaattaggtaactataatttattttgttgtaagttgttttatcactaaaagtattttaagcatgatttatgttttatacatttgcataaatttttttaaataagacgaatgatgttaaaaatcaacgacgtcatctattaaaaacgtagggagtaagttttttttagctgcgctgatatcctttataactaaacagcatgcatcaccttgtctaatcacgaaccagtcgcgctataagactaatataagtgcgcgcacaataattagattttaccgtaacaattatatatatattaaactcctatgtttggtacagcatcaatacagaaaccgatcgcccccgtcaccgttgtgcgctgaaggaaaaatcagaatcggcgatgtcggccgacgaggatgccatccacctcctgtccggcgggtcgtctagcagctggcgagacgcagccgccgccggcaccgggtatatgtcctcctccggtgccggtggtgaggccaccgtgattgggctcggcgggtcgtccgacctcgccctgtgatcctgcagcaggtgcaccggcgacgcggaccggctcgacgccggcgtcgcgaagtcgacgctcatctgcgccaggaacgcgtccgcgtcccggaccttcttcttctccatcgccttcttcctccagttcatcagcgccttcatcgtttgctcctcgaagattgtcttcttcatgttcgatcccatctgcaagtgatggccaaaacacataccaacacaaagggcatctcatgggttcaatattgtggaaataaagaaaagacattttatggggactggtagtgaaactgaaatttcgaaacaaaaaaaaggttttggactgattttgaacaaattttgcaaaattccaaaaaaaaaccccctccttttcttaatagatgatgctgttaacttttggacacttgtttgaccattatcttattaaaagaattgtacaaatgcaaaatataaattatttaaaaagtacttttagtgataaaacaactcaaatgataattacataaatatttttaataagacaaatggtcaaaacgtgtgtctaaaaattaacagcgtcgtcaattaagaaactgctaatagaatttgtgaatggcttgttcacctgtgtgacgagcgcgtagagcgggaaggtgatgtagctgcatagcacctgaagagagatccccacaatgacttccacgatgctcagccaaatattttcatggaagcatttcttcagaccaggtgttgcctgtcacacacaaaacaaccagatcgatgaacaagctgtgtcattttttgtctcattagtcagtgcatgcatcacacttaatttgcttaagaactgataatggcaacaactaagcaagtagcatacacaccatagtccatacgaaatgcgccatctgaaatgcgttctggtgatcatcgatccgtcgtcccatcgatcagtagccacaaatggatggatgctatgttagttaattaggtgttaattgtgaaagataaagtactatttgtagttgagcagcaaggtttaggttttaaacatgtacatggaagagtgtcaggtgtatgaagaacaagacccagtcagggcggttgaaccagaagtacttgttgcttggttcaaccacaggtgctccctggatcacagtggccctgtcctgtatctcttgggccatctgcatgatcaccatctctagcttggtcccaactaacaagacgatctgagacaacggtggcattcacatgaatgtttgttcattagttatatgatcatattaattttcatgataaattaaagcataattaattatgttaactgtttctttggacagggaaatttcgctcttacgatgagaggaacaaaagagatccaaataagtgtgccaagacctacacgcggggaaaaagttgaaaaaaaatcgatggtgattataagaccaattcagaacaaggttttgagagtaaaaaacagaatgaaataggacaaggattaccgtggatatcgaggaagagtacaaggattccgacgaaccacagagggaggctgcaaaaccagccaaatgtgtcaagatccacatacacatacacaactggagactaaatatgtttctttataaaaaaaatgttgaatataagagtcctataattaataaagcgaggacggacctgatgccaacgacaactttgaagtcgtcctccaaagacctcttgatgtatttgtggaagtcgaacttgctattctgcgacaaatgcgcctgcaaaagagaagaagctaaaaccattactcaatgcacactcgaaaaaaaaacctggtctctgtttgcatcatcaatgttgaattggtcaggtttgattagtatatacattgatgaagccttgccgcatggtcaggtagtccaccttggtgacggacccaaagaactgcctgaagaatgctacctaacaacaaacacggcatgaatattttttttttcaaaaaatatggattgaattggaacagctaggccagttgcaagaataaaaaacaagcatgtattcggagattgataactcacgatccatctgagcccaggggtgcttgagaatgatcccagatgccgcttcacgaacgacgtctgatgcgtgaacctgaatcgtgaaggatctgcatggatcgatcatatttttcagctgatttgctcctcctctttcaagacattatcataaaggttctgaaatgaaatagttagggagattcttaattcactaccgattgcgaactgatactccaatgagttggtctgtgactcccacttcttccatttcttcatctaaaaccaagaaagaccaattattatatatttactggcaaattaataaattgggtttcttgtcgaaacaatccatttgaaggactgacaatcttgctagaactagagaaaacatgtgcatgagggacagaacgacaaactcactttgaggcgccctaaacccatggtgatgacgcagtaggtaacatggaacacggcgagcacgaagatgaaaatgtgcagctggtgcatgctctttgccgacatcagcgccaccttgccctgcagaaaacccaagaaaaatcaattatagttaaattagttattgcatcgaggttgtgcttgccggcagctggtgttattctcacatcgaatttcgagcagtagtccccgccgccggcgccggccaaggaccggcgatcacttgctgcttcttcttcgatggcatcttggcctgccttgcacggcaacaagatgttggcagccgacttggggatgcagatcttggagatgggcgcctgtgccacggtgagaagcagggatatgaagcccagcagcatcagctctgcaagtgcagataggacaagaaatatgagaactgcggtggttttctagtttgtgtgccatctaaataattatttttttaaaaaaataaattaatatatcattttacaaatatatacataaaattcaattcctaagttgaaaaaaaacaaatttaatgtatattaacagttaaacttgtttgttttgtaatttacagaagttaaatttaatcctacatgctcgtgaaatgatctatcacatactaatttgtattgttgttattttttaaaaaaatcataaccatttgaacagcatataatcaacgagggaatataaaaaaaaatcatgtaatgactcctccaccctaccttaaaaaaacaaattaacaaaaataatttttctttctcctttttggcctgattgctcgctcgcttgttaattctctctcaaaaatgagagttcaaaatcataaccatttgagagttaaaaatatttcccataagaacatggtgaatcctgtgcgcaacaatgaaaaatatgtaatgactctgactcggtccattgtgatgaactggtatggtttttctggtcatttatgattaaagaagattgctctgtctcggtcggctgatccagacaaaacaactcggtcgtcctcaaatcgctacatgcatgcaataatttagctattagtttattccttttcctcttccccgctttaaatattttttcttctaaactagttaggaactatacttataagccaaaatttgaattttaagagttgattttgagatttttcatcgaagtttatttttcagcctttgctgctagatcgttaagaacacatacataaaagttttatttacaaattatttttcgtttgcaaatataccgtttggcttattccctgaataagccaaccgatgggcatgttatccaacatacaatctaatcacaccgttatattagatgtaattaaattttacaacaagatatcacattattacattctaattaaaagaatatgtgttttaaaccgttaaaactcaatatttcatacataatagcagtatgtttgaacatatgtcttaagtgtgtttcacaaaattcatataactacttatctctaatctctctccacttcatccatctatacgtgtatgtatctagtaatcttcaaaatgatttttctcttaaactactaatatatatatataatccgatcacaccgttgtattcgttgtaattatatctttacaataatatatcgcatgattatattctgatgaaagaaaaacatatgttttaatctgttaacattagatgttttatacgtaacaatgatacgtttcaacgtgtctaatatgtgtttcacaaaatatttcattgtttgtggctgattttttttaacatatataacctaatatttcaccgatgatcaaccaaaaaaattagtcacccgaattttttttaagtaatcggacatccgactggtagtttcctccatgattaaatacaagtagtccccccttaaaaagcgaaaggaaactataaacggcttatttgtgacgtttgatttggaggacccagtcttgcgtaaaatacttgaaaaaatgacgagggaggcagcaaagtggctagaggggagcagcaatataatattcccttcttccctaaatgtttgatgccattgactgttttaaacatgtttgaccattcgtcttatttaaaaactttggtgaaatatgtaaaactatatgtatacataatagtatatttagcaatgaatcaaatggtagaaaaagaattaataattacttaaattttttgaataagacgaacggtcaaacatatttaaaaaagtcaacggcgtcaaacatttagggatggagggagtaagagctagctgagggtgagctgaggctgagggtgacctgctttgatcttgtcgagggcgtcgcccatggccttcttctgccgcctacggaaccactgcaatgcaagcagtagcgccaccacagggcgatcgatcgaccaggatcggatgttaattgagatgtcacaagaacacaacaacaacaacaaccaaattaactcgagagatgagcacaccgcgtgcgcgcgcgggtacatggctgaggttgtggaggccgtgctccatggcgacggagacgagcacgaggacggcgcagacgacggccaccgcccacgtcggcgtctccggcaactcccgcgatcccgatctcccacctgccatgatccgatagatcccctggtgcgtctcggggtgagctgactgggtgaccgctagcttagctctgatgcacttgacactttgacacctttgacagggggcggccggtttttattaaagagcgggggcgggccggggggcggcgggcggctgtgtcaaagcgcgtgcatcgccggccaatggctcgatcgcggcaggttgggcgacgtggtgagcccgtttctgaccaactcatcccatcctacgtaccggaaatttgtgcattcgtgagtagtgacgatctgccgggtacttaatccttaatgcataacagggtttacgggtcaacataagagggttgataggtcaaccaacttgcaactttttctatgagttacggtccaactaatatgattcgtatggagcaagtttaatgctatctccattcgatcttttttgtatttaggcaaattaaatttgttacaaggcactctaatttcatggttttagccggaagacttcgcaaaaatcaagttttaagggaagacactatcaaaaaaaaatagatatttgccgatgaacatcgcctctcttttttattgtttccatccgattttggagagagaaaattatgaaaaagcgatagggaatacccttggggcactacaccaagtatgtcaagtggcctctttcccaggagcccgagcacatctatcatattagttctagcactcacccaggaattaaatgtaccttcgaccaatcatatgggagcacaaggattggaagggcccacatgacagtccaaaacgactgaaattgacctaatccatagtgcaccgccatatgggccgacttgtcagacatagaagagaggtcctagctagaggttgtttgcttggttcggacaaaacagggttggcacccctaactgtcagcgttcgatcatgtggcgatctcctattggttgacgatggtggttgtgagtgtttaccgacttaactaccgacctacaaccgaccattaagctgctataaaaggatgagctaatttcacttccaaacacacaacaaaatagagtacaactcactttcatacattaggcatcattttagttgtgtggagaaaaagggtagagagtgagaaaggttccggaggagtgctggagttattggcgtgctctcctctcctgtacctcggtgaatacttctttaataaactaagtgttcgagatttccttttcgtacttaattgacttacgtaagtgaggtacattctcatcgtcgtgggtttgtcgcttactattatattaagtactctagtactagcactctccataaagaatgaagtttctacgcgagactagagtagtaattgataacttaggcgtggtgtctagattagtggttacctttgtttgttgtgtgcttcgtagaaaattaggtaggccggctcaacttggcagatcatgggagagccggtgtccaaagcaatcgatagagttttacctcaacttaagtacagttaattaatccatatgaatcctctctagcttaagcctatcatccgttgttgtccttaattgaattctattcttatatatatagtgttggtatttgttaagatcatagataaatccgcaagcgcacagataccgctatagcctttcatctaggagtatcccaagggtacatatttgtttttctgctgggaatgcggcggtatacagagttgggttatatattcataaatcgtaaccatgctataattaatataccaaaaatctaaacatgggttaagataataataaatagtaggctagtgtgacacagaagattcgtctctaataatgatacacttggcagtgaagatggactaaagagatctaaggttcatttgtacttctatattactatccagtttacacttaacaaatacatgcttacaaggctaggacttagttctgcgcaccctggtacaactgagagaccactccctgctagcctgccaacatggtaatgacattttacaaactcttatgtcatacctagaagtggaggaatacaaaggacggatagagttgtcatcacctgccgcctaactcactttccgtggggtatacccgcatccaatggaatttaactaacctaaacaccatgtttatgctaataaataatgtcatgagttagagctagtgcaacccattagtattggaccgttaccatggcatagatcgactagcataatcaagtgaaacagttaaatgaagtacaatttgtttgtagaacacaaaattaataaactaatatatcaactatgaacactaataagtaaataagataattttttaatgcaactatagtcttacaagaagagtaaagtactgaagacataccggaatctccgagaagacaagaggaccaaagattactttaagcctaactacaatatgtggaatgagagaattgctccttgagtgtgtgctttgagagagaagaagtgatttccttttatagttgcttatgacgggaaggccggtaactcgcacaatcgtcatcgggaagcaaccatgaagcgccacgtggagggtggatatgagaggaggtgatggcggtttggccgaaccctgggccccaccccactcaatcgcctttcttcaagagctgacgtgtgaacccctagaatgttgcactgtggtttggccccactttagctttatttgatctgacttgtatgcccattaatccgtgtgctctcacgtgattcgtcggaagtgtgtttcttcgcatgccattgcaatttctccttaatttgtagcatacccctgcatacatagtatttctccaagaacaagtggaactacattatttagtactaatatacgtgtaagaaatgttagttctccctttatttgttctaaggtagttaacggtcaaaaccgatacttaacggccgttaacaacaccctcaagctaaacttttgctcctcctcaagtaaagataaaatttaggttgttgatcaggagttgctaccatgttttatgccacaatagtaccatgcctacaacgtatccttctacctagaaattaaacaaattggcaattgtacttttacctttcttaccttactcccgttggggcttttagcttctcctcatcttgggtaattgagagacagaacgaatcatagagcacaatcacttactctttgtttaactttatttctagaggttttcaagaattttataaataaaaggaaaaagtacgaattaccccccccccccgaactattgcggtcgaccgaattaaccccctgaacccgaaaaccaaacattgcacaccctgaactttcaataccggacgaattaccctcctcaacctaacctagagcagttttgtcctacgtggcttacgcgtggcaatctagttagcatattctttaaaaaaagttggtgggacccacttgtcatatctcctccctacctcttcccaatctctatctctctatctcaaacgcgcggacgcatgtgcgcatggcagcagcgcagcgcggacgggtgggcggcgaacggcggtgcgcaggggcgggcggtggacggcggcggcggccgcgaggcgagggttgaggtaggcgttggcgcgaggagtggggatggcgacggggagagcgggctgggcgcgaccgtcagggtggaggccacggcagcgacgatggagagggacggcgagggggcggagggcacctcggctgcacctccgtcggatgcctgcacgatgcagcacaactgcgcatcatcctcggcatcacccttgccctcgtcctcggcgtcggcagcggcggcgctgggaggagctggtcgagagtggcgtggaggcccaaacttggcggtggtggccgctgccggtgtggctaatgctaggatcgaccgcagtttggttcgtcatcttcaacgtgggggtgtgcgccgtcggcgtgctgttgtcgcgtgcgcgggagtcgctctcgccgcgctgcggcagtggcggcggcggcagagtcacgcgcacggcctcgtcagcgccggagcgcatccactcgtcgttctccatcttctccttcccgtcggtgatcttctatgagttccatcttgacgccggcgagccacaaacgccgatgccgcgcaagtatttgtcggtggaggaatcgcagcccacgacggatctcgcgggaaggaatcgacaagcatgccgccgtttcgagcttcctcggcgactttccctgccagcactgtgaacggccgccgtgcttgtcccccacccttgtctcctgcacggcaatgtcctccgtgacgacgccagtcacccgagctcgccctgcctccaccgccgactgcctgagttctctctgcctccgcctcctccaccggcgcggagctcgcccctcagctgctgctgcggccgctgccttccccccgccgcagcgtcgcaccccgtcttcctcccgagctctgcctccgttatcggccacccaagcgagcgagaaagagagagagcagagggattggggaggggagagagatgataggtggcgccagtagtttttttttaattttctttgctgactggattgccacgttggcgccatgtgtccaagctcaagtcaaaaacagctcaaaacagtgctttggggggggggggttattttagttgggggtgaagaatgtctggttttcgggtttaggggggtaattcggtcgaccatgatagttgggggggggtaattcgtagtttttcctaaataaaataagagttcctccaatgacattctcatatcgcttaatgtgtataattcctcaccaagacattgtgttgcctctttttcatcctacctctaaaaggtttatatgtgaagctcaaggtggggaaaataattaggcaatactcttgcatcacatatattgcaaaatcgaaaagaggatcaaggagaaaacaaatcatacaatctgatcaagatgtgcaaagtgtgtggctatatggtagaaagtggtatgtggtactctttgtcatatattgactatattttattcctactttgagatatgacatttttttctaactatttttttctcatgcagatcaagaacattgatgagcattcacttcttttgcaactactctttttttttccacagtgcttgagaatattttctattctctatcgccttctcgttgtttttatcacagccatctcttttgcatatataaagtgagatatttttggctgatgtaatggagcattttatttgttcgatgagatgttgctaacctccagtgtggaggtaaagcaactatggtgggtgcatggtatgtttttgctaacctctagtgttgaggtcatgcatatattgtgggtacgtgcacgtatgatgattatatgtgtaaagaatctcacaagggtcacaataatttgaaaaagctcaatgcaatagcaagcattatatgtgtaaaggcttttgcgatataatcatcatatggctttggcaggaatttgtcatcattgagaaacttataaattttcattcttttgaaaacttaaatcattcagaagtcaagtatcactccgaagtaagaccatagcaactctatttcaccatctcagatccacacaacaacctagacttagatcatgcatatgcagcccacaagtttcaagttcaaggtaaaattttttgtccaacaaactcagaaacttaggtgaagactaggttgtaaaactaagcattagagggaaataaaacagggcaactattcatcatttcaaccatgagcactagagcagtcttaccacgtatggaaagcaaatatttttggtattttttatattttacaaatttttatcttttttaagatgcaattcaaagaaataaaatatacaacttaccttgggcccttccccaagctagcttcttgctcatagtctatgataaggattgaatctctacgagtggaagtaggccatcaagtcagcgtgactttgcttcatggtggcgctgatgtttgccaataggccatcggtatgctactgccatgtgtaggtctcctggacatgctgatccagcgtgttctacatctcattagtccagagatcaagctctcctagcttttgggtgatgtccgcatatcctcggccgaaatcacgataacatggagccaagaaagagcggcgtgcaccaaatggaggggcatcccactggtgctggaggagtggtccacattggaaaaattgtcctagcgattactgggttgttccaattgtcacgcccataaatttagctaaatttccggactattttgtgtataaatcggtcaatatactgcattgtagttgtagcattctcacctatgaattttgtgaaattgggcacatctaatccttacgggtatggaaccgaatcttacatgtttacgatacggcctttcagatgtatgcgatgttgctttagactctcttttccaatgctcacatgaccgatctatggttcggtcttaggtgataatattatattattttcatttgtaatacaatccgaacttcgttctatatttttagttgcattattgtctaagctagtaacacaatccgaatcatcacttggtttagctatacttgttattgcattatcatctaagctaggacgtaaactattgtcatccactcggatttcctgagccagagcttcatgcaacatatgattaacatatgattaacgggcggcggtggtgctcgatcttcgtctctcgacgacggcgacaacgatccaatctggttagtccgattagtttgaatggagatgtggattgatccagttgaaaacctgtgaacataaatttattgttgtaaattgtgatgtaaattgtgttgatttgtggatttgtggatttgttaactgtgatggatttctggatttattaactgtaatggattcgttaaatgtgatggatttaaattgtggatttgtgaattttcggttgacagaggcggacggagcagcgtcgctccgtctttttttagcgcgggttaggattatcactggcggattatacaacatagccgcctttgcaaattcattttcgctagcggctaccttacgaacaccgccaatgaaagtggatccacgctggtagttggcaaatgccagcgaaagtactatattatcactggcctttggtctctagcggtgctgtaggctgcttgtgaaaacctattttggccgtcaggaaaaataattttttagtaatgcaagcagtctattatatgcaaggtgggccaaatctctttaagttatattttttttggaaaaaaaaacactgtaggggaatcccccatagtaaataaatttattaaaagatcaaaagaataaatttacaacaggtttaaccagtttgaaagaaaatttctatcttctacaggtaatcttaaagaaagctctccaagaagaagaaacagatggaatcacaccatcaaagataatttatgcccatttctctgcttccaaatgttccaagccacatagagaattttttcaacaaagtgcgaagacctataagtttgttttgcttgaagcaacatttgctcaaaagcaatagatacatcccagactattccaaattgagcccaactctgagagctgaaagaaaagatgcacgaaggtttctctagttccagaagaacatagaacacaagttaaatcactgttcagagatgcacaatgctttctatctagcatatcttgggcatttaatctgtcaatcagaagcaaccatctaaaaaccttaactttcatagttcacttacttttccggatccaattcagataaccaggagcttgaatattctttaagttatattcaaactagaacatcggtttcaaactagaacattggtttccagcatctctaaacctcttaaaataatcagtaacagattcatcatattcttccttaactgatgttaacttagataatataaagcttggtttcactagtataaaaataatcatgaaatttgcactctagttgagcccaagtgtagatagaatttgcaggcaatgaagtaaaccaagcaaaagcctaggtgtttatatgtgatcatattatccttgccgctaaattttacgaattcaagcaccttgaaatcacgaggatatgggaatatatataaaaaaataaagacaaggccttcgagtagccttatttttttggctcaattatgcaagcttccctaattatggtgcattcatgtgtatcttgagaaacttcaggacttaattgattatgtgttaacgactaaatttgggttttcacaccaacattatcatcttgatctaatggcctaaagtgtgtgagcacaacaggatcttgagagcaaaccccctgctggccataatgcttgtctcgtgccaatccatgtactctatgattttggattgtctcataattattggtgcaaatagcatgtgtatgtggaataattaacatgactaacattattaatgggagatgaataacaatcaaaatcagtactattagacgtggcacaaaaatcttgagaaagctccagggtgccagtctgactagccatggacccggtctgatcggcagtcagtgaagcggtcagaccggccacaggaggcacagtctagctgacaaagggcacggtctggctgacacagagggaacagtctgaccagtgtcatgcgcggtgtgaccgttggctaggttctgtgtgtagtttattcctgtgtaatcggttgtgtaaatacccttgatccatccatgttactataggcatgttgtatgggagcaaaactggaagtagcattagattattgataattgactattttggagccaatctattatattattaaaggaatagaaaaatgagcctctacgttcgctctcatggtctagaaattctcacattaatcggagaaaaagaaaaagcaaagtccatatagaaatacaatttaaaaatagctgaaattcagaattaaaaaataaggaatattaggagaggagattagagtccatatagaaatacaatttagaaatagttgaaattcggaattaaaaaataaggagtatttgaagaggagactagagtctatatagaaatacaattaggaaataactgaaattcagaattaaaaaataagaaatattagaagaggagactagagtccatatagaaatataattaagcaataactgaaattcagaattaaaaataagaaatattagcagtagagtatagagtccataaggaaatacaattaggaaataactgaaattcagaattaaaaataaggaatattagaagtagagtatagagtccatataaaaatacaattaggaaataacagaaattcagaattaaaaataaggaatattagaagtagagtatagagtccatatagaaatgcaattaagaaaaaaaatagaaatttggaattaaaaaataaggaatattagaagtagagtatggagtccatataggaatttaaaactaactaaaatttgaaataaacataataaaattaaaagtagagtttagagtccgtataaaaatataatttagaaataactaaaattataaattaagaaaaacatgggaagaagagttgaaggtcagtataggaatacaaatataggaatacaatttagaagtaactgaaatctgaaattaaaaattaaagaatattgaaagatgagtttagagtccacatagaaatacaattagaaataataaaaaatcagaaataaaaataaaaaatattggaagaagagcatagagtctatatagaaatacaatttacagaaaattcggaattaaaaaatattaaaagacgagtctagagtccatataggaatatatataatttacaaataactaaaatttgatattaaaaataattaataactaacacgtatataaaatataatatgaaaaatcagaaataaaaataaataatattggaagaagagcatagagtctatatagaaatacaatttacaaaaaattcggaatgaacaaaaaaagaaatattaatagacgagtgaatatatataatttacaaataactaaaatttgatattaaaaataattaataactaacacgtatataaaatataatatgaattttacacattagtagttttgtaaagttattgcaaaatttaaaattatgttgtcattttaatatatttgaataatataatgagaaaatatatatgctattatatgagaaaatataatgatgctagccgcgcaatttgcacgggccaccatgctagttttcttaaagaactcatcaagtctagtattaaaagcatcttcaattgtatcacgatttttatcgatataagccctaagagatgcatctacaaaactatcaatagtttttcgaatagcaagagatagatcgggcggatcagaggtatatataaaacctgacataccgaaggagagaaagattagaagaaccaaaatgtaaacgattaactcaccctctgttacctaattcttgaggctcagaatcgccatgcctgagctgctaaacatagcaagagctcgcaaccatgttttagtaaacggttcttctgtttttgacgctatggtcccctattcttaggccacgacagcaaatcttgtttctttccatgcccacctgaccaaaagcagcaatttttcacgcattctcttcctcctcccccctgacaactcatccaacgacattgaccacctctctctgcagttttctctgctgccagccaggtgaatacctcttgggcttgagatattgatttgggtccagatcatcgaggagccattgatagattgcaaaagctagctgtctgggagatggtggtggatgaagggatgtgctgctagcagaaatggtgatcgggagcaaatgtgggttgatgattctcgtaccagaagcattgtttgatacgattttgatcagctggcgggagaggaaacatgtcatcggaatcggatcaagccccctcgccaagctcgccctcgtcgtcgtcgtcgtcgtcgtcaggaaatggttccaacaaggcgcctccgccggaagagtctgataattcgagcagcaatgggtcgtcgtcgtctagcccgacacctccttcgtcgcagagctccgactccgactccggaggaggctcgagttcgccgtcacaaggctcgtcctcgcctagcccgcctccgccgtcggggagctcttccgagtcgcattcgtctccaccgccggcgccgccccagtcttcttcttcttcttcttcttcttcttcgagtggtggaggttccaagtcttcgccggaggcaccgtctccgccatccgagtcatctggaaatggtggcggtggcggcggcggcggccgctcctcgccgccgccaaactggtcgccccctccgcagcagcagcagcagcaccagtccggaggctcaactccatcacctcctccgtctccgtcctctaaccagccaccgccatcgagtggctcgtcagcgtcatcgtcggaaccatctccgcctcgctcatcgccgccgccatcgccgccgcaatcaagtggcggcaataatggccaaccgcctaaaccttccggcgggcagcagcaagctcctccgcagtcacctccgtcggcggcgaaccagtcggtggtgttcattcccgtcccggtggcgtcgaacagccctcccggaatgctgccgccaccgcaggtgatcgacgccacgccctccggcgccatctcgtcgaccaacttccccggaggaagaaacagcacggcgggctcctccaacacttcattgtcacagcagcaacacacaaccgtaagctcgacggcccaggccagcagcagcggccacatagccgccgccatcgccggcgccgcggtcacgggcctcctgtgtgccatagtggccatctacctcatcgtgtcgagccggaggaagaagaagatggatgggctggtctaccactacggtatatatgcaatgcagtgcaactatatatgcaaaagcacaagaaattgtgaactatatatcgcagctaaattaacaacggtgatcggatgatcggatgcagatggcaacaactacttcgtgccatcgtctcagtttggcgggtcaagccgcaaccaccacccaccaccgtcggcgattatgctcaactccggtggggcgtcagcggacggcggcgggtactacaattcggggacattctcgggcggagaggggacagggccggcggggtccaagtcgcggttcagctacgaggagctgacggggatcaccagcaacttctcgcgggacaacgtgatcggcgagggcgggtttgggtgcgtgtacaaggggtggctaagcgacggcaagtgcgtggccgtgaagcagctcaaggccgggagcgggcagggggagcgggagttccaggcggaggtggagatcatcagccgcgtccaccaccgccacctcgtctccctcgtcggctactgcatcgccgcgcaccaccgcatgctcatctacgagttcgttcccaacggcaccctcgaacaccaccttcatggtaagtaattaattaatcaattcataacactagtacacaaactttaataggtttcagttggaaaccggcgccggtttttcagccgacacctatactcccggacataggtgccggtgttttacagccagtgtttgcactctgttcgaagttttgggaatttcagcctgcggcatgacactatttcaccactaatattttgtgaaaaaaatatatttttttgtcatttagaaaaaaaatggttaaaatttattcaaatttcaaaaaaaataaaaaattccggtgccccttgacgtaaatatgcaaaacaaaattagaaaccatgtttgcagcttacaactaattaatgtccttctatgtaggccgtggcatgccagtgatggactggccgacgaggctgcggattgccattggtgcagccaaggggctagcatacctacacgaggactgtaagtttaatgatccacattgacgctcatcgatctatcttatatgctgttacacatcacctagctaacactggaaaaaaggcgttttgttctctccttggcaagataggccacccgcggattatccaccgggacatcaagaccgccaatatcctactggactactcgtgggaagcacaggtacgcatatacagtacatcgatctccccagccagctgccatcttcaattcaaagttccatggtgtttgatgcttccatccatggtggcgcaggtggcagactttgggcttgcgaagctggcgaatgatacgcacactcacgtgtcgacgcgcatcatgggcaccttcgggtacctagcgccagagtacgcctccagcggcaagctcacggaccgctccgacgtcttctcctttggtgtcgtcctactggagctcatcaccggccgcaagccggttgaccagacgcagcccctcggagaggagagcctcgtcgaatgggtatgttttgatcgtcgaggggacgttctaccattaaaatagatataaaaaagtctcaaaaactttcacaacatttatacaatatatatatatataccactccacgaaatcttaattagatctaaacccaactcacacattgagatgtttttccctcaatgtgtaggacaaatttgaacttaatttttggtagagtgatagatgtcattatattttacattgtcaatttctttttaaaatttttataactaattgcatttagtttggaaaaaaggtacacgagagaacatcctctcgagggattagaattattttccgtatctcctcctacccccacccgccaccgcactttcgatttaaaatttgtcttttttgccttatatacaacgccatctcttctttgcaggcacgaccagtgctggcggatgcggtagagacgggtgatctcagtgagctggttgatccacggctagagggcgcatacaaccgcaatgagatgatgacgatggtggaagcagcggccgcatgtgttcgccactccgctcccaaacggccgcggatggtgcaggtgatgcgggtactagatgaggggagcatgacggaccttagcaatgggatcaaggtggggcagagccaagtgttcactggtggcagcgacgctgctgacatccagcaactccgtcgtatcgcattcgcctccgaggagttcaccggagagtttgagcagagaacaaccaactccaactctgagtcgcggccgatgaatcggataccagagtaataacgccttgtatgttttgaagtgcttagcaccggtgcaattacgtgataagggtgacaacaagaggtgagtccatatagaactgaactgaactcaaaaacacatgtaggaaattcagggttttgggtctaattttcggcagtttgtacttatgtacttcaaaacccttttgcacatggaggacattcaatcaagtgataaagatatagggaaatcagtctattaggatccataatggtttgctaagcacataccatcagcatgatgatttcttaagtttggtgacccagtaagccactggtctctcttgcacttcagatcccttctcaatggcctctttccattttactcttgcgaatgtgttgacgacataaaacctaaacaaatgtcctttgtaagcagcctattactgtggattcctctagaattgtagtaacactactattaacctacagggattccataacaagaactaacagtgaagttaatgatgacagaacaggcactaaggtatcaatgtcgattcgtaaccataaccaacagtcctaggaagtgactatcattgctaatttatatatgggataagtccatttgaccccctcaatttttaacttcgtctaaaatatacccttaaagtttaaaaccgggtattttacatccccgaactttcaataccacgcagtttacccccctgggtggtttctatcctagtttctgcaattaatcaatgggaataagactgtcacgtagccggcgagcagctcgtcaccgccggtgatgatcgcgtcatttaattgatcgatcgaaattgcatgctcccatttaattttcgatgcgttttgctgtgcaatcgcataccgctggagttgattgatcgatcgaacagcaagatgacgaagcgcgtcgcgagcagctcgtctctgccggtgatgtatgcttgacggtggaacggtttcgctatggacggtttgcatggatcaggatcggtgatgctccgggcggctgccgccgccggtacaccatgcaaggacagaaactccgtcgctgttggtgcatcgagaaggtccagcgagagcaaccgatgcgtttgcattccacacttcaccggcggctcgtcgagaacctccggccgtggttgttcgcactcgccggcagcgggcggggcggcaaagacgacgaccaccacgggccacagcggcggggccgcggaggcggcatccgcaggggcggcgtccgcaggggcgtggctctcttctttgcgctgtctgcggcattcatcggcatcaacgctcgagctgaccaacccggtggcttctggcttgggaagagagaggagggaagatgatgaatcagtttgacatgtgggatattaattattttctaatatattttgctgacttagattgacacatcagcgccacacattggcgaaaccaccatatttcaggacaagggggggggtgatttgaatggttttaagaattgagggatgtattatatccggttttgaagttaaggggtgtatttcagacaaacgctattgatacttgttaaatcaatgtcttgattaatgtttttatgatgaacaattggcatgcgagttgattacactagtttagatacgatggtggtttattggacagagtggtttttgctttgggtgtgatcgatcagacaggccaggcaaaggtggtcggattgggcaaagtagttttgctctccgaatgagactggttggactagctaggcaatggcggtcaaactaaaggttagacggcggtcggaccagctggctcgatggtctcaccggtagactccagctcggagtttgtttcaattgtctttatggataatcttgattacttcatgttaaaacttcaagctgatctttatacgtaaaatatattgttccgtgctaatgtgagtcaagttgggaaagaactcgtgcttggatatggtttctttgttagttcatgtgtaggtatttcttgaggcctcggtagtattaccaatgatggatcaggactagacttgagagaagttgaggtccagacgatcaaggagatcatgtgtgatactaagagcaatgcacatgaaggtaaagttttcatatggcatataataggaattgtgcgcatatagaaagatgagttgaatttggattggagtcgaagtttaagagaattggagtttggagttctaaagggatctgtgtatctctggtttgaggtgttttctatgtgattaggattccttattataattggattcatggttatcaacaatcaaatttgtgggtataaatagatgaggtgttgagactcaatgtaaggcaacttttgaagagaaaagttagggtttgctttgagctttcgattctagtttgtcagttaagaggagcacattggatgcacttcataaacacatcttgatacaataaagtcgatctatttttaagagcaactttgatctgtgtttttctggatctcggtagttatgctaacattaggtgggccatccatccaacggcacataggtagcctaatttgcgagcagtccaaccagtggtgagcatacagtctgactaggagtgatagggtggtcagaccagcggccaattgctggtcagaccatactccatcaggtcagagatttatttttattgcaaaaaacagattttaatttttagtgttcctaccattcattccctgataggcttagttcttgtgttcgatcctacatactcatatggaattttatagctatattttgtagttttaaaggaaacttggattcttgatttgaagaggacatttgaaggtcacacggtgatagatctcccctagtgttgttatgatctagatctccactagtgttcacagaaaaaatgttatctcttgatgattgactgtatttgggaactatggacatctttagtgaatattgtgcttaaacatctcatggtgattgtgagattgttatagtgtgcacatcttcagtgaaaactgtatttacaccttagtgagaagcttcatatttagtaggcttcttatctccaactgaagatgtatcaattcagtccaagaagcatcattattagctttcccttttttctcttctgtaatttgagtgtcatcttagcaagtatcaatgttgtcttgggacaggagtacaagaataatcattctcacaaatacattatgcatgtcatatgttgaatagtcataaaaaaatcttagtatatgaagcatgtcataaaaaaatcagctcaaccaatgcgacaccaattatatgatagtctaatgcaacttttatattgatatcaatgttaataaagtccaacatgtacattcttctcgtgaagattatattgtgttcttggtgtttgcatattgattgattccaaccaggcttagattatattgtgttcttggtattctctagtgagatcaaaacttctcgatgtagaaattgtgtatatgaaatttcaaatagatataagaaactttttccactcaaaatgatgaaatttcaaccgaatatttgaaagtttcttctcaaaatcatataactatcatcttaatattgaaagattccgctcaaagactatacattaaaactttcaacatgtggtatagaaactatataaatagaaagtttgtatatgggaacactacataagaactctgtatatcgaaacttaaacatatatgtgggctagaagtggagctggataggctttgttgagccgaggttgtgcaaagtgcatggccaaaagtgaaaagcttgctaagtcacactcgggctcttcaactcaacgtgcagatgtgacccacaatgagtatgcaagctcatatcgattagacctattcttaagtggctactctataaaagtagggctaatatattggattatgaaaataaagcgtgcagtagaatatatctaactacaacctaaaacatagctgaaaaaaatatagtagataattttaaagtacacagcttgttagcccacataagaaccaatacactataaatacatgtataactacggttgtgattaagcgggccgtgaagcccgtaatgatgtggattagggttcccgatcttccgaaatgttctgataatcaacgatttgggtggagtcacgacacaaatcgatccggcttcttgaacacgcacgctcttgagccccgcaatcgcagcaccatgtctcttctagttatcacccgtaccaaaacgcagatgaccttgccgacaaggctaatccctatttgcgaatcaaagaacacaaacaagaataaggtagaatacaaccaaaattgcagatgaatgattaagctcaagagttggggtcttacaaaccgatctagcggcgaaactattctagatagaataatctaagcaaaacccaaaccctaaagatgatggcgggtactgatatatagagtttagggtcatgcaaccaacccttgatgcagccctaatggcctccaacacgatacatggcccaaaggcccaaatacggtgacgcaacaccgggacagattctggacgtcaacttattcggtcgattcccgttgactcgaaaagaatttggacatgggaataaaagcattagaatcttagctttccatccatataaagatcgccccaatccgagcacgtatgcgacctgggcacccgttttagtgtagactggtcctgaactccgagttgcactcgaagtcgatttggtttggacctctaccttgacttggacgtcctcgatgatcctccatgactctaagtccttctccaagtgtctccttgtcccctccattgtttctaatcacaatataatcattaggtagcaatctattctaaaattcgtacaaagaagaacatagaaacgagctcacctctaaattcaattgtcgcgcacgagctcttgttatcggtccttgaatgaccgttggaggattgttgtgtgtatccgaaggagtgatgttcacatcacgtaagcacaccatgttacaccctttgataatttaacccttttcatggcattttagatcctctacagttgcatctagctattgcaaagattgtgttaacagtgaaatttggtaagctccgaagtcatcatcggcctaaagtcagtatcggctttagagtcctggaatcggccgataggaattatcaagttgccaatagtcagattcttgctatattcggttaaggaaattaatctattcaaggaagcttatccagaagagaccaagttcaaggaggatgcagcatggtaagttatctattaattaaaaagactctgttagtttccttttatctttaggaaagtgtgtttagtgtccgataaggactttatgttttccttttatctttaggaatgtttctttcttgtcctacaaagactagtatctacccatgggtataagtatgtacattccgtggtcattgtaaactatctcacagatcaatacaattcggtgcatcaccacctgttaacggccaaatttggtaaatcatacatcggattcaaagttaaaatcgaagcggattttgagagagtttgtttctcagaagcagagtgcgcatcggctactggcagcatcggctattgtctgcatcagctgatactggatcggatagggagaagccgttgtagccgatcccaggaagatggttctagaatcattgatgggatcaattgaggcgctgcacaagcattgccacgtatggattgagtccaaagaaggcaactgtatctattaattaggatatttctagttaatttctttagagatattttcggtaagagtccgcctaagggacttgttcgtattttaagttgtaatagagatagagtcgtgtctggcgaggacatattatgtatttcgggtataaatatgacccaagaccttgtaaacaaacaacatcagttcaataatactttcagcgcatcgccaacctttttctactttcgttgttttcgacgagttcttgcttttgagtggagctgcatcggtttcgatctccggcgaagaggtaaaacttgttatggtggtttgcattctcgggactagtgcttacatcttcatgatactctagtcctgcttatgtgaatcgccgagttatcatatatgttgtataatctagatcggtcccgctgcttaatcttatcagctagcctctatcatcgaaaatagctaacaaggttaaacattaatggctgagttagattatacagtatatctaccatcttgaaaaggctatcatcagttggtttagatcttatgtttccatctgcgcttaatgctgcatcggttaagtctgacctattaagtaatacttagaaccataatatctagctcgccttatgattgccaatagagatagcgtcggagtttcagccaatcttacctggtttagttatcctgctccttttacgtttgcttgatatactaaatctgccctttatattaagatctcacttgtttgagatatactaagcttgccatcagtctgttaggttatctcgatcttagattgatccctgttcagtatgttccatctatatcgatgtctcagtataaagtggtatcggagtactagccgatacaagtcagatctatcttatcggctattctatgaatgtacatgatccttgcttcgaagtatttttggatccaagtggtttatactatctcggcgtgctgtccgatctatcccaatcatttggtttaaacgtatttcgaagtatcgattatgtattattgatatctacagccgatcaggtacatttaaccgtttctgcaatctatctttcgttgcggatctaatgcatgttacattggcttaatactgaacgatacgtcatcggcaatctagccgatcggctgtcgtttgtggatttaactttgtttccttttttggtttcttgttggttgtaggatcaaaccaactggcacgctcagaactcgaaagcaattctttggacctgcactagagtaaagcaaatctctgatgccagtgtgtgtttttcgcatcaacaccaccttttacctttctacttgatttcgacgagtttatgcttgtcatggctgcgtgcaacgttggggctagggcttcgacactaatcttttcaatgtaagcacctatctatcatatatcttagttaatctagtttggtatttgaatttacttgtatcggctgagattcgttttagggtttatgccggtatcggctaaattgctttaccagattagattagctaaggcatccaccactcttagaatcagtcaaaggcttgattggttagactttatgtttctttgcatactttgagttgcatcgatcttagtcgtgcttagaaccataaaaactaacctgtctttaattgtcgataagagtttcatcggggtttcagccgatgagttatctggatgttgtatccgcttacaaggattgcatacaagttggatttagccgatcgcaacaaaggcttcactgtttatctagtcatgtggattttatggtatcggccttctagccgatgtacgcattaaacttcgaatcagtgcttattctacacatcattattagccgattggtttctactggattatattgttattttattacatcatcatcatcaatcgattgtctttctatcattatctatattggacatataaccgatacctcaaaatcccatcgctatcggttggcatcggcatcggcattggttggaattactctatcggcttgtcagccgattgactcgttgatctgctatttgtatatcttattagttataggatcaaactgactggcatgcccgcatctcatcaacctttggacctacactagagctaagcagatcttccaggctgttgtgttcgtcgacttagttcgcgccaacgcagacctgacaccatcagccgagcacggatttctcgtcaacagattgtcaataagatacatgcaccgcatgagacacattgtattactgaatctggacaggggaagtgtcttatccagtactaggttactatataatgagatggatggagtactattttgcaccattagatataacactgttcactccattaaagcaacctacactactgtaccttcaatactcctttatagtgttcggaaaaaaagctgtcacccatgggtaagagcatctccaataacctactcaacccaaactctctattttcttatttggcaagttgacaaaaagatttctctctatatttcatatgtactccaatagcctttccatctacactcctcttttttgcggggactttccatctacactctgcattgtgaatctataagagtatgattatatgacccatatgtcagtctctaactcttctttttctcccgttcaccttcctcccaaccactgcttccaatcctcctcctcaagctctccactatccaccggtggcaacagtagtggtgaggggagaagctgacgacggtggcatgcaacaagaggggaagagtccggcggcggtgctggcaacatcacctcggcgatagcggcatcaacaccccagtgagatggagccaaaggtggggatagaggtgcagggaggatgcggaggatgggggtcaacagacggtgggctcacatggtgggaaggtagaggcatgatggctggtgaaggcatgctctcgtgtggtggaggatgcagcggagtggcttgagagggatgagggcgtggagagagaaggtggggtggtgggatacatgttggcaagtggtttcaacattctacatttggttagtcaagttagaatttcagcaagccatttggcttagcatttagcaagtttgtcggaggctccttttcccgcaagtttgccaaatttttgtttggagattgaaatggagagactattggagatactctgtccaatctgaagatcgtttttgacagcttcactctgtctccattgatcgatcccacattacagttgcaccgcatccatgccacgcacacgaaggtggcaccttctcctctcttcggtcctccagccctccacacaggtgtaacactataatatttagcttactctagaacaatattaaaacacataaaactcatcaacatgattaaaacaaagataagtagcttaattatgaaatacaatataattaaattttagagtaaaatgcattgctggtaccacaacttgcaaggtgagtgcaatttagtcacccatcttgtaaattgctcaaataagttactcaatttgtttggggtgcaaatataataaaaatgtgctagcatattatttttgccaaggtggacgatacaatggcagacatgacgatgagttggcgaaagtaatgcagttttgtagaaaaacccttctactatattactctttggcgatgagtttggcgaaagtaatacagatctaattggcctatttagatctgttatgcccgtgtgctaagccatgatcgtaggtttttgttggcatgcacatgggacaggacggcgccagatatagagagtcatggccctaaatcacgtattgaagatgtggggtatcaaacaaacctatgtactcaaacggaaaattgaaacaatataagggctactttgcattttgttccttgcatacaaggtcaacctgtcatgctgacgtggcgtccaccttggcataaataatacacatggcaccttttcatctagatttgcacctcaaaacaagttgagtgacttatttgagaaatttacaaaatatgtgactaaattgcacccactctacaaattgtggtacctgtgacgcattttactctaaattttaatttaaaaaccataataaaagttacacataaatctaaatggttacatgataattttatataaattacatagtaactttcaaaaaattacagtgtaattatattaatgtaatttttattttggctacattagcaacaacatctcttgcctagttggtagagacctaccagtcaatagaaagttccagaatcaactcttatctttccttaccaaaacagttccaaatatgtagactcatgtacatagatttaacctattctttggcctattttaattggaaaagttcatcggtgcatatgcgcctgtggtgtgcactctatgctacttgctcacaaagcctacaggtgctatggttgtgtatgaccacaagtgcagcttcatgtgtatagcatattggcggtcatacatatctttagatttagaaaaaaaaagagagtaatcattccataaaaaatttaaaactttgaactcataatttgaaaaaaatcatccaaatttttaaaaatttaactcattttaaaactttcaactccaaatataaaactttcaactctaaattttaaaactatcaactcaagattttgaaactttcaactcaaaatttgaaactttcaactcatatttaaatatttcaactcattttttttaaaaaaatataccaacttttcaatactcaactcaaagttttaaactttcgatctttgaagtccaaatttaaactttcaactaaattttaaaaacttttagctacatctttttttacgtactaaaaaaatcacactaagtgctataattagaggaaaaaagcgtgtggatgcatgggatgcgtggccgcacgactttatgcagccggcgcacacatacccactaggtgccttcctttttaatatgctaagccaagtattatctaatagttatgggttttagatggtaatgtgtcaaagtccatgggttttttaacaaccgtacataaccctcgtatatatttaggataaaattataaaagttcggtcaatcatattttatcaaatttggggattgtcgaacacatctgttagtaaaataagtcgaatttacacggtaatagagttgaatgatagtaatgcttaattaaccttgattaaccattaatttgtacaacatttaaaactttttattacccatttactgcatacaactacatgctcatttacacggtataattacactatagttatagttatgtcgtagttacacaatgtaagtaggatgtgactatatatatagtgtaattaaggtgtatatacactgatttgtttgtttcccttccttgcttcctatgaatcatccggttaattcactgcattgggtagtgagagtagtaacatccaatagtagcaaaagctcgttgagcttatgcacaaccatacgtatggtttcaatttaatgagttgttctaactagcccgcatcctgccctgatcttgcacaaatctcgaaggatgaaatgactgaaaaatcgactgtaataatgtcaaaaatctatcgatatgattttatctaaaccaccttttagcggttaatttgatctgtgccattgtaaatgtgtttatttatgtcgagacaagatttcggcaatactaaaaggggtggctatcaagctggaaaagtggatgggtttagagacaaggaattttatacaggttcaggccttcttaataagaagtaataccctactcctatccagggattgatccaccgagtatattattgatcgtatgatctgagagaaaaatcgtgccccaagaggcacccagacccttccttatataggggaaggagtccgtattacaaagtacagcccatattcctaacggaataggcagttatagataagatacagtcataaccgactgaaatcccgggtgcttccttaatatacaagtttaaggaatttaacccgaaaccctttaaagatattctatctatacatggtacccctatacccagtcggatataaatgccgtgtggatatgtggtatccataatctccacagtagcccctaagacctttacagtcgacgaaatagtcttttctcgtaatccaaaacgacaaaacgataatccgagtgcttcaacttctcctgccttggtctcccgagtacttaaatcaaagactgtgaagggttgaaaattaaaaatcaggtgcatcgactagatgcacctaattaggtgtagcccccaactatgtgattagttgaataaaaactaaacatatagtcaaggtacattaaacatccatccgagtgatcttataaccgaatcactttagggattatatacttaagctcatgcagcacttgataaaatatccaaccgactgctttagccataatacgcccaaaaaggcataaagagatccgagtgaaaagcactccaaagatctataaatcaacatatatgacaagaatccgagtaaaaaactcttaaaggattcatcaactgttgtataaagaataacaaatgacaagtcaaaatagcctaagctgcgacttatgtcaatatcaaaataagcatataacatgctgagagaatagccatctgaaattaaccatctcaacaaaacccaagtagctttgcaacctaaaaaggtcaacaaaattagtattacacttttctgtcgggcacctttttatttcgcatcgtagtaattccaaagaattatctagctgcatcaaaaaggattttaacggtattgggctatcctgttgtgagcaatttataccaaggcaaaaatatatgcttaaatccctaaggaacacaaccagccacgccaatagtgaagttgggctgaaagcactgtgcaggcctaggcccattagtacctcccgataccctaacaaaaaacactgaacaagcgtcgcttcgtcttcgccgccgagacctccgccactttccccattctgtgctatagtacaagaactgcgccggtgaaaactagggtttgcaaatcctcaccaatccaccttcccaaagcctcgtgtttttgcgaagatctcccgcacaactaccgcatcgattccctctccaatcactaccaccctcacgctagatttcatcatccatcttgcatccatggcggaggagagagaaagctttgagagtcaatgggctccttccgatgtcacggaagaaaacttaacggaaatggtggtgcacgacgtttcggctggcatccagcattcggcgaagcattcccgacccccgacacacgaggtcgttgtattctcccacttcttctatggtggcttttctcttccaacttcgaagttctttagggggattctggaattttatggaatcagcttgcatcatttgaacccaaattccatagttcatattgccaactttatccatgcctgcgaggcttttctgggaattaggccgcattttgctttattccgccgttttttcttcctgaagccccagccaaacaagagcaagccgtgcgttgttgggggagccagtttttagttaaggggcaccctgagccaaaaatatttctccgtgcctttcaaaacatcaaacaagggctggcacgcaaactggttctatgtacagaatcctgaaccagcacttcccaagtactcctgccttctccagtatatcaagacacctagaattcgcttccaatgggagacgaggcttctcaaccacttatcatgttggaacgcatgctaaaactcaaagagcaaggtctacaagggaacaaatcactctgcactttatcaagagccgactggcacctattaaagagagatcccgcactgccttcgagttcgatggcaagaatgaccctaaccgtgaagatccaaagtctcttgagttcaagattatgaaggagaggatgtacaaaatcttctcaaacggtattgtggttagctattcacacctactgctagtggtgccatataatgccttcaaccctcctctaccggtatgtatcaaatatttcggccttccttatgacatccttttgtcttttgtactattggttgaaaacttgaaatatcatgcataggaattttctttgatgaaatctgatcctccaatcgctcaacgccgctcgccccgccgacaagctggtcaggccagtggcgggccaaaaatccagtctgctgctcagccaagcatctcaaagctaactaaccagtcgggctctcggaaaaggaaattagttctgagtgacgacgaaggtgacaatgttgggaaagctagcagcaaagaggtgattggaaaacagctaagataggctatcccgaagaagagaacatctagtcgtccaataccaaaattcagaaaatcgaccaggtatgaatcagcttgccatttctcatgtgttgtcttgacatgcatcatcaatataacacatctcgaatcctcaggataccatcagacattgatccatctggaaaagaccctgagtcgaccgacaaggagactggttctgcgactgccagggaaaccgagccgactgaagaaaaccgctcaaccggcagttagttgttgaccgacaatgtagaagctgggaacaagcccccgactggaaatcagtcggcagaagctgaaattgacgctcaccaagagcccctgactggagaccagccggaggttgaaccacataaagacatcccagagatagaggaacaaacaaacaaccctccctttaacaacaccaatgctggtccagaggtcagtacttttgacaaagtacaagggccagctcgccctcctctaaaggttataacaggtaactgagcctctgaatccatttatattgaaaaagttctcttcaatcgctttatcactcttttcgtaaatgcataggcccaataattggcgacgaagaagaaattcttcggatacggtgggatgacgaaatgcagccgcaaggaattgtaataaataagcagaaagatgacaaagaagtgtctctactcacaaagacacttaatcaagccactcgtcttgtgaatgtacgtcttctgcttatagcttgactcatcctgttggtcagtcctgtgaactgaataaacttgtaatgcagagaattcatattaggaatgaagcaaagactgcaacccttgaaaaactggtcccacatcttggaaccctggaagcaaccagaacccaactccacgaaaccagggagcttgccaggaagactgaacatgatctcagggaccggattgccgagcttcaagattccaatttcgagctaagtggttcatctaaaggtaacccctattcctgaataacttattccaagctatcatccgtgttcgaccaaccgctgggatgtattgcagtacaagctgccaagatcaccgagctagaaaagcgaatcaaagttctggaaaagataagggtgaactaaccaaacaaagggactcagctctgaaagatgttgaaggtaatcgcagttcaagtctcaaaattaatcatgttttcgcttctaggtgttgatataacccttttatgcatatcgcaagattaaatctcaagctcaattcgaagtgttggtcaacaagatcaagaaacttgaaggagctagggacgaagtcaccaatgctgcttgtcggaggtagaactcctccatcagggaaccgtgaggcccccctttgtgagttcggccgagggcagcgggtgagattcgagggcttggtgagcgaagctgtgtgatcttgagggggttcaatcccgcaaagacgatgagacaaaaggggtttatccaagttcgggccgctgagaagcgtaataccctactactgtgtttgggattatgcttgagtgttacaagggttcctaatctccggagagcactctcgctgttcttctcctagagttcaggcctactgagtgtcgtcccttttctcggtgggcaaggtcctccttttatagttcaaggggataccacataggcccaacaacctaacttcctcgagaagtattaccatctttgcattaaatgcatgtcttgttccttaacttggaagccgcatacacgtcgcctcggtcgtggggcctaccacaccatgccgcctgacacggggggcgcccatgtcattcaccatttaatggatgaagacttctgggctcctattacaccgggaaacgggagcctagctttgaccagagcgggaggaccgactccggctgggataagacgatgagaacctctcaccatcattatttgatgggacatgtcaggctgcacgccgcctgacacacgagcagcgcacaggcgcactacccagtcccatcggtcattcgaccggtcacagaccggttgagtacaccgcacgccgcattaaatgcagcatggcgcgaccgctcgggtcgccataaatgcgagtaggtgggcacctgtaggcggacacctaacccaccgtacgtggcgacctagagagggggtcgggggagcccgacccctagtcacaggagggggcggtcgccgcctgacctcgggcccgttcccccctcgggggagggctacatggcattggggggcagcctcctccgtccaatctctgggagagaatggccgccaccctacctcgggcccgacccccctcgggggagggccacattgcgttggggggcagcctcctccaactagtctttgggaaggagtggccaccaccctacctcgggcctcactaccctcggggagggccacgtggaattggggggcagcctcctccgactagtctttgggaaggagtggccgccaccccacctcgggcctcactcccctcgggggagggccatatggaatttgggggcagcctcctccaactagttattgggagggagtggccgccaccccacctttgggggcagcctcctccctctaaacacgatacccccgggcccatatcaccgacagtagcccccggcgttagccctggccaaaacctttcctaggtggtcagggttgatgccaatctgctagtcagttgacatgtgggcccgatcttctgtcctattattctaggagttgggcggtgggagtttagtcacgttcatacgtcgccttaacttcccactttcctcccggtctccgaggcgctgcaggcttgggagtttagcccgtaccttaggccgtgaacttatttcctgtatatactcagcaaatgttgttagattctctcgagcccgcgacctcgtgcggcgtacctcgcttgcccctgctttttgttaacctctgtttgcgttttacttcatctatccaaacgattattttcacatgagggtgaggactgaactttccatagccagcaacctttacccacgatcaagccaggctgggcgccatagccagccggcggggccaaagatagctgctacggaagagccagcacagggggccccgggcgtcgacggcgaccagagctcgacgcagagctaggatagagcttggaattgtagcccccacacctttagcaaagaatcgtttgaatggatgaagcgaatacaaactttttgttaccaagggaggcaagccagcgcgcgacacgtgggtaccgtgggaccgcgagtaagagatgggtgagagataaatataagccataataattttgctgataagcatggacaaagtggatataaacttaaaggaagtattacaaatgctatgctcaaaaagatcatccggccaacgctgagctttcccagagaggtcggctttggtccgggtattgtaatacctcctttgttacctttgtttatccttgtttggatgtcgcaacctttcaaatctttggctcgaagaggacctcccaccatgggtacctaaccattttgggaagcctgcgaccacttagcaaacgaggtgaggtttccacgagcctgtgtccccatgctacacattctgtttgctctttcctttcggtggcctccttccaatatctctcccttctacacggacaactactttcgcacgagtgtgagagccgaaaaactctagagccagcgatccccgtccatagttgagccaggctgggcactgtagccagccggcgggaccaaagctagctgctacggaagagccagcacagggggtcccgggcttcgacggcacccgacgctcaacttaaggctggaatagggctagaaaacttagcccccacacttagcgaggaaacgttcatgtagatgggagagaggttgggatcttaccaccattggagcaaacaaatgcgtaacacgcgagcgtcgcagggtcatgagaaaagaacgggggaaaaataaatatgagacttcaagctgtattaagctgatgaattgaaaaatttaaaatacttgaagcttgaaaggacgattagttgagccaggctaggcaccgtagccagccggcgggaccaaagctagccgctacggaagagccagcacagggggtcccgggcttcgacggcacccgacgctcaacttaaggctggaatagggctagaaaacttagcccccacacttagcgaggaaacgttcatgtagatgggagagaggttgggatcttaccaccaagggagcaaacaaatgcgtaacacgcgagcgtcgcaaggtcatgagaaaagaacgggggaaaaataaatatgagacttcaagctgtattaagctgatgaattgaaaaatttaaaatacttgaagcttgaaaggacgattagttgagccgggctaggcaccgtagccagccggcgggaccaaagctagccgctacggaagagccagcacagggggtcccgggcttcgacggcacccggagctcaactgcaagagtcctcctaggagtagaccgaggcaggtggcaggttcataagcgatccccgcgcttggccctggatggccatggggaagaaattcgccttgacccggtcgtcaccccacgccacctctatgatcgtcgtgtggatctggagggactcggaggggttgacactaccgtggtacctttcggtgaggctgggccgaaactttgggggtcatcggacattccaaagactcgccataaagacctggccaccagccttacccggtgaagatgcagggagactagcccctgcctggggtgcgcggctctcttgaggaggctgcgccttcccccacattggcggtgcgacgcacgtcacgccggcactcgaaagaacctcaaaaattacgaacgcgcccctacctgtcgcgccagatgtcggagaataatctcctccatcggggaaccgtgaggcccccctttgtcagttcagccgggggcagcgggtgagattcgagggcttggtgagcgaagctgtgtgatcttgatagggttcaatcccgcaaagacgatgagacaaaaggggtttatccaggttcgggccgctgagaagcgtaataccctactactgtgtttgggattatggttgagtgttacaagggttcctaaactccggagagcactctcgctcttcttctcctagagttcaggcctactgagtgtcgtcccttttctcggtgggcaaggtcctccttttatagttctaggggataccacataggcccaacaacctaacttcctcgagaagtattaccatctttgcattaaatgcatgtcttgttccttaacttggaagccacatacacgtcgcctcggtcgtcgggcctaccacaccatgccgcctgacacggggggcgcccatgtcattcaccatttaatgggtgaagactcctgggctcctattacaccgggaaacgggagcctagctttgaccagagcgggaggaccgactccggctgggataagacgatgagaacctctcaccatcattatttgatgggacatgtcaggctgcacgccgcctgacacacgagcagcgcacaggcgcactacccagtcccatcggtcattcgaccgatcacagaccggttgagtacaccgcacgccacattaaatgcggcatggcgcgaccgctcgggtcgccataaatgcgagtaggtgggcacctgtaggcggacacctaacccaccgtacgtggtgacttaaagagggggtcgggggagcccgacccctagtcacaggagggggcggtcgccgcctgacctcgggcccgttcccccgtcgggggagggctacatggcattggggggcagcctcctccgttcaatttttgggagagagtggccgccaccctaccttgggcggaccccctttgggggagggccacatggggttggggggcagcctcctccaaatagtttttgggaaggagtggccaccatcccccctcgggcctcactcccctcgggggagggccatgtggaattggggggcaagctggaaaaaattaccatttggtccctttttgcaaatttattttccaaatggacccttgaaa

SEQ ID NO: 57837 - DNA, 89025 bp, Oryza sativa
cagttcaaaattaattgattgatcatgtttaaatggacctcatacaggcataatgtccattgaaaaaagagtgcaacgaggggggaagtaaatataataaataaaaaaagaacagccataaagctgtaaaacagtgattgtgatctactaccgatataaatatttacaaacgaaaagaagaaaattgtaaagttaatctgcaaatccctcccaagtgcacgatttcagcttttctgtggcttgagcacagatgcagaagcagaacaacaagcaatgctgtcaaggtaatcctgtgtcaaatagcagtgagccttatgattcaattccaggcttccagcatgggtttgctttcccattcaatcatatctgaaaggatttttattatcttctttagttccacgaggcaaatccacacccagctgcctcccgaagcccctgtcaaatctccgagggcttccccttctttggggttctggggatctgggagccgaaatacatggacgaagtttatctcctgtatgatttctgaactgctttgtggcaccattcctgtcatatggcttggcagaatgagtttcatatctatcagcatactccctttgatcatcaccattcccatcatgcctatttcccctccccctttcgaagccataaggaagtcttccctgtgttgggcgatacaactctccagaccttggccgtccatgggagtccacatcaaacctgtcatttcttgaggtaactctcaggggtgggctcctccttgaatatcgctttttatgatcaggaagatcaacagttgagcagttcctcccatcagcccatgtagaagcatgttgagagtaagcacgatctcttgatgaagggctataacgcataactcgatcaccaaatccaggttgtctagaaggcgaagtcattcttcccattctaacttcagtcatgtaattaggcggagatctacttctactatgcctccataaacttgaactaccattcaccataacttcccttctgttcctaggtgatgtccaagcatgcggagatcgagaccttgaaccagaaggggatcggctgtgagcacgtgataggttaagtgaggctctatgttgcgggaacctcctttgtctactggccagtgagcaacgagctgagctcatatttacattagcatgatctttatccatatcaggcccatatctaacagatcgattaccactagtactgaagcgtctttctggggatgcttccctagcatgtgcaggacctctagacaccccacaacctccatctctgtcaattggagaaccacgtccagataaagggcggtatgagctactcaaagtgttgtttctcaccctcctagccattttactagcatttgcagtatcaaccgcctttaccaaggtgccatcaggtgcaacaacaaagccattgctctgcatctttgcaacagcagcttctgcagcattccttggaccaggcagtccgtaattataataatcaggtgatttgcgccaggtagtgcgagaattgtttgaattttccacccactgttccacccggctgctaccttgaatatgtcgtgatgctccacctctttcatgtgatttacgaatatcaatggttctttcagcctttgaacctgagccataaccatcatcagatctggatgaaaaaagaaaaggggtcataagattagtaattggggacatgataatggatcatcagtgtcgaattaccagcaagatgacagctaaaaaagttcaccagtaacttacctgcataactcatttatgtgggctctgtcaaatgatcttggccgatcagctcgtggttgcatatctccacttgataactccatatggcgcaatgattcaccacctccagctgtatctgatgtgctcaaaacacaccggttagatgaatcaactgtgtcccttgaatcatgttgagaatgccgctgatcttcaggtaacatatcccatcctgtgggctttgttctcagacttgaaagatcgtcccctaaaccatcattgaccctttcagactggttgactgttgcggaagatccagctattacatggcctggattcatctcatacattcgagtctccccattaactctcaagtgaacactaagagccttttcaccagtgcttccagcacacatcgttccagatccatcatctatgcaggtagttgaccatgaacacttcaatgcggctggtgaaacatcaccacctccattcctggaatgttttccattgaaattagcaactcgatcacctgtattctttgacatggagccaagagggaagggagaaatgcctggggcatcactcttgcaatctaacacctggtaattggcaggtttaacttcttcataacaatcatctccccaatactcgccagattcccttagttccccatcctcatattgagaatcatcctcttcagcaacaatatttccagtcccagcaagatctttaataatatgaggtgcctccgtttcattacagtgctccataaaattattcgatagaaccttcccgaggtagctttgttctgcagattgtgaatcggcaatgctgtccatgtcagtagttgatggttttatgcattctgaattgatagggggagctacacaggcaccatctatacgacatattaatgcattgctactgtcagtacaggtgagattattactaatagttgcatcagcaccctcttcttcatgggcatgggacataccacgatcagaagaacctgggttgtcattcatatgagaatcggagaggtccaaatcatcatctacatctgcagctttcttggagatgctcaattcattggtgacatgttcaactttgtcgtgacctgactgtccaattttactagttccagaatcaacatccaaaagatcctggttcttcaattcagatatgctttgttgagatgtttgcccaagtttatcattgctccagccaagatcagtagaacttttattgaaaacagttactgttgcaaggtttgtgctttcctcagaaactaacctacttgtgaaaggcttcactctggatcccagttcactcatttgaactgaattgatcccatcacagccatctgtagaaaccatctgggacaaacctacacaatcaagggctgaggcatgtgaaacatcaagtttctcctcaattacggtcaaagcaaaacgttcagtcataggaggcaaagagctgcaatcaggatcagaccctagctgtgattttactttggagatatcattgttatcaggcaactcctttgttcctgcagataaaccatcgcattctagcggtctcgattctaatactggtacattttgcggagacaggctgcacaaaggttgagatgaaccgtcaccagcaaaatcactttcgctctttgtagaagcatcttttggtgcatcaatcacaggagttttgtcctctgaaagatcaggaatgttaccagcaattgttgagtcaaaaggagcttgacacacctgcagcttgttcaacacattttcagcatcactacaactgcttatagcaaaagcaacaggatcaggatcagccgcatcaggaacatcatcaccaccacagtcagtgtcccatgcctccattgcaacattaagatcccagtgcaatcttgagtcacgggtgccattggaatgcttagtttccacaactgcatcctgcaagccgcctacagatttgtctggattacttgcgttgattgacatggtaacacctgaagacttcgtgtcagaagcagttgaagaatcatctgctttgtttgcactgctcaatgcagaaaaagacgcggaacagtccttctgagtgtgtgtagattcaacaagattttcacagttcaatctagtggcaaccacaggcttcgtatcaggaacagattcagacgactccagcagcgggtctgatttgcaatttgaagcatccagactatttagcatgtcctccttgatgttatttaggaaattcaattcagaactaccagtgatattttctggtttcctttcaacacagtgggctgacttcgaacattcgacattcaacgtgtcatcatccaactcgctcgtgcaggcagcagccgcaagtattgatatgccagaaaaatcatctacgccaaaatgctcttttgtttcctccatgtaatcaagtctaggtgttttaaccttatgatgctttccatgtgacgagatacctccacaggatctgctcaacagtttttcatatggatccactagcaatggagtgggtggaggtgatggagaacaatccataagaaatcttctcttttttattggaacatttcccacaggatcactaaagcgccgaccaagaatagataccccaaactgcaaagatgtcattaaatagttcataaaattggcattcaagaattgaattgactcttacttcattgtactctaaaggagaaaaataagaaccttctcagactcagaaacaggagcatcatcttgtgccaattcttgattagtagcattgccacatgcatagaaagatctaatttcatcccttattctgtcttctccagagaaagaggtccttgctctccttgcagctctttgccttctgtttacggtcttccatctcacctcaggatctataggccttggaagctccaagcccatggtgttgagcttgctgctacacgacggcccagctctgtctgttgttgattcaccaccacagcctttgcaggtcattgaaacacctgagttattaagattacgaagtgatgatggccttccagtacaggtgcacaatcgaatctgccaagagaaccaaactagtcaaaagatccatatccagtacagtatcagtaaaaaaaagtttaggcggaacatcaacccatagcaaactgaacacaatgataggctttcaacttggttgggaatacaagcagagcatgaacaacataagcataccatgaaaccaggccttcttcctgttgctcccaaagaaacaagagactgtttcacatcaactgcaccctcaggtccaatagatcccttaaaatcctctggaaaacaaaaacaacataaggttccggttgagcaccacaccaccaaagcgtacgatactgcttgaagaataatagcatcacaatccacatagcatgttcgaaagcaataggaaaaaactaaacgacgcttctgcagccatgccgccaccgcgcgccaattatatcagaaaataacttgaacccctcctgtagcaaaatttttaggaaaaactttgaactcccccgctccaaggctacttgagcacatatgggagtggagcaccagaaataatggaaaaccagaaggcttttacttccaggactgaatcccctatggcatcaacacggaacaacagctcagtcaactgccctcttccatcagcatccgcaccaacgagaacatctccttcctagaaaatcgatccccatgaaaaagaagaaaagcaggcagatctggggagctggacgaattcctggcgagcaccgcacgaccacctccatcccagattccacaacacgcagagagagaaccagattggttgattgaccccgagaagtccaaatccttcagacaaggcagatctgacaaccgaacctgttcctccgtaccccaggcgccaacacggcgaaacacacggcgatctccccagcggcgactggcggcggaggccaagcagagactactaagtcagatttcttaagatctagggttgcgtataccttttgctcctccggccttcctcatcaaaccccaagggcaaaatctctccctcctctcttaccacctgcgcgcgcgccgccgccggggctcagctttttcagtagaaatcgcgccgccccatccgctcttccgcttgcccttctcctcctccccttcctcgacggggattccttgcgtgcgctgctctcctgcgcgaagaaggaattcttcccccccccccccccccccaacacggctgtggctgatgctgctcctgctgctgccttttcccttccccctcgccttttgactcccgccctcgccggggcgggacccgatcggtgggcggcgccgcctccccctgccttccgtccgtccggtcgccgcgagccgcgtcgccgctgccgccgccgccgatttttttttttttttttggttttggaccctttccttgtgctacttcgccgcctgcggaggctgggagggggagaagaccaagaccatatttttccgtgatttttagggtgcgctcgatttacttatatataataatactcctatatatatataagtattttttttctcttctctccatggtggtggtggtgggtgtggagctatatagggacgggaatcaaagcctttggtcgatttacgggattgcccctggtgtgcggtgtgttggggatgagagaggtggaggctggttttgcttttactcctagattgttttagctggggtggatctcggccgtcggatcgcatcgggattgaccataatcagcttcagcggtagtctctcctttccaaattaatcatcatatatgttttttttcgaggaatcattatatatgtttattatgcaccaacaccaagataatttaaataacatcaatcaagatatcatacacatattctcccacaatgaatatatcattctattacatgatgattaatttgggaaagagggagtagttttttaaaagaattaaaacaagggtacctttaatggaattgtaaagttttaggccacttctaaaaataagttgtgaatcggtacttatagtatgagaacatgtatgatgatattagacaatagtgtactctttttgttccataaaaacccggatatgacgcattctagtattacgaatttatagaatggagagagcaacagtgcatgattttctcgatatgggctttgtacttagaccatgataggccaatgaatgaagtttgtggcaaataattgggttggactcaggcttttgaatttatgaacccataaaactttgcctaacctaagagataacatatatgcctcattaataggtcaacatcgaagacccaatgatcttaacataggtggtgtttgaatcttctgaagatgaagataaaaattaagtgtttcatgtaaaacgaggtggtaataatgaattaatatgatattttagagcaactttcatatagaattgtttcgcacaaaacacaccgtttagcagtttgaatagtgtgccatgagtatccaaaatttaatccaacttttgttggagaaaagaagagggcctagtttcttcttaataaatctacttgttgcacggtgctacttgttgtgttctttcccattagttcccaactcatatccatcgttttccgcgtgcacgcttttcaaactgctaaacggtacgcattttacaaaaaggttatggatgtgtttagttccacgccataattggaagtttaaataaattagaacgatatgatggaaaagttggaagtttatgtgtgtaggaaagttcggtgtgacggaaaagttggaagtttgaagaaaaaaattagaatctaaacagggcctatataggaaagttgctttaaaaaatcatattaatttatttttcaagttttttatagctaatacttaattaatcatgtgttaatctatcgcaccgatttgcgtgcataggggaggggttcccaacccctccaaaagcactagcccatggcccactgctctcccaccacatcggccatgccccacgactctcccctgtgtggttctacccatcaactaataacccaacataagcctccgttggctgtagctttgtagcttcttgtacccctactattgggaggatgctacgcgtcggacgtccaatttttcgtaaatatcggacgcccaacccctgactgccgcacgcctacgcatgcatgcacaatctctaccgtttctactctagttgattagcacatgtaaaaagtctatatgcttgcgcatgcatgactgcatggttcagcacttatctcaaccccactttttatttctttaaattaaatttccttctaaattaattatccgatttatgattcgatttcaccattaaactccttgcaattaaatcttcacaacaagatctcgcacggttatattttgatgagaaaaatcgaactttgtttcaccacttataaaaaaaatgtttcaccactaggtcaaaatgttccaactcactctaaaaaatgtttcagagaaatgcaacattcaagtaatactaaatgcaacaccgataatatcggtatgaaacattgactctcaatgagtgagacataaaaatcttgctcaaatgtttcaactcagtctataaaaatatttcagagaaatgtaacattcaagaaatactaactgcaacaccgataatcacaattaaatctttacgacaagatctcacatgattatttttataatttaatcataaggtattaacaattgaaacatcatataatatttgctgaaacatgataccgtgtgcaatatttttaattaattaatgaatacttattgaaacactcaatcaacacatatgcaacatttataaataaactagtgaaacataataaactacttactgaaacatacaaatagcaccatgtgatgcattaaagaaagatatatacattgcgacaataattaaatatgtgcaacataatagaatttcagttgaaacatcttattctcacatgtgaaacattaaatttaattggttgagacatatgtgtgttttttattataatatagtcatgtgagatcttgctgtaaaaatttaattgtaacgaatacaatggtgtaaacatatcgtagattggatgagtaatctggaagaaaaatcattttcaagtttgctaaaagggtgttatgtacatgcaaataatcttgtatcctctctcctccatgcatgccaatgctaagtaagggagcatatgtaacaggtgtgaaaagaaagtatctgacaaaaagaatacgaggctgcatgcagcaaaaccacaatgagacgcgtccgatttttttcaggagattagacaaccgggtggaagcattttccctactattggccacatttgcccatggcttcaccattcaccaactttgcatgtggttgtgtcctaattttttatacttgcaatttgatctctgggatttataaaactaagttatgccaagtttttagtgtagacttcaagcttttggtccattgtgcaagccaggttcacatatagaaaatgcaaccaaaaaaaagcatggctaaagccggtctcaatttggttcaaagatcccattttcttatagaacttgcttggaatttgaacatgtcaacctagcacctaacaataagataggtgaatgtatgatttaaggaggtttgaggatttgagggtgtgaaagtctcatgtattactaacagctatatgttttaaccaagaaactatgacaagtatctatcttgaaaacaagaagagctggatatgttttgatcatctagcttttccttgtatcatagcaaccatgaagagaatgtgtagaagtagaagtgatctatactttttgatttcaaaccatgtcatgtcagtgtattggtaaataacataatttaacaatgagcatggttatttaatcctgtagtagcttgttgccaatttcactagttcaaatttgttgtctcgtaaaatctttgacgatatcaaattagttccacaacttcgttcaaaaatctgttccaaaaccaacgctgactttattggctagccatggatgacaggccaactgtttcgcttatttatatactccctccatttcaaaatatttgacaccgttgactttttagcacatatttgaccgttcgtcttattcaaaaatatttgtgaaatatgtaaaactatatgtgtacatgaaagtatatttaacaatgaatcaaatgatataaaaagaataaataattacttaaattttttgaataagacaaatggtcaaacacgtactaaaaagtcaacggtgtcaaacattttgaaacggagggagtacttatttgaatcgctaattagtaaataaaaatatttataagtaaaacttttatatgcgtattcttagtgactcaagaacaagaacaaatgttataaaataaactatgataaaaaatcaaattataaaatttaaaatttcactatataagcctaatcaccatgagcgaaacaagtttgcggaccaagtggaccgtcgaatgaattttaccgaccaaaatgtacccttaagtacggatgtaactgggtcgatctacgaacccacttgtaaacaaaacttagtgggtaacctattaatttggtatatattacctccttttttaatatatgatgccattgactttttgtcacatgtttgaccatctatcttatttaaaaaaattacataattataatttattttgttgtgagttgtttatcactcaaagtattttaagcatgatttatatcttatacatttgcataaaatttttgaataaaacgaatggtcaaatgtttgtttaaaagtcaactacgtcatctattaaaaaacgaaacgaagggagcaagtggattcacgggttgacccacttatatccttaagtacgacaaaccgggccataacgcgggaaccaacgagttacctacttatttaacctgtaagaacaagttttgtaatagaggtgattgtcacataaaatattatccatatcatcgactaatttatagtgggcatctcatacaccacattacctctaatgtactaaccctaatgcaacataactatttattttatccactctcatgcaatcaacctcattcttttctctttcttccttaaagtttgtgatgagattacccttgcatgatggtggctcatcctgttagtgatatgccctaaaggcaatcatagagatgattgtatcacatactatgtttacatattgatccgactttgttccttgaaatggacaactcattattggttaatgaatatgtgattctttcatgagactctttatgttgtttgttactatttctaaaggatccctgatcaaatatcatatatggaacaaatatgtttaaatgatcaacacatgtattaattgatgatcatgtctcatggatcatggtatatgtcagggttatggatattacatacccaatagtaatcgactaagctcggcagggcccaccacataccatgtcttatacggaaacaaacctcgtatatagagggagttccggataaggaaggacaagaagagttatatatggaaatgataaggactactcggattgtatccatatttatctccctagtcttacttggacaagggggcaactatgagtataaatacaagctcccctaggaggagaggggacacacccaccacaatatacaaagccataagccaatacaagccaatacgccgccgtatattgacatcagagattagcctaggcatacaccatccggcacctataggggccggcaagagggatctagcaccatctctgatctcgccgagtacggattcaaggaggaagactaccttgtcgtcgactatgagttaattatttagtcgtcaagtcgacgacggatagatagattatcccagatattatatttgtgtgatccagatgaataaagagcaacaccggcttcggccaacaggatgtagggctattacctgtaagataaggggcccaaacctgtataaaaatccatgtctccatcttttttatctcaatctcgcatataccctggtaccaatgatccccataccatccaaatatcgtagtcgtgatatcaaacgtcgacagtatagagataccaaattaataatgtggacacatgttggggaacatgttattggatagacccaacatgagacacttcaaaagctatatgtgttgtgtcatcagtgatctcatttagtgctggtgttgaatccttagacctaagattatcatgattcccaacatgtgtagtagcttacctagggactgctaaatgctactccgtaattgggtagttataaaagtagttttcgggtatgttgtgaaacatgtagtgggatatgaataatcaagatgggatgtggtgggccccttgatgttgtagattatggaagtgcatggccatgccaaaggtgattgaggagtcaatcacaagttatataatctatacaggttcgagtgaacgattgagctattagaggatggcacatatctaaccttgagcttaatcgatatcgtgaggcaaaggggttcatacaagtatacactagaggttcagccgatatgatctttatgtatgctcggtgggtcaatacgttctgctaggggccgttgttgacacgtggaccgaaaatgagttttcgggttacagccgagtgtacatgaacctccaggatcgtacgcttaatgggccggaataaggggattggatggagatccaatatgagcttaattcggatagggatccgaataggagtcctatgggccttggaggctcgagtcatagatcctatatattcgtgagaggtgtgattggcggaggtattgcatcacgagcaaaaccctagccgtcactcccctccccgagcaaaaccctagtcacgcacgggtgctagcacatctacgcgtggcgttccgtccctgtacgtgtggataccggtagaggcgccactactttgcggtgctgatcggcgtgggaatacggcgaggggaacgcacgaggaggagaaggtcgagccggtgcgatcgactacttcctctacatcgacgtgcgctacttcgcgggagtttcttcgacttcttagcgcattcttccgctgcgcagcgcgtcgagtggtaacgatctatgatctaatacttgcatggttcctggtttacatgatagaaaattttgatttatgctatcgtagcctacgcgtattccatcacatcccctatcctctattctttcctccaccttatcatttaagcttaagggcccctttgaatcgtaggaatgaaaaaaatgaaggaataggaaaaacacaggatcctaacatgaatgaaagtataaaatagaggattgcaaaacacaggaaaaacatagaaattaccgtttgctcggaccgtaggaaaaaacacaagaatcatatgagggagatatgccccgtttggcacagctctagctcccaactcaacttacctggagccggagttgtgccaaacggtccagatcctctgtttttttggagtggagctagtagaggtactcctaaaaactgaactacgggggtggagctgggtttttctgctccacagctccactccacccccacaaaccactaccctttaattttgtagtctatttacacaaaaataccactcaactacccttcagtcatcctctcatcctgttctctctcctccccatctcctcccgatcccaaccgagctgcgggggcggcggcaggggcagcggcgtcggtggcgtgaggcggcgaaagcggcgggcggtgacgacgggcaggcggcgcgcggccgacgaagcacctagggacggcgaacgttcggtgggctggcggcgcgcggccggcagccgacgacgcgcctgggccgatggctattttttttcttttttttccagatctggagctgaaacgtatccaaacacttttcaacgagtcttcaactccaataggagctagctctcactggagttggagtttggagcccttcaaaaaggaaattttctaagagctttgagctctggctaagttttctccaagatctctataggattccattccataggaatttcaaaggattttatatgatccaatcatttgattcaaagacattcataagaatttttcatatatagtattgtaattcaaaattctctaaaaaaattgtttttcctcgaaatcaagatcctaccaagatgcttgtgcttagatactctctccgtcctagaatataaacatttttagagttggacacggttattaagaaaataggtagaagcgaatggtagagggttgtgattgattaagtagtggaggtaggtgagaaaagtgaatgatagagagttgtgattggttgaaaagagaatgttagtgaataaattgttatattttaggataaatcttatgtgataaaaagttgttatattttgggacgaatggagtatttatcgaccaacttgcattcttgcccaaagccctctctccctgtgtttccttcacatccactctcccatccaaattcccaagcccatctctctctctctctctctctctctctctctctccactccagtcgaggcacggccggctccccccgcgtcgccggcgagcagggcacgggcgtgtcgcgctcgcggacggcctcccctcccctcccctcgtcctagccttctcctccgtgcggcgcacggccggcgaggccacccagggttggtgacccaaggggggcgagagcgcggagacgcggcccccccatccatctccgtctcccccgtccggatcgaatccgaggtatccgctcttctttctctcttgtagcgctcgctcgtcgtcctccgcgcatgccatccccatgagtgagccggcgtgcgcgtgggttggagatccatcagtaattagaatatctagattggtttgtatcatccccaattaacctgtccacgcagcgaaccgtcttccggagaattggtgagcggagtggtgctgctgatatcaaatcatatagttgcgtgtaatttttgtatgtgttgctgcaggattgatgtagaggtgtggaatcaccgtaccatgttggcacatagtatttgtcgatatggccgtatggggtttatttagcgtgaaaccgattggcattacttggatcatgtcaacatagtgtttttttgttcagatatagccttttactgatcggtctgtgattgtgtgcctacctttgaagttacttccttcatttttttttctgctttcatatgctgatgcagcttctcactaaagcaacttctgcaaatattttctgttggatgtaaatgcacacttttttcgtcgaaataaatcttccataaaagaggagcacggtattaggtgtacccctgacactcactacaacttaagtgtgcttctgagattcttccttttctcgcaatttcataatatacataccaactactattgtgctacaaagatctattgtaactctagcattacacggtgggacttgctacctttttctttaacataaacggtatacatcgttggacaattccactaataagggattttctcttcaccttgcataatgtttttggttgtattgacaagcactgttttaatcctaaaactctctctctctctctctctctctctctctctctctggggtcttatatgtcctgctgttttgttgcctgctatagcattaggcatcaagttccttccagttactatgtgctggtccttttgttaggtttgtaaaatcatagttagttaactagccagatggacatattgcacattatctctctttttccccactttctgatatattacagctggtatatgctcatccatgccacacgttattgtataagtaaaacacactgtggtgaacaaaaatgccattctataacgcgcagctgtgaacattttttattggtgattttttttttggaaaatttatacagaaccagagcaagcagaaatatgccatgtttttccttctttattctactgaagaacaggacaaaattgtgtatatatgttctggtcacacaaaattatattgaaatcctttgaacacattggttgcttttcatttgtcaagtctaaggatgatcaagctggtcttttgtttcacaaagtcacttgtatgcttcttccatgagaagtcctttttattagttttatcagttatcacatcacgataaactcataggcagtgaagtcatgtttgtgtggttttgactggccccagatgacacaccctttttgtcatcttggatcgcacgtttgttattgtggacttgtggtattgtctgtgcgtgctacccattattccctttggctctttattttctaaaccaccccaagtttgtgctagcaggctagcattgacttacatatcttttctagcattattattaatataaccatggtgaacaaggtttctgaaaagtttaaatgcaaacatgatgataaaatgccttgttaataaattcagtctaatctaatggctaaagaaattaccttcactgaagatattaagcatgtgaatgtgtgtacatgttctgcagagtgaacacatgaacctatggaaaccaatgacattgccaacaaacaaactttatgaagttccctattgtagtactacctccgtcccaaaatataagcatttttagctatgaatctggacaactgtgtgtccagattcatagccaaaagttgctatatgttgggacggaggtagtatatattatgagaaagtgactatggtacatatgatgtaaaatactacctctgttttttaatatatgacgccgttgacattttgagatacgttttttgtaattatcatttattttttatgacttaatttattattaaaggttatttaagcatgacttatatttttatatgttggcacaaaagttttgaataagacgaatgatcaaacatatgtttaaaagtgaacggcatcatacattaaaaagcggagggtgtatgtgctacatgacctttttcctccatacggtaattatttcttagaagtggaagtggttaggagtggaaaatatcaagtgagagaactttcttttagctgaaaaatgtgtgtaagagccttgtttgcttttctgtgagattttccttaattcacactacgttcctttttttttttgtcaccgtgtatgaatttcaaaagaggggtcctattcatgttctaatgtgtgacattcttgagtaggtctataaatggcaggaagacaccgcatacctcgtgaatactatgatgaacgtcgaggatttcgtgatggccccccacctccacttgctcgagcaaggcccatctctccacgtcgcttggaggaggagctgtctagccgccgtgctgagatgcgcagaatccatgatgacaatcagcgcctagctgatgaaattgttggtctcaggcaggcaatgcctcgtctgaaggaagatctccatgccgcaagtcaagctatacccaagcttcgtgcagaaaaagaacttgagtcaagggagctgactcagaggaatctgaagttggaagctgaactacgttccttagaacccctcaggcaagatgccttacagctacggtccgaggccgggaaactacagtcaataaggcaagagatgactgcaaaggtgcaggggttgttaaaagagcttgagcatcagaattctgagaaccagaaaatacctgtcatgatagctgaacgtgatgctcttcggcaggaactagtccgaatgaggtactgaactattctgcatcatatttcgtgtaaaatgattgcttcttattgcttttcttgatggatcaagtgttagttctaagttgctgcttgaaggagcgcatttaggatcctttcctacagtttcaattctaaagaaaaaaagtggggtacttgagtatcatcttcctcttttcaccaggtggaagatcaaactgattaatatcactgtaggggaacccttgagtacgagaagaaggcaaggcctgatctgacagcacaggtgcaggcaatggagaaggatcttgtttctatggctcaggaatctgagaagctgagggctgagattaagaagagaaatgcacccagtaggtttcttttcttttgctagcttgaaagttatggaaatcaatggcgctgacccacaacaacatactatgtttgattttaggtttcagcggccatggagcttatggaccaccaatggcgactccagggatgggcctgcaaggcgtctatgatgatggctatccttccataggcagccgctatggcactggatcttgggcaccacatgatccccatggttatccacaactgtgactgggcttctgatcgttcttccctgggcagtgctttatcttcgtaatatcgcttgatggttgatactgatcgtgacaaagcttttctcttagtagaacttgtggtgcacagtagatggtcttttgggggtgcacttcaagtgttgttagtttagcatatgtagcaatataccagctatggttgccttggtacctctccaaaaaatgtaatcaatgatgactgtaagagggaattcagtgcaacgaagaagaaaaataggaacttaagctttacaagatgcaagtttgcgtatgaatataacaaggtggaatcagtcagggctggatgttgctcagaagtttgtccctaccaaattgcaatagcaaaaattacttattcatgagcgatatctgcaatgcgcagcatcatgagctgtgtttcctgagcagatgcatattatttgctccaggataattaatttaattttgtaaatgagtatctattcgcaacaagcagtgcaaatttaaatgattctgctattacttgtgtgaagtttatacagtagtcgtacctgaagtttctgtgatgttggtgtgggtgcctaacccgacgaggcgcaaatggcttctctatgcaacgattagtaattctgagcgatatgattctttttcccccaatctccattttttggagtcgaatccaaggtgtgaccttgagagagacatttgtccgtgaaaagcacgagacaagtggcttgaagaagattgaaggcatcctaaaagcaccagacaaaatggaagatcgaagagagacggcagtcaagatcacttgcttgcagttgcagacaacattccatcaattatctttcttttttatcagtttattagatattgcaaacaagtctatcaagcacaggtcagcaaattatcgaatcccttcaactttggagtaaccgagcaaatactgataccaagacaaggatccagctatttggtgggggtgggggtggggggttgtttttttttttgtttgaactatccggctagggttagattcgaaaatgaattcggactttttcccttcggtcacagaaacttatacaaaagtgctaatatacagtgtaaacaaatacggtcctaactcctaacctattaggatagttttggaaacaaagacctaaaagcatctccaacaacctcttcaaatttgaccttagatatccattttgtcagcttgttaaaaatttagatagccaatttatctttcactccatcggcctttctatttaccctatccaatatgatagtaggtctcacatgtcgatctatatatacttcttcctccctctattgtttcctcttcccatcgttttcgtccattcccctacccctacctctcgttgcctcagcccaagtcgccagtgcaacccatccttgctgcctccacccaagctgatttagcaagtgatttggcttggctaatggcaaatctgttggatactggtttttctccaagtttactaaaatttgacttggcaagctagataagtagtttgttggagatgctctaactcattactttaatttttaggcccatctctagctctacttgttcatagtattttttttatacaaagcatggcatctagctataaatgtatgccttatgcacttgttttttttttctcattcctttttacaatctaattataaaatattaaattgaggtttaagatggacaccatcagggttcacgattccaaagaaaaccggttgaattccgtggaaaaccgaggtttcgacatggctcggaagtagaggaaatctggaatttcgatgggttttatcaaaattcaaatttgaattgataaaaaagaaaaaaaacaaataaaatcctataaacagtatgatattcatatagtctatttgagtataaattttccagaaatttggtgtattccatgtatttcttgaactttatagtaggaaagaaaagaataacgatttaaagaaaaggaaaacactttcctcagccgaattccaaggagtaggcccacttagtacttagcccagttaatagaatagaaaggtgatgtggtcccgcacctgatttcgctcagaatttcgccaaagtcaaccggttttcgcgagcatattggtaaactcagtgaatttgtagttaaattttggtttatgaaatttgttcaaaatctacctgttttccaccggatttcatgaaaattgtcataccgccagagcctggaacggaaagtcatctcagaattgtaaaccttggacaccattagtttgtacgtgtttatacgatatcgttatacacatatacagttgctatttttttttaaaaaaaagtagtctactcttttatatagaataacaattgatattttcaggcaatttttcataagtccgtcagacaagtattttaaccgtattcgtttcatgtctatattcgataatatttatcttcgtattgaggatattcatcatttatatgtttccaaatccaaatccaaaacgaaaacgagaaacaaatacggtacgcgtagtcgagttttgtttgtgatgagtttgagttgtgactgggcttctctcccgttaacagtgagagagacctttttggtacacaaaaaatcctcatcatcagagggaccctgcccgaaaaaggtctctccctctttttacacacatatattacgcgacactacccctctcctctttcgtttctttccccttctccgctcctcctccccctcgcgagctcggcggcgggcggcggcggcggcgcgatgaaggtctccatcaaaacgctcaagggctccagcttcgagatcgacgtcgagcccaccagcaaggtacgccgcggcggcctcccccctcccctcctctgatctgtgatgtgatgccctgtgtgtgtgaatctaccccgtcgccgcggcggcggcgggtttgcagatggtgggggtgtttggatggatcgggttggtctagagcgccacgggggttagcagcagcgtggatgcagtggggggcggggatggggctctagggttgcgggatttgggggtgagggggattggggagtggtaatggagggcggattcatcgtctaggggcgtggcttttgtgctggttaggtaggtggggctctgttcgtcgccgctgcgagttgggggagctgctattgagtattgagtgttctggtgtagtatatgatggttggaagcaatattaggttttgttatggctttgtatgtatgcgtgtatctgcttgatgatgtattgattagcgtagtccgcgattcagtaccgtgtctttatcttccatcgcttttattgatattattgcatactggagcttggttgctatgtgttcagcttgttgtgagcggatcgcgggattacggatatatctttatataggtgtgtgtgcacgagtaagctgtatttaatgaccgttggaacaggcaggccatgaatttgtacttatacgcgctggtatcgttgtgttattatggctcgtgtgatgaggactgtttcttccagtaatgttatatatatgactagaccatggaacgataactgtagcgtcattatgcaatatttgtttgaatctaagatttggactagggatagccactctagcaaagctcttaaacctttgatcatagcgcttaggctcttcagcacataacttaatacggtatgttttctcattcgttttctatattgttttgatgatcaaagggaggacaatttctgtttatgcatatagttccaactagtttggaatatatattaacgtgtgataaatgctgcttagttattccacatgagtatgtacacatagtaactattgtaaaaattgcccatcagttaccattaactatggtcaggtggttttactggagtgatgttaacggttagtcggttacgttacaatccatgattggaatcttaatatgtagtactcattactgcactttttcatgactcgcctccccagatacatcaaagcaatgttttcttgccacgtgaacaccatattaaattgattaatacaaatacattctgtttgactatgattgttttatgcaggtcagtgatgttaaaaagctcatcgaggttacgcaaggagataatgtctaccccgctgatcagcaaatgctgatccatcaagggaatgtccttaaaaacgacacaacacttgaagagaacaaagttgttgagaacaacttcattgtgataatgttatctaaggtgcgttaaatttttatcattattatagtagagagcttaatgctatctaaggtgcctcagtatgcaacatatttgtgaaatagcacaaatatgggtcatgcctcgttatgaacgtatgatgcaaatattttcctttcaggattttgtgatttatctatgctataatttttattaaatagaacttggacaattctatttgcagaagggatcatcaagtgctgcttcaagtacagctaaggagcccacaaaacaggtgcggtagaatagccatgtttcattatatcattgaatctgtttctcagtattatttttcccatttttttaattagtgttctatgtggtttcttagaatatcactgatcaataaagtaaatgtgctaagtcttattcaactgatctggaaattttattgactcactcaagaggaaatctgctctgtcctatatatttaaggagaactaccattgacaattcaagatttctacttgttgtatacctgatatgagattgtactatttcttttatacgcttttcctgtaaggtttttggtttaataatatcatctcctggatacatgatgcccatccaagtatatgatttaaggagaactaccattgacaattcaagatttctacatgttgtatacctgatatgagattgtactatttcttttatatgcttatggttgttggcttgtagaattgttattctctttttgtaatttgacactgaactcaaaatttcgcttgttgtacaatcaaattaatatgtatgtcttgcagccctcagttgaccgggcgatacccactgcgcctgcaacccaaccacctgctccaccagcacctgtgtaagtatccacccatattggcctgactgaaatcattgagcacttatgtgctcaaggatccatttttctcagtccttaaattgtctttctttaacaataactgtagttagtaactaatgttctcttggccattatatccatcatggtgatatttaggtccacatcttaatttgcaaattgagttcttttgttgccacctaattgcaacgttttgcttttcccagtagcgagcctgtgactgcaccagttccaactgcaacaactgcttcagctccagcagctgctgtcaccgctgcatcgtgagttgttacatgtttcctttgaatttaagaatctgatcaatcaccctcttttgcttttgttcctttgtttggcattgttttatttggcaagatatgaaaggccactttgacaatactatctgataatttgattttaccagcaccgaagcagataattatggtcaagctgcgtcgaaccttgttgctggaagcaatttagaagggactgttcagtcaattcttgaaatgggtggaggagcttgggaccgtgacactgttatgcgtgctctgcgagctgcatacaacaatccagaacgggctgtggagtatttgtacaccgtaagaatcatttctgcttacctcccatgttttccgtgtcttgttgcttggacttcctgacgtgctattatgtcgtcaaaacttttaaaacaaatagggagtctcaaaatattaaactaatagaaagatgttgttaatctgtgttatttaagtttttgcaatgccttgttgaaaataataaataaacagatcaaaaaacaattttaacgacataggcactttcttgtcatgcatgctttggtatgtgcccttgggcaacaggaaaccacttatttcaaacaatggttgcacccttttctctcctttgaacttatttctgccacttctgctgcttttcgggcacaattttatcatgtgactaatctattgcactttgtgtatttgatatagggggttcctgagcaagctgaggcccctgctgcagttcaagcacttcctgtccctgctgcagttcaagcacttcctgtccctgctgcagttcaaccagttgacccaagccaggctccccaatcagctcaactttcaattccatcatctggacccaatgccaatccattggacctgtttcctcaggttctgcctccacaactcacacaaccacatacacacgcacacaaaaagtactagttctgaattctttcaatttttttttcaggtccttccaaatgcttctgcaaatgctggtggtggaaatcttgatgttctgcgaaacaattcacagttccgtggcttgctttctttggtgcaggctaaccctcaaattctgcaggttactttttcatctttttcttctagttgttgtactctatacgacatatgcactgatgtacaaattctggcatgcagcctttgcttcaagagttggggaaacaaaatccacagattttgcaactgattcaggaaaaccaggctgagttcctgcgcttaatcaacgaacctgcagagggagctgaagggtatgcattgcaagtttgccactagtgatgtcagtatttgtatatttcaacattcgtttttgtgcttgacgcttgataccgtaaaccaggaacttgctagaccagtttgctgcgggaatgcctcaaacagtggctgtcacacctgaggagaacgaagccatacaacgtgtaagcactatatgtgttcttctgcagtaccacaaaaccgagccacttgtttcatgccatcttgttgcttttatccacgttttttgcacctgcaagttgtaacatcacgtcactttgttcttttgtgcagctggaacaaatggggtttgatcgcgatctggtcctggaggtattcttcgcgtgcaacaaggatgagctgttggccgcaaactatctcttggaccacatgaacgagttcgacgacgacgcccctgaaccaccgcaataagatgactgacccgtttttaatgatacatgccagtcacacaagagacattgggttgcaaacagtggtcaccaagactggtgattatccccgttttagaacatccaaatccacccatccatccaggcgtgagaaaaatgtttttgagcttctctcatcatcattcttttttctgctttgggatttttatgatgattagtacatactctagatgacatttacagactacatataaccaaatgtttcaagtcttcagtgtcggttaactgcattgagggagaatgagttgaagttagagaaatccatgtgttcaacttcttatgctcttgtttttttggaggtcgttgtgcacgctcaaaacgtgcttttgacggtatgatgcataccttgacagcacgtgatatgggccgagccctttaccgacccacataatatggcccgcacggatgccacaatccatatagtatgggccgatcttctgttgcatctaatgggccgggtcgcaggttcccaaggggtcggacgcaggggggtttgcttcatctgatgttctgacgcagccacgcagggtggttcgcttttcggatttggagatttcaaattcatacaaattttgctgttacatggagacacgccgttctaacttccaacctgtttaaccgccaccaagctcatgcaatccggcaaaactgtatacaacgatttcacgttcatacacaactgatctcaaaattgtctgatcagacacaaggaaattcgaattttagcaattaattttgaggctgttcaaattgatgtcattttcaaccatactgtttttttttgagaaagttgtcaaaaaaaatgtctacatttagtttattgtcaaatttagtaaatacataataaatcctgccaaaattttggcaatattaccaacttgccaaaatttggtaaggtttattttggttataatctgaacatgcccttttaagtcaaatttaggggtttcttcattgtagactatttttttcaccatggatttttaatggactgctaatagcacatgtatagaagttttacacattatttttggttgcttcattcattttctacatctgtcattcaaacgatcagccgtagaataaaaaaaaggcatgaatttttatatcaaatcaataagttagcagtactattatcatttaaatgcactagcaaacatgactaattaattgagcgtaaactgtttccaatctatgcacaccacgatgaattgattgaattcacatgatactatatcacatggtaacgccggcttcatcgccactcccatcgtcgaacaaggtcctcttccctgcaagatggccaaatcatcatcatcatctactaaccaaagccagaaatgttataacattaaccaagattgactgcacagcaagtcatcacatcagctacaaattaaggcaagagcagcacctatgatgatggttaaacaattaaagatcagcaacctctgcatattacctgtgctaggcgtgtgccacttaggagtgtcgtcctgatctggcactgccaatcctgcgtcgtccttgtcacaaccagctctccctattcttcgtttcttgcaccatgaaaaatcaggccattttgtgacgcgcagaatgcggcctccaatctcggacacgccgtcacagtggagcgcaccattgtagctgctcgcaacatcgtatcttatgtatgctttcctgtgaaatttggaagagcagaggtaaaatggtaatggaagtcaaaaggatagttgaaacaggtagaaaagatatgcatgcaggaacaggtttttctgacttaccctgtgcttgtgccatctagattcacgggagttacaagttttttcatatgatcgttcgcgaaaatttcttcaagtgcgtgcctaatctgaaatgggcaaattgtcgaggggaattccctagggcccatcactccaaaaggcaagccaacgcaagaaggttaaaaggaaagtattcatccgtttcatattataagattttctagcattgttcacattcatatatatgtctagattcattaatatctatataaatgtgggcaatgttagaaagttttataatatgaaacggagggagtagttagcaacagtatagttaccgttccaatctcgagggatgaatcaaagccggtcacacatacagtctgcattaaataattaggcattctctccccacgagtaggtatatctctgaacaattcggaagaatttgtgcaatgttaatgaggcaaaaacaatagcatagcgataaagctgatgaagtcacagttaacagacatatacctgagaacagcaaagtccttgggatcgaaccatgcaagttttaaagggcgtcccatcagatgatatcccataaaatggtagagtgcctgaaaatcaatataaacagtgttgtcatcctcaaacattgcaacatgaatcatgagaaaataaaaactgtgcagtgctacaccaggtatacaacacaaacaacagagataaggctttacactctcagcagcttgttctgtagaaaaatcaacaactgcgagatgcctcgtgctactgaaataaataccaacaatctcaccaatctcctgaaaaatgttcttcctataaaccaacagttggaaatttacaatcaatggtttaattttcagaaagaaaagcagttataatttcaaaagccttacacttgattatattcaacataattggccatgccccagctagcaatcatggtctgctgtggtactttctcttggactttgtcttttgcgggtgctttcggctgtacagaacatcagaccaggattacatgaagtaacaaggattgatttctagaaagaacatttagatttcgtggaggagtctggagtttaagaacatgaattaaaaacatgataatgtccatcaaggaaaaaaacattgagtacttaacttgtattggtttttccccaaaaattttgcaattccatgaaagaacaacttttatggtagttctgactgaacacaagcacattggcagatagcgccaatagcaacatagaaggattagtccttaggaaattttaactggcatcgtaagaccaggtcaataataggaactcaattacatactagtatctactatataaatgggcaccaaaagaaaaaaaaaatccatatatgcggtattaataaaccattagttagtgaaagataaacaattggccatcagcccaacatataccatgatccatgtcattatggccattttctttgaaagattaatcagattgaattggaggtaacagtgattaggtctgattagaactataatgggtgtatatccatcagttgcagatcagctcctctgttgagaaagtagacatggatatgaacaagcctgcctgcctgcctcaatcatcacaaagatacaagtccctagtaaaacgagagccgttcacctatcctcttctccaacgtatgcaacgcaggcgaaaaattaatcacgggaaatcgttgcagagcagacatgggatgagatgaggggaatagatggcattccgatattatatttggataaaatttcaccttcttggggtggcgataagggcaaccgaagatgatgtagcggcggaagtctctcgggggagggcgatgccggagcgggaggcgggggctgctggcctctcctgcgctgcagctgtaacccgcccaatggtggcctgaggactcgctccccgctcgagtcgtcttctcccccgtcgccattgttgacgatcccgattcttgtttatgcgctgagcccttgggaggattagacattagggcttgttcgtttaatcctcgcaaggaaaaaattggaggggattgataagaaaaaaataattttcatatcataatagatataaaataaattctctataaatctccctcaatcatcttgtgagagggattaactgaaaccgtatggtgagacgcctgttagcatatttcaacatgtacgaatactagtcaatagtttcaatctatattttttttttcttttctcattcgcagtgtacgctgcacatgtcatgtctattcatacatgtccacatgtaatttttttttactcatctgcacccttttctccgcctttaaatatttttttctcctaaaataattatctaatctacaatatgattacatcattgtattccttacaattaaatctttacaataagatatcacacgattatattttgataaaaaatcaaacgatgtttcactcattacaaaaatttgtttcaattcactctataaaatgtttcagagaaatacaacatttaaaaatatgggctgcaacactagcaaccacttatatgaaacactgagtcctaaatgagtgaaaaaaaatcatataagagatacaatatatttataaaaacctgatattgttgaaatatttttatatcgcatatgaacactaaactataattattgaaacattataaaatacttgctaaaacattccaagaacaccacgtgcaatatttgcaaattaaatagtaaaacatcatatgaatactagccgaaacatttaaatataataggtgcaacatttgcaaattaaaatagtaaaacatcatatgaatactagctgaaacatttaaatgtaataggtgcaacatttaaaaaattcatgaataaagctaaatatttttttcatcggattatagccatgtttggtcatgttttaaagatttaattgtaacgaatttagtggtgcaatcgaatcatgaattggagaagtaatttaagagaaaaaatagtttaaagtttgctcaaagaaacttaaaccaacctaacttttgttttctagtatggatgcatggcttctgatgtttgcagtgggcttcacctggtcctggtgtgtcttcatgcgttggcggaggctgaggtgggcatccgatttttaactaaaaaatcgaacgtccgatccgtagtcatcccctaattgtcatgcattagaccttgcaaggctcatttggattgaacgatttccccagggagaattgaaggaattcaattcggaatattttctatctggctcatttggtttgaaggaagcttcaaaggatattcgtaggataagaaaaattcatccacattttagagaaattctagcgtagcatgagagggttataagttataacctcacgttttccagtttctttgatctctctctttctctctctaaccaacatataatctcaaatttcatctctctctattaaaccaatatataatctcgaatttcctatgatgcattccaacgtatgatgcacattagaccatgtcttttttatccatattgtactttggactagggttaaactactttattgtgggaataagatgatggggttgtttatattgtagcaaaaaatataccttaccaaattttagcaatgccaaaattttgttaagttggcaatattaccataattttgacgagatttcatatgtattcaccaaagtttcgttaaaaactaaatgtagacatatctttggcaattttcaaaaaaaatgaaaatgacatcaatctaaacaggctcgatatcatccttcccaggaccaaggctccaactcctttgctgccctgagcttgagcatcacgctcatgcttgtcccttgctgcctttggtactatgcccaagctgagctcaacctctatacctcatccatccaccttcggatccacctcttctcccaaatttagtactccctctatcccactatagtggccatcccatgaatgctgacacaaattagctttgggagaaaattacccaaacacccccaaatcattagctgcaggtagtcatttcaagatgcagggaattgtcacacaagcaccaaccacgtccacagaagggataatttaaacatatacaattactccgtaatggtggcatgcacataatttgaatgctcatgcggtaaaattacaaggggcaagtaacctagctagacccactaattcaaaatactccattgatggtgttttgctgccaaggtgtaccctttcatgtcctataaattctgaaggaaccaagcagacaacctttttccattgcattcatcaaactgtgtggtaaaccaactcaatgtccagacatcacaatcgctatagatctagacatttggaaggcctttgcctgaccttagggctgtcaacgagccaagctcgagctcgagctcgagccaagcctataaaatgttcgaacttttagacaggcttggttcgagctcgatcaagctcaagctcgactaccgagcttgatttttaagtacaataatgcatatttcaaggataatattttaaaaaataattattttctagttcatcatattaatagaagaagaaaaaagaataaaataagtatatgacaccaatacaaggcatacaagtaacatatttgatatcctaatttattacataaaaaaatcatatattactagactcgttggaagctcgagctcggcttgacaaagcccacaagctttgggagaggctcgggcttggctcgtttggagcccgagacgagctcgaatcgagcctaggatgagtcgagctctagcagcttgcgagcctcgagcttttttgacagccctacctaacctcaatgaagcaaaagacaatatagaagaaggaagggttgtttcccgggcagcttaccttgctagagttgcttggcatggaaatgaacatgttgtactcccttttgatctgaacttgcaaacttttgatctcaacatggaagctgcatggaagctgcagaagaaggaatggatctaggttatttttacgtcatctattttttctcaatgcatcacatggatctttatcagtgcattaaatgttgtttgcaatacttgatgatgattgcattattcaatctagtttagaaaaaaatatatggtattctatgacatgtgcagcacactctactccctctgcccctcatgatcagcacacacacatgatgttaacaaaacaaaagattggtactacgataatttgacagtttagctcatctacttccattttctcctaaataatgttaaatatttaagatttttgattcatcaacacaaccacatcgacaaagcaagatttgtgcataatttgattagcaattcagcctacaaattttcaagttatcataaaagagagaagtacaaggtaattcaatgatcactttgttgcacccccatccatgaagtttcccatctgcatgaactgccattgtatgccttcaccacctgattcatcacagaaaaaaggaccagataaatgacatattcctcctcaaaaggttgtgtaaaatagaattatgacagatagctacattaaaaaatcatagaaagggcaactaatctttcacaatgcataaaagaaaatcaacatatagacatgaagccacaacataacattgttgattacgctacatcaatacaagcatagggtagtactggaatcaatactaaaaaaagagtgtaaacttcagttgcatagttgtatgcctaagtcatggataatatatggaatagataatattgttctaacgtacagtatgagtcatgacattgcatatcctaaacatatacaatgtgctttgtggctaggtaaagggtactgactagcaagttgtttttttcagacaatgatcaccaactcaaggagcacacccttcatgttaatgcaaacgcaaatgagaaacaaggtattgaactaggtaaagttcatgactttttaattagttaagaatatgttcatgtccttgatttcggttgtgaataaatcagcataatctgattagccacattaacttaccaagtaaataattttgtagatgacgacgatgttttgcaacatgagctacaagccttggagtatgacattcaagagtatggtgtgtacgccgatgctatcaatgttgtgttcaatgtagacgagttgctcgactcagatgaagaagaaaatgatgcaaatgcaaatgagccaatcaagtccagaaaattgacaaacccacaaaggcaaggcatttatgaattgttgcttgcaaaaagtatggatggaaaagtagaaacgggcagcacacatgtagttgttgaagtgtccaatatgagcatacgtacagtccaacgtatttggaagagagcacaactttgcagtgcacagggagtacaagttaatgttgactgaaggaagcattataattgtgggcgcaagaaggttgaaatagacttgttagttgtagcagcaattccattatagcaaagaagcactatacggtcacctgctgaagcgctaggtgtgtcaaaaagcacatttcatagattgttcaaagaagggcatctacgacgtcactctaactcattgaagccttatttgaaggaagccaatagaaaagaaaggttgtggtggtgtgttggtatgttagaccattgtacattgccaaacaaccccaagtttactgaaatggaaaacattatccacataggccttgtttagatcccaaaaaatttaggacaaaaacgtcacatcaaatgtttggacacatgcatagggcattacatgggaaaaaaaaaccaattgcacagtttgcatgtaaaatgcgagacgaatcttttgagcctaattacgccatgatttgacaatgtgatgctacagtcaacatttgctaatgatggattaattaggcttaataaattcgtctcgcagtttacaggtagaatctgtaatttgttttgttattactctacgtttaatacttcaaatgtgcatccatatacttcaaaaattttacacccaaagaactaaacacacccatagatgaaaaatggttcaacgccaccaaaaaggacaagacttactacctacatcctcttgaggaggagctgtataggattgtccaaaacaagaatgcaattgagaaagtaatgttcttgtcggtggttgtgagacctaggtataatgatgaaggtaactgcacttttgatggaatgataggcatttggccttttgttagaaaggtaacacatccttcttacatgtattgtttgcttatatttatttttgtttttctgatgtactaatagaaacccgcccaaaggagtagccgtaacaaagaaagggggacacttgtaacaaagacttaaggttggtagagacactatgagatcatccatgatctctaaagttctcccagctattagaccatgttggccccaagaagatgcaagaataacaatatttatttatcgggataatgctagaatggatgtcccaatcgatgatgaacaatttggttttgcagtagctctaatgggtcttgatattcgcttcgtgaatcaaccaccaaattctcctgatatgaattgtctagaccttggcttctttgcctcacttcagtccttaacatctactagggtctctagcaacatggaggagctagtagagaatgttcacaaggaatataatgactacaatccaaccactcttaatagagtgttcgtggcactacaaagctgctacatcgtggtaatgaaagctagtagagggaataagtacaagatccctcacatgaacaaagagagtctagaggcacttggcattcttcctaaagcgcttttttgtgatcatccgctctatgagagagccatacagcttatagtttactaattgtgtacttgtgtcatctatgtacatgtgcatctatgtaattgtggaaactaaatatataagttgtttgcttgtattaatgctttatcccatgttatattaacaagttgattgttcatatgcgcaatcacaaaaaaaaagaatgagtactgatatcgaataaagatacatatggcatttcattaagatgttttcataaccatagttccaaaagatgccaccaaaaaagaaacacaccacatatagcatcataggatgaactatgcaccccaatcattatgacttcatattttagactagtaacaagcatagtagaaaaaaacggaccagtgggtgacctggtcgacctctcggtttgacggtccgctggtccaaccgtgaaccgaacggtcgaaccgcagtttaatacatatatgtacaacgtatgtaattgctcaatcataagtgcttggatggctcggtggttaccgccacttgcttctatcatggagacctgagattgaaccctcataggagtatgtttcctctgatttttaccaaccaaaacgctgttggcaggctaattgggccacattaaggcccatctcaatattggtgtggtcttgttcggtcggaccgatggcggtttaatggccggttcatagaaaaactacccggttcaaccggttcaaagcgagtcacgtgcatgcccggtccggtttaatgttttgaatcgaacgacgaagatctctggttccggttttttccggttgaaccgccggtccggttttttccaatatgataacaagttgtagatatatggcacattattcatgtcacacggtactagatgggcccacttcttttttttatgagtactttcgctgttggggacttgggcatcaacctttctgggacaacttctacaacgtaaaacgaccactaaagtgggacggaaggagtagcacacacttgacttagggaggaaaggaggaagaaaatgcttttgatgaccgacatatcaccaactagtccagtccaaaatgcaatcttcggtaacaaagcatatgatccagcttctctccatgtgggctagagcaattagcagctaagcgctggtacaaatcgtacgtatagtgattttcaaagtgaaaatacgtacaactacctattccaatatgcaacataggtaacaaacactagcccaaggtgcaattcactctttcagaaatcctgatgtccaaataagctctcaagatcttttttttcttattataataaaaattaaaaagattaggtgtcccgttccaaataaaataactccgcaacgcataaacgtatcggttcggctcattttgggtcttttgtttcaaaccactcgaagttggaacaatattttcgagcccaccgaaaggcaatcgacgacatcgcaattcaacaacgcacaagggcagacaaacaacatcgaggaggtggacgacaactttaaatattgctcaataaaacactatctggagacaacacacacgagagtcatatccagaggaaaacaatcagcccagacggaccactagcaccaaatgcaaagcaatgggaagaactaattcgaccgctaccaccctagtaaaaaccagagaagagagaggaaggggggacaggaagaaaaacattctagtagaacaggagaagaatccatccatcatggtgacagcagcatgaggcatctaaatcgatggtctccaataacatgcggagccatcgatcgatcgatcttcccattttactggccctcgcaggcgtcgcccttggaggcttctttcacctcatcaccaccgtcctcctgccacagatagtttcacaaggtaaaattagcaagttgctcattaggtcgatggattttgcagaagggagcttatgatgtgttgagaggtaccgtgaggtcagaggtccagagggtcaagttgtccctcaggagctgcatgatcaaagtgctgtccttgtaagactcctccccgagggtatccaactcggagatggcttcgtcaaacgcctgtagcaaacggttcatcagtcacatttatttagagttgatatagcgacaaacgtccagatggcaaaaaagtcagggttcatacaacaagcacagacacatcaaggaccagcgattcaacaatgcataaaacaaaatagtttgttcagatttgacaaacctatatttatcatgcttacttttttgttggctttggccccattaaaataattaccacactatgagctatcactaggcaaatactaccacgtgcacaaatacaaatttaatcaacaataagcaggggaagaatatccaagttaaagcaggaaactatagagtttaatgaccagcaagttaacttcaaagtataaattcaaattaatatcatacaacatatcctaaagcacagaaacctcatactaatgacacaatcatgattatattgaagagaagagcaaatgaccaccaacctgcttagcaaggttgcaagccttgtctggagagtttagaatctcgtagtagaacacagagaagttaagtgccagtccaagccttatgggatgggtgggagcaagatccgccagagcaatatcctacatagaaaaacgtgggacagacaatttcagaaagcattgcctgaatcgactaagcagtcaatgaaatgcatttattaccagatggagacatgtactaattagttgctagagtaataaaatgagaagtgaatcagtggtatagcatatatgttatctcagaattaaaataaatcaacctacctgagcagccttgtaagccaccattgtgctctcagcagcttcctttctctcggcaccagtcttaaattccgcaaggtacctgcaaattataaactaaccaaattagaatagtcaatataaactaaggattcagttgtttttatgataagtgctgcatcattcccaacctgtggtaatcacccttcatcttgaggtaaaacaccttagattctgcagcagtagatgagggcacaaggtgtgagtcaagcaacttcaggataccatcgcaaatcttgctcagctcagcttcaatcttgccacggtactccttgatcagagtaacatgttcctcattgccacgaccctcctccttctgttcaatggatgagacaatacgccaggaggcacggcgggcaccaatcacattcttgtaagcaacagacaagaggttgcgctcctcaacagtgagctcttccacatctacagtctttgcaaccttctccatgtactcaaccatctcctcatacctttcagcctgctcggccagcttggccatgtagacattctcctcccgagacattttgaccaattaagggattactgtagccagataaaaaggtactgataagcattcaccaacattaataatctgaaagccatggggtctctccagaaggtataattgtacaaaacagatcatgttcccattcatatcaaggatgttcatttgttgagaaatgaataattaaacaattgtgaataatactactgaatcctacaaattccatcaaatatttaatactaactctttttaaaggctgtaacaaatgaataagccaatatcatgtccaaattcaaaatatttcataatctcaactaagttgtatttgtaatcactaaaaattgttcaatacagaaagaactaacagaaactcaattacagccttataatgagggatatatctaaacattgcagatcaataaatcataaacatggctaggctagatctaaacgtcgcatcaatccacccacgagacaaacactgattttccacaaaccaagaccacctacctcccaatccagataaaaaaattatcaccccaataccgagcaggcgtgcacctttcaccgctacatatatatagatccccacactattaacagattaaacctagatctaatccgtggatcaaacgcagctaataaccgataccatcaacatacttccacaataaataaataaataaataaataaataaataaataaataaataaatctgtctaacttttccaaatccccaacagacgtttgctcaactcagagatgataatccaaaaaaagcaaaaaacaaaaatccccacttctaaacgagacgaagctcgccaaaccgagcggatctactcccctcgcgtgcacgggatcgcagatctcacgaatccaatcccatccaaatcacccatcaccaccgagcacaccagatctagcccaaaaccacatcccacagtccagaacccaccaccccaaaaaaatcgccaaaaaaaaaaacatcgccgcacgccttcccgtgagatcgagcacgcctagaaatgcaaccgcgagaggaagaggaagagaaaaaattccggcaaccctaaccttcggtggcggcggcggcgaggcgggtcgggttcgagtggtctcgtggatgcgaatgctttttgttcggcggagaggaggggttgggaagacgggtgcttttatagcagggaggcttggcacgggagccaatggtgtggcgccacgtgtgcggcgagccaggctggacagcggatgacatgtgggggacgggtcgcgcctgggcccacgtgtcagtggggggtatagttggcgggtctggttggcctcggtgcgcgcggtcggtgggggatatacccttcctcctcctagctcgtgagatacgcgttttttcgtatgatgacatgtgggccctggagttggtggggccgacgtgtctgtgtgatgacctgataatgtgctgaaaaagaatgttttttttttagttttattttaggggctgatataagtggaagcgcaccatgggtgatgcaaattgcaaaatgacctgtgatctcaactcaaaaggggaaaaaataaacaactctggcaaaaaaacattataatgttcatggaatgggagttataaattaacaaattaacagttataaaatctattataataaataataattttataatgtttcctaagctgtattgcacggcatatagtaatggcttttgctgacttcagaattctgaccccccccccccccttcatctgttgtttcaaggtctagagaagaaaaggtcagagaaaagctgtttaccaaataccttttcttatttcctaaaaggattcttttgatgttgaactgcttagtggtctaaaagtcttcctacaaggaaaaatttgtcaccgagaacaagtggagattttgcatctatatatattttttataattctaagtcttaaatgtattgtattagctatctaaaacctgggacggacctagagcaaggaaataatgtacagttgtacttccaaaatttttgacaaacaatatgtgatttaataggtagaagtataatagtacatgtatataccattaggtgggtcaataagagcattgttaagcccaaattcatcctttccagaattttatagtttgcctcgtaccaaccaccccagctagaaaaccaaaatgaacttgtgaacctaaaaaatcataaatgtggcttggtgaattatgggcattgtctagctggcatgcgtttaaactagacaggacaaatatggacagtttgattttctgacagaaaaaaacagaggcctctcgtctttctgacgatccttaaaaaaagttacaatgaaaaatagaaacaggagacgtgcctaaacaaattatttcacccgtacatgttcttgtcaaagaaaacactaaaatccctcatatccaagttgcagccattgcccattgctgtcaatcttctctttcaaactccttacgtgtccctgtccagagacaggcacagcacagtcagctcgaaaatatcaggttagtttccatcttaatggcagaaaaggatgccatttccaccgaagcaaatctggaaagcaatgtgtatgatgcaaatccagaattgacacgtaattgacagcatccatacggcaagatctcagataagcatcgagactcatgtcatatgcagcattgaaatcaaatggaaaataattcttgcatgaggctacagggcacacacacaaagacaatggctggtggcaacagactaactaccctgaattaacatgcacagaagaatcaactctcttaaccggtcaactagcaagaggatacatatgctgttggcacaagaacagaaatcttctcggactactgaatttatttcaaataattgcttgtactacagcttaaacttatcagttctggcttaaacttagcagtagtaacatacagctgaatcattggggaaaggaagccagccaagaaacaggaccagctgacctccatatcagaagaatcacaagcattttagcgcagccataaatgtggagatctgttcagaagtcagatgatactgcaaaccccgctgagctgcagacagtacagaagatgtgggaggccataaacatcaataacgcttccagcatttacatgagaaaaaacaaaaggctctaatgacaacgttcaagcagagaaacaggatacacagctattcctcatttccagtgatccttttctttagagcatcaaagccattggccagttcttcccggttttcctgccagaaacaatacaggctgtaagggaaacaaacatttgagtacaactaaaacatgaagtagatctgggtcatactcagacaaataaaaaaggcacagccacgtatttatctacgtgcgacagtaagttgcaccaaatcatatttgacattcaaatggtaagtagtaggagtataacttttctctaggataaaaacaaacggaattgacttgggatggagctgtgatagacatggcaaagctaggtatgtcaggcatggacaattgtcaattggaccgacgtgatctgtactactgaccccatcaataccaagttgtgcatcctccacggttcaaccaacagccttttaggtttgcacagctaagttaaatggacaagactcaagaaactcgtgctgaatagctcaaaagcagcttcactgacagcccacatgattcaagattaccttgaagagcaggtagcggtacacaaaccatcccgagtagccaagcccaactagctccagtatgttcggaagctacatgaaggaagagtagttagataaacaagtgacaccatgactaggacagcattttgcagcagctacaagtaaatgggggaatagcaatataagctgggcatataccactggaactgaatcgacagctttgacaacaatcgaggatagccagacagcgatgattgctccgcctccgtaaaagagaacagaggacttgttctcaatagcatcccactgtgttgtggtcatagcaatcataagattactgactcagtgaaatacattgtgttctcccaagtgaacataccttctctttgagctcagaaaggatctcatcgtcctcatcagaactactctcttctgaagatcgcatggcttgtacctggagtagagcgatcttcggggaatctgctaaaatttgatttcttagtgtacttgtacactttctcagccacatagtttggagggtggccatcaaacagatgccgcaatattgctaaacaactttgccaaacaagtcacaatcattgtatagatcttctacccttgtatactaagtgaaacgtatgccttctttttctctccttgagaaacaggcttctcaatctttttattgaaaaggccaagttttttaaagaactaaaagaaaacacatgattctttaaattgtatttatattttgtccctacagattcagccgatgagatacttttagaacgtggtttggtagcttgagtttttgaattgtccacaacataaacaacacagatacactgactgtaaatagaaagagctaattacaatcaccacttgttcatcagtctgaaaatatgatgtggtggctctcaatgaaagtaatataagcattttgatatgcacttgatagtgcagtggcaagggatcccatatacagggtttcaactttcaaccctgaggtcccatgttcaatcctcaacacgcttacaatttcttcttaaaaaatgtttggagagacaactctccctccaaatcttttttttttttgtaatacaagcattttgtcaagcattgacaattctctcttgtcagaaatacttaaacaggtagcagtgatttcataccctgaacataggaaatcaatgataaatcacactagcccaaaactaggacgttcttggatgagagcacttctttgaaaatttatagagcagaaaagaaatatgtggtaaccaaaactattaagtaatttttcgccgggtaaaaactattaagtaattgggttgggtgcactcaggtcagtgagaggttttctcatatgttgttgcttaacttgtacattaattcttgatctctacagtgaagcgcaaaggattacatgtgcaaagtgatttttgcagtattttactgtaaagagtactggtggttagcagcaaatacacttccaacattagagctatcatcagtatatatgctttgcccttagtgttcggcaacatgtcaacataatactagacattcaggttaccctgaagtcttctgtgaacaacttgccctcccactttgtagagtaatactcagcttaacaaggatcagaagcaagaacttcaatgtgggtggttactcacttactctacaccaatcacaaccaaatgctgcattctactagccagccaaggcgattctaatatcgagtcccaaaatggagctcaaccgttgttgatccagttttatgcttgcactccagtatccaattttttctaatcccctttcctaagaacgatttgacctcgtgtgtgtcgatctgggatccaaagcatatggcgagaagtggttaccttcgcagcgaagggagggcgtcgtcttcacgcggggagtgagccggcggcggcgcataggagctcgggggacagcaatcggacggcaaagagacgccggcggcgccgcggcggcgaccatcccggccatctcggcaaccgccactacctaccctaccttcagtggatgcaggcgtcagcgtcacggatcgagcaaacgctgcgagagggttgagaagcgcgctgctggaagctgcgggaaggaagaacgcataccgcacggaggtggggtggcggcgacggcgtcgccggcgaggtcgctccggcgagaatggctctcgctggcacgcgcggtgtgaacaaagcaaactcgataagcgccgtccgatcggagtttggcggcccagatcgaccaagggcaagaggtggtaggtgtagggtagggactagggagtagggaggatttgtggctgaccgttgcgcccccaatttccaatccaaatttctcaacccctcagggtcaaaaatttaagattattttttgtttgaatttcgtcatccagatcccgtagctctaaaatctaaaccgaccagtttctgttgaatgtagttcaattgggctgtgtctagtttcacgccaaaattgaaagtttaaaaaaaaagttacaagtttatatttgtagaaaagtttagatgtgatagaaaagttagaagtttaaagaaaaagttaggaactaaacaaggccttggtcaaatttcacaaggtcacgtgaaattcatcatctcattctaacttgcatctcgaccaaaaaaaaaaaacgagattgcaagccttgctcctaaaaacattgattaaataatattaagacagtttagatgtacagtgcatacaactttcaaaccttaataattaactttgcgggaggataaaaaataatatttaaaaataagtttgggaggaaagaagaaaggaacagattacgtcacaaaagttgtcatttctcaacttttgtttttccttccctagggtaatgaattcacttggaaatcattcatagcgagaagatgagatggccatgcttatttatctcagcagaaagaaaaatcccgattcttttattcctccttgtttattcatcactcagctcatacatctcagagatcattttaacattagccttgtcttattgcacgaaaagtactcggtagtattatctgtaccagctccgggatttggctttaaaaaaccaagaggcgatcgattactcgtctgcctccgtccatgtcgcgatggccagcgtgtgcctcccgccgcaggcgacgtacctcgcctgccattgcccgccggagtcgccgccgctggttcccggcggcggcaggtcgatggggacttccatcgggtggcccgtcgtgaccttcctgccgtagcccagacggccatggtcacctctaccgtactgcgagaacagaaggggaatacaatgtaaacacattataagtgattccctggagatcaaattttgttctttttagataacaaatcagaatggattccctgtttaagcaaaacctgtggttgttcagggattacaggcttacagccaggcatggttaaagaggaatgctgtttttaaaagttttactgagattcaagtatccaaaaacacctatcagtacttctctggtgaaaaaaataatctctctaaaatatgcaagtgatctgtattaatggagaaatgtggtgtcctcgtcgccagcatttcatagactagaactttgggtatgttctcaagggtgagcagaaaaaaatgttgcatagctgctcggcaacattgactatcaaactgcaaaaggttgtttcatgatacgatactccaaagcacagaggcataattgagtgattatggacttgcgagtgcttatagcagttctaatcagccattattttggttcactcaaatttgtttgaaatttgaaatatttgtctattttcatttgcataatttacaggtggtattacactcaaatggggtcaagatgacaggaatatgcactcttggtacaaagtaactagtagctggagagaaaaacacttacagaaaacattcgtccatcacgagttagcgcaactgaatgggttcctccacatgatacctgcacgcaagaaaatgagtactggtgctcaacttggacaaaaaaaaatccattacctcaggcacagcataggagaattacctgaataatatcctctccagcaagaagctcaaccttttggggaaccatgtgactacttttatcatctccaaatccaagcctcccatgctctcctctcccccaagcatacacctatagaggtccagaaagtgaacagctattaatcccttgtgcacaaagcaatgtttatttgccatccttctggtggcttggcagaaataagctcaaacatgatgtttcagttaaagccaaaggaaggaaatacctctccctctttagttaatgcagttgaatgccaacctccagcagcaatgtcaacctgcaaacaaatgtacaaatgagcaatatgtatgaaactataaacaagaaggtaagatacaaaggcatgatccagaaaattgtgcagacgaatatttatttatcagcatacagtggtagcctataatcagcacaaagttatatgtatagctagaatcaaacatactagtgtaaatggttaggagtggaggtactgaacaccatggcttgtgagatgaaccgagcacaactgaagtgactgtaagcaaacatagtttaacgcaggatccaaaagactaggttctgttttgggctttgttagtaatgtcttgagaagacaaccaccctgttataaactttatttcacaagttatcagaattagaagaaaccaaatcagtgtggctcaccaatgaaaggtcagataatccttcaacacggattggttgcgatcttggttgagtatctccagtgcccagttgaccatactcattgttaccccatgcccacaaaattccatcttctgttagagccaaattatggaatgcacctacagcaatcacctttacattctcaaggccttgcacccgcactggtgtagatatttgcttgctgaaaaaggactaatggtcaccagcacatatagggagaaaaacaaatttcagcataaagcaataaggcactatacatatcgcctggaggccatggttgtccccatgtccaaacatggccatcttgtgtcaagacgaccgagtgtgtccctccagcagcaacctacaattaacgggaacgattagaaaacccatgctaagaaataaaaggtggaagtgcatgacaaaatattatcattatggaaaagtggagtgcacgacaaaatgttatagcattattctgttacgataaaaatccatttcgggagtgcatgacaaaacattatagcattattctgttacgataaaaatccattttgggagtgcatgacaaaacattatagcattattctgttacaataacaaaccattttgggagtgcatgacaaaacgttacagcattattatgtgacaataaccattcattttggatataatacgttatcacagttgcaaaacatatatcctggcgacccttcaagcgatttacgacctaagaaatgtgttccacaacctaacacttgttgggcaagtagcagatgccaaggtgatagtgcacaatttgttggattcccattatccggttatcccctacaaccatgctgcatcaacaaagacgtgataaaattccagcattctcatggggacaaattgtaggacaagtcaggaatcgattccactcacttgccggactttcagcttgggggcacacccctgcgggatcggaatgtccctcctgagagccctggttccatcttccttcctctcagcctcctccccacactgcccatactcgttgccccctgcaacaacccatccacacgctcacattgcatcaaatccaaccaaatcgggtcacagaattgacagaaaaccaagcaaggcgagccgagctccccgtccccgtaccccaagcgtatgctctccccttgtcgtccaccgcgaggcaatgccatccgccgatcgccgcctggtaattagcaggacacacactcgcattcgttagtgctcactactactgcaggtagctcaaatcgcgattggaagaggaatgatctgcggtgacctgcacgatgctgacgccggcgagggcatcgacgggggccggggagctctccgtcttggtctccggcgggtgcccgagcgtgccgcgctggttccacccccacgtgaagagctgcagcagagcagtacacgatcgaatcagatcagaaacccagcgaaggcctcgatcgagagatggagggagagagagggagagagcgtacgcggccatcggcgcagatggcgagggagttgcggctgccggcgacgacggcggagacggcgagcgcgtcgagcgcggcgactccccgcgcccagtcctcctcctcgtagccgcccatgcccagctgcccgtcctcccccgaacccctacacacaaaacacagagagagagagagaaggcgccatcagcgccgccgccggccgcgggagcgaagcagcaggtcggagcactccactcaccatgcgaggacggccgtggggagggaggaagccggtgggggcgccatgggtgggagaggagaggaggccgccgagcaggggcgcgcggaggcggaggaggtgcgggttttcgtgcgccgcgcacggcggaagaaacagtgtgtgcttccctcgtgtccgagcccgagcaccgagagcgagagagggaggagggggctatctttcggggcgcgtgtccgccgtggcgtgggttttctccctttctctctctgtgcgccgcggtcggcggtagggtttttggggtttgggtggcccaccaaacgtgaggtggattccatttccatccacacccccttggtgactctgactcacccccggccaaatcagtccatttgagcgaggataataatgctcctattgtttcaatcagtcgctgctaaaatttgaattttcaaactcaaatttaaagttgattttcattcaaatttattttttagcattggtatttaaatcgctaaaaacacacacacataagtcttgcatataaattattattgctttcctaatacgtattggctaaacgacgggggtctaagctaactataaacttatatgaaaaaaaagataaagaaaaataagaagtattggttataatgcaagagctagttaaaaacgagattttgagggacatatgtccctctaaatattttttttaaaaaaatatgagtgttctagggattaaacacggaaactcgaagttgaaatcacacacccctgccactgcactaccaagtatatctcaatgcaagagttagttatatacatgtttgttcaagatatttacattaaatttatagtgggagaaaaggagtggagaaaaaaatatagtcaattgttaacatattatacatgttagttgcaatataggctaaggttgtgttcttcccctaccttttccagtgtacctttctcgttttccacgcttcctaaattactaaacggtgtgtattttgaaaaaaaaatatagaaaagttgcctttaaaaaattatattaatctctttttcaagtttattttaactaatacttaataaatcaagcactagctgccgctccattttgcttgttgcgagtgaggttcccgaattcagtctaatagtcaatatttagctttactattaaacttgttgttagagagaggattagtgggggacacggatgcttgctataggtataaagcgtgtgtgtttttttagggaagcatgtgtttatattaggaagtgtattattgcggtgccgtgattaatggttggatgttttatgatgtatgggtggaaattaagtcgagaaaaaaaatggtgtttgctgcgtaatgattaaggccatgtttgtttcattctaagattattataatctagattactgagccaaatgaatgtaagctgaattataatatgccgatatataataagttgtgagctgtttgtttctctggattataagctgtttgttaaatgttagccacccaataattttaaaaaaacacctttagcgtggattactggattatagtaatctggcttatagattgtaataatctatcataatatgctatatgtttgtttcagcttattcctaataatccaaattataataatcataagctgaatcaaacagggcctaaactcatgtgccacgatggtaaaagacggtatggttgggtttagttcgcaatttttttcccaaaaatatcacatcgaatctttggacacatgcatggaacattaaatgtagataaaaacaaaaaactaattgcacagtttgcatggaaatcgcgagatgaatcttttgagtctaattagtccatgattagccataagtgctacagtaatccatatgtgctaatgacggcttaattaggctcaaaagattcgtctcgcggtttccaggcgagttatgaaattagttttttcattcgtgtccgaaaactccttgcgacatccaatcaaacgttcgatgtgatacccaaaattttttttttcgcgaactaaacggcctatgttggttttatgttggtatcgaagtgattgtatgagaatgtccccttttatatggtcatccatccttttcttaacacggtcaccaatgctgacattttatacatagaaaagggtatattgttttaaggagaaaatgagaaatgagactaaaccttggatgaggaactagggtttcgatcttccaataggtattgataaagtcgattatggatactcaacgatgatctaaaggctctgatcaggacgatcgaatccctcctaatcactaaaccactcttcgattggttatcaaccgagccgaaatattactgacctcctcgataagactatctcttacaagcaaatcgagaatacaagcaagtgagtggaagaagcaatctgaaaaatttatgaatataagacgaatctcacaagttggatttcacaaaccgaagcagcgtgaaactgcaatgccataataatataagcaaatctaaccataattcggagacaactactaaataaataagttatatagtcgaccaagaagccctggacgagtctctaatggactccaacacgatacacaacatgttaagacggtgacgtgacactcgtatagattctatatgctctcttgtttcgacgattcatgttgacttagaaggaattttgatgtgagacaaggctcattcgaaagttggtctcattatctttccatacataatggaatccgaatgagatctgggtgacgattttagtgcgggttgctcttggattctgaggtgggcttgaacttgatatgaattaggcctctatttttcaagtctcttttcaagtgcttcttgtttctcctttgtacgtaccgaaagagtgatgttctcatcaatcttaataggaaaaaactggacgaaaatcataactagaacaaactcacaactaacctaaactattgtgccacggaaatagaaatagtcaggttcactaagcaaatgatgttcatcaccaaatttgcaaaattagcgagctaggagatcaaactatagtcatcgattagtagataccaacggtgatacaagctctcctaattcatgtcgttgtgttatctatctccaatcaattttcatggaaataaaatggataagaatcataccattgcaaaattcctacgctctacgcaaatctcgtgtcatataggtactccttccattccaaaataaattatcctaatatgaaatgcgatgatttctaatataacgaatgtatccagattcatcgtaataggataccacatctcgtattcgatcatcgatggcagcagcatcatgtcatatgctacgaaatatattttggttgcattcgttgatggaagagaaatgccactaaaaggggagagagaaaaaaaaggaaagcacgaattttgcacagctaaatgggccagcccgaaaccgtttatactgggccgcaacgtctagagtgcggcccacgaaaaggatggccacactggctcgcctcaaggaagcccggccgcggagagcatcgcgtcccaccccccaccgccgcggcggcgatggccgccgccgccgccgccaccgcgcgctcctcggtggcgccgcacgcatcgcccacccttcgccgctcgggctcatcaggtaccttgccccccccccctctcccacctcatcacgacatcaccctcatcactgtttcatagttatatgatttggggatccccacagatccggctgcctgtttggcggcgagatttttctagctccaagagagaatgccagccacgaatcgtgcgtgatccgcccgccgccttctgtgccgtgcggttgcataaactagtatactgatgatgatgatgatgatgatgatgatgatgatgatgatgcggcactttcgggcttagtggggtgttgcgatgcaaaaaaaggcagttctgtcggcttggcaactttgcgtggcgagattagtaaatcaagggcatgtttttttttgtttcgatcatctagcctttttaggtagtggagaagctatgtctcggtgtttatggaatttcctaaaaccgatgctacagctttgcagcatgctggatggtgggcgttgtgatgcaaaaacgattccgttggcttggaaattggaatagtgaaattaactgagtaactgatgagcaaggcatgtctgtttctgatcataagctttttagatagagaaaaatacaggttgggatttttgagatgaagatcttcttggaccgatgttagcgcttcggaacatgctgttaagacgagctctgaagaaattagagtccattgatgagtcctatttagtgtgagttacctttcgtaacttccctcttttaaacactgaggtgatgcctgtggtcaggctcttattttgagctgttttctgggcaattagaaagcccaagcattgatgataagattgatacatgaggctatttgatattaaatgccatctgagcacttgagcagtagctgaacaagatgtgattttgtcgagggaatatgtagtgaatccaactgaccattagaccagaactctgaagtacttttgggtacttaaaatttaagaaaaataaacaaaagctggaaatcatctggtagtaatactcctgaagcatgttctgcatttttccgagctttgtcatagctgctaagagttatatcctctcgataacttatcttgcatgaggcacaaaatgtgcttgaaatgattcgcgtatccatcgttctttccctttcatagctttagtcatatcagatttggtattgcaacaattaaaccttctcaaggattggatgatgatggagagtgtggtcgatgaccaagataaggagcaaagaaaacaagccaggtctggagagaaaaaatgtagggtagagaaatgttgtaatttatatattagacctgaatttttcacctgtcgacatttttcatgttcattcaagctactgtcatagtttgtttggattctgcatcaacaaatatctctacagctttttgatgcatccataaatatcgccagtctcctcttaagtgatgctttcactttgatatggccacataggatagctctatatgagaaatattggggatttaaaacttttaatatacagaagtgattagttcatgctaatccttctatttcagttcaatcgtggactgttgtcagtagagaaaataaccaggattgccccttctgtttacgacttcacagcattctaaataggttcaggcgacagacaggtgcaatagacagcgacaactaaacagaagcctaccagtcttctcttatccttacgaccttacaagtcatggccggtaattatgatttatggaggtgattattcatgattactcataagggaatagaaaaataaaatcacatgggtcatagcatttatctggtggaaaattgactgcattcttgttagtacaagtagagacttgaccaactattcatcatgtattttggctgtttcagtggatcgctgcacttcctgagagttcttttaaagatattaccgtctctctcaacgcttaccggaattgcagattcgatctatttgcttcgactgcaaaagcaggtatgtgaaccttatccccaagatatagaagttagcaatggcataagttcctctctctttgttatcaaaaacatgtcattcttttggagtacatgcatatcaagatattgaaacctaaatcatttatcaggctagagctgcggctgggtgcatcccatccactcatttttcagtggccatgctagcctgctagggatcacattgggaagggaaacaatcaaataatccgcggtggtctcagctcagctgcatgtgtggaggacaagcaaatcgccaataacacaccacatggggcaacatcgcgcagacatggcatggaccctgcttgccatctacccctcaccgtttcaatgcaccagagttacagcggcagcaaggaggcccccccattgcaattgaaatggccacatgtggagactgccatatgtttccatcagagatgatctctcagttacagtaagacacatccaatttcgacttgttaccctgatgaaggaacaagaagaagagaaagaagtgagtgtggcagacagagacagcagcaacccgggcagacagctccacgcacatttcacacaaaagtccacactccaaacagctccgtgtgcagcagcagcaagcagcaggccagcagcttccttggtcagatttttccatctcgtccaattccatcgcgttcagtttactgaactttcgactgctacttcggttcaggctttgtttcgacgccctatcggacctttgactgacgtgcttgcttgttaggtcgttcagaacactgcaactactgtatcgtcacgtcgggttttcgcttcgcttgcacctcagctaagaatgatcatagcttcatctgtagttacctaaattaccgaactgtaaatttcatgagattgcaggttcttcgacagtaaaattatcaaatttgtacggttggaaggattttcagttaattaacttataatgttacgcacgaaattttcactgagcattgacggtgctggctcacatgctatctgacaaggtggtcctgctatcaatttgctataaagttacaactaatgtcatgtcgtcatgtgttagcattgttattcttttcgcattttgcttgtatgttcatcctcgattggtgctcaaagccaatcaagcagttcaaagttacaataagggctcctctgaatgcaaggataggagaaacataggattgacagaaatataagtgtaaaataaaaggctacaaatcacaaaaaaggaaaaacaaagatagcgcttggttagatggcatgaaaatgcaggattttgaggagagatcaaaatgaaactacccatgaggttggacctcaatattaaatttcctcaaaacctgcgtggattgaatcatttcatatatatttcataattctatattgtccagcctttgtttctaaggatcatttagaaaaaaaaatatagaacaaaaatcctacaaaatttctatgttcatagttcaaatgaaaggggtttacgggtattttctcaagggtactaggcaaggactaggtattttctctactaagctttttttctcatgtctatttgagatctcctattatatgtgttcaataagggattttttttttactcttagccatcctccctaacaacgtgttctcaaatgccatccttccaaacaactttaattatttaccatccgggcccactaggctattgctattttgccacttttgattggtagctcagcaaaccgggtgacaaaagacttcctagccccttatctcctttttcataccttcttccttggcagtccttcccctttcctcatgtcagcgagttggcctaattctagcaaggtcctgcaagctggcgatggaggtgagctcggagacatagtcggtcgggcttcgcggacccaccgggatagggaggatgttgttgttgctggtggttcaccacccaccccgtcccaacaagctccttgtcgatggaggcgacgataaccgacgagcttagatacacggctggtagggcttcacggtgccgccgggatggggaggtggatgttgctgtcagtccactaatgagctctctctatctctctctctctctctctctctctcgctcgtccgagcatgacaatgaaggaggcgtggatgtcgggaagtctctagcaatccaaacctccatccgtcgcctctaaggtcttccacccagtcatccatcgccgctgtctctgtcgatggttgccacccgtaggatccaacatggtggccggccttgcatcccagctccacaaaggggaatggtggcgacgacgatatgacgggggaggagtggagggagaagaacgggtacagttcgtaggcgggaagctcgccggtgtgtaagaccttgccggagccaaggcagctcgcgaaccaaaggaagtgagttggaagaaagataggagagatgagataatgggtgaggtcttttgttacccagtttgctaagttagcaattaaaagtgacaaaatagcaatagtctagtgggcccagatggcaaataatcaaggttatttggaaagatggtatttgagaatactccattgggaaggatggcaaagagtcagaagccctgtttaacgagcacaatatcgactattagtagcaaatacttcctccgtatcattttaagtgtagctgtggttgccgtgtccaatgtatgagtgctcgtcttatttgaaaattttatgaaaaattaaaaacaaataatttgcgcataaagtattgatcatgttttattatctaataacaataagaatactaatcataaaaaataaaataagatggacagtcaaacattatatacgaaaatccataactgcacttaaaatgggacggaggaagtagtgaggtcgtcagtttccaattacgtgcaaaccataaatatggtgtgcagtggcaactgagccagttcatatctgttcatggttctttctattaggagggaagaggtacatatacacatttttttttagcacgcccatttttctaacctaccatagagttgtaaacctcatctcatctagaacatcacaaaaaattttaaagcattgctctagaggtacaaaatgaagctacttcttcacattcccaatcctcacaatcaaccgtaatcattctccatttaactttttcatctacttttccttctcaatcaatcataatatttctccaatcgtttttacttgctttcttaatactcattcctacttaaaaatgcttaaataggatgaaggtactcctagcctcctagatattgtaaacttaaataggatagaggtattcctagcctcctactagtagatattgtaccttgttaacttcgttcgacactcgtttaattgctaaacaatgcttactgaaaacattaaaactccacacatcagtttactaagaaacgtcgccaccaagctcgatcaatgacggcgaccggacaggctgaaaaattgaaaatacggttaactggtaccgatacatccatgtgcatgtggtctcattctttgctctagcaacccaaaaagaattcatggataaggatttgtattcatatttttgtgatccaaaaactgatacggataaataactgtgataagaaaaagcttaaaatttattcaaatgtttaaatcctagataatatggataagccaaaaagttaaatagggtaggcatgtcttcaaatacttctaccagtacataggagtagcaggagtaggagtaggagtacattctagactgcgaggaatacaaaacgtcacgtgtggttaatccctcctaaccatgtcaacgcgaggagagccgggtcagcccaaccaaccaacccaacccaccaccgccttcaccctcacccacaccacccacacgccccccgccgctacgcaaccttacgcctatggcagctggggcccacgtatccgcgggaccaccatgtcagtgaccgggggtcatgggtactccagcttcgtgcggcagcgcgcacgaaggcgtggggtgtggtggtgggcccggctcctggtaggtgagctggatccagcgcggcggggcgggggcggaggcggcatcgggatcggcgatgattacacagatgaatgcgacgctattggatttgctagtttcgaaatgtttgattttttcttatttaaaaaatttaggtaattattaattattttcatatcatttgatttattgttaaatatatttttatgtaggcatacaattttacatatttcataaaagtttttgaataagacgaacggttaaacatgtgctaaaaagtcaacggtgtcgaacatttcgaaacggagggagaacgttttttttttgagagagattttgggcgcggggcatatgtggtattgctcgtggcaagaacagaggggggtttgggttccgagggataggggggcacagagcttgtgagcgcaggggatgggggatgagaaatgggagtatcgtgcacgagcactactactgccgccgcggccgttgtgatgatccgatgacgtcgtcggccactgttcatgtatttcctctatctatatattttaaatatattttaatgtatgatgccgttgactttttatccaacgtgtaaccattcgtcttattaaaaaattgatgtaactatcatttattttattgtgacttaattcatcatcagatattttttaagcatgacataaatattcccatatttacacaaaaattttgaataaaatgaatggtcaaacgttgataaaaagttaacagcgtcatacattaaaatacagagggagtacttagtacctccgccctaaaataaggctgtgtttagataaaagggttgtaaaattttatagtgttgtatcggatatttggaaatatatttaaagtattaaacgtaatctgataataaaacaaattatataatccacctgtaaaccgtgagatgaatttattaagcctaattaattcatcattagcaaatatttactgtagcactacattatcaaatcatgacgcaactaggcttaaaaaattcatctcggaatttacacacaatctgtgtaacatatatatatatatatatatatatatatacacccctccctcctgtcgcccctctctccctcctccctcccccagcgccccctccctccgattccccctccttttttctctccctccttcttctctcttttttagaaaaattaaaaataaattggtgaattcaagacttgaaccaatgatctcatggtttatgacaagcacttctaaccaaatcaccatatgatgatttgtgaacaaatcagttatgtacctataacaatcataccttgttactatgattcggcagtaacattatcccagaaatatagtaacatcatatgttactggaaaaatgtataggttgttactgcacttttggcagtaacaatatgacgaaatttatagtaaacagagaacatgcatagtaacagtggccctatagtagtaatgtttttttagatctagagtattttaaatctcaatatttagagagtactaacatacacgttatgtcttatttttctaacccatttgcatcatggcattcgtcaaaaaaagtgcttaacgaaactagaaccatcataactattttttaacattgttacagcgaaaagcagaggtgttactgcatattggccatcatgttactacgctgtttcagtgagatgaggactaaaaaaaggtaaatctcaatctttagagagcaatatctctcacatcatatcttgtattttcaatccgtttgcaccatgaagttcataaaaaaacgcttaacgaaacaagatccatcatagctactttttgacgttgttactgcgataatgtggtcttgttactgcacgatgaccatcctattactgcacgattcctgcaagacgagagcagcaaagtggtgggcgggggagggagtggtgggcgggtttgaccggtgggaggacgctttgaccgacgtgggaggggggctttgggccctaggaagggtggggggaggtgggtttgacccatgggaggggggtgtagaatagattttatatatatatatatatatatataatacttcgtgcatgtatccaaacattcgatgggatatggtgtaaaattttgctaggggatctaaacaggccttaaagcaacttactccctccattaaaaaacaacttataagtagatgatgatttgacaccacctaaaataatgaatccaagtttattatcctaggttgatttttcttaatgcagagattaaaaggtagtacctcatccacccgaaaatgtaaacattttttaggttggcacgggtattaactaaggaagtatgtgagaatgattgaagggaatatgtgattagttaaaaagaaaaagtaggtaaaggataatggttgtgattggttgagagtaggagatagatgaagaaatagcttcattttgggacaaagtactatgctagaaataactacatattaggatgaagatagtactacgaatttgaacctcttattccctccgtactcgtaaaggaaatcgttcgatatggtctccaaaatataactttgactacttgtttctataaaaatatttattaaaaagtaatatatgtatacttttatgaaaatatttttcaagacaaatctattcatataattacatcttcaaactcaacaacttgatagttattcataatttatattcccaaagtttgacttaaacattgtcctaaacgacttccttcctgtacgagtacggagggagtactgttaaactcattgttagcaccgtacctctaatactccttgttaacagttctatgcatgtgttacacattcaggtgttaaaaacaacaacagtcctaagacacataccatggacgattcttttgagatcaagctagtaaagctttcgcctgcagattaacgtggaacaagggtaaatatatgaggcaaataatatgactggcatccatgcaaacgcttccttatcattaaaaaaacaattaattggctctaaaaaagttactacaagcttcaaaaagaaatagtataaaataaaacatagtactccagagatgttttatctaaaagaaagatctttgcattatcagagatgttttatctaaaacaacatcagatatgtcgctgtggctcgatggttatacagagaaattcgttgactaaattagcagttctttttctaagtctgacggcgcttaagcggatagaattgatagttccttcgttaccaactgatgtactttgacacatttgatttcactattcgtattttttctacctcctccatttaaaaattactttacacgtcttaaaatactgtaatctatatcttatgtccggttttataatattaaaacggaggtattttagataactccctctatttcaatttcgtatattattttattcgttgcaaggctaatttgttttggaggaataaatttgtattttgtcatataagattaatgatgaaaaatagtactccctcatttttcaaattataattcgtttgactttcttcctagttaaacttctttaagttttatttttttatagaaaaatatagtagtattttcaacacaaaactaatttgagatttaatgaaactaatttgatattttagatgttgctaatttttttataaactttcaaatttaacaaagtttaattaggaaaaaagttaaacaacttataatataatatgaaacggaggaactactagccaagtttgcatggttgaatcaacattttgattattttacagggcatcttgaactgctaacaacgatacgaaaactttaaacatacactattatttttagttgcattttttatttttccatgccttattagccgtagctcaaatgacatgtgtgtcgacgtttaatgtctcgactacggtatttgcatggcatgggaatcgttggtactagggtatacgtgagactgaggtaaaagagatggagacaatgatttttatacaggttcgggcccctgaattgtcaggtaataaccctacatcctgttggccgaagccgatattgctcttattcatgataatcacaccagtataatatttggggtagcctatctaactgttgtcgacttggcggtctgaagttctgactcgtagtcgacaacagggtagccttcctcctcgaatccgtgcccggcgagatcagagatagcgctttcgtctctcctgacagtatccggagacaccgtagggtactagccgtgcttatccctgaagtcgatatccggtggcgtgtcttggcgtatgtaggcttctatattgtggcttctatgtcgattgtgttgggtgttgatcctgtcccctctcttcctaggggggcttgtatttatacccataggtgtccccttgtccaagtagaactagggaaaccaatatagatacaatccgagtagtcattgtcgtttccatgtagaactctggttgtctttccttatccggaactcctcctatatccgaacgttgcttccgtataggacatggtacgtagtgggtcctaccgagatttagtcaactactattaggtatgtggtatccataaccctgacagtagcctccgacttcaatgcaaatgaacgagttcatattctcaaccgcagaccttggaggaactgttatcgagcgcacatgaccattctcggtgagtgtagagataacattagacttcctttatcagcctcgtgtgggtacctaaagggttagtctgagtcaatctccgacgtcaaccaagaaagaacagagcatgcgactaagtctcccgtcttgctgtaatcgagaatttggattgaagtcaagaaattttatctcggtgggtacaccatctcttcatttcgtattccttgttgagatacatcaaccgttctcgagtgatcgagaaagcgcagaatctgcgacggagctttgtcgacatttgtcgtactcgccttagtcgatcttggtgtagaaccatagagacatggagccttcgtcaatgtcgaatagaattttcctgaaatcaatactctgaaaagaatattagatagaaatagccctcgagcgaacgctcaaagggtaacatgttataatataacagactagtgaattgaatgtacagaccagtgttttgtatatgagcgtcttctctcttaccgactccgaccagtcagtttgtagagtcatacactctccctagcccccagccttgtcgtcggagaatcgttctcggatgatgaggctcttggacctttgacctgcctcggttgaacaagcactgatcctagcccccagccgtgaagttgaaaaatccaatttccgattacacggcttggttaatacgcacggcgagaactcttacacgaccagatcttacatggtcttttgtctttaaaggatccgataaggccttatcggctctgggcgtccccagccgaagttcccttaggttcctcggaggccttgtcaagacggcgtaaagggacattaggataggtttcaacgctaggtgtcttctgtggtaagggatctctgggtaaaacacttggcaatattgtgtacatgatatcaactttgttgaagtagaggtaatgggagaatcgctacacctctggtcaagaaccaggtagtagtcgtaactcaaccactagaagtaaatgtacgagagatcgctacgattgactggttgagaaccagtgagtaggtgtctctcgatcatttgaagtcgtggaagtttgcggtgcgggagattgctatgtactggttcgagaaccagcgagcgagtagaatcatctctcgaacaccaatggaagttgcggtgcgggagattgctacgtactggttcgagaaccagcgaacgagtagaattatctctcgaacatcgatggaagttgcggtgcgagagattgctacatactggttcgagaaccagcgagcaagtagaattatctctcgaacaccaatggaagttgcggtgcgagagagtgctacgtactggttcgaggaccagcgaacgagtagaattatctctcgaataccaatggaagttgcggtgcgagagattgctacgtattggttcgagaaccagcaagcgagtagaattatctctcgaacaccaatggaggtgctagagttggtttattgcatgtgcgtctcatatggctagcatgactcacgcacccaacttgtagcatatccggatgtccgttcgcaatcatgtcgggtgatcaagccgacgatgttcgcgaggaattatccgttaacaaccttttctcaagtagtccagcgattgctgtgttaacaaccaaatttggtaatatcagcatcggaagtgaagatgggatcgaagtggagtcggagataaggattgttgtgggaacatagtaaggatcggctggagtccagatcggctacgactataatcggctaagtctgaatcagactgggttaggtgatacagccgattccgacgatacgacttgtatccgatattgggtttgagttgacgtgcttcaagatgattgtcatatatggatggagtcctgagaaggcaattgtatctattaattaggatgttttgtgtaatttccttagagatatgtttagggcaaaagtctgccgcaaagacttatggtatcttagagtttgttagagataatagtcgtgtctggtatggacatatcttgtaattctcgggtataaatagaccccaagccctatgtaaattttaacacacacgttcaatacaatttcggcgcatcgccacctttttgctttagttttatttcgacgagttcttgctttcgggttgagctgcatcggtttcgatcttcaacaagaggtaaaacttgttatgatggattgtgttctcgggattagtgcttccatctttacgacactctagtcttgtatatgtaattcgtcaagttatcatatatcttacataatcttcgacaatatcgtcatctaacctacaatcggctaacatatgtcgacagaaggcagccgactaggttaaatagcgacgttgacctagattatataagatatctagcactttatgaaacatccagcggcttgattgtctagatattgttcttctttcttcttttcatacttaatgctgcatcagttaggtttgatctattaagtcatgcttagaatttcaatctctagcctgccttctggttgccgattagggtagtatcggagtttcagccgatcttatctgatttaactacttttatcttatatgctcgattgatatgttagatcttccctttatattaagatcttgctgcgtttaagtatattaagctcctgtttaatgtattctacttgctttaatatcttaatatagagtggtatcggagtattagccgatacatgctagatctatctgatcggctatgctatgaacatatataatcctattattaatatatatttccatctaagtgatttatactatctcggcaaggtgaccgatctatcccaaccacttgatttaagtatatatcgatataaggattacatatgattaatatctacagccgatcgagtagatttagttctgatttgtttactaatacttgccgatcgatgtacatatgacatcggcataagataaatggtatgtcatcggcatctagccgatcggctatcatttatagatttaaccacgaattctttgtctctatttcttgttgattacaggatcaaatcaactggcacgctcatacatccgaaggcgagctttggacctgcacaggagttaagcagatctcctaggcctcgtgttttctgtcaacaggccggcgctatgagatagttcgtcggtcttcgttggtgggttgggcgcgacgattctgcatttgtcgagatcgttctcgataatatggtgtacttgaccacagcctactcgagtgctcaattgttcctgaaaaatattttctagaagacaagacatatatcagataatatcgagtatgtactcaaaaactacatggatcttctagcattatcaggatatgacgagcagatataaatatcaggcattatgtaaaccgtaagcaagcatgatttatacgaaagaaaatagagcgagcccccagcattaaactgtagtcgatttaacattggggacactcgcgcaataggtattgtataaaaaacatgtaataggtaaacataataaattatagatctgacaatattgtatgatctgagtaggtacgataaattgtatataaaatattgcgtacctgtgaagatacatgccggatgtatctacggaattagtagatcaattaaaaattaatcttactaaataccttgtttagccttggtagccgatcttaactgtactctgaacgcacaataattagcatatatcggtggcctgcatgggccccacggtatgcatgctaatatttttgtagatggcgatgcgatcggtcggctggttggttctaatacggcaaattgtctggcttcgacatcctttgctgcggtggggttagtcgaaccatggtgaagcaccacgactgacaaccctaaaatcgacgtgatccgcggtggtgacgtcttgaagcttggtcgatctcgagagatcgaattgttgatgacgatggttccgatattgtcggaagacatactccggtcgtgttagatctccacagccgaagtcgtcgagtagcttgttgtcggagaatccatctcttaaacccatctcgtcgaaaccttgaagcaccaaaatgcccctacgtggcgcgttactgtcgacgtttgatgtctcgactacggtatttgcatggcatggggatcgttggtactagggtatacgcgagactgaggtaaaagagatggagacagggatttttatacaggttcgggcccctgaattatcaggtaataaccctacattctgttggccgaagccggtattgctcttattcatgataatcacatcagtataatatttggggtagcctatctaactgtcgtcgacttggcggtctgaagttctgactcgtagtcgacaacagggtagccttcctcctcgaatccgtgcccggcgaaatcagagatagcgcttttgtctctcctaacagtatccggagacaccgtagggtactagccatgcttatccctgaagtcgatatccggcggcgtgtcttggcgtatgtagacttctatgttgtggcttctatgtcgattgtgttgggtgttgatcctatcccctctcctcctagggggcttgtatttatacccataggtgtccccttgtccaagtagaactagtgaaactaatatggatacaatccgagtagtcattgtcatttccatgtagaactctggttgtctatccttatccggaactcctcctatatccgaaggttgcttccgtataggacatggtatgtagtgggtcctgtcgagatttaatcaactactattaggtatgtggtatccataaccctgacaatgtgtaatactcaagtgtgtctactgaggaagcggaacatatcggattttctttcagcagtggaatacattctgatagtactctctccagtcataaggtttttgacatttagtcatttacaatagcttttactcaaacttttacaatcaataacttcgtatagttttaaactaactagaaaaaatatccatacgttgcaacgggtaaaaacgtattttcactgatatattaagagctaagcaataaattgaaatattaggatcgctatatacattataattgaaaaagttaatgagaatcctaacattgggatcactaacattgggatcactatagattataattaaaaaagttaatgaaaatatttcctgggtttagggtcaatagccttcctttatttttagccctaggcaagtccgctacctcattctgtttgtttggcctgcttcccttcgacccaaccataagtggagtcgaagcgcagctcaaagtctactaccatattcggccagtacgctacctccctccgtttggcctgtttcccttcgacccagccacaagtggagccgtaaactcaactcgcacagtctactactatctttggccagtccgttacttccctccgtttggcctacttcccttcgacccagccacaagtggagccgtaagcgcagctcgcacagtctactaccattgtcaatctcccgaagatagtcccgtggccgtacggttgccggagcaaatctctccccatcaaatctggtcgaatctttcccgatcacattttggttgagggtttttaattcactcgatcttctctttccgttttttccaaaatcagtgtaaaactctcccccatcaaatctgaccgattctttctcgatcaaccaaaattagttcagggtttttgatccactcgatctcctctttccgttttttttccaaaattagagtgtaaaacttggcataaaaacgtccggggaagatcaccgtcatcatcggcaattgttaaatggagattaaatccgatgaattaagaccgaatcgaaagggaaaataatggagaaaatgatggcggaggagtggggaatcgatttttgcaatcaaattggaggagaaatgtacaatcgatatggcggcggcgcagcacggcgctagggttcaaactcgggaggcgtgcggtgaacagatcgtgttaaaaaaccagatgaaaaaaaaccaaaaacacacgggagaaaaaaccggcgtccgaaaaaccaagcgccgggaggcgccaatagattaaaaaacggacgaaaaaaccaagcgcatgtgaaaaaaactccttcgcgtgcaaaaaaaaaaaagggaaaaaatgcctgtgccaaataaccaaatggacttttttttttccaaacggacttattaaaaaaaggttttttttcgatcagatgttttttctttatattttaccgagacagaagctctttttatcgcttttgaatcggactttttttttacctcattgagttcgacttttttttcctcttttaacagacaattgaaatttaagtagtatagataacataaaattaaaaaatcaactcaaacacgaatgacgtatcaaagtaccggcaaaaaaacatctttaatttttataatagtagagatataaatcgtacgcatgtatcttttgtcttgaaaagtataattattattatgtcattaacttactgaatttatataatacaaaattaaccaaagtttcaaaacatggatatattataatatgtggaatacatttttttctattttacgtaaataaaagaaaataaaaataatatgtgccctattttccgttcatcatcttttccccttgttccctccgttttctacggaagtgaaacgtggcgccatatcctgcggtgccttctccgctgttgcgtgtggaacggctcggacgggatccccattcctacacgaatggcgttatcgtcattacgataaaaacggaggggtgatcgggaaaccctctgggcctctccacgtcgtcgccgttacttcgaggcggtttcccttttttgtcagcgtccaaaaaatgagaagcccgcgctcttcgccttttgcagtaacgccccccgtcttatacaagattttcactatgaaccgtgagaaaagtcaaaaccccagtcccccgttcggagaaaagactcaatgaatccgttacttttttaaaaaatacgacaagtgtcagtcatttgtgtatcagactttttgtgaaataaaattatgccgcaccatgttttctatgtgtttattagttacttaaaaaaatgctcgtgtgttgcaactggtgaaatttattttaatcttattattattatatggtttaattaaaatgaaatttaccgtcggagtttgcttggatatatatatttttagaaaatcatgagctacagttaggagcccgatcgtttcaagttagtatgcgagtttttttaaacagatttcttatatgattccttctgtattatcaaaagtgaacaatattaaaaaccaattcaaatgcgaatatgtatttccaaaagcaaacgaacttaaaaaccgactcatacatggatgacgtaccaaaataccggtaaaaatatattcaatttttataataatagagatagagataggttgctcttaatgaattttactgattcggtaagtgttttttacataaaacatggttataaatttaatagactttaacttttttttttttgaaaagagactttttaacatttagtttactttagattcttttattgggtctctttctcttttaactctagtaactccttcagtatagaggacatggtagcgtctagaattgttcatagattgggccaaaaaatgcttaatttgtatagtataaacaaattagcccaaaccattcttttcactttcgttgttttgggctcaacaaaacccgtttaacatgtcttgttattcacaacatcccatgacgcggttgcattccctcaacgtcatgcctcaatgagtcccaacgttattatcccatagcaactatttccccgcgcttgacgagacctcaacgtttgcggcatcgcgctcgatgagtccaatcgatgattctattcctgcgctgatgagggctatacctctaagagtgatgtccctatacattcaggctgtgtttagatccaaagtttggatccaaacttcagtccttttctatcacatcaacctgtcatacacataacttttcagtcacatcatctctaatttcaaccaaaatccaaactttgcgcttaactaaacacaaactttacgcttaactaaacacagcctcaacaacctgcatgcctatgttcacgtggctcgatctgatggaacttcccacacatatagtgatccccgaatgcatgacgactattcctatcccctgccatggccttttgctacttctatgctctattcctttctcgtgtacaaatgaaggagcatgtacatgatttaactgatgcggtatatatacatgacagaactggttattcatgaggcggaagtattatgtgttatggttaggttcagttgagggtggttcttgcattaaagcaataaatggacacaacatgttagatacaaatctgatgaccgttcaaaattctacagactcgtagatataaacatgtcacctataccgtgtaaatggttcctaaaaatttatcttatccgtttcataatataagactttctagcattacccacaatcatctatcatctataatgttacgtcatagatgaatatggataatactaaaaagtcatatattatagaacggagggagtacttgttttcatccatatcgacaacatattctggtagcttccattccatgttatcgaaattttccgggcaaaacatattcccctatttttagcctccaagaacaaaatggtcacaacttgtaaataaacaaaagagcaagccccactccgcaaaacacacctctcctctccttccctcatattttaaccattccacccctcacaaatctcactatttacttacctttactccgccgaataaaaccaaccaacccaccctcctcctccctcgcccgcctcttattttttcttttctctcccccaaatctgatcccctcccacacgcaacacgcgaggccgcgtctagggttagggttcccctccccttcggccatggacgagctcgcggcggcgtcggcggcggcgaggaggaggtgggtgcagtgggaggaggtcgtggtgtcgaacgaccgggggaggcgcctcgtgcactactacctccggggagcggccgcgggcggcggaggagggggagaggtgagggagcttgcggtggtggggcgggagcggagcccgcggcacatgtcgtacgtggtgcaggggcggttcctgcggtcgctggcggcggcgggggtgggggtgggggtgggggtgggggcggcggtgggggcggtggtggcagtgccgtcgccgtcacggtcgccgctgccggcttccgcggagggcggggcgccgaggaaatggaggtcgaggcgggaggtcgtggactggctgtcctccctcgtttccggtaagatttgtgtggttttttttttttacgcctgggcggtcgattcgggtggtgttgtgcaggattttgtgttgttttgtgtgcgtttgcggctgttttgttctttcgcgtgttgtggtttgttttttctgtgttatatggtggctgatttgggaatcgtttttctgaatgttacggggtcctattccagactgcgcgcagatgcggtttgggcatatgtttttccctgtttctgtttggttcaatttgttcagggaatagcgtttttttggatttctataccaaaagaggctgtggtttctgattttctgacgattcgacccgaattcgcaaatagcgttttggatttctctaccaaaagcggtttgtggtttctgattttccgacgattcgacatgaacttgcaagattgtttggcctttagataggcggattgatttgttcccgtgaatcttttgtataacccatgcgtgttaatggagcggatctgatttctaccgtattaggtctatcagggcaggaattcaactttgcatccttttgttctctctgttgcgaggagttcatttctggattcgttgggttcaatctgctgcggcgcccttctcacctgattcgtgaggaggtagacagcttgttcgtatctcgtggttataggagaagagtacaaacgtttgcgataacccatccgcttatggtcgattgttgtatattagaaacttgttgctttgaacccggatttagctattgttcctttctattggaggggtttgattctgtttctatttggagggggaaatatgttctatttagagggcaaagattgacaatttttttcctccaaaggcaccttttttacgatataaccctcttatgacctgcctatgatttgattcggttagacatatcttatgtcagtattggaacacttatgctagttctagagttctttttttgtcaaaataactaatttatatgagttgccttgcggtttattctagaaagctaacaggattttatcataataagatgtataattcagtcttatattggtaacctgtaaatctcatgccttctccttttccataggattatggagaatacatgtgtgacccagtggaagccgctgcaggtttccctttttgggtcgattgtgtaagcatgcgttcggaaatatagagaaaatgaagcggcagcgtgagttgaaaggcaatcaggtgccattttgttcttcccttcttgtggcctcccacgagacacccatggaattaatccgtgtaaattgaatgcttccgtaatctgcccaacaatggtcaggaaatcctccaattagttctgtcgatgagcttttgtaggaactcttacggtgtgctgacgcatcaacttgtcaatgcttctgtttaaatatgaaacggccttacaaattagaagtcacctccaactctgtttgcttccaactgctcttggttttaaccttggtggtgtgcggctgtgcgtttcatcttcgatttttttttgtgttgttttcttcttgtgttgcctttattttttctgaatcacaagtgtgctactatgttttaaaccaatgttttgatgatactcctgttgcactgtcttgtatggtaaatttcttatgtctagtgcttcttttgcaggatgtaattacggatcttcttcaatgtctaataggttcaatgaaaatccatatgatgacattgagttcactgatgttgctgcttcaaaggtatagagctatttcaagataacttgcccttcatccttctagtatgtccaggatatatttctgaatttccccccattgctaattcattccatttttgtgtgcttaggatgtttcacatacatcatcagtaaggaataactcaaaagagttcacatggttaggtcctgcatggctttgcgaaaagcgatggaagcactacagatctttctgccgtaaggggattactatttcggtatgttacccactgatcattttcctgtattttgtgttgtcaccatgtgtaccactgagattttatcaaagaaatgaggacaacatgctgagatgaagtattgcagaacaataaactatgtagggttctaaatgaaactgcattatgaaaacctggaggagttttaggggaaaaagctatgacattctgttattgccctcctgtttggttttatacgttgtatttattagtactactgcacagtgatatgggagtatttcaaactattcaaaatagaagtttaaatgctaatacttgttattactctgaacctttgaaagggaaaccttggttgacacatgtttatgctatctttgtaggtgcataattttgtctacatcctgagtgaggaaaagaagaggctcatcgcccaagtggaggatctgtatgaagatactaattcaaccaacgttgtcatggtacgatggttcgacaaagttgatgaggttggtgtcgaattgccacctgatgttggtgacagagagattttcttttcccctggtctgcaagatctcagtgttgaatgcattgatggattggctgcagtcctgagtgctcaacacttcgagaagttccagagtagtccaaaacatagctattggcagccttatatttgtcgccgacagattgatgaagatggcgtcaaaccttttgatgtaacccaattgcaaggttattggagtcaagaagtgcttaggacaatgttcaatgcagcttcttctcttaaggtacgtttcaaggtcactaaaggtgcttctagttcagatggggcacaaaagaggaagcgtgatgcattcagtgaaaccgatccacagcagtgtgttccttccgctgcattcggttctgatagtctcaagaatgatttggaacataaaactcaaaagcagctatatcctggtagccgtgctgaagtcctatcacaggacagcggtataaggggctgctggtttagatgctttgtattaaagaggcgcggagacaaaatcaaggtgcgatatgaagatcttcaggatgctgatgagacaggaaatctggaggtgagcttagtgtaattctatataatctttttttccccactaaattggatctcagatcttacttgttacttaacctttgtttgcaggagtgggttttgctaacaaggattgctaaacctgatcagttgggtatacgcatccctgaaagaccaatggtgcggccatatcatgtacatagcaaggatccatgctctttcgatgctggttccattgttgatgcatggtggaatagtgggtggtgggaggggattgtattgcagcagggaaatgacagacgccttcaagtttattttcctggtaattacattcttaattaccatcaacatttcaatttgcctctgcatgacattttaataatgtagtttggagctactgaacttacatttgctttgttatttatcacaggagaaaagcagattgctgatttttgtgaagatgatttgaggcattcacgtgagtgggctggtggcaaatggaattccttgggggaaagaaaagatatcacacacctgttgccccccacttcagttcatgaagagggaggtttgcttagcaaacctgtttcacaagaaggcaatccctcttcaaaattagaatctgacaagaggtgtgatgacaaatcattgggcaccaagatttcacatgatcagaagcatcagaagcgtgttctggctgatctcacaaatgctctgaaattcgataacctgaaatggaggccaagaaagcggagcagaagatctggttccaaaaggcagtcagacactagcagtggcagtggcagcagcagccagggcgacatggaggagtccagcccctgcggaagttttgcagtgcttaattcagcgcccgatgaagaagtatgcaagagcagtggagaacctcttttcatgagggtttccaacctggtgatgtccagatgaagtcactccacgactgacatgttttagccttttctttccggatttcaacagccttggcgagatgtgagtttgatgcatccccaggttatttagtcacaactcacaactggtatcctgatcatcttgagagctctgaatgcttattcgctcggatgtccaggatgcaagcatggaggagcacactgttgtatttatgactgatctagatgagttttaccattttgtctcactttagggtcttgtagggtgttttaaccgtcttgttgtttagttggtgttacaaagatagctggctcattccacctcggcagtttccagagtcccttttttgtctttgtttcagcagtccaatatccaatttaatttgttcatcagctgttatagatgttcttatagtatactctctgaaatgataatatttacatcgtcatacgagttttttgttcttctgcctatgtggtgttatttgtgtgaatttattggtctataattgaaattgagtgtattgtcttcaatttctgctgcgtttttgagcctttgaatactagatgtggcggtaattgttggaagtcatgttggttggtgattatgtttgttgtcatgtttaaagtgtaccgatcttaccattttccaaccagctgtaccgacttcaccgggtcaaaattggcgccttagcgagctactgcttacattgcacttccgaaattctagttccattcgtgccttttctgtctgttttttcagacaactttgctctatggttttgccaggtccatggaacgcacaaactttttctagacgacattacgaagatagtagtatttgggacctgattccatccccgcgagggcatctcggcgaaggcaaaatgtccataggaaaaggttttatcatcacaaggaagaaaaggccaacgagaagcagctaaggaaaggaccaccattcgtgcaagccagccactgaatcccagccagcgtcgttgtgaggaccagaatccgattcgattccgacctccagcagcgtccaccatgacaccaacaccccccttccctcaaagcggccagaaaaatacaacggcgagccaccggcatcagcttagccccagctgccggccaccaccaccatttccccttttgcagattcttctaccgttctctcttctccggcgagccggaagccgacgaccggtcgtcgcgcgccgccgccaagtggacagacggtgttcatgagtggcaaggtgattatggtgaattggaagtgcagagggggaatggtgtggtgttttgttgtggagtaactgaagctgtgttcagttttctctgcagttctactgcatgaccgtcaggatgagcatcgactgcaatgggtgctaccagaggatcaggagggcactcctccagatgcaaggtgaaaaaccggaaaatccaccagagattaccaccataaatattccttttggtctttgatgatttgataatgctcagtacagaacgatagcaggggaacaaaaaaatgggcatcaggaacagcatattaagcagcaaaaaacatctatcaagattctcttgttgattgtatttatttactaaaacaagcagaactgcttacctacacattcaacattggttacctgattggctacaattgatgtcctttcgcatcaacaattttccgtgcaaaaaatgtggatttcatctcacatttttaccccctgtgtatgtatgtatgtatgcaagaagatctggatagccacctgatcgaccggaagcagcagcgggtgagcgtctgcggcgccttcgtgccgcaggacgtcgccatcaagctccgcaagaagaccaaccgccgcgtcgagatactggagatcaaggagatcgacgccggcgacggccaccggctgtgaagtcgccggcgtcgcacgagatgggacggcggcggcggccgtaggaaaattctttgtaaataaatcctgtatattatagcgtatatcatttgttttaatcagagccgataaacttattcagctaacccttttaacacaaagcgagaatggtacgattgcgaatcatgaggaaagtagagaatggccagctgcatgcctgcatcagtatctaagctttgagatgaagcattcatcctcccaaagcatccaggtgaggaaggcaagctctgcaagcgtaggaacatggccaattctgcttggagtgcagcttcaggaagggcctaagtagccccaaccatatgcacagaggtggtccaaagatatgcactctcccataccctaacaacataacagaaactgaactagctctacagattcggtaccgacgatgatctcgtcgcaattgcgatcacatgactgacgatactgcgaaaatgacacaaaacaatagcagaaagcgattgcgaaatcgcctcgagaactatcatatcgccataacacggtctttcactacaacagattggtaacatcgagtaccagacagattgattgctggtgagtgagataaatgtgcaaagaagagctttgcatggtggtgtagatcatcaagaacttgagtagcttctacctccatccaatccaccaacaattgtcagaattgctggtcagtcagggtttccttggagtgccattaaagtccgcagaggtggatggagaggagagaaactaaacctgctgatggcttacggccaagacagcaaatgtggccgcacaacacccccaccatttttatgagcttgaacaaccgtcctggctcctccttttgtcacacccagtgagggttctgcaagtgcttcttctccttttggctgagattgagcaaacatgggcatggcgatgaggtgcgtcttggtcctcttctccgtctcccccgtgctgctcctgttcaacttcgagatgctggaggttgctctccatctagcgagccgcgaaaaggagctcgacaccgctgcggtaaccccttctgccagtttgagcttcctctcgaggtttaggataatgctggggatgaaccatcatcggtcgcggggccgaaggcataagagatattcagaagctccagctccagctccagcaccagtcccagcccatcaagcaagatcagaagctcctgcccctcttgttcatgtgcctcgaaaaggaatgccgtcgactcatcgcagccacattgccccagctagaagcccggtgcacaaagtgaaagatggtggtcacaccaagatcccgagatccgccattgttgctctgggtgtggttggattatgcctagttgttcttggagttgtcatagcagcattctcagtcagaagatcaaggaagttcaagaaggtgtgtacaaaggcattcaaaccatttcgtcatggatcaagagatcaaaggtcacctgctgctaccaggaaggtcagttcccaccctagcccagatccacttacactaagttccatagtacagtaccaacagaaccttccaaaccttaaacaatcatctgaatcaaagagtctatccattcagagcactattccgatgggtacagaactaatagtaagtgatcatgctgtgataaacaactcacaatctgatgaggttgaatctttccattccataccttgctctgatttatcagctggctccattacagagttacctcagcaaatttgtgatagaagagctattatgaaccgatctgagtatttcctacaaacacatgattcaccatctgattcatcatatcaatccctttcaccagattgtacatctcgtttgtctccaaaggatcaaactttcactgcttccagtcacctcagtttgcgtagcaaaacttgtccagaaaaatcagatggtgaaaatgctgaaataaactgtcatgatggattggaaataacttgcatttctgggtccatggaacatcaagaagcccctatcgaagagcgggccagaatcaatttcaggaacccaccatcacaacacatcttccctccctcctatcgtacagatacctcacaatccaaaatcaacatagcatttactatgactaactcaaaggttgaatcaagttctaaggaatcatcaaggattgagacctccagttcaatgggtataccaaaaccggcaccgcctcctccaccgcaaaagaaccctcctccaaatctgaaagggcaatgctatggccagcctccaccaccacctccattgccacttcagatacaggttggtaaagatgggtctcccctaccaaggttgaaaccattgcactgggacaaagtaagggctgctccaaaccgctctatggtgtggaatgatataagatcaagttcatttgagttcgagtaaggctatcccccctcataattgtgttcatcacatttcctattcttattatgttttacaataaagctatgctatgcagatttgatgagcagatgatcaagtctttgttcgcatacaaccttcaagggtcaatgaaagatgaggaggctatgaacaaaaccgcatctaccaccaaacacgtcattgagcaccataggcttcaaaatactactatcttgttgaagacattaaatgcaaacaccagtcaagtttgcaattctgtaatacaaggtaggtttcatgatgttttaagtaattataagttatgattatcaagttaacaataataacaatcaacttatcctcatgtctcggctgactcaggtaatggattatctgtgcaacaacttgaagcgcttgtcaagatgaaaccgaccaaagaagaggaggaaaagttactaaattatgatggcgatattaacatgctagatccagcagaaaactttgtgaaggtgctactaacaataccaatggcattcccaaggatggaggtcatgctctacaaggaaaattttgatgacgaggtagctcacatcaaaatgtcctttgcaatgatcgaagtaagtggagtcattttgcatgacttgtttaggacatattctgttgtgcttatatatattgttttatttaatagggagcttgcactgaattgaagtcaagcaaactattcttaagattacttgaagcagtactcaagacaggaaacaggatgaatgtcggaacattaagaggaggtgcaagtgctttcaaactggatgcgcttctgaaattggcagatatacgtgggacagatgggaagacaaccctactgcactttgttgtaaaagagatggctcgttcaaaaggattaaaggctttagaaaagctcaatgaaacacccagctcttgtcatgacacaccaactgaacgagaggagtattcatcaatgggtacagaatttgtctctgagctaagtaatgaactaggcaacgtcaagaaggtagcaagcatagatctggataccttgcgaaactcaatatcaaatctatcctgtgggctggctcaactgagaaatcttgttgagaaggacctagccagtgatgacaagaacaataacttcttgcaatgcatgaaatccttcctaaatcatgcagagaatactatgcaggggctcaaagctgatgaagctcaagtcctactcaatgtcagggaactaacggagtactatcatggagaggtcagcaaggatgagtccaatctgctccaaatattcatcatcgtgaaagattttcttggtttgctggataaggtgtgccgagaaatgaggggcacaaagcataaccaaactctcaatttagtccttccactcaagtgaataggtatagattaaccaactggccactaacaaattgattgttttgcatgtgaatgtttgtataacgatgttagcattaagtgtttgacaagttgactgcttgtgtatgagagtgtttctttgggagtgttagaatggagatcagttagcattaattataaacagattgtttatgtggagtggtattggcatcacggattcaaaatggatttgtgtggcatgatttttcaggcagcttttcattttggttagaatattagtgaaataatgcagaaaatgttgctcttggtaccatatatgcaaatacaattatagtaaaataatgcagaaaatgtttgcaaatattacaaatcaccaatatgacaaaccaattccaaagccagtatgcaaacacaatttgagatggctcagatacacctagatttacatactagcttaatttgtgatctttagagttatttccaagattgtaccaatgctaccaagagtgttaatggaggttaggaaccttatgcaataaagtagttttctccacaaattcaggaatacatttggcttttagcatcatatagaacagaatctgaaggaacaacaactcatgaggggcgaaaaatataccgaattacgaaaaattataattaccaaactattctacagttatagcttattgctttccataacttaatagtatcatctctccaacagtacccaacattcagaaggaaaaatagtacaaacaaccgaaaagtaatacccgatgagtgattaaagatacaaaaatggtattcgacaatagacctccataggaatcaaactaatgattagcgaagatagttgaaacttccaaggaaatcttacaaagttaagctctcaggatcctcaataatctttgcaaaagtttgcaggaatgctgccagatcagcaccgtatacaattctgtgatcagcagtgacattaacctaaaaaaatgtagatccaccttagttgtttctatatacagaaatgtcattcaaataaatcgcagataagcattaacagttcaagacgtaagatatatctgtggtgcttcaaccctacttcctaccaatgaattgatattttttatgagaacaatgctcttaatatcaggtgggtaaataaaaagactggatggatcatgtatacatataaaggaatgatcatatcatatatgaaaatcatgatgtcaaccacctaccacacccaaccaccccaaattatacacatggggtaattcgtttatcactaagcagagctcctgcctttgccactggctatcagtaatacatggggtctgggagtaaatgataatgagaactcagcattaaaaccaaaactcatgctaaattagtagcttaagagagatggttcatccacttggtagacaaatatttcggttcaatgtgtgaatttgtgaatgatcttatatgactaagcaaacagacacaaaacatactagagacgtgcttctatgctcctcggaaaaaaatactgcacgaaaattaaagcacatcaatggttcggattaaaagatgattactagggtaaaccgtcattaacgagggccaatttcgtccaggaagtaaaatcccacatcagaccaggccaatcgcaccatcgatctgggaggttgacacggcaacagggctgggtggtgaagatcggccgggcatgtgcgaggaatgggagggcgacgagctgtgcggggcgttgtttggtgcccgccgtcggcgttgagacggattatatataggacgacgagagaggaccagttctcgatcgaagggcaacgccgcagtggggaggctgcaggggcggcagaccagatggagcatggccggttcatgccacgcgcatccactacggccgccgttcatgatcatgattacgcaaactcccggccaaataaaagcttcttttgattcagtgttctcctgttctttgtactggcgaaaccttgatagaaatcccaactgttctcctgttttttgattcaatgtttttcgtccttgatagaggcggctgggtatggatatggaattttacttcctggacgaaattgcccctcgctaatgaggtttaccctgttaatcactttttaatccagaccattgatgcgctttaatttgtgtgcagctttttttattgaggagcacagaagcacttcccaacatactaatataacaatcactaatttccagtattggctgaaaaattgcatgtgtgaagggcaactaaccagcattttgctcttgacactaaagaaaccatctttatcagccaccactgtaggttttgaggctccgacagccattatgcctccctgtattcatacacactcaaatacttaggccatataccagtaaaggaaccacatcaatatttagcatcaagcagattaggagaaagagaacctcacctggccaggtggaagaattgcatcaaatctatcaacaccaaacatacccaagtttgacagtgtaaatgtccctgcagaccaccaattcttcaggtaagtacaattttcacatgtttttcaacaacgatctacaagactgaaacatcaggttccataccagagctgtactcatttggttggagctgttttgcacgagctttcttgactagttccttccatttttgtgagagcaaatatatatccaactgcatcatgccattgctcaagctattcagtgaactcatatgattcaattcctaaatgaaacgacattaaacacacagatatcctgtaccttatcagcatcctccagaacaggtgtaatgagcccaccatcgattgcgacagccaccgcgatgttgatgttggtgttgtaagtgaagctcttcccatccctgcagctagcattcaccaccgggtgctgcgcaagtgccatagctgcggccttcgccagcagaactgtcatggtcaccccctttgacttgacctaaccaaaccaaatcaaccccaacaatcaacaaaatgaccaaaatgtaataaaccatcacaggaggttaagcactgccacccccaaagtctccaaaggtatagcaccttctcatatagctcatcgagcttatcggtcacaattgggtatcccacacggaatgcgggcaccgcgaggctctccaccatgttcttgctcactgcagcctgcatgccagtgaatggaaccaccgtggcaccgggcaccggaggaagctccgcggcctgtggcacggcgccaattgccggagcagacagcggcacgggagcagcagaagcagcaggcacaaccttcggcttcggctcgatgccggcggcagcctcaacatcggccggcgtaattcgcccgaacggcccagtgccagccaccttagctaggtccaccctatgctgcttggccagcttcttagcttgcggggtggcaatgcccttcgtgccggctgccaccggcgccggagccgccggagcggccgcgggtggaggaggcggcggtggcggcgcggcggcatcggagggtggaggcgcctgctgcgggtgggccttggagagctcctgggccttggcgagggcggcctggaggtcgtcctcggactcggcgagcagcgcgatgggggcgccgacgggggcggactcaccggcggggacgaggacggcggcgacgatgccgtcgtggaacgtctcgacgtccatgtcggccttgtcggactcgacgaccaccacggcgtcccccttggcgacgcggtccccctcggcggccgaccacgacacgatcttcccttccgtcatggtggagctcagcgccggcatgaagatctcccggatcttggcccgcaccaccaccatcctcgcccgccgcctcgccaccggcgccgccgcggcgccccgccccacgaggaggcgcgccggcacggtggaggccgcggccgagagcgagacgggcgctggagtcgtcgccattggagaggtggaggtggaggaggaggaggtggaggcggcggaggcgaggtgggggaggtcgggtgtataaggagaaggtcggcgagggcggagaaagcgaggcggatgagagctttggaaactccgacgaatgctgaaatgggctggggagggccgggccgagcctgacgtcaaccccctcacctggcctctatcagggccgggctcaactttctgttttggatcgggctcgttttagtatattgggccggcccattaacccgcagacgcaagccatctgtcgcgacttgggaaaagtctatatcacctccctcgtctattactccgctctccatctctcctcgcaggcagcagggaataagttcaccagaggtccctcaacttaacagcgagattttctgagggccctaaactacaaaactagaaatcttcatccctaaactcatataaaccgtgcactcaaggtcctatagcagtatgtatgggtggtttcgacgtggcatcctagtcagcaaaaataaataaaaaaagtaggtggggcccacatgtcagtttcgttaccgcacgtagccgcgtgctgatgtcgtcgccgccgctcccacctcgagccgacgcctctgctgctcccgccgccgccccttttccccgccgtcgcagcggcggccgccattcccaatgttgccactcctgccacgtatcgccacagccaccgctgctcccgccgcacgccaacgccgacaccgccgctcctgccgtcacccatgttccccgtcgtcgccgaggccaccgctgctaaccaccacatgttgccacgtccgccgttcccctccccctgggaggcctccgcggccgccacgaccgccgctgctcccaccgcatgccgatgtcgtcgccgccgctcccacttttgcccattctccccactgatacagaggcaaaatgaccagaaaaagggtaggagtacagtacagtacagaggcaacaaccacgttggattagaactccgacgctcgcccgctgtcgccgccgcgctcgatagttgacgccgccgtccgcctgctccggccgcacgttgacatcgccgctccgcctgctccggccacgtgccgcccgcgcccggagccggtgctcacccgccgccacggctgcgctcgcccgctgacgccgccgctccgccttttccggctgcgcgccgcccgcgcccggagccggtgcagttccggatgaggagaggtgggcgccggccgccgctcccgccgtcgcggcctcacgggcggtcgcgccggccacctctctccccttctctggcgccggccgcctcttctcccctctcccgcttcttcccagcgcgccgcagtgcccgctccgccgtcggccgccatctgcctgcctgcgcgtgacggcgtgagaactgagaagttgagaagagaagagaaaaaagagatgtgggacccacatcaatttatctcactgacatgtgagtccccacatatttattttactatttttgctgactaggatgccacgtcatcaaaaccagtcatctatactgcctcgggatccaaattagatggttttgtatagtttaggagtgaagatttctggttctgtggtaaggggacatcaaaaaatctcgttgttaagttaagggacctccggtgaacttattcccaggcagcagtggaggcgagacagaccagaccgctgaagaacagtcatatctcactgacaatctgacatgtgggtcaatttacacttgtttttaaaggtcaagaggtgtaagtgattcgatcaagaataagatagaggaggcaaattagacttactccgcggaggcgtcacgaattttttgtcatttttagatttttttttaatatttacagaaataatctatcggtcaaaaaaattgcaaaaatagaccctgccgccccagtggtgggcggcaagctgatgtggcagacggcgggtcgaccgtgccgtctgccgctgtcggccaaaattgcaattaccgccttgccgcccatacagagagcggcaaggggctaattgcaatttttgccgcccataatgatgcagcaacgggggttcccgatctttcgatgagaggaggataaacttcgatttggggaaggatacgacgttggcggtccgactataactaccacaggggtgctgcgccttagcaaccggtacaccgactccacgttgttgctgttcttgccgtgccaagaacaaccttgaacctgcaagcaatcgaagaacaagcaagaacaagttgacaaggaaacagctcacggcacttgtcaaatgatgaaacttaaacaaaccaaaatggggttctgaatacaagtatccgggtggtctagccgacacacgcgagtacaaggaagtagctgcagctaaacttacatcaaaacaaaacccaaagtgcaaaatggtggctgctaggagtttatataggtggaggaatgaccaggagaggaggtgggagcaaaccctaggttttgtggacccctaatgggctgtaatgatacaaggcccaagcccaagtttctgatgtaaagaactattttcgtcattctgagcagcctgggtcaaagttgatggtgaggccatgcatagctgatagtagacgacgagatctttccaacaagtactcatttgccccgtttgacctccggagtgaagagcattgacttcatcaaatcagcgctgctagtgctgcttgcgatttggttcctctcccatattcctaacaacaagtagatcacaacaaccatttagtagcacctaattctgagaagaacttgtatgattagctaggaatgactttacctgataattaagttcacgagctcgagctctagtcattggtccttgctgtgcaataggcgtggttgtatcgttggaagggatgtcctcatcagataaagaggttgcgctcgtactttttgcatctgg

SEQ ID NO: 57838 - DNA, 797 bp, Oryza sativa
ctttttgcagccaagttcataaagattatggatattctgatttggtactccattttcttacatgatatttatcccttccttttaaaattccatttgtagtagtagttcgattccagtgaaagtttttcaaaaatcatactatgtcccaaaatatagctaatttaaaaaattgaagtagaaagataactatactttgggacggcggactatatttcaaaggatacctcaaagtttgaactatattttggaaataaaattgtatttctacgatggcatacctaactacctaggaatttaaaaactttatcactgaaatcattttgcttgccattagtatcgaagggttgatactcgactacaataacgcatgggtgggagactagtacgaagatacgaacgaagaatacaaaacgcggaagatacgaggttatatatgttttgcctataagccatactactactactctcttatcttaatatgtgaaagcagcaaagctatctcagaggagaatgggccacatcatctaaaatacgagaaccgtcggatgaaactgataaagaaaaatacaccgttggatcatatataaggcatctattggactaatcaggaggcttccataacattcctccctattctttttagcaccatgtttgattaattaatcggttgacaaataaagaaaaaaaataaaagagacctcaacctttaattcataatggagttattaacctatgtgattatcattaataacatgatttattgcaagattaacaagagacagtttctttccctggac

SEQ ID NO: 57839 - DNA, 1163 bp, Oryza sativa
agacttattttccatatttgattgaacctttttttcatatagcgaaactcagtgcgacaatatttaagctctcgtctacaattttatttgtggagtctcaccaaaaaaatatctaagaatactccgaaagtatttaattttggtaaaaaccacattaatcgctcacactttatgaaaacatattgattcggttaagcatgtgtttactggggtggttttttcatcaaaacttaataggtgggtgggcatttgcaacaaaataacttatggggtgtaatgtcaaacttcaagtgatttatggggtggtttttgcaattttccctatttaatttgtacataggccatgaattcgtgcaacgaaacctcttctctatggaatggttgacgactaacccaattcttaatcaaataaattttgtcgtcgtcgatcgatcaattaattgacagaaatcacatccacaggaaaaataaggaaaacaaaaacagtggtcggatttgatcgatcgatccgttaatttcctgattaattagtcaatggggttcggttcattagccggattagctcgagctaatcccaaaagccacgattaattagcgcggcgaaattactgcctttccctcgccggggacgggcgggcgacgtggccagttgggtaaaaatttggcgcgaaattcacgcgcgcgccggtgcatggcatggcgcgcatgcaaaataagggccgtttagttactaaaaagttttttcaacatcacatcgaatctttgacacataaataaattattaaatatagataaaaagaaaaactaattgtacagttatgggagaaatcgcgagacgaatcttttaaacctaattagtccgtgattagcaataagtgctacggtaacccacatgtgttaatgacggcttaattagtctcaaaagattcgtctcacggttttccggcgagttctgaaattagtttttattcgtgtccgaaaaccctttccgacatccgatcaaacgtcaaaggtgacatccaaaaattttcttttcctcaactacacagggccttaaccgctttgtacgaattcaaagccgcgtggaatttggcacggcacgtcgcagttagatcgatccagctcacatcctcgctagctaaacctcttcaagcttataatct

SEQ ID NO: 57840 - DNA, 2252 bp, Oryza sativa
  unsure (1)..(2252): unsure at all n locations
ggcgaattcgagctcggtacccgacatgtggttccattcccacgacacctgcccgctctgccgcgcgcccgtggggcccgacgccggcggcgaggggctgccgcgcgtgccgcgggaggagccggctgccatggacttccccatgttccccaccaacgtcctcttctggggcaccgcccacgacgacgtcgccaacgccggtgaccgccacccgttccaccccccgccgccgccgncgtctttcatggccgcgccctccacgagctcctcggcgtccgcgcgcaggaaggagagcctcgtcatcgacatcccgtcgcgctctgccgccgccgccgaggcggacttcgtcacgtcgtcctccgcctcgacgccgctgtcggcgagcaggatggcggacgacatgaggtcgccggtgtcggcgcggctgcggtcgctgcgccgcctcctcagcaggggcaagcaggccgtggtcggaccgtccttcagcccgcgcggcggcggcgacatcgagcaggggctcgccggcgctccgccgaagacgcccaagacgccgccgccggcgaactgatccttctccccggagctccgagatgcattggctcgcctcgccgatcaccggagcgtacacatgtgttcattctttctttcctactattcttttctgatattttcttttacatttcaaaaaagaaaaaaaaagaagaaattttgatgagaaactctcatgtaaaaagaagatgacaacattactgtaagttgattcttggtgattgggggataaaattgatgaatttgttcaattgtccatgagattgttcaattgttcttactttcttacttatctttgcctagatgtgaaattgtctgaaaaggtttatgtgtttcagttaaacactgcttcttcttcttcttcttcagaagtcagcagtctgaattcctactgtcactgacaatctgatcccagaaacacgatattagaaatgaatgtatttggttaggagccgaaattcaaaagataattcctaaacaaacacatcagcaagagagaagaaaaagaaggctcaaaatggaattatgcctaacaaagtacatcaactgtacgttcggctagaatatgaagtgtgtaggagacaacctctgcgctttttaggcaaaagagttggtttctgctgatgaaaacttgttcatgtaggccccaatgaccccaactatacgatcattttcttttcagaaattttgatagctatattcagaaatatgcatcaagaaacgagagcacgaacaattgttcagtgcttaacatacatttgctgcaatgcagcggcctcactagttttcagtcgcttcaagtatcacctcatctaatcacagtttaagatatccagctgccttcatggataacacaaattccagcatccaaaatatgaaaaatatcaaacccttgacagtgcctgagagtttctttccgtgaagcgattattctgctcgtttcagcacaatggatttgccgatcaaacacgacacagtctcagtctcaccgtgtgtttgcacacaaaaaaaagtcgatgcgattcgatgcaaaaactttgacccttcctcactctgattaattttggcttacttttttccccctctttctgacacaagttgcacttgactatgctccattcgttttgtgcgtcactgcgtgtctctgaatttccaagcaaacgagctaagctagccgtcagtcaggtcagtcaacgacatgtgatcttatgtaacagtaacaatactacgtgtgcattttataaaattgttattaattagctttagctgcatgcggattaagtcgtggcgtccaatcgcctgcacgattaggatgtcagtacaggagaaaatgggggaagtttcttggatgcaagtaaagtactcggctggagtcagagacggttgaatgcgagaagaaacaggggaaggaggaatttctgagctaaggcaggacggacgttaggtcaggtgtcactttctttgccttgtggacatggctaatctttggtcatcaacgagcttcggttgctaatctcatcgacgtgagataccgtgagcgtgtgactgatcgaatcctttgtcacagagttattattagcaggaacagtgaatagtttaagtgtttctacgcagattgaccctgatcaattggcatgttggatatagcctggttgggtttgttgagataatttaatttacgtgcttgagattcagggatcgga

SEQ ID NO: 57841 - DNA, 8854 bp, Oryza sativa
tatttgcgacctcaccacacgatgattcgtcgacgaggaaacgtgacgagccgcgagcaggcgcggccccgtcacctcgccctcgtggcacgaacgataaccatcatctcatcaaaccgagaacgcgcgtcgtgatggccgagatgacccgcgggcaaacggcgcacgtactcctccggtcccgaccatccgactattagccgtgcgaaatccgtcgacgcgacggctgcggtgcttagcgctacgagatcttttttccatactccagttgcttccatgggcgtgcacgtctcgtcgctgcaacttgccatgtataactgcggccccgagtcatacggtttgctccactgcaactggtggtggctgtcggtgtggctgatcgcactgtagtactgtaacatctactacaggggagcaactttgatgtgaggactagtaaggggaaggcatgccacagtgccgcacgcaaagggcgttccactgataaggcacactgtacgtgcatcgtgtctactaggagtagaagtactgctattattatctgttattttcagcaggttgggcctcgttgtcaaaggagtcaggtagcgtatcgagtgtttaatctcctgatcgtgacgtctgctgttattaacttctatagctccagcaaccttggacgcaagccacccgcagataaaatttccaggtaaatatcgtgggtgtgacgagccgtgagatttgagaagactgtaaccgatgtcggtctcattggatcgctatattttgggcctttgaactgtcattggtcggtaacctcttgaggtctcaggtatgacttacggaacagtatcgttttcgctaaatagaagtacaagtgacttgcgtgttgcatgtcgaggttgacttatttatttacagatcactccaaatataggcccactaaatctcaattcagcagaatatatgcttcgacttttgcaacttaggtttggtacaaatccaattgaacgaattaagttagatactactccatccgttagcaaatactccctctgtactcgtaaagaaagtcgttttggacagcgacacgatctccaaaacacaattttgaatttttgtttctataaaaatatttattaaaaaatgaaatatgtatacttttattaaagtatttttcaagacaaatatattcatataatttttacattttcaaactcaacaacttgagagttattcatgatatatattcccaaggtttgacttaaacattgtcctaaatgactttctttatgagtacggaggaaatataagcattttagtagttttagataaaatcaccttgtaaaatgtcgtcgcgagattactttcagaaaatatcatactgaaagatgcaatcaccaatgagcaataaatgcagcgtttggatgaattgaaaaattagctctcccgttttaaaacatgactttgaatttttcttatcaaagtttatttttatattggtttttaaatcacaaaggacgtatatataaaagggtttacctagaaattattattcgtttgctaataaatcgtatggattataatcaatatatgattaattgatgaagactggtactagaaatatttacgtttttggataaattttaaacgataaaagtagttatatttctgaacgacggcaatatggcaatatgagtttcaaataattagatcacaaaacttcttgtgctactagtacttaacgccagggtttacgttaccatcggtaaccgcgcggttaccgtggttaccgggcttaccacggggtacggtaatataaataccacaataacctttttaaatttaaataaattttaaaattaatttgaatttttaataaattttgcatggttttttatggttaccgcggtaaccgtgcttgccgccggggcgcggtaaccccggccctggcggtttgggaaaccctgcttaccatctcaaacctttgagcagttgcacatgctaccactctcctctctagacttgcctacttgcctctagtcctccgttggtctgcgtgctctctttctaccaacaatccgctcaagatctcgcgcttctcacatgtggtcatactctacattttggcgcttcttgttactttatgttaatctcaagttctcaacctctactctcgcccatagcactagtgatgggttacgaatactggcctgtttgctttcgaccattgggctgccacccgatctttctgtatccccacgctgttcattttcatagaagggatgaatgcacgtgtttcttgagctttaaaccggtacgaattttattaaaaacaatctatgtattaaattatttaaattatttttaactataatagttattattaatttgtaacctagaataattctcacaaatcatcgtggtattctgtcacccagccatttagcgcaaaaaaaaaaaacttaacaccctcatattgctaatgaactttttattcgtaacccaaagctccgatctgataagagaaggctaacccgccccaatcgcaattgacatccaacaaatagagattttgctcatttttgggaaagaaacttaaagtaaattttgtttggcaaatcccttaatcaactatttattctataactacgagagtttagggaaaaaacagttaatataggatcaattttgtattgatggtacagaccctaaatgctttaatctggataagattcgcagcttgtacaacaactctcgcttttaatatttctaggtagcagatactcctacaaatgacttggttgatgtgcgggccgtgtcaacatatcagcttaaggaccaagctgccatttaattgggtcgatctcgtggcaattgattcttcatcacgcagaagaaagcgaggacacaggacactgtggctgtttttttgtaagcgtgatcaatgtttttggcacacacactgatctcgttccgtgtcaactcgtcatcaccaaccttgcttgccattttgcctacctagtacagctactaatcctaatcctttcgtgattatccaaatggtcgttgcagccaaagcttgcaacaaaccaggaatggctagctaaataatctggcaaactatccacaacttctcttgtgaaatgtagtctttgatctatacgcattcttcttaaataaattggtactaccatgcttttcgccttttcctctaaaaatatctcacactgtctctcctaaaggtgtgcttatattacttgtaggtaggcagttgcttgtcactatcttttcaattagatggaaatgattgggcaacgtaaagttcagttaaaaatcttcttttccgtcaagaaaaaagtaaaaaaaatgttttccgagacaaaatatataaagcattggtaaattttggccctttcaacatgaacagagatgaaactttctgttggctaaacacgtttggctgcacctcttgttcggaaggtctctaggataatacagtaatactcacccatttgttgagtacgcactacaacagctaccatatcatcaggtccaaatgatataatgcaacatccgacaattggtctaaaattagtgattagataaagatacattttgtgggggacaaagaaaggttgatgccttgttagtatcaacttggagaagattcattgaacctgggacggtgagagcaacgccccatcgaccagttgtagaatactgcatccgtttctaaatatttgacgccatttactttttaaaatatgtttaaccattcatcttatttaaaaaaaaattaagtaattattaattttgtttcctatcatttgattaattgttaaatatacttatatgtatacatatagttttacatatttcataaaaaaatttgaataatatgaacggttaaatatgtgctaaaaagttaacggtgtcgaatatttagaaacggagggggtactaatgataattaatggcagtatcgcttacattgaagttggcctcaaatggaagctgctgtttttctaaccatggccgctgcccgctggcccgcatcgtatgtaacgcggtcgcattgccggttgctagatcaacatagaaacaacagacgaacacatgatcgctttagcttctgcaaaaatactctcataaagtttctttaacctcgatgatcatgcaagatgacgaagcaaagccgcaaaagcgacagcatacatcttaagttcgttgatttactcaagtggcagtactaatcaagcaaagcttttggcaaccaccggcagagcaagaaaatacctgcataccatccttgcggatgcaacattttcctaggaaatttcacttaggaggttaggaacacattatatacagaggtctacttatggcactgatatataacttgtcttcgtactccctccggccccccccccccccctcaaaaaaaaatcacttatagagtttaaattttattccatagaaaactaacttctatcattctgtcaacccttaacacgtaaaatgtgaagttttattcatttaatattctttatctatctatcactcttacttttttttaataattaaagatattttagccattctcatttctcactaattctaccttgaaatatcatgaattattttttagacggagggagtacaagattaatataaagtagttagcatgataaccaactccacttggaattatttactcacatgaattgttccaaagggaatcaatcaaagttcagtaaagtcaaagtgaagtcgatgagttgatggtgaaactgccgcgttgcatcagcagctaccaacctgcacggttgcaggacctggcaggcgggccttggtttgttaattgttagtaaattaattactccaggtcattgtcttagtaaaaccatatatactcatgccactagcgtttgtttggctgtggatggtgacgaccgatgacgtgtcactggtgcacgggcccaccagccagggacgatgccgcctagtaaatcctagaatgttttataaaaaaccaagttagtacgggaatgggacatattggggctgattggttcagctggctgcagagttttgggatgcagctgtccagcccagccaatcggctgcagcctaaaattctacagcaactcttatgttttgaatgtgcacactgctgcagagggcagctgcttgttggttgccgttgtagttgatgcgagctggctgctgcagctctgcagcgctgcaacaacaatcacaagcgatcagccttattatatgtccaaatttatagtaatagaatgtgttatatctaattttagattcttttttataggacatagaaagtatacgccaatggccggccggcctgcctagtatacaatggaacggcgcatttgcgtcgtcttctccgacggcgttggtggacagaattgcaatgcgagagattcagctggaggcagttgcgttatccagcgcgcagtagcggaatacgtgctctgatgaagcaatataatagaagggttcatcagagatgcaacttgcaagatgctctctctatgatcctatccattctagggaccgtacgagataaggttgggattagtttcagtagaggtgtcatgtgccctgctgcatcttctgttcccaaggacgagaggagtaggacggagccgataagataatgaatattactactgcatctccttttcaaccaaacaaaaaaattctaaatctttgcttagggagtaatcaagcaatcatggtatcctcttgctggggaacgatggatggaccggtagcattgccattgtcagctctgatcagcaccggctactttgtccatctgtcttctttcaaaacgaacaacaacaacgaccagtctaaaaaaacgaacaacaacaacagaaaaaaaagcttgggcctttgtcctgtatactgcgaagtttattgggcctacattcttttatggcctgtttggggcaaaatgccaggctggttgggcctgttttggaagagaggatacaagggccttgtggctctctccggaagccagttactagttcaccaaggtccctcaatttaacatcaagatttttttaatattccttaatcacaaaacagaaatatatacacctaaactcacgtatgagcaagtttaatagtatagccaactactagctttaattcatctatagccaatctaatagctcatacatacaatagttacatactacactattaatacctgatcccacctgttatacacactacgtcttatagtccgtgctacagctggctataaatctgtagccagcttatagcctgctattatacctgctctaaaccatataactcatcgatgtcaccgttccagcgagagtgcctgagtctcgaggaaggagctgatggatgacaggactggatttttcacattttgatccttttaaaaaacttatttcgcaaatagacccctgaaaaaacttatcccagaaatggtcctttttggggcgccagagtggctggcgccgtcatccaacgggacggcgcctcctcctgccaccgtggcgcacgcgaaccgacgtggcaggaggagggcgccagcatggctggcgccgccgcctccattcctgtttctctgtatggagttgcaacggtgtcatttttattttattttttcggatgttttttcacactcaggatcacgatacaaccaaccacaaaaaaaatttaaactcgaactaccacttagctaagtctgaaaatatctagcataccacttagtctactttgcaccttcactcaaattagaccataactcctttagtaaaaccctttgatcagcatgttaaacataatgcactctaccactatataaattacttaatctaattcaaaatataaccacatgaaatgacatatataagttaaacagtacaaagagatgcaatttttttatttttatttcatttttttgatatttttttcacacttaggagaacataggaaccaaccgtataaaaaataaactcaaacggacaaaatatgtgacatgtagaattttccaaaactctaccgaaacggacaaaatatgccatctattaaaataggcgtaactttctcatacggactcggaatcaggcaaataatatatgaacggacatctacagaaaaagttacatccgattctcccccgctttgccgggttcggcgatattaaaacctccaaattccgcttgcaagattgtattttcgaggagagaagtttttcggtggagctttggaaaattccacatgccacatatttcgtccgtttgagtttattttttacgtggttggttcctgtgagttcctaagtgtgaaaaaaatataaaaaaaataaaataaaaataaaaaagttgcacatctctctcctctgcactagttcggagagaggagaggagaggagaggaaaaattctacatgtcatatattacgtccatttgaattcaatttttctatggttggtttttgtgtgtccctaagcgtgaaaaaaatatcaaacaaataaaacaaaaataaaaaatttcgaggggggcgccagccactctggcgcactccccctagccacctcagcatcgccccgccaagtcggcggtgggacggcgccaaagaggctggcgccgtcctgttgaacgacggcggcagccactctggcgccccaaaaaggaccatttttgggataagtttttctagggatctacttgcgaaataagtttttcaaaaggatcaaaatgtgaaaaatccaggatgacaggaaggggaagaagggtggtggtcggcgagaggcggctctccggtgaggaccagatcggcgtcggcgacggcggagagggataacgcagttagcgccatcaaccgttgcgatcgtggcccagatggaggagagcaaaagctggacctttctgaccgttcgatcaacgttagcaacggccgcgattaaccaaacggcaaagggaatttcgcaacggagccctgatttaactggagcttatcctcagttgcactaatcccatctggccgctacgctttccttcctcttgctccgcgcctccgccgacgagctccggtgaggagcggcggcgaccggcagccggcagccgagacagacagcagtgaaggattgccatcaacacgaaccaactggacatcgaaatgctcttgcgcggcgaagccggagaccagccgtcggccaaggtcttccgccgcttcgtccatgacgccatcgagaggtgagattctaatcctgaatgccccccaacatcaagtactctctcaccgttgttagtactaacgattttgctcaaatgcgcagaccggacgagttcatattgcatcctgccgctccgctgccaccgtccgtggagattgtccgcgtcatggatgtgatatccaattttgtaccccacttcctcttgaaatttgcagcatctgagtaggtatggagggagtgatgcgttttttgcgattgatgatttggtcaggtttactcactgattcagcagagctgtagaggaacacgcaatcagatatgcaaggctgtgtttagttcagcgcaaagtttagattttggttaaaattaaaaatgatgtgactgaaaagttgtgtgtgtatgacatgttgatgtgatggaaaaggactgaagtttggatccaaactttggatctaaacacagcctaaaatgcatggtgcaatgaatctgccatggtggtaagctgtgaaacctggatgctctggtctctggaacctaaattatatactccctccgtcctatattataagggattttgagtttttgttttcaacgtttgaccactcgtcttgattaaaaaat

SEQ ID NO: 57842 - DNA, 20478 bp, Oryza sativa
  unsure (1)..(20478): unsure at all n locations
aaagtagcttccccgtaattttactgttccatggtttagggtttagggtttagggtttagttcagtaatacagtaatattacggggaagctnctttgtggccgcacagccacagtgtggccatgtggcatcatctactcatttcgcgtcagccaatatatgttaaattgtataattatatggtttgctctgtacgtcttgtttagtcagatagttctataatattttttcttcaactcagctgaaaaataaaatgctggtgtccattcaagaaagagaaaattaggaaacagtgtttatatgaaatgaattctaatccatcgggggaatgccatctcgtgttcattattcttctaaattcgatataaacagttgtaaaaatttcttaaaaaattaataatgtactagagtacaatgatatctattagtacaccaaaaatcgaatttaaattcgacctacacatcaagtaaaaacatccaaatttagatgtgaatagtgctactattcatctgaatttgtcttttatatctcttgacgtgtgagttaaatttggaactaagatttcatgtagttgtatatatatgttatatgagatttcatgaagttgtatatatatgttgtataagtgttgtcaatagtttttagattcataatagtttagatagtttatgagcaaacgagaggacatcctctcgaggatcaaaataatttcccagtgtttatatatgtacatacatatgctgaaacttaatcaggttgtagatatatgtgccatgtatgcagcatatgcgcatgtatgaagtagtaataattattaacagggatcttgacatgcatatggacttttggtgtttggcttgccggtcaacacacttcatatatatatatatatgctgtatataactttacgcgtatatccagtatgaactctacataacgtgaagagaactctatttgtatatatgcaaataatataattagttgtcgttttagttttaccattctaagccaaacattttcatctttaaccaatttctaaaaactcatggagtttaataacatgtgaattatatactaaaaaatatttctcatgataaatctaaaagtataaattttattaagctaactatataaatttctataaattaatagtgaaatatatagatgtttgactttggacaaaattataatgataaataatttaaaatggagaaagtaatattggtgtgccgaaaattaattctatgctaaaaaataatttgattatattcgtgcctgtgcctgccgtgaagcgagggccggcatgcatgtaaaatacacatgcaagacttgaaaaaaccgatcaaaggaagcatcatggttgccgctgcacgaattgaaggtccggtccggccacctatcgatctggtcctgcgcaacatgacaattaattaaattgaaccaaattttcctcctaaaagaaccttcttggccgatctcgtatggatatgatgcatagttgcatacacaccaaacagtttaattttgtggcatttcctcaatttgtttatcttcctgaataattgaaattagcgtgaaacaattaatacatactcctccacttagagtatagggatttttagagttggacacaggtattaagaaagtaggtagaattaaatgggagaagattgttgttaggtttagtcccacattggtaattgatgatggaatagcacgacttaaaagatgggggcagttctcacccatcatactagccttttgaattgtacaggcccaggacctaaagttggggctccggttagaccagtgatagagcagacccaatgtgacctgggtggcccacgattggtgggacggactgcatactaagtggttgagaagtggacgctcctagcgcgcgtatgccccagcaattatggccacgcgtcgtcttccctttttttttcacgtttttttttcattttctctcattttctgatttttttcccgccaattagcaagttttaaatcatgatttgaaagttttaaaatctcgggttgaaagttttcaaatcttaagctgaaagttttctaaattttcaaatctggacttaaaagttttcgaatctcgagttgaaagttttcgaatccgagttgaaagttttcaaatctgggtttaaagtttttaattttgagttgaaagttttcaaatttgggttgaaagttttcaaatctgagttcaaagttcttaaatctgggttaaaagttttaaatttgagttcaaagtttttcaaatttcagatgaaaagttgaaagttttcgaaatctcggggatcgtatttctacactcattgaagcgccgaatatagtcccgcaatgattcgcctaggttctgggttagagcatgtaggtcgtcctcgatcgcgtggcgcttgtaagtccctcggaagttagcaacgaattgctgccataaatcttcccacgaagagattgagtttgccgggagatggacgaaccatgaccgggcagagccttttagcgcagccggcaaataatttgccaagacgtttcgtctgcgccagtgacatagagaactgtggagtagacttgcagaaattcttctcggtctgtacttccatcatatctctcgatcgatccaggtcggaacttctcgggccaccgcatgttgcgaagtgcgggtgtgaatgccctgcgtccgttgcctgggacagggcgtggcccatgaccgcgatgccttcgtggaggtcgatccgaagaggacgatgaagacgaagaagagggatcgcttgggtcaggagcccgagttctcaaacgatgatcacgtccacgatctcgactcggatgaggagattgggagtttcgatctcgtcggtcgtcgttattcctttcttgtctccgaggactgttttccgatcccggtcgttgtcgtcgcgtcggtcgtcacgaggtcgacggtcgcgattcccgttggagatgttccttcggccatcgtcccgctctcgtcgaagctgggagcgaggacgatgctgtcggtgcggatcgccatcctcacgacgaggagaacgatgtcggcggcactcgttctcgttgcgttctctcctgttacgccgacgtccgtttagatgttcgcgaaggtcaccatcttcatggcgcggtggtgtagggtcacatcttggaggggagcggtcgccggtacgccttccgtcggggttttcatcctccgcatctccggtaggccgctctccgtctctgttcggctttgggccgcctgcggcttcagcaaacacggtgttgaggttggtcacggtctcccgtagtcgctctgtccatcggctggcatctgggtttgttaccggatcaaaagggcttttcctcaatatcgcgtctaggttctgcaactgatgagctggcgttctcacagcggcggacgtgctcgtctcagtgttgtcgaccacgtttacatctctaggcgactgcgaggaggactcgtagccttctaagaggtgtaacacggatggctcgtttgcgccgacaaatcccacaaaccgattcgggatcggagccgcatctggttccttggcaacacacggagtttgaactcgtggctgctggacgcgatgatgcgctggtttgagggtcctgaggaagattctgcagttggtgagatcatgcactctagatctgtgaatcaggcagtaggtggtactcgttggtgaagtgcgttgtatcccccgttcccaacaggtgtagagttcagcttgcacgtggagtatcaccgggcagtcctcgagagcatgcttggttgtcttatgtatgggacaccaagttctcggtttcagggtggttgtccttgtcggcttcgatttttcacacggagggtgaaactcagccgcttgagggttcgtcccaggtgttggggccgtcgatgttccgttctccatcggagtgggaggaattattgacggggcgccgtttctctcagtcgtagccgtacccttcttgttcccgatgacgatcgggccagtcgagattggtgtaacggtgtagagcggaaatagatccgacttgagtccacaccagcggtgtcaaggtagaaactccttgattggcgctgaggctgttgtcggggagtcttgaagtcatactagtggatccttgagcaccaagtccccctacctagcgcgccactgtcgaggagtactcgtggactggaaggatagggtattggggtacgttagaacagggatctacgtagtacgacatcaaaacagaaaaaagacaaggattatactggttcaggctccttatcaggtaatagccctagcccagtttatatgggattgatgatgatgagaatagattacaaagagagtaaccgaattggcgatgccgatgagaccgtagtcgaggaattcgacgagatctcccagcgagttggctccgtggactccggcttcgtaaactttggtgggtgtgttggcgatgagatgcgatgccctttgcctctccctaggggtcccttttatatcgtgggatacctttaccctcaagtaagacttggagatatgtaaaccgacacgatatcctagagattttaccctttccgagtaggacttctgcaattcctaaacttcgtggagatattttccataatttgaggcgaattcctaacgatgtatacggaaaccaaccatatacgtgaagttataccttatcggtgtattccataagtcgtaggatagagagtatgttttatccgtaaccctgacaaatatttatctaaacttgaatataaagcattactttcaatcctacttattttaaataatattatgtagtatcataaagatcgtagaatcggaatactatctaaaatttcgtaggatcgtgtgaaaatgaaaattaagatactacgtaggattgatatagttttggtttgataagatgatagtaccgtactactctgttccaaagaaagacaaactctggctaggaatttggacacgcatatattcaagttcgtagctaggattggacttttttttggatggagggggtatgatactaggatatggatcgggatactgataacctacttgtacctactctgtctgtgtaattagtttttttcccttttgttttaccatttttacgaatgtggctcctgagaagttttgtctttttctgattatcgggcgagcgagcttcgccactgccaagaatcaatctaaggcctctctcaaagaatggtaggatcgtccatgttttgacttaagaattatggactccatcgatttctgacaagttgaattcgtcctatatacgagagattagctttgttgacaaattctaattcactacagagattaagaactgaactcaactactgtccgtcgagcatagaagttttgtcttaaattgatagtttccttgaaagccatgttcatgcagggctgcatattggtgactcagtgagtcattgtcaaagaggtatatataggaccgaaagtattgctggttcacctgatctcacgctaattctcattccaatactacttttctcaatacctaaaagtataacaacagaacaagtcaccgataatagagaatcaaaatgtcttatatctaacgacggatcgggagtatttctcgttcgagtcaggcccgtttagttatcaaaaagtttttcccaaaaatatcacatcgaatctttggacacatacatggagcattaaatgtagactaaaagaaaaactaattgcacagttagggaggaaatcgtgagacgaatcttttgagcctaattagtctatgattagccataaatgctacagtaacccacatgtgctaatggtggattaattaggctcaaaagattcatctcgcggtttccagtcgagttataaaattagtttttttattcgtgtccaaaaacctcttctaacatctgttcaaacatccgatgtgacaacctaaatttttgtttcgtgaacaaggcgcttagtcgttctaaaggagagacaagtaagtgacatgacatttctgaccgtcgttttctgtggtttgattagttttttgcgtggagcaccgaggcaacatgccccttttggtgtataaaaatgatatatatcgcggtctctattttgtctcctaggcacgattgatatttgggcaaagctactgtgctccacctatagtccatctagaattaaagttggtttagcttcaataccttcactctttatttcctttcctcagtgaattctcgatctgaagtaaattaaatagagtatttccttggcaatgatatcctaacatttctagagaatgattaaacacacacatttgcatgaaaatccttttttcaaacggacccttttcataatgtttacacacacgcacgagcccacacacacactagcatattgatgtgcgttgcaacgggattttaattagttaaataaaattatcactaacttgttattattatctcttaattgatgtacatatttgttattaacatgtggaccttttaattccacactattcttttttttcctttttatagaaagtagagagttggtccgagtggttgatatgtgagtcccctagcctcacattttataggaagtatagatatatatatctcttttttaatagcacatgctctgcatatcatattttttcatggaaaattattttttacaaagattatggtaaatttgctgccatttataaggacaactatgctctttttctaaaaagttttggggcaattgcttatttgaccccgttttagattgtaactgccaatttaaccttactttttagagtttgcttatttgactctccttttcaaaaacgaagctcctctctgaccctatttcgtttaggtgagttcacggtgttaagttaggggtaaatagtctattttgcccttatatttgatcctattatatcttacttgtttgaccctattatgtcataccgtgtatatattcgaatactttaacatatttgtaataatttttgcataagtttcacaatgaagacaagtttgacagatttgtcataaatttgccaaatttgagcactttgcctatacactagtaagtggtaacaactactagtactatcaagtagtactggaacagtggagatcaggattacatgagtaaatcaatcagggatggcaacattcaggtttagtttgatcagatatcatgccaccatggtcagatgagatcagatgctgccggcggcgccgccgctgaggatgttgagcgcggcgacggcggccttctggaacctctcgcggtcgtcgtcgagcgccctgcccttgttggcgacgacctccttggcccgctcgatctccgcctcgatctcgccgccgcactggtcgatttcccccgtcatccgtgagtgaatcatctgctctccagcgtctaatttggaatcaagcaagataacgagttgcaataagctccactgcgcgcagccgcagtgggggatccgccgccaccgctcacttcctccgcgagccgccgccgctcccttcctccgcgagccgccgcgccgcctacgctcccttcacggccggtcgccggcacggatcccgccgccaccgctccttaccttcacggctgggcgccgacgcggatcccaccgccgccgccctctacctccacgagcgggtgccggcggggagtcagctttacgctgccaccgccccctcagcgccaccgacggacccgcagacgccgccaccgtttcgtcaaacgccgccgccgcaagcccgagcgcgccggtggggatcagcttcatgccgccgctgcacccggcgcacccgcagacgccgccgccgccgccgccgcaccgcccgacgccgtcgttgcaagaacgagagagacagagagttgttcgaatggatagggtttggatggatagggttgtgagggtactttgggaattaagaataataatcacatttcttttttaaaaaaatcaatccttaacggaggagtgaaaacaggtcaaacgggagcttcgtttctgaaaaagagggttataagcaaactctaaaaagtagggttaaattggtagttacggtccaaaacagggtcaaataaacaattgtcctaaaagttttaaacatgtactccctccatcccaaaatatatgggattttggattgatgcggcacatcctagtgctatgaatctaaatatagagtatatttaaatttgtaggactagaatgtgtctcatctatacaaaatctattatattttgggacggatagagtaaaatagtttgtatggaggtaactgtagtggcgcttcggatttgagagcggagaggatgtgaagagaggggatggagcaggggaaataagagtaatttatttgttctgctgacatgttgaccaacgtaatgatgctaaattgtttgatgaaatgaagagttgaaacgcaaatctgtgtcataagattgaatatcatatcactctatggagcggaagaaaagaagtaagagttgaaatacaagtcttctttttgttgttctttttgggccattcaaattaagccaatgtgtattgggaaggaagtgcctagagcacctccagtgaggggctaaaatcgatttcaatgaaaaaactgaaccatgcacactgtagtaagagcaagtttaatagtatagccaactaattaccagctccaaatcatttatagccaatttatacaatagttacctataaatatatactacattattaatatttggccccacatatcatatacacattgtgtcttagagtctgtaccgtagctggctcactactacaaaatcaatttttcatagcgtcaacctttctttttctctagcggccataagtgaaaaccaccagtgaaaattaaacaagggatgaggtgctaatgaccgccagcgaaaattgatcttagctagcggccggtttaagtgcacctcttgtaaaaatagaagtctttttgcaagcggacctctttagtgaccgccagcaaaaattgaattttcgctggcggttgctaatgagctccgacagcaaaacgtacatcgagagcacctctcgcaaaaagaaaacaatggcgttattaaaaaccccccacggccccaccgcccaccacccactgcatccctctcctccatctcctctcctcccctcgacccctccgatacccagtcgcctcccactcctctccggtgctaggagacggcggcgcggaggcgtgcgagcgatggcaaggcgctcggaagacggatccggcgacagggaggagcacgggcgaagctcgtggcggtcgaccgcaaggggagcagcgacaaagctcgtggtacggcggcaaggggagctacggcgacttgggccacgggcggcggatctggtggcccggaagtcgtgggcggtaggcgacggggaggggacggatccggcggtgggcggtgaaggagagggcggtcgcggtggaagaggtggatttggcagcggggagcggcgtggtgggcagagccgtggcagagaggggcacgtgcggtgaatgcgcggctgggaggggcgtgaccgatagatctacgaccaggaggagcacgagcggcgggcggcgaaggagaggggcagtcgcggcggctgccacgacgacgatggccgggccccaaaatttccagtggcttcctctaatcccctcccttctcccagatccaacgtgtggtggcggtactcggccggtctctcgacaacagcgatgacgatccaatccagttagtccgattagtctgaattgtgatgtggattgatccagttgaaaaccagtgaatggaaatttatggctgtataaattgtgatgcaaattgtgttgattttcggatttgttaactgtcatggatatgtggatttgtaaactgtggtggatttgttaactgtgatggatttgttaaatgtgatggatttaaattgtggatttgtgaatttatggttgacggaggcaggcggagcggcttcgctctgtcattttttttagcgttggtcaggattttcgctggcggacgatacaacagagccgccattgcaaattcattttttgctggcggctaccttacgaagaccgccagcaaaaatggatcgacgctggcggttggccaatgccagcgaaaatactatattatcactggcctttggtttatgagggtgctgttggccgcttgtaaaaacctattttggccgctaggaaaaataatttttgtagtagtagctacaaatctgtatccctttgctcatctctcttttctttcaactcctcaatatgtatttatagctggcttaggccatccctaacccagaaactatcaactagtttacatacttgccatgtcatatagacactatgtatagaaactatgtatataatggatggtgtcttcaaattaaattatcatccgatcacctctcttctctctccttctatccacatatcatcttgtttttattcttggttcttgtatagagatgattttcttgcatgagaaatggtttcttcatctttttacctatctcatcattaactctcttgccacatactctgtccgtgctcgtaaaggaagtcgttttggacagcgacacggtctccaaaacataactttgacttcttgttttcataaaaatatttattgaaaagtgatatatgtatacttttatgaaagtatttttcaagacaaatctattcatatattttttacatttttaaacccaacaacttgagagttattaatgatttatatttctaatgtttgacttaaacattgtcctaaacgacttactttgcgagtatggaggaagtagaatttttacttatgtgacaatgcatttaatgctatggaaactatgtcacatggagaattggggatagccttatagtatgctgttgtacgtacctgctctaacaacacaaacaaataaaaatatatttattgacttctgggtcaccagatagagggcgaggagagaagcgattgagatagttttttgagtaaattccctgtgtacccctgaaaactcactcaatccctttcatacccctaaaatttacccgatcccttctgtacccctgaaatttcaatttgatcccttccatgcccctaccgttacattttccatcattttactgttacgtttggttgcaaatgtctttttttgcccttgatgctttaggtttaaatataagcttcaaaaataattgaaaattttgtttgagtgcacatcgtgtgcattttataaaactaatgagactaaataattagtgcagaaaattttgacataaattttgaaaataaaataaatgtaaaaaattaaaatttttatttgaaattttaataggacaatggatttttttatcaggagcattcataaaaaaaaatgttgtgaacattggtatacctatctttatatgaatgctcctcatttttatgacctttttttaaaaaaataaatacgtatttttttaatttcattatctaaaaatatttttttgggataaataatgcatcgcacaacaaactcataactataatagtctcatgcgagaagcttttatatttttaataatgtaattcatgaatttctttgttcatccaagggtaaaatggtcatttttatagaaaatacacggtcaactaacggtcaactgacgggaggggtatgcaagggatcaaaatcaaattttgggggtatataaggaagtaagcaaaattcaggggtatagaagggattaggaaaaatttcaggggtatataagggattttctctagtttttttgatgggtctcacaaaatcgattctcacgctgtaataatcgaaccaaaattttattcggtttgtgtactgcactaaccgaaccaacactacggggcattttggattgataccaaaattgtatcttcctaatttttcctaataaatggtaaatgtgtttgtttggattgaggtcatccaattggcagtgcccatattttatttggccaaattttaaaagttttttcactacagtaccaaaatttaacttgatatcgatcccaatccaaatatgagttagataaatttaccttaccaaattattggtaatacaaagtttacctaaattttagaattaccaatgaattgatagggtagaaatccaaacatgtccaatatgtacccttagtagtagtttgacggacatgtcattctctcttctaaagcaataccaaggcttccatccgtcctaaaagaaaccaacctcatatgggatgtgacgcatcctattacgatgaatctatacacagatatgtcatatcatattttgtacgagattggtttattttggtgcaggaagtaatgctctaacacaaccatcgagggacgtacggataatattatccgtgtatgccttctggcctagtattgctgatcgaaactgaatagctgatggaaagggacagcatcttcagatagtgctttgcaattccggaaggaatcaaaagaagctgaagcggaagggatgagcctaaaatattccaaacacaagattactagatatagtagtattttttttccctatttgtcgtcgttgccgacatcaactacatgcattcaaaccctttgccaagccattgacctgacaatttagaacgcacgcatatagctagtagaaataattaatttacaggttagcatggatgggcaagtgagtaaaacagagcaggtcgttgcagtgcatggcgagtcctccattatagtattaaaaaaagactaagcaagaattaattaatctcattatcaattttcgacaagaaaattttcatgcggccggcgtctggagaaagagagatcgaggagacctcattgacagcgaaaggcatatattactacattaatatgcatgatatggatatggatggatggatgcttcgtggagagatcggtggagttgccggcaaacggggggcgtagatcgggcttgtctggcggccggacaaagctaattagagagaacccaaccaaaaaaccgagaccgaccgcttcaaagcagacgactttgcgaccccgtctgtgtggatggcttttgctcgctctcgctcactgtactcggtcagtttgggcgcgagtcaatggcaaactcgatcaccaccgccaccacgtcgtcctcgccgtacgtcgccctccaccacgcaccctcacccgatcacactgccgatcgatcgaacgtgcacagcgacatgtgctgttcgcttgtgcgcgcgcgcgcgcgttgcccgcatcggccggtgtgttctctgcgacagcggcgcgcgcgcggtgatcgatctgccggcgacttggaagaaatttatctgtacgtggacgtgacatgattgcgtcgatggcgccacacacagggaaacccgggtacacggcgcgtgggcgcgggcgtacgctgttcgtcgtcgtgtctgcacgaccaggtgtgagtgagtgagcgcgcgcgccgcgaatcgcgtgttggcaactactacgacgtacgtacgcgcgacattgatttctgccggacttttcaatggcatgttggcatgtagaagtagaacgtttctcgatcgatcatgggggctcactcgcggccggtagtccggtcctcgagtatggtggtattcagtagtgctgcgaatggccggccgggaactcatgggaaattagaggtccatacagggtacaggtggtggtggtctagttgactggtccttgtgtttttgcgtatatatctggacattaattcatcgcataatttcattcattcgtgtctacaattcgtaccttgccgcgcagggcgtgtacggagcacggtatagagctactagaaagaaagaatgggcaacagattttttgttttttctctacaacagaaaacgtataatttaacaaggaaatattgttgatttaagcacaaatattttaagagaattaaaatatttaagaattggtctaatttgaattaagttttattcgatgaaaacaatatataattggattggcacttaaaatttattttcctatgattattattttgtttctacaaacattgttgtatatgagaaattaatgttcaaattaatttagggggtgtttggttgtcagccacagtttatcatgtctaaggttaattaagttcacacgcacattttccacgctgctaaatagtgcattttttgcgaaagaaaatccatacaatagttgcttcggaaaatatactaatccattttccaaatatttttaagctagtactaaattaatcatacactaatgtgtcgttccgttttacgtgcacaggggattagttcccaaccaccttgttagaacgcatgctaaggttatacaagtttgataaacttggtagttatttggttgctaccatagattccattctaactaattgggtctcacgtattaatattaatgactcacaaaagtctaataagattttattaagtttgctaatatgtactaaagaattttatcacctcaatttagtagacagtatggtgaatttgctcacctcaatttagtatacaagtatggtaacttttatttgcaaataatgataaagtatagctagcgaccaaacaacctcttcccttattagagaccttatatttgaccatgcgtcataggacaaaggaagtagaaatggagaggggatatgtactgggccaaagttccaaaatcactcatgattactgagcagtttcattgtgcacatattggtttacaaaatagctttttatacacatacaaattataaaaccctaaaattgaccaaattagaaaaatcgtagatcatatctctccgtttgaaaataaggtatacttgtggtagcaaatgctctattaggatatcatttatgtgaaacaaaatcgtaagttgtaaataaactacatcctaatagagagtactatgctcctccgttctttcttataagacattttaactttttcatattaaaacatttttaaatgtgttcatctaactaattttattaaatctaaaattaaatatattttaatagtatctttatttcttttaggaaatattttgatagaagtttgactagaaaaatattcaaagtgtcttgtaatatgaaatggagatagcaattgttaaaatttatttatagaaacaggatacaccctttatattactccttccgtttcacaatgtaagtaattttagcattttccatattcatattaatgctaatgaatctatacatatatatatctatctagattcattaatatcaatatgaatgtgagaaatgctaaaatggtgaaacggaggaagtagtaatatataagacagtatcaaatcaaactatgatagatgagagtatccctccgaacaagtccgcgtggtctttgagccttttgtccattttctccctcccaccaccgggccatttctccccatccaggcccatcttctcttctctcctagtatcttcttttctttttggaaaaagttcacttaaggtccttcatctggtcgtcgagttttaaaatcatccttgaaccttcgaatacctcttgtaaattaaaccaggttacgttaggttccaagacaacattgctcactggtttagctgacgtggcgctaaaagcaaaaataaaaagttaaaattcacatggggcccgtatgtcagtgaagctttagccggttggcttcagcggacgaactcctgcacgcgcatcggcctggagcgccctgaggactgcggtcaccgtcgttcccaggccgctcgaccgccggcggcgatggtcgttgaggtgggcgaggaggcgggcaccgcagcggaatcgtttcgggagcagaaccgccagcggcgaacagttcgacgcctacttccccttcgccatccgcattcgccgcgccgacgccaccgatgccgacgcgacgacgccgacaccgtccccgccgcctgcatgcgtcgcccctacatcaagtgcaacagctgcgacgtgcgaccgcgccctcgacgactggctccgcgacgatttccccgaccgcctccgccaactctactactacaaggtgctcggcccctagcctttttttctcgccgctcctctacgtccaggtacacacctccatccatcaaccattcaaccatcacttcatcagttcgttcaacacatatgtttttgatgcgttaattaaacaactcaacaaaaataatccgcgtgtgaaaattgaaaattaaactgctgattagttgatagttgcagagtctattgggattcttggattgattgttcacaatttagtgcaaatctgagtagctagctatgcaagcttgtgtgatatgtcgcaggtgctctacgtcgcctgaagcggctcactctaccactctaccaggacgtggaccacgagctccccacaccactgcccggccaccaccgccgccgtccgccacatcaactacgacgggcactgccacccggtgcacgtcttgccgagcacgccgctgcaatagtgattcgcggagtcgctcgacagcgaggataaccgtaaggaggaggagacatgtgtcccattgcaatttttttatttttaacccaaccatcacaaacagggcggagccaccgcacggcttgcccgggcagccgttcgggctcgccggcaaatacaccattgaatttttaatgttttgaaaggattaaagttataaatattgtagcaaatactatacatatttaagtttgctcgggcttgaaaattttactagctccaccacttatcactaacatgttggtctcacgtgatttcctgattttaagtgccacgtcaacgctatataggcgtcacatcagccaaaaccactgtccaaccattttggaccttatttgcactagttttgtaagctgaggacatgtcatatcttgtattcaatttaagaatgaattttagactcggcaacaaattaaaagacctaaagtgaatttcatacgttggcaagtcaaggcctgaaccccgaagacataaaaggatggaggaaaaagtacacctaaggtccctcaacctgtcaccgagttacaaaatcgtcccccaaccgcataccgggcatccctcaactaataaaaccgttcacttgaggtccttcagtggttttgactccgattttgtctctgacgtggcggctgagtcagcatgggacccacgtgggccccacagccacatcagcctcctctctcttttccgctcttctctcccttcctcagctttctctctctccattctctacggtgatggcggctacgggcgacgcggcaaaggtgggggaaggaactgcgggcgggcggtgggggagggcggcgcgcgggcgggcggcggggggaggagcagtgcgcgggctcccccggtggtggcgggggaaggagctgcgggcggcgggggaggggtggtgcacggctggcagaggagcgcgcgggcagtggggggaggagttgtgggcgggcgacgagggagggtggctgtcacgcccagaaattcacgaaccagaatttctaagctgaatgtgcattaaacccctgtccaggaccagccagggtacacaaacgacaattgttgacatacagattcacgtcttacaaaaatataaaagattacaaacgcagcggaaaagataaaacgagctagccttggaagcttgacttcagcagcgggcaactccactccacaggcaaaccttgacggcagtgacgaaaccaacctctctgagacggctccaattgagaagaacttcaactctggtgtgggggaaaagagagcaagactgagtactacccactgtactcagcaagtcataccggaaaaggaggtacgatgcaggatataaccaatggaggctaggggttcttttgcataaaactagcatttaaaagcagtagttgaaagcagtaaaacagctgtagtaattaatcaatattaaccaatcactgtccaacgctacaccatgttgcaacaggcccaaccaaccacccgaactacaccagttcattaagctaaactaggggtgagactaatcacggtgaatttgattgatcgcccataaccgcgggcacggctattcgaatagttttagtctggccagaggtgtacaactgtacccacaagacacgattccacacatgtcaccatgccccaaagtatcaccatgatactgcaaagggggaaatcgtgacaagaccctccgcataaccctctcctaactatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacctcagatcaagcagttacccactcccgcttgtggtaagcatggtaagtatcccagggtttcccgtgaaccggtccttaactgccatgggtgcgactagcaaaaccatgcacccacagcccaccattcagtgtattttaattaactaacaccattgcggtgcaccaatccaaaactatgctcatagtcaaagtctatgtaataatgtgatccccatttgtatactagttgagctaagcatggctaagcatttcctaaaccaacatctaatcattttgatacccaagttatcaatggcataaggtaaacaataaatggctaagtaataggacccatcccacatgacattataaaagaatgcaacatttaatagaaatgcgggatatttgtaaattgggtacaatatgatcaattgtaatgcatgacttgccttgctctcgcactgatgagacctcagcaacgtctttgagaaaccgcggatcgacgaaacggccgaaatctacgcgacaaacaaagcacacaagcaaaacatgctataagactactgaaacaggaaacaaaacaatttttaatggattctttgcatttttatgaatttactgagacttgaatggacgtaaacggagctcggatgaattaactatgaattttagaagataaattgtgtttttactaataaagaaaaagtccttaatcaatttattgcacaataatacccagggctaacgtcagccaaggggggggggggcggcgccggcaagtgggccccacaggtcagcgactccaaaggggggaaggtggcgcctggcgggtgggccccaccaggcggtggctcaaaggggaggcgaggaaggcgccggtcgggctcggctcggcctcaaggccgaccgaccgaccaaggcgaggcggcggcgagtagggatggcaattgtgcctgtttgcccgtttacccgcgggtaaaaaccctattagggttgggtttgttctccattttatacccatgggtatcttattgggtcaaaagctatgcccgatgggtaaatgggcatgggtatgggtaatcactacccatgcccgctttgcccgtttacccgcgaaatctaacttacatgtaggctaggagcaaaatccactagaatacataagcccagttctttgttttcttcggtttcccttttatttcccttattatttctctcctcttactctatcgccgccagaggagagacacgacaccgaggtggagaatatttgatgttttaagttcgattcgaacttagtagcttgtagactttttgttccactgcttttgttgtggcgggtaaacgggcacgcccgcgggcataaggcgcccgcgggcaatgggcatgggcaaccatccttacccgtcatgtagtaatgggtatacccacgggcacaaataatctcacgggcatgggtatgggtaggcactacccgtgcccgtcgcgcccgattgccatccctagcagcgaggcacggccaccgacggcggtgaccggcggtgcgggaagcggcggcgacggccgaaaggcggcggcgcatggccggagcagcggcgtcgcgggaaggtgaggaaagaagggggagggaggactcaccggcgacacggcggccgaagcggaagacgaaggcggcgacgacgacccgacgagaggaagggcggacgagcggcggcgacacctagaggaggggaggagatgagttagggatggagaggacgaccgcgacgaccaaagtggccggccggagacggaggggaatggatagctcaccggctcgtgagggagatggggttccggtggggttccggcgacgcgaggcggtggccgagatggcccacacagcggcggagctagcggcggcggcggcttggcgcggcggcagccctagcggcgacggcacgcggccggagatgggcggcggcggcggagctcggcgagcgcggcgcgacggcggtagagggcgtgggagaggacggtgaatggggg

SEQ ID NO: 57843 - DNA, 562 bp, Oryza sativa
cttctctttgattatcacaactcgtacccttggtgcaaaactggtgttgacgaatcgcatccgctggtgaccaaggttcacaattggcaagaagttgaggaaaagcttctttcttgggtagtaccagagttctgacacttgattcggtaggagacgcaccatttgagagcagcagatgtctcggtagactttgatttctgaagaaacatgttcaacccattccagtatgtcagagttaaataggatctacaacatccctaggcaaagactggcagaatgaacgttgttgcagaatgaaggtctggaaggctccagttttagtatgtctcccatgtgattcaagacgaatttgcaatgttgacgactgaaaccgtcttcactcttcagttcttttaccctgctgtggggtgtatatattgacactgctataacctcaatgaatttggggaacgcttcatataaatttgacatgcgtgtgagcgtgttagatctttaactttctcgcctgtgatctctcattctgcgtttttaagtgtagatcggcaaaagttgaatccaggtc

SEQ ID NO: 57844 - DNA, 14216 bp, Oryza sativa
gggtgttgggggatttcaaatcccccaccacttgcgggcgcgcgcgcgcgggagatgcgggggagagggcggcgacatgggcgcgaggtgcgggcgcggagtggaggcgcgacgtggagtggagaaggcggcggcgcgggcggttggagctctggctccaacgaccggaggtaggggacgactgacaggtgggccccacctgtcggcgcccgaaagagaaagggagggagggagggaggacttcggggaggggaagggaggagcgggccggcccaggaaggggcaccgagcgcggggagagagatgggccgacggcccatctagagaaaaaggaaggaaaagaaaagaaaaggaggaaaaggattttcctgggattaaatattacactttggtgatttttaattggttaaaattatttctaaggctctgaaaattccactaaaaatcccgttaatgtattgtgacatgtggaactcaagaaaaatcccacattgccaattccaattattaattgcctttattaattagggatttagctctaggttaattaagataattttttggacgatttatttaacaaaattttaaagcaaggaaaaaaaaggggaaaacttcagggcgtgacagtggcgcgtggggggcggggaggagcggtgtgcgggctctcccgccgcccacgaggagccgcgctgtcggcaactcccactctcagatccctctcgcgcgctctctctctctctcaccagggacgctattggcatcgcggtgacgcggtggcgccaggatcgagatcgggatcgacctccgcgctacggttggggggcaacctcctcttcacgctctttgtggcgggcgtcatcgccttcacactccttgctatggtccacaaccccgacgacccactactccaactcctccgatgtcgccggcgcggaggctaccaaggcggtcccgttcatcaagctcgacgacgtggcgaccaaggaggagtcagggtcagggccggcggtggtgtaggccatgaccattgacacagaggccagctcggacgtgggtgcagtggcggaggtggcagcggcggcgacagaggagaaccccatcatcgaggcggtctcctgcgacacggcggtgcctacttcgtcgcctgtctcctgattcctaaacacgacggccgtggcggcggtagtgtcgaggtcgacagccgcctactacatggtgttcagcgacgccgagctgataccgacggctgcgacgacggcggctgtgatgcagcaggcgccgctcctggatgacatcaagatgctgctcgacaactactagcctgcggcggcggtggcggtcactgagaacgggattaggctgctccctcgatgacgatgacgctctcggcctaacaccacacgctgagaaaagtgagagagagagagagatgaagggagagaagagaggaaaagagagaggaggctgatgtggctgtggggcccacatgagtcccacactgactcaaccgccatgtcagacaaaactagagtcaaaaccactgaaggacctgaagtgaacggttttgttagttgagggacgcccggtatctggttttgtagttaggggaacgattttgtaactcggcgacaagttgagggaccttcggtgtactttttccaacggatggaccctagaatggctccgaagtgaacgggtcaagcctagccaacataagtacataacaggccattcatgcttaggcgtatatgcggattcggcctgcatgcccaatattcttgggaaaaagtgcaccgaaggtcccttaacttatcagcgggattcaaaaacgtgctccgaccgcaaaaccagatatgtggggtccctcaactatacaaaaccggtcacccgagatccttcagcaattttgatcctggttttagtctacgtgacagctgagtcagcgtagaccccacgtgggccccacgtgtcagccaaccactctctctctcccctcctctcccatctctctctcacttatctcctctcgggcaagccggggcgggtggggaggagatcgctagggcggccggcgacgcggcagcggcaacacgaggcgacgcggccggcgacaaggcggcgggagccggggcggcgccgcatccacgaccgcctgcctctggtctcccgccgtccctcggaactccgacgtcggaaaattctaacgacgcccgctagctagtctgaccaccatgagcagactccctcgggattccacgaggttacgagcaaggacctgctcctcctcctcatcacggcgccagcaccgacggcgcgtgcatcacgctccagtacatctccaacatcatcatccacaacatccacatccatgattgtgtccccgccggcaacgcgaatgtgcacgccttgccgacgcactacgggtggtgcacccactccgacggcgacggcatctcgctctactcggcgcgcgacgtgtgggtggaccactgtgcgctgtcgcggtgcgccgacgggctcatcgacgccatcatggggtcgacggcgatcattgtgtcgaatagctacttctcgcaccacaacgaggtgatgttgttggggcacagcgacgagtacctgccagactcggcgatgcaggtgaccatcgcgttcaaccacttcgggatccagctcgtgcagcggatgccactgtttgccgatgtttgccatgttcttggcttgtttgccgatgtaggtaaataagtgacgccattgtttgccgtgttcttggcttgttttgctagtgagttgtgacagcagaagaggggaaaaaatgtttttttttgtgtgtgttggattggatttcgtctgtttgtttctcattttgtttcccgccgccgcgtcgctggccacgtcgcctcgtgctcccgctgccgccgcaccggccgcgtcgccttgtgctcccgccgcctcgcctcgtgctcccattgccgcggcgtcgctggctgcgtcgcctcgtgctcccgccgccgccggccgtccttgcgacctcctccccacccgccccggcttgctcgagaggagagaagtgagagagatgggagagaaaaggggagagagagtggttggctgacacgtggggcccacatgggtcccacgctgacttagctgtcacgtagaacaaaactgggatcaaaaccgccgaaggatctcggatgaccggttttgtataattaagggaccccatctatctggttttgcggttcgaggacgttttttatctcgctgataagttgagggacctttggtgcactttttccatcttcttctgtacggtagcggccggtcgaggaagagctgccgaacgagaaaggccagaacagcagaatccaaaccctcaagaaaagtgggcggcctgctggtttgcgggctaaacatctgtctctgtctgggataaaaaagtctatttataacccttacccatgggtcaaatttgattcgcactaactaccgtaaaaccaggtccagaacatctacaattttttaaaccaatgcaaatcagttcccttggggattttggactggtttcagctgacgtggcacatactaaccttgctgagttatcttcattagacatggcgcttatgtgtaattagccagtaaaaaatataattaaatatgtaatgagatgcacgtgtcagtgataactctatcataaaaaataaaaaaaactactggatccacctgccagccacatagaaaaaaaaataaaaaacctcaatctattatcttcctctcactctctctctattcccctcctccacacccagcacatccggtgatctgtgggacggcaacggaacagagaacgacgcattgagacggaagccactagtgattggcttgggcatcttctctcggtctcgtaccacgacaagtcgagaatactgcactaccttataccttgtttggttcacgggacgcattgagacggaagccactagcgattggcttgggcatcttctctcggtctcgttccacgacaagtcgagaatactgcactaccttataccttgtttggttcacggtactaatctatttagtccctctatactagtccttaagaattcaaataggggtaactaaaagggactaaaagtatatattgggactaaaatctatccattagtccctattagagaacttatagggaccaaagtggcagcctctctcttctcctcctcggtccacgtgcttctagtcccttttagtccttggattcaaacagtaggggactaaagtttttagtccggggactaaatgatccaaacagggcctgggttctatgggcttgtaagcttatttggctctttaccctatcaattcattagtagtgtcgaaatctaggtaaattttggcactatcaaaatattggtagggtaaatttatttagttaacatttggataaagctaaattcttatggtagatatgatcaaataggagaggggcactgtcaaatatttagtctcaatcaaaactagcacacatctgtacctaataaaaaatacgtaacgctttcggcgaaaattttcgtccgtcatccatcgcacatggaatcagcttcgttaatcaattttttttgggcagtaatcatattcgtttcctaatctaaaaagccaggcccaccatcaagctcaaatagaaactgtaagggcgcaaaatcaaggataaatctaatcataagtaaacaaataagaagataagagataagatttaaatgttaccgcgtgatcagtggtaacaaactaataattctatccggattgcccccgagctccagcagtgcaaataaaaaggtgaaaaggtgttgagaagaggtaaccaaccaaaagcaaaaccagacatcggcttcaatggcttcatctcagtcagagaattaattttcgtaattgaaaggtgattgtttattagatcttgtattagaactccaacattgtggtatcggagcttaaatttagcctacttccttattcacattatccctgtgattagaagccatcggtgccatcttggttcgacatgaacaattttgagtcaaataagtttattctaatctgtttaaattcttatctttactgcttagtgaagattagctattgttcatgttcaattaaagttaataagattgagttagggttcatgatgcactgctatgtttagacttattttaagtttaagttttatgtccaattaagcttcacttagcagtataattaagaaattaagggtagggaagaatgagataaatcggtttcaattttcccgaaatccccaaattgaaaagaacactaagcctcaaaatccgaatcaaatccaaatccaaatcaaattaagaaaattaagtccgagtttggattcttaccggatttggagccctaattctaccgggaaaccccaccgctatttgggtctcaccgggaagcgggaccgctgcccttcacctcctcgcggtcacgttggactccccgtgcgcgtgccatctaggtgttcctccactgtccctcactggggacatcaagcgttggcttagtgccgccttctggctccgtccccccccccccgggcgaccaagcccgagtgttctcggcgcccgtcgccacttgcacgcccgctttgtcagactgccgacgccatggcttggcttggcgccgacctcgggcgggcctcccagccggcgaagccagagccgcgtgcatgcttcaccacgacggaccgtcgtcaccaccatcgctgccgtccactccctcgtgtcgccggagattagatccgggagagtaagggagaaaggggattagggttagggtttttagacccctcccccttccggctggcgatttcatcggcgcgggaccaatctgagccatccatcagatcggacggctcagatcggcccaacgtcgagcctgcataagcgaattggtccacacgcgcttgcccgcgtcaaggtctcataagctcacccacatgcttgacgagccgtgcctcgcgccccacgggctggcatgccgtttgggccgacaccagcctctgggcaaaaaaattcatttttcatttattttcaccctaaaatcacttattgttttatttaataataaataattttagtcaccttgagtcatcatttcaagctataaaattgcagtaaattttatagacgtattttaatttatttctaactaaatataaccaacgggaagtttagttagaatatttaattattttttatcttctcagcctaatggagttatgatttaggaatatttttgcactttgattttgtttttcttttcttttttttcctaagtggaaccaacaagaaatttagaaaaaaaataaaattattatgttgtgatacttaaattttaattattagtatttatttattgttaatattaatatcattttcacccgttgcaacgcacgggcatattgctagtactatttattttgttaacaaattggtagggcatgtttttgttatcaaaccaaaatggctctatattgaacggagtcagcaggtagatagataggtttgtaggttgtaagatatatttctgaagatgaaagaaggaacagagctcgctgtgagcattaaagctaggagtgagatgtgctatttatctcagagataaacatacctcttgttttagatttattaagtgatgatttttttacctgtcgtaaacactaattaaaaattatttttactatctagcagtcatttaatatattggacgttggggaacctaagtacctaacccatctcgccacatgtccatatgattgtgcttaattttaatttgcaagctcaataatcagtataatatgctggttttgtaattgttgaaacttgctgaagcccacagactggatcagtataacgagctgactttcggcaggcatttgccagccgtgttgccctgtcgtacagctacccggccatatggctcaaatcaatttatcaatggccactacccactatcagtgttgatatattatggtatataccgcctcaacgcgctccatatgacctggtactcgaaacttaattaacatgcatgtcgtcgctctgcttaattaagataattaagttcaactacgaactcggcaattaaacaaagtaaataagctggagagactaattactggatatcgactgcacccacgcacgcacacatgcaggccaagtcaattaatggatccgtactccatctcactctcttgatcactaacggcgacatgttcaagtagatcatagtcgtcatggcctcatggctagaaggatcgcgggagaagtcttccatacatcttgctatgtacttcgtatatatactaatccatatagctagagagcttaacaaccagtcaacagtctgggggagatatatatatatacactacatctattaaagaaaatatacccctctctgtcctaaatatttgactctgttaactttttaaacatgtttgaccattcgtcttattaaaaacttttaagaatattattaaaaacttgaatagtagtagtatatttaacaataaattaaatgataggaaaaataataattatataaattttttaataagacgaatggttaaacatgtttaaaaaagttaatggagtcaaatatttttggacggatggactactggtgtgtcatttgatcgatcagtgataagtccattcaactcgacgccagtttcatctatcgcgcatatcgattatctcaaaatacatatatcacgcattgtttatgcatgctagaatatgtgcaggtcaggtcaacggtttgttgctgacagctcaaaggaagttaattagttgtagggattttcttttcagtctggtaataatatgtagtagcagaaggtatattttgcactcctcaactttcaccaaaacttaaataacaattttcaactttctagttaaagatccgtgcattgtaacaaatgttgtaagagataaaagcaaaaactgtaagtttcagctagttgattaaagcatatattaattgatagaatatgttcgaagactccaactgattttcacaaaataaagaggcaactgtctataaaaacagtgaaaacattctaatcaggctcttaaaaatgcatagtggagactgataatcataatatcatttaaggttagtactatcaacagtaaacctattataatacacggtagccaggatcctcgctcgggtagccaggggaactacccaggacggcagcggcggtgaccaccagatctgcgccggtcccgctggatatcgggggtggcagctggcagcagtaggggtgagctgcgctgggtggcggtgtgtcacaccccaatctgataccgccgtacaacggcacctgacaggagcgtgtcgtagggaaaacggcgcgaaccgcttcctacgaaaccgcgatctcggtaccagtcccaggacatagtgctggtacccacggtgacaaatatgaatcatatcaatccttaaaataaatagaggacttatttacattaacttaggttgcagctcagacagcccgagaatacaaccgacgacacggacgaggcgaacaccaacaacaacaacagcagcggaaccaacggtctaacacccaacaccacaggcgacggctgggaaccaggacgaaaccctaatcttcacttcactttatcttctcttcagggcggaggaactatatatatatatttatatagagcaagggtgagtactttcgtactcagcaagtcacgggaacttaggtgtttaatgcaagcttggaagagagacaaggttgttttgcaaatcttttatttgaagacattttgaaatcactaagtgatttatttctttctaagtttgggccgaaaagagacttgcgtctcgattcgactttaagagatgtttttcaacagctcatttagtaatgtaccgacctctggggtcagatcattacttctcgactcccatagccattccacttgattaatcggctcccagagcctttttcattttctcggactcccagagtccagctgcccagcagcaaagcaatcctcttccactcgggaagcctagtctatgatgcccacagacatcccgaatcacacagattcgtttctgaccactcaggtcatccatctgccacaaaggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagacacgaacttactccagacactggccggtgtcagaggttcgcgacaaagcctttcccaagccgacctagggatacctcatgccacatagaaggatcaaatcctcacataaacataggccattttaggcgttcaccaatcaaactccaaccacctcgatcggtaattcagcaagcttctcgttcttgcattaccaggaacccggtttggctccaaccgaccccgccccggcgttcccaactattggcatgcgaggtttccctgaaccgactagctacttagccagggtgtcccattccaccttgtggttgcactttgattatgttcgatgagtttcccacaggaatcagtccttatatgcgaatacgggacagtgccacataggcacaacccccgcatcgcgagttttcacaattcattttattttcaaacacaccgacaccacatgtcgggttttgaaggcttcacaaacccatttcccaagttttcgacaaacaacggtgtatgtgggatatttggtatacgcgctcagagagcacgaataccgaggtaccacaagggtggagcgacaaggaatcagggtagtacgacctacggaaattagtgcgactactgggtaggtccgtcggtttggcacgcaaaccgaggccaagcaagttaagtgtgtgattctaataatgcaagttgcaaacaaaataataatgacttttcaattataggggcaattgatcaaagggtgacttgccttgctcaaggtcttcacgaagcttcacgaatcttcgagaaaaccctcgacgaaaatccgataaccgcaactatacgcaaacaatcgaaaacctaaacaaaagaccaaaagaaagatcctatttagactaattagtagtgccattaaatagatctcaatttacggaattattggaagtggaacggagtcaatcggacgagcggttggggagatatggatttcctaagattatttggattttctgtctaaaggaaaaggatttatcaaatcccttggaaaagaaaaggaaggagggatgtcatttagacttactcgggcggcttaggctcggcccaaggggtcatgcgcagcgcggtcaggccattgggccggcgcgggcgcggggagagagaggccgacgcgggtggacgcggtccaccgcgcgggacccacatggcggtggttgggttcacggtggggagggcgcacgcgggggcgggcgctagggtttcgggtgcgcgcggttcgggcgcggcgcgccgggtggacggatggcggcaggcccacgtgcagccgcacggcttgccgtggaccgcgcgcacgggagggaagacggagggagggggcggctgactggcttggcccggtcaaggccgaggtggcgccgagatggcgcctacgtggcagccacgcgggccggcgggaggaggaagaaggggcggccgagatggacggcggacggcggccgagttcaccggagctcgtcgcgacgattcgagagagagggagtacacctgaacgatgggacggacgagagggagtgagccaccggatcggattcgccggagggaggccggcgacgacgaatcgcgacggcgcttgccggcggcggcaaaagagggaaacgacgacgacgcgatgagagctcgattcctagggacttgagcatctacgcgacctcctgagttcatttctagagtcggattgggtggagctacaccgaggaaggccagcgacgagcggctactaccgagtttgggcagcgacggtggcgagcctacgacgagcagcggcggcggtcggggcggcgccagcttgctactggaaggctactcgcactactgcccagagctaaggagaggagagggagcgaggagggagaacgggagatgcactaccgagccgagacggacgctgtgacgagcggccgacgacgcggaagcgagctctccggcctcgggccgggaaaggggaaggagacggcgcctggagtcccgcgtcagctcctcgcgcgcacgccggcttcaccagcacgcgcgatggaggagggaggcgaggacagcggtagcaaggcggcaagggcacggtggtggcgagggaatgaacgagagggagatggggcggcttggtttaatagatggcaatgtcggtttagggaggaagaactgacattggcggtcaaggagagcgagctggcggtcatcgacgcgtgcagccaaggcggcgacaggtgatgacgccggcggtgtcgggcaaaagtggaaaaggaggggaaaaaagtgagctcttctctttgccgagttggggagggagagggataggagcgggagctcggcctcacagttttggcaggacatgcgtggaacggctcgggcacgcgctgtagagctcgcggcaggcagcggggccgagcggcagcgtagcgcaggcgctgacggaggcggcgaccgggcggtcggtcacgagcgtgcgcgcgcgcgcgggaacgagcggcacagccgaaaatcgaatggcggcagcgggaaatcggcgatggcggcagcgctagcgtgggagagagagatcgaacgagagagagagagagacagcgagagagaggaagaggacgagagagcgagagaacgtccgagagagggaagggagagagagacagcgctctctctctctctcggtggtcacgtgcggcgcacgtggagatggagggagctgagaagagatgggccagcggcaggtttcggcccaaatcatcacgagggaggtaaaatagacttttaccggaaggtttgatttggagagaagtttgatgtggagattgaatttgaattcaatttgtatatttgtacacgagggttcaaggtggatccaagggaggggtcaaggaagggcttcaaaagcgggaattttggtatttttgggatggatttatatttggcggcacgaaggattatttcagaggatttcaaaaagggaagatcattattcaaaaatggaacaaggaagatagcggtagaatgccatggatagatagatagacagaaaggtaggttgataggtagagggacagatagacagatggatagataaacagatagataggtatagtagatagatagatggatcgatcgatagatagatagatcgagactcagggagagatgggatggaagagaaggaagaggtggaccggaaaaaggatgaaggtatccaacctatgagggaggttaaatagactttcacagagagatttaattgggaggttttagggttggagtctggattcgaatttcgaggttgatactcggtctcgggagaataggaaggagtcaaggaagggaacaatattcggagacgagtcaaaaggggatggataatttagagaaagagagtgtaacttgggagtttgtgtttgactactcaacgagatatgtggtaaggattttggagagaagtctgaatagaagggttcggacttcgagattatttcggaacggaaatcattttggggagaactcagggcgaaagggattgaatcttgggattttgagttcaagggtggaagtgatctcgatttgcatattcagacttggatcagaagttcgagaaagagaacaagggtagattgatgaaccaatacagggagaaagatagatgaatcaaaacctgagaggttgaattcgaatttgagaatcggtttgaaggaaccaaggagagagcttatgacgcgaaggtgaatccttggacggagttagggttcgggcattcgacaaagttcacggatggggttccaagaggggattccgaatataaggaatcgagcttcgggactatattgggatggaaattttgaggagacgatctttgataacagggtatcgagacaagggagggatttaaattgagatctttggcacaacttagactcaacactcaaagaacgaaattttcgcaattaggattttgccgaattagtttttaacgtctcacgaaaagcagagcgttacacggtgaccaacagcggtagggatggcgacggcggggcggatccgacatccccggaggcaatctggcccctcagcggccagatcgagtggggcgagctcgcggtgggagagcccgtcacggcagcgagcgggagcggagatcgcgacaacgcagggctcgcggtgatggcagtgacagcgggtggccggcaatgacagtggatggaggtgcggtcggcggtggcagcggctagaggtacggccggtggcgacagtgacgaccgacgaggtgcccacggcgcgaggaggcgccggaacggccactagcgatgtacgccggggaggctcgggtcggtggaggcagtggccggcgtagcgagaggcgacgaggcgcggtcggtggtggcatgtggaggctggccggcgggggcggcggtgcagtggtgctcacgcgccggcagaggtttagatggtggtggagcatcggtgtgtcaacggtggattggcaagcggtggatggcgggtgaaaacccaaggtaggcaacgatggcgctcgagtgtcactccccttcttgagggtgttgtcgtgccgtctcaccctttttagtggggctgccgggtgaaagcccagtcaatgttcttgagaccacgacggacggtgggtcggtggcggtggtgctttcgtcgcttctctctctctggagacaccctctagcagcaccattaccggaaccacccaaacatctgctgcaagctcgctctagagttacatcctcttatatcgacgcccagtttatacaagttagccacgtcggagggcctaggggggagtggttccattcttctttctcaccctctctccctaaatccctacagatgatgag

SEQ ID NO: 57845 - DNA, 2424 bp, Oryza sativa
acctaaacatttgcatttcacggagccctaaatttggagacggatggactagtccaaaacacctgcggcgcagtcgcgcaccacaccaccttccgagacgggcttgcacaaaaccgtcgtgaggtcaggtcaggtcgtctccggcttcccccaagccgaaccactttgactcgtcaagccgccgctgatatcatttgctagtcccacccccgcacgcggcacgcggctttccgctcccctttctttttctccgctctccccgcggctattccggggcgttgccagtgacatgacatcccggtgttggtgcggggtgcgaccgatcgagagatgtggcgcaaaagccccggcatttcgcggcggatgactggttgctgccgcccgcgtctcctgcttgctgcctcgtcccggtgccccgcctgtctcgtctcgtccctccaaatctgcgactttcccatcaaaagcgaagcatctgctgcgtacaacacccacctgcgctgcgtgtaacatccatcatcggtcgtaatttcctcgcccatgatggggcagtggcggaccgggtgagtccggtggtgacgtcatcgggtctcggtaggagtagtactagctacaggtggcctcttttggttgatactgcgtgtccccaacctcgtgcgcacaagacaatgcattattttttaaaaaaaaaaaagcactctcggtctgtgcatgtacagtggtatttgtgcgtgtgacgtctttcgtaaaattgggagaaaaagaaggaaaaaaaaaacgccgaagaatgaagcgaacgcccgccctcggaccaaccaacctcgccgcgacggcacggcggacggctacgggattattacctcgtcgcgtgatccgccgcgttcccgacgtgagaggcggacgaggccgcgattggtggtcgtgacagctaccgatatagggaagggttcgcgcgcgatggcgttgcggatctctgaacttgtcaattgtctgcgccccatgggcacgggacgatacgcgtttctcccaccaaaccaaaccaaagcgtttgggtttccaagtgaagtgacggggccaatatttcacaatttcccaccgttcccactgcgcgagcacttgagttggtcagatgaacatcaagtggaaattaattaagctcacccactcatacataaaggctgtaatttcgtccgcacgaaattaataatgtttctgttacggacgcagtacttcattcgttaaagaaaaaaacaaaagtaccacggaatgtaattcatcttaatactataaatatggacagaatatatcacatttgatattacgtttaatttttaaaaatcaaagggagtaatgatggtgcaatgattggaagtactgtgaaacaaagacgacaaagtagttacggcagtaactaagctagggtggtaggagtaattatcaaacaaagacgacgaagtaggagtaattaagcactatcgtgactattcgtcttaaaattataaattgagattatttttttataataaaacaaatcataataaaatacataatttttatataagatgaatgattaaaatttacgtgaaaagttaacgacatcatatattttaggacggatggagtacattttacgggtactctctccatccctaaatatcatattcagattcgtagtattagaatatacactattcaccaaaaaaccctttaatgtcgtgcattagtgacttgggacgacaactagaaatgtaaggatcaccatcacttgacgataaaatgtcaaggcaaaggccagtcttgtaccactcggaggccggtgcacgccggccggccggcaggcagatgaccccaaaatcatgaaccgatgcgtgcgatcggtactgcacaaggagaaattccaatctgccaaacgtatacaacaccatgaagcacggtgccaaaagattcaaatgtgtgtgattctggtctcttcggtgtccatcaagcgtgacatttcacatttccaagggagggtttcagactttcagggttgggatggactggtctatcttccattttctgctctaaaaaaacacacaccgccctgtacgtttgggactcatacaggatgcagctttagttgaattattcaaagttcaagtcaaacaaagaaattaaggaacaaaaacaaacgtgatcgtttattgttttgcaacatgatacagattgtctgatttgagcatccgatggttaatctaaggaggtgaccattttactcttcaaagaggtagtatgccaatgttgacctaattacctatttgagtcgcccactcctgttgtattcaaaataaggtcatattattgtgagtcacttccaccaaatttgaaagaatcaaattcaaatggacagagatcaatatcccacgttttttttttgaaatacaaata

SEQ ID NO: 57846 - DNA, 675 bp, Oryza sativa
tacccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatgcgcagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcaaatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatcta

SEQ ID NO: 57847 - DNA, 2292 bp, Oryza sativa
  unsure (1)..(2292): unsure at all n locations
aatcggctccggaggagcataactaaaagcaggagttgggaagtgatgaacattgctgtactgcactggaaaatcaggagactgctttccaggtactccaaatccaagtggattggaatagaagtggctaggctgggcatactgcatgtatccacttgctggagcagcccagggatggttgtggagccccattgtggctgaagaatgtgtaggtacatgcatgctttggtgatgcaacagctgatcttggaaagggggtatgttgaatcccaatctgtcgttgtgaggccggtgcatggcttttggttggtattctctgaaaccttttcctgcacaagcctcaagaaggaccgtgaaacggtctttgttgatggagcttcctcgatgctgttgactctctctggagattcctcagagtcagatgatgatgattcttgatgttgagcgctcaaagaagtcacactgcttgtgctgctttctctatctgcttcactcgtacatgaagacaagccatcaggctggtagagttcatcatcagctcttcatcatgcccagaaccttcatcttttgttgagtagcagtcttgtttatccaccataatagtaccaccgcaagaagtagcttgatttttctcattgttttcacatggtcgatctgtttctgatttacagatatccctggatctttcagaagattgacttagtggctcatgccntgcgtcaaaatttgggcattcactgctatcttgttccactaatttggttggatcaacattacaaactgctcccgacccattgtttttgttgtctaacaaattcttcttttgagaatccattggttccatacttgctttggagcaccatttttctgctgagtattaccagtcggctttcttttgacacaataaagttgtccaaaggatagcacctgcggtactgcaccctagctctctcaactcctgtttttcttgccatctttgtctccctacctgatccagttgatgatgaagaacagctgtcatttattacatagtcatcacgagggtcacagctgaaggaaatgtagttgtgtctatcccttgttctgttatttgtagtaaacactgagttacaacttcgggcactatgtcttgtcctttcctttgattgccactgaaaatcaccaatgcttccattttcatctccgcactcatcatagcaacaagaggactgatcttgagggaaatcttttctcagcctcagattccatcttgatgattttgattgtccagatgtgaaaaggtcactgctatttgttcgagcaaattctgtcaatgtattgcagtagtccatattgttttgcacactaatctccctgcaagctgtttgatcaacaaaggtgtcaggggagcaaagatccaccactgtggaattatcttcttcttcactagctgaatctctagagtcaggagtatttgttgattcatcattagtagatgttgagttctgagagttgaacatgaattatcattgatgatttcaacccaaggatttctttccctttatccctctctttttctttcagcctctcttttctcctgtgtttcttctctctctcttttgttctcctcctcatcctgcgctcttgttcatcttgcttttctttctcttcttcttcaagaagcttgttctgcaagaagtgtgtcaacgaagttgatgtgccccaaaatcatggatgatatgaaatattttatgacttctatgcaatcaccacaagtacctgcttttccaacgtaataatttctttgcatgctacatggactcgctcttccaaaagttctaatgcaagagacacaaaaatactgtgtgcattttgccgagctgtaccttctctgaatgccttctcgacctgcaattaacccatatttagcatatgcttaagcttgtaacataagcatctgaaattttagcaaaaccctcaataaataaatcttgatttgatcttagtaactacagtaaccactactagtaatattacaggataaaagaatatggatccccttatgtacatatctctgtggagaatcgttctttaatttttttattgcattaaatatcttgaataataaaaaaagaaaattgactttgatatgtggaggtccagaactagattggcatgtacttaatggctacaacagtggctagaaaacacaacctcagaagtgactaaagtgactgacaatgctatgatgggggcaagacgggtagaaacaagaacaacaaaaaacaacttttattcatgaaccttaggtaa

SEQ ID NO: 57848 - DNA, 1782 bp, Oryza sativa
atattaacttttacttttacatacttataataaaattttaacagatattaaatggttagacattatgaaaatcaacgatgtcatgtatttaaaaagaagatagtatatatgtactactacatctgtcttattacattataagtcgttttaacttttttttctaaatcaaattttgatcaatttatatagaaatatagcaatatttttaatataaatccattcaaaaaaatatttttaatatgaaaaagaaactatcaaaatatactgaaggttagatttaataaaattaatttagtgctataaatgttgctatattttttgataacttaactatacttttaagaagatttatttaaagagaatcagaactatttgaaacatgaaacggaggggaatactagttttagcagcagtactgcctgcctgggtcatataatggaactggacgggacgggttagggcggcccgatcgatcggagagtcgacgaagaaagaaacgagaaggcggcggcttgggttttcaattttcagctcgaccggcgaggcaaggcaatcgtggtgtacgtacgtacgtgtggtggagtggagactggagaggcgaagcgcagccgcgcgtacgtgttggcggccgttggtgtgcgacttgggtacgtacctgcgcgattctgcctgcggaataggcatagccgcgcggccgcgcgcgacgagacgaggcggcgaatcgctgcgggcgtgggtatcgtgcagcgtagcgcgggcgcgtacgtgttgctggtggtgtgggcgtgtgcgagtccgcgcgacgcgagcgcccagtttttatcgcctcgtatcggctggcggaccgccgtggcgcgcggtgggtggggtggatgtacgcgggattgggcacgcggccgcggtgcgtaagctaaaaagagctagggcctgtttacttgatgttatttttaaccttatcaaattttatttaagttgttaaaaaagtggctacatttattttgctgtcaaattttggtaactatgccaaaattttagtttgctacccttagagcctgttcactttgatgccaaaaaaaaaccttaccaaattttagcattgccaagttttggtaacttgctaaaattttagcaggatttcttatatagttaccaaaatttggcagcaaaataaatgtagccacttttttttgcaactttaccaaaatttggtaagttgaaaatggcatcaaagtgaacaggccctaagtccgtcttgactccctctgctagtagatgaatctgattcgtatccctaaatcacaatgccaatgtagtttgactctctcagcagtttcatatgacggtttcactgatgtgacgtatatatggttgtgtttagctgatttttgtcctacgtgatgttgacgtgatacttacatgatactccctccatccttaaatagacgccgttgactttttaaaacatatttgaccattcgttttattcaaaaacttgagtagtagtagtatatttaagagtaaagtccatcaccggtccctaaacttgtaccgatgtgtcatcccggtccctaaactcgcaaatcgaccgttcaggtccttaaacttgttcgactgtgtcatcccggtctctaaacttgcagatcactcgtttaggtcctccatcttgttcacttgtgtcaccccggtccttaagacggtctaaaaattttatatcaaaaaattattcataactttttcatgtgaactctaatgaagacaaactttatatcaaaattgtagccc

SEQ ID NO: 57849 - DNA, 2323 bp, Oryza sativa
cagctctaaaagaaaaagaaaatatgtgttccccatttattcctttcgccattttaccccgctagaccgccaaccaactagtgaaacctcccatagtagaaaacttaattacatattgcattcccagtcattttgtcccaacaattaatgtacattcaacgattttgtgcccacgatttcgcagcacaacttgaggttgctttagtcagttactctgaacttcagtgcagatcttgttgcagtacaacaagtgttaatttactgtgtgtgtagtgcagagctttcacacaatcacacatgattgcagtaccagatcaaattcaagatgctatttgtaccctctcttctttatatataactggggttggggaggaagagaagatacatgtttcagcataacataaataagctaattgaggaggaggaaggagctgaacagaggagagacacagagaggtgcataccaagatacattttgcacgcaacttaatcacaagttttaaccacatactataaacctaatggcaacattgcagggctaggactaggatgcatcaggaaatacagtgacaggattttgaggagttctagaccttcctcttgattctgtattgtgcagtttggctctaggtaatgacatcaaaagggctgaagcctgtccaaagctacaaaactaaaacactcacaaaagctttcactagtgaaaagtgaatcccaaaatacaatcagaatgagccacgtcattgtgagaacaatggctattggatgaagaaaaggacaaaatagagaggagagagttgggccgttggattactgatggaaaaaacagttactgtaaatttccggagccttctgactcaaagaaaaagaagtgcttgaatgaagagagaggaggtcaagagcatcggctatgagcctgtgagctgtccaaaaagactgaggatggctagtaacataagtgacctaatagctggtggataatatgttaacgccaatattttgaacattgttcatcatccaaaagactgaagatggtttcgcaatctccaattcaggttgatctaattcactagaaaacctgcaaagttttttgatcaagaaaacgagtcactaacatttcatcatgtatgatacatactaatattcaaattagtagaaaataagtcactaataagaacaatgcacatgcagcatctggtaatataaaaatatttcctctgttatggtaccttcatggagtcatggttatatgtcactcgtagcacgcaatactcaaactagaacagtaaaattggatgggtgagcatcagtcaatgaatattgactatacggccagcacatctacaacaaatataagagaggtggagtaggcaattcaaatactgaattactgattcctgcaatatggtagcctgtgatacatgggtaggaccaagtaatgacagaaatatttcatacagcatccaagacaaactgctcctacagagaacaactctatctgaccgtattccaagaattaataatatattactgtccagctcatgaaacatcgtaattaaacttaattacctaggctttacataagtccatcattaagagatttaattcaacttaggttaagtgagattgagaataccttgaacggtttaggtaagatcattttcatgcatgattcacaattataaaacttttagtgtccaagttggctggttcacatgttgcattctaaagccaatcgcgaaatgggagaaaggatggagcttatttagatatgttgactatctaaatatatcttttactagctaaaactacagtattttaggcgcagagggagtcaaacattgttaagtcattttattttgtcatagacaaaaaaaaaatagtgaaaccttccatagtagaaattactaattgcataatgattgcactcccagtcattttgtcccagcaattttgcagcacaacttgaggatgcagataggcagttaccctgaactttagtgcacctcctgtacaccaactgtttaccatgtgtgtagtgcagagctttcacacacatggtaacacatgattgcaataccggatcaaattcaagatgctattgctaccctctcttctttatatataacttggggttgaggaagagaagagatgtgtttcagcattccataaataggctaattgagagataggagctgaagagaggagagagatgcatatcaagatacattttgcacacaacttcacctgaagttttaaccacaccatataaacctgatggcacctctagccataccgcattgcaggactaggactaggatgc

SEQ ID NO: 57850 - DNA, 667 bp, Oryza sativa
tggccgaggacccttcccgcgctgacccacgcaccatggggctggtcaccttcctactcccactcctctgactccttctggacgccgacgcgcgccatagcttcaagagccggcgcggggtggaccaaggagtctcgagccagtccttgtggtggagtcaagctcgagtggtcaggcggaagcttgccgcccctcaccggacaagctcgccgccggaccatcgtccacgagcgagggcacagcccgagtaggactagaagggcatttcgggtaaaactacaggaccattgtgtacccaccgtccaatcccaccagctcctattaggcgaaagagctacttttgatagagcagatacacttcactaggggtaaatgtaccatgctttaagattcgtgcgcacacgtgtagggtgcagatcgtgggtgcatatgaacccacgtgcagattatccaactcctataaataatgactgcctcatgtcatacgttaaagtttaactgcatgctatgtacctgggggggagcaaggcgagtgtgttagaggctgtatcaggtgttatttaatacgtagcaccttataacttattagatgaggcagtaatattttactcagccctcactagagtggtgacaggcgaattagaagagagatgactcagtgattttt

SEQ ID NO: 57851 - DNA, 1292 bp, Oryza sativa
ccaaccaagattaatttctattggtcaactacatgcaatatttaaaacttgatgtaatccatgggatacgaaacaacgtagtacaacatctccaacagcctctcccattgactctccaagttaaattttggctattctacccaaaaaacatgctccaacagcctctccaactcactggccgccaaaccctcctcctcactggctaaatttggctggccaatggtgggccccacactgacagtctcctccataccccccctctctctctctcgcatccgtctctttcccacccctcgagcacaggcaaccaggcgaggagcacggggaggagcactgctatggcaggtgaagacggtgcccgccccgccgctcgccgcagcctgccatagcatcatcctctggccgccctgccgccgcagccgccggcctccgctcgctacagcccgccgcctccgctcaccgcagccgttaccccgcctccgcccgccccgccactcgctgcaacctgtcacctcgcagcctgacgacggtgtcgaggtgggagaagggagacaaggcggcgtgaagggagtggtggcgctagcgagataggaaatgaggcggcagtggggcccgcttcccctttcggcgtcgccgtagtcttcgtcatccctcgccgtcgccgtcgactcgcatgtgcacggatttgccggccgctgcttctcccctttcatcgtcgtcgtctacttgctgcacgagcccacctcgcgcacacggatttctcccacccctttcccccttgcccgctccgatgctttgcctcgcgtgcgcacagttccaccttcggcgtcgccgaaaaggcgctcggtgatacctgcggaagaaaaagaaagtagggagagaataaagaaaagcaagcgactgacatgtggggacccactgtgatagacttaaaatagagtgggtagatggagaggctgttggagcgagtaagtagtttgactagccaaataagatggagagttggctatatgggtgtttggagagtccgatttggagaggctattggagatgctcttataactgatgagaattaattacagaatgataaaggtttagttgtccatgatctttgtgttctttgcttatgtgatgtttaaaatgggatggatggagtatttatggttaagacttactcactcttgcccaaattgatcatcatatattgaaaaccaaattttctcaatttgatcatcatataactgcatggacaaggatttcatcggagtacaattaaattaatacagcatggg

SEQ ID NO: 57852 - DNA, 3160 bp, Oryza sativa
ccagcggcgtcagcacgcgcaccttcctgggccggccgaggcggccctacgcccgcgccgtcgtcatggactcctacctcggcccgctcgtcgaccgggccggctgggtcgagtggcccggcgccgagcccggccgcgccgagacggtgtacttcggtgagtatgggaatggcgggccgggcgccgccatggacggccgcgtcggatgggccgggttccatgatatgggctacgacgaggcggcccagttctccgtcgacaacctcatctccggcgaccagtggctcgccgccacctccttcccctacgacgacgacgtctaaccgtacgagcattgtcaccgacgaaatccatgtccaatcaatgcattgtagtattgcactattactacacctgtattaatgaattattaccacgcgtaaatctcaacaatgcagccgttaattaattaccgtgtttcagagtaaatccgtggaactgtaaactgcaaaaatgcagaattaccctgttttgtttacgacacaaaaatcctaacaaatttcagtaataatggttgtaaattatattaaaggggttgccaaaaacatagcgacatatatttcatttatatttgagttaatttttttcctacgtaattgcgctctctaccctatattttgaggaaaactacggagtatgtataagtatggttctacctctcttatctcctcttccaagttgacaatacactacttggaatattatttctattatatattgtctatttgaaaaattacagtgtaatttaaagtgtaaaaactaattggttgttttttaatgaaaatgtggcgttataaatatctatcttatgctaattcttgctacagattctgaagcttaataatggttgttcttgaagctgactattgatgatgacacgacacgctgtaaaagaatgttaatgggtagtacactctgaatgtctcgaaggatgtcaacattcagataactctgagccaccaacttcagagtttttttttttagataataccaacttcagagttacattcagataactctgaggcaccaacttcagagttcagactcacatgggcacatgagtctcactaattaactgccagtgggagccaatctcttcatctctattggagtttttcttaatcaaactcaccagctgatgatgctagcaatgattgaaatgatcgtgcacaaaagtgttattcccagcagaatgagaaatagccaaacaggtcagaatatctgttctgaatcttgattgcttcacaaggacaaatttacaagttctccatgaaccaatttactgtttttaaaagcacagaattctaaatctgaaaaattagccaaactatatatatatatatatatatatatatatatatatatatatatatatatagagagagagagagagagagagagagagagagagggtacagaactacatcagaactgcctcttcagtgtacttgaattccataccttgaaaattattcttacacatgagcatttctatacaactactgccttgcactacatgatcattgatcagttcttctcagatctgcctcttctgatcattcttgatctgaagaacatcggcatcttcgaagacccggaacgtcgccagctcaatgaaatcagtgatctgaacctccataggcctgttcttcagaggaacagaagcaagcatgatcattagacaaccaaaaccaaatcccatcagacaacaaaatcctcatcaggcaacatatgctaatcttctttctcctttcagcatgtcaggaaaaattcagtaaattcagatgttggcaattaccatgggaagcaggccttctccggcagccgcattccgagccttggaccttcatcatacccttcacagaccatctctcccttgtcatctctgtagcacacaatccctctcaactggtcctcaaacacctgaaaattccgacaagaaaattcagaagcaaagttaatcaagacaagatcactcatatactctccttgcttggaggaaaacatatactatatgtatgtatactttcttgatcataattaccttcttgttagcagttgctgcagcgatggaaagctgtgatgagctggtgccgccatgggcaggagctctgaaccttagggctgccttcctggtgccaattaatcttgggatgctggccatggaggaaggatggagggagctcctggctgccattttggtttgtgctgagaaggtttggtgttcagctttctgcagagactaaatatagtgggggaaggagtagggtagggtgttataatcatggaggaacaaaaggttttattattgcaggttacatccggttcgtcccaatgacctgtcactgttttatatttaaaatgctgcttattgtaggccatgctttctattaagcttataaagtcatatttctgtgtatgccaaatttgaattttgacatttcattttagaattaatttacgggtttcttttttgttttcgtcgctctgcgtgactggctaagagtatatgggtaatactatattgccttgactagattgtattattttcggaacagctaagaattattttatcgtaggttagagccgatccatatggacaattgaattgccctgttactgttttatactcttttaaaagaaaatatggacaattgaaaagaacacaggaagcacttcaatcattcaattctaaaggagtatttaaagttctgcttgtcataatttcttttaatgtttacaaagtcatgcttctgtgtatgcataagtgcatgcttaagccgttgcgaaatttgaattttaaaacttcactttagattttttttttgagcgggcaggggcggttatactaccttcatccaaaataataataatgcaattctgactaatgcacctgaatattagctgcattgtctttggattataataatagttgtagccaacaaaatgccttccaaaccgatccttgtaaaagtaaaataaaaaattatcgcctgtagtttttcgtgttttgatcggtaaccgcaagcaatgcgcatctaatggtcttatggctgaatctctccccaataggttgggggaccccgggccatttcctcatataagtgataagtcgcaaatt

SEQ ID NO: 57853 - DNA, 1304 bp, Oryza sativa
  unsure (1)..(1304): unsure at all n locations
aatatctccatcctggaattttctcttacacatatatgcaccatcgtcaaagaggattgccagaaacccaccttgcaagcatagcaaggcattgctttggcatgtattctggagcagtatgtccaccaccctacacaaattaacaccaaaatactctttttagttactgagggcctgttcactttgatgccattttcaaccatattatttttttaaagttataaaaaaaatatctacgtttagtttgttgccaaatttggtcaatacataagaaattctgccaaaattttgacaatattgccatcttaccagaattttagtattgccaaaacttgataatatttattttggctacaatctaaacagaccctagatcatgcgtaccaagatattaatgtgttgcatcccttgaaggaagctaaaacgctggcacataccttgacagttgcgaatgtgaggttattggagtatgaccttatatatctgcacataagacagacggataatatatctggtcagagacagacacagtactcgcacacgtactcaattaatttgatggtatcgatgaatactgtgtgtcctcaccctgcaacttgtccatccacaaaccatggtctccactcatccacgacagagaaattcagagatctaatccaggcttgcgtgccgatgaaagggataatcatgtcatgatcaccactgtaaattaggcttctgtagcctctagttgtcaaatccagatggtatcttactgaacttttgatgtcataagtgtacagaatggcgtagatgcatctttgccacgaaggaactgttccctgcattgcagaatgaatacagnggatcattgcattgtgttgtgttatgctgtgtgacagaatgatcgaacctgcatgcaaattactgttcaattgaatgatgatgaacagatgtgtatatacctggtgaattccaagggcctctcttactgtatcattgttggcccatattctggacattgtatattctgccgtctgcatgacatgaagaaataccaaatggtaagatttggtcggctaaccaatactacccactaacatatactctcacagtcccatattataagatattttgagtgtatattatgggacggaggatatattttaattagataggatatattagtacaaggctgttcaaattttttgggaccggaggggtagcttgtactccaagaagatttgataaagaaaataattagggtccactgactctgcattctgaagaaatctcagacaagtgaaagtcttggagttggagta

SEQ ID NO: 57854 - DNA, 1120 bp, Oryza sativa
gtagttagccatcatactatctaagagggtcgatgatttgtgcagtaatagtattggcaacgtacccaaattaagagggtcgatggtttgtgcagtaatagtattggtaatctgtacccaaattaaaccttgcttttgcaattctaattaagggtccgtaaccaaaataaaccttaccaaattttgatattttgataatttagcaatattactaagttttagcaggatttcttatgtatttaacagagtttgataaaaaactaaatggatgtatatatttgacaacataccaaaaatggtatggtttgaaatgacatcaatctgaataacccctaagtaaaccgatattttttttagaatacacagtacaacgtagacactcacaacgcacgcgcactcagccacaacgccgataaatcctgaaaaattcgctctcatgggagagtcgaacccaggacctcatgtgctactgaggctcttgtaactactaggttacatgccctttcgcttgtactgattgatattggtggaataaataatatgaattgatcaatatatataacattcacaaaaatattcaagtttaaggaccttatttctccagtaataactcgaaagcaagtttaaatttggctggatatttcgactcaatcaaacaagcggccaccggatgaaatggctggagtgggtttaaactgctggaattcatcgaaattactcgtgttggtgaccaaaacgttaggccgcttggcgtgtgcaattttggatgggggaacagttcgttccggccatttcaattgatatcggaacaaaattgacagtcttaattatgtatgtgctacattcacttttaaatataagcatttataattataaatatagacaaaacacttatccagatttataacgaaaatactcataattagtttagactcataacgaaaaacactcatttacctcttcaaggccggcgcctcaggtcgtttctcgtggtgtccacgtcggatagctatagtgcgtgttggaaattttataaaaaaaccctttagtttgtacgtaatttgatctaaatccctcactaacagttcctctatgttgatattttacatttaagccctta

SEQ ID NO: 57855 - DNA, 1148 bp, Oryza sativa
tacgaacaccatgacgacatcaatcacctggtgctggtgtacatcgtgccgtcacgctgttctccatggggttcttccgtcggactgcagccctgcactgctagctctccatggtacgtgtacatggttctagctcgcatcggcatgactgcgaaaacagaatggaagatgaagatggattactgaactttagcatcatttcattcgtcggacattaggatacagatctacacatcaaacacactaaccacagaagccatgatcagggatttgagatcaggagttcggcgccgctgtttttatggatgagccactgcacaggagtacgccggtgattacgaaagggcacgcatgccgtgaaacctggacgaagagtcgggctggcggcggcgcctgctctgctatttcaatggatggggttggatctgcctgcgcatcgcttagaaagacgggttgcgctagccaccatcgatgatggatcgacattgtcgtccggggaacgccactgccaccgccggctcatcacctggatgaatgcatatacccggtgttaaatcccagattaacgagtttgactagcccgaatataccgtgatcagtttttaatcgcaatttttttaacaccaaaaactaaaacgggtttgcctgctaaacccggtagcacacatgagattgggatggattaatcaccggtggatgggagagggagtacatactccctaggagtatagaaccattttcatatatatagatacacacatataaaaaggaggagttgtacccctccaatcctacaggccaaatcatccggatcaatccctaccgtccatcgctatcatccaacggctcaaaacgcccaggactggctatgcgtagcgcccgcggacgcgttgaccccaccgtgacgccacccaatcgctgcatccccatccgtcgtcggctttgctgcaggtcatcgtgttgccaccgttgctattccacttccatggtcgccgctgccgccgcatcgcgaggggactcccttggtgatgccccgatgcaatggagggcatgggtgccgccgccaccgccaccgccgcccacagttgatgcatccgccgcatcccctctgcctgctctcacgccctctgtagctcagccaccggtcg

SEQ ID NO: 57856 - DNA, 1505 bp, Oryza sativa
ccgggctgctctccgagcggatgaagtagtaaagaggcgcacgccggcgatgcggtccacctccacgtacccggtctccagctcgaaggggagcgccccatcgaacccggggagatgcctcaccactctcctgctgctgctgctgctgctattgcttctctctctcgcagacaggcagctgcaggtgaccaggagaagaagaagcagcagcagccgccgccgtgttaccgccgcctccgtacatagatgcatcgagaagtagatagcttcacctatttcttgtccttgtccttcatccctcacgtttttgtttgtgagatgatcgatcccttcattttggagagcgaatatgattgattgcctagctagcttacctgtctgtcctcttcgctcagcagtacaatatctagtaatcttctattcttctttttccatgctgctcctgcctccttaattacttgtcttccacttgctaattattgttgcatcgttgacccaaatcagattgatatggcggcttgtttggtaacttgatgaaaagggattggaagtttatcgaggaaattgatatgagattaagataggattcgatttttaattccaatacattgtttggtagaggtgatgaaaattgatagggagtttagttagagattatatcattaataaaaacgcatggctgagatttgcttagataaaatagaggaggaattccctcccaattacctgcccctacccaggtattaaaaagtagggagttccttcctcaattcctcatccccatcccaccaaagttcccatatctcccaaccaaacaaaacacttaatagtctcatccctctaaactcccaatcccttctaaaaactccctccaactaaacaggccgtgggtagatggatgggatgtgtacgatcacgagggcattattatttttttgggttttgctatttaactttttatcaattttttaaggtacaaaattaataaaaattctgaatctcagaaatttatttgtcttttcctcccttgcatgtttctaaaagaaacgagaaaaagagtatatatccttgacttggtgggagtgggaacgtgacgtagcatcgttcgatgccactaattaattaagcttgcccagcacagtagacgccgcagcccgcactcttataattaaaggtctgttcagacagtcaaaataaacctcattaaatttggataaaaccaaaattttagtaagtcagtaatattaccaaaattttgacaggattttttttatatatttaccaaatttagcaacaaactaaacgcagacattttttataacttttcaggaaaaatggtcaaagtagcatgttgaagaccgtatcgaagtctaaaaatatttatttaactcttttttaaaaaaatcatttaaacaatatagcgtataatatattgatttatatttttcatatagcagataatatatttttttgaaaccgagcagataatatttttccttgtcata

SEQ ID NO: 57857 - DNA, 677 bp, Oryza sativa
gtagtttatcaataatgcacccggccacaattttatcgagtaagacacacttaaggagttcgagttccttagccatggcatgtatttcatgagcctgctcaagtacaaaacgtttgtcaaccatcctgtagtcatgaaactgctccatgacgtacagatcattgctagcatcagtagcaccgaatttggcagtgcatcccacaactccttagcgtcagtcatgtgcatatacacctcgactagacgatcgataagaacgctacgaatccatcccacaaagagagtagtggtcttctcgaattctttctgcttttcagcaatgagaactccttcaggtttgccattattaatctagaagcatttcatagccatcaaccacagagtaaccctgatcttccatctcttgaagtgcacaccgatgaatttatccggccttagagcatgggaaaaactagtcatagtaaaaccacaatgcctataataaggtttttggattgttgaaaatattagcacataattatttcatttattccataaataaatcatgacattgcaaatgacataatcacatcatacgatctacacatgtaaactagacagtaaagtatgaacagattgaatatgcggaatatgtcgaatgcataccgagggttttggaaaactggctgctcagcagg

SEQ ID NO: 57858 - DNA, 716 bp, Oryza sativa
tgcagccctatttaaaacattttacttttataaatattgctggtcaaagtagcatcttgaatactgtatcaggatttaaaaatacttatatttttggacgagtagattgccgggtgacttgtcatgacatccaaagaatgaaaattagaaccacaaatccacggtaggcagcaatgaacgacggcgtccgcggccattggctcggcggtgccgtccccagcacagtcgccggccgccggcagctacgtcgtcggccggcccaacgctttcttacaatcgcccagcttgaccctttcctggctaagaactaggtgctgatggttcgccccctgtacgtccagcaaccaacaagcaacaatgaggtcagatgaacaaccaacaaccatgacttggtgctgttacacttgtagcatctgagatgcccctcctaaaatctatagaatcttatatgtctatagatatccactacaacatgatcagcagtatctgaactttaagaggatggggctgactattggtcaggtgaaagaatcagaatttgctgagtatcactttcatatttgtcattgacctcattttgctgaatagaatcatcaccacgaatccacgatctgttccaactctagccgaactggaaattaaacaaaattagtggtgctccatcagaaactattttcctaattgcacatacccaacaaaattgacaagcaaacaat

SEQ ID NO: 57859 - DNA, 30913 bp, Oryza sativa
tttgtgactggtctgacaccggtcacgtcatcggcagacaaccgtgctctcacgttgcatctgcttccggcggagtggaggcgagtgacggcgctgggcctcactcaaggacaagctgtgatttagcttccaggcgaaggcgcgagccaagttttggtcaagatagggtgggtccccacccaaaagaagagtaggtagaagtggtgcatgtggtatccccttgagatataaaaggaggaccttgcccacgggaactctgagagagggggactctcagacgactctgggaatacctgagctcgtagaggagagaaaggggaagaggggttctagagcctgaactctcttgctctccggctctctgtaacttcttcacacacagatccaccagaacacaggagtagggtattacgcttctcagcggcccgaacctgtctacatcgcccgtgtcttgtgcatttgctctctcgcgaacattccacagatcgagggtgaagaacctcacttagcgcccccggctgaaccggcaaaggggggcctgcgcggtctcccggtgaggagccccacgctccatcacatcacatcgaatctttggacacatacatgaagcattagatgtagataaatgaaaaaactaattacatagttagggaggaaatcgcgagacgaatcttttgagtctaattagtccatgattagctataagtgctacagtaacccacatgtgctaatgacgggttaattaggctcaaaagattcgtctcgcggtttcaaggcgagttatgaaattagttttttcattcgtgtccgaaaaccctttccgacatccgatcaaacgtccgatgtgacacccaaaaatgttcatttcctcaactaaacacaccctgactaaaaagacgggggctattatcgataaatctctgcccttattaaattaacataatatttataagcatcaatatttaaacctggtggatagagtatatactcacaacttcgctaccacaccattaatgtaaattttcagtaatacagtattagccaagtattgaatgtgggaattttgagctttataggtcaggtggtggcatccagtctggatttttcacaatttaattcttttaaaaaacttatttcgcaaatagatctatgaaaaaatttatcccaaaaatatagtcctttttgggcgctagagaagctggcgccgtcctcctaccaccgtggcggggcgacgctaaggtggcagggggagcgcaccaatgtggccgacgccccccccccccccccccacctcccccaagtgtagagagatgtgcaactttatatatatatatatatatatatatatatatatatatatatatatatataagaaccaaccgtagaaaaattaaactcaaatggacaaaatatgtgacttgtagaattttccaaagctataccgaaaagcccccctgttggtatttcttaacgatattactagaaatataattcccagcaatggcgcagaaatactcctggtatattatggttacggagtttatccacaagtacacggatataccattgtagcatttaacccgagagtattccaagagtatcatatttgtttaatcccgtgggaagattataatagagagaaccgtactaataatttatatattacttgtaataaccatagtctaagtaggggttagtataatccaaagggtagggtgacacgcaagcatagaactactcattctcatattaaattatctaagctaagtggaaagaaaatagaaaagaatctatttctatacttctagtatacatactgtacatacattctagtcatatgattaacaaactaataccctctatccgatgccctcctgatacttcaagaagccacccctagctgccgagttccttacgacagctcgtcatgaccatacaaccggggctaaatacggaggagtaccctccccaggaaattaacttaggactatatacacgcgcagaggaatagacgtactgagctgtcaccatcagcggcctacctctcatccacagcacgcctaaactaccagatactactttaataacatcgtcatgacatagagtaattgcataagcaaatattatacctgtacctatgcatatcctagataagttagcagtataatcagtataacatgaacataaaataaagttggcattcatatactcaatatactcagaaagtatttcaataccagaattgtataaagaaaaatattctaaataaagtacaaatcttacaaaagagaaaaggagagctactagagccatacccgaactcttccgaagacttccggactccgatttctattctattcctactccactagcttgagactactaaactaaacttgagagaatatgagatagctgttgcttgaagtgtgtgaagaaatgaagagagtgagctccttaaataggcaggtaatgatggttatggcggttagaaaggtcggtaataccttccaaccgcctgtcacgcccagaaatttaggccaaatttccagactatttttgtgtataaaatccctatccaggactagctaaggtacacaaaatgacaagtaataaacagttccaaacgtaaataaagcgtaaaaatacttacagaagaggcacttagtcctcacaccgaaagagaacgacagcagcagaaaaaggcgatcctagcggggcttcagctccactccacaggcaaaactcaactggggtctgagccttggtcttctaacttcgtcttcagctcagaagcactacacttctaaaaagggggaaataatagcaaggctgagtacaaccaccgtactcagcaagccacaccaacgatgcaggcgtgcaaggggatataaggatggcttgtggctatttgcataaaggcgattgtaaaacattttattgagcaaaacggtaaaactgttgagtaattaaagtaatattaaatctccactgatcaacgctacaccacgttgaacaggcccaaccaacccacctgaactacagtgcattgggtcgatttattaagtatgagactaatcacggtgattctggtcgatcgcccataaccgcgggcacggctattcgaatagttttactctggccagaggtgcacaactatacccacaagacacaatccaccagcatgtcaccgtgcccggccagacacgtcaccatgtcgagtgattgtgacaagacccttcatataacccgctctgaccaagcacaccacaccttaagtttcatccccgcccctagcaggcagcgggcagtcccctctcgtgcctaggtgaatccggaagcaacagaggtcgtcgcagggaccgccccgctccatcacgcccacccttgcctggatgcgtcagccagagaaaagctatacttcaagtcaggcagttacctattcccgcttgtggcaagcgctgtatgtcttccagtgcatcccgcgaactggtccttaattgccatgggtgcgaccagcaaaaccatgcacccacagcccaccattcagtcacgttttagttggatacttacgaccaatgaaacatggtcgggtgtctcgagcacgcagctcgtcatgatactaacaggtctaatactgcaattatcccatcaactgagctagtggtaattaagcatggctaagcatatggttctagctgtgtcacataagtaacatgagctagtcgatttatcacccaaggttgacaaagagcagatatcagtaaacatggcgcaagcaagcagataggtaaactctgatcccatgtaattagcaaaacatgcatatttatttgcaaatggtaaaatatttgcaaattggaatcaacatgctcaaggggaatgtgtgacttgccttgcttcttcacttggatcttctgaactcttttcctcgcgactgcgaacttccgaaacgacgtattctacacgctggcacgcaaaacgagaaaaaactcaaataaaaaccaaggaaacaatacataaaaagtaaacaaacatgtagagctcaattttagatgaattttgcaagttgaacggctcaatttggagttcgaatgaattagatatgaattttagcagttttgagccatttaaatgaatttctagaattaaatacgatttatgacgcaattattaattatttttccaaaggaaaaagggttgctgacgtcatcaagggggaagggcggtgccggcaagcgggccccaccggtcagcggcacaagggcgtcggtccatcgtggaccgggaccaccgaggcggtccaccgccggtccacgggaaccgacggcccagattggcccgagccgatcggatggccacgggcggtgctgctggggcatggcatggctcaaagccggccgatcgagtgatggcgatgggtggcgcgcggtggagcagccagcggcggcgcacggcacgggggaggccagcgaagggggaaggaggaaaaagggagggggagtgctcaccgagcgacacggcggaagcatgcggccggcggcgaggaacggcgacggcggggctccccgggaggacagcgtgatggagctctggcgacgggtgtcgcttgggaaaggggtggacaggcttggcctcgatttgaggaagatgaaggaggggttaggaaagtgaggatggttgcgaggtgaccggaaacgacggccgaccgtgacaatatgaggaagacctcaccggcgaccgagggaggtggagctccggcggatttccggcgaagagaagcagcggccgaggacctcctcgtccttgcggagccgagggagacgacgacgtagcgcgggacggacgagagcggcggcgattggcggccgaaggcggcaatggcgacggtggctcgggttcaccgtggagagggcagctcgggggtggaatgggggagcggcgtggtggccaggcttgctcgcggggcggcgaagccgactgtggtggtggcagggcgcgggagcggctcaggcggcgacagcgtgcggctggaggtggtgaaagaggcggcggcctcgggtgtgcggtgggagttgtgctccggtgatgaaatggggaaacggagcgggggctgaggtgcggcaccgtgcggcggagcctacggcggtggctacgcggcgcagcgaccactagggcggcagtggcgggcggccgaaggttgccggcgagcggcggcgatggggtgcggcggtgtcgcggtggtttccgggcacgggagggctcgggagagaggggaaaagagagaaggaggtgcggggatcgttttatagagctcgggaggggaagatcgtggccgtggtgggcggtagaggccggcgacgtggagcggcatcatggcgggtgtggcggctcggcgtggcgccggttcccgcagggagagaggggagtggggcgggatgtgggcgcgaggtggacgggactcgagtccacgccggttaggacgaggggaggcgcgggatcggcggagggagtgggcagtatggtcggcggttggagccggcctgaggttggggatgacaggtgggcccatgggtcccacctgtcggggagagagggagggggaaacgggctagggaggtaatgttgacttgagggagagagagagagagagccgagcggggccgagcggcccaagaggagaggggaggagggcggccaggcccgagcggaagggaggaaggagagggttgggccgaaagcggcccaaagaggaaggggagattttattttgcttttctttttattttaattggttaaatgatctctgtgactttcaaattatttcttgagctccgaaaattcacggaaaaatccggagagtatttgaaggcacaaagaatattaaaaattattcccggccaatgatatttaaaaggaaatttttaattccctcaataattcacttgatgaaattgatttaacttttattaaatttctagaaaatacattatttaatgatttttaatcccgaccgaaaatcggggcgttacaatagggaggcaatgcacaccgtccagaagaagtccggcatccaacggcaccgaagaggattcggccgaaccatgggctgggcctccctggcccattttcggcaggtggcctcctcttttgctctactctgcagacttgtgaattttggcccaattcgacgtgtcatttctaagttcttggcccattcatacataagtctgattctcgatatcgtccgattgattgatcatttggtttgatgtcgattctcctccactttatggttattctctgcaaaaggttagtaatcctaatactagtggaatattattattctaacttaaatatgcattgcaagtataactagttctcctctattttggtaatattggcggtcgaaacttgatcgctaacgacagtcaacaccccccctccccccccccccccggcacgcgctctctccctgctctttgttgttttggtttttatttgacctccccgactgcagctccatcttgtctggtagcatcaaattcaaaagtatggggaaaacgcacgatgatcgcagcgaaggaaacatatgcgcccgtgagcactaatcctccatgattctctctcctcctttccgtcgttgggcggggcaactttatttctgcatcctctacttctcgatggtatcactacaagcagcttcagccatagctggatgactttctaggttttgtacccatgccttctgggcaggtaaaaagcaccagatagcttggagttccaacctaccatatcctttttgttaggagtttttaatctttcaatgagagggggataacttctatttggggaaggagtgacgttggcagtctgactacaactaccacatggggtgttgcaccttatcaaccaatacaccaactccagttttttgttgttcttgctgtgccaagaacaatattaaacctgcaattaatcgaagaacaagtaagaacaagttgataagaaaacagttcacatcccctgccaatgatgaaaccgatacacacaaagttggggttttgaatgaagtatctgggtgatctagccagcaaacacaattacagtgaagtagctgaagctaaatctgtatctagacaaaacgcaggttgcaaaaagaggctactaggggtttttataagaggaaaaacgacgaggcggggtggtgggagcaaaccctagcctttggggtggtgcgagcaaaccctatcctttgtggacccctgatgggctctactgaagacaaggcccaagcccaagtttctggtccaaacattgtttctattattctaggcagctccactcaaatttgatagtgaggctaggctcatttcaaagtagtcgacgatatctttacaatgagtactcatgaggtccaaacgaagctcgtatgtaaatttggtggccgttttaaaacacttaggacgatatatttttttcacacttaggagcacacaaaaaccaatcatagaaaaaataaactcaaatggacgaaatatgtgacatgtagaattttccaaagctctaccgagaagctttttgccttgaaaatacaatcttgcaagcagaatttagaggttctaatttcgctgaacccgacaaagcgggggagaattggatgtaactttttctgtagatgtccgtggatatattatttgcttgattccaagtttgtatgaaaaaattacgcctgttttaagaaatgacacccaaatgtaaaaaaaaagaacacaaaccctaacttttttttttggtttataggatgtaaaaggtataaaaaaaaggctaaagagtgttcgaaacctgatctactttttttttttgggaggtgggggggggggagaggggactatataagggctcacacatgcttacccccgctcgaacataaaccaatgtgggtggtaggagcgaaacgtggctagccttgctgcgtatgtgtcgaaacatgatttcggcaataataaaagggggtggcgctcgagacctaaaagtggatggatgcggagacaaaggatttagacaggttcaggccctctcaatgagaggtaataccctactcctgtttggggatttgaatccgccgagtgtgtattgatctgacgatcaggttgtctcatatatatgccccctagagggcctcctgcccaccttatataggatggggggcaggattacaagatagaaaccttaaccaatacggtatcggtttcctaaatcaggactctaggccgttccgtaatatacaaggaaacgtaacacccaagtcatgatctgttacatattacatagatataagttatcccctataactagtcggataaccatgccgtgtgggtatggggtacccataatctccacagtatgcctactctttagtccatgggattttttgcctagcaagttagtgttggaaaaaaataagagtttacatatggaatttttatacacggcaattttatgtcatagaaatgaaactttcgatatataatctttgaacaaattaatttgtagcgaataaaaaaagaagaaaaaaaatctatagataagtttataaaaataaaacttgtatgtagaaacttttgatacatatgtaaaaatttgtactttgtgtaaaacttttggtatataaactctatgcaaaagcagattaaaaaaaacatttgtctacaaattttcacctaaaaatttgacagatgtaattatagtacaatcgtagtgtaattacactataacttgtatgtaaatacactgtaacatgtaactacagtgtaacttgtatgtaagtttcacgtaattttgaatcattagatctaatacaagatttgttctagtgaggaagaaaaaaatcacagcacacacatgtgtgaaaggatttgttcccacgacctccattttaccgaaatagcatgttatggagagatttttaaaagttatatacaagttactgtgtaagtataattgcatctgagaaaaaaaattatcgacaaatatatagcaaaattgaaaagagaaggagaaaagacaaacatgccaaatgtgtcatgaggcccgctacttatcggtccatcacttggtttcggcctttcatggcccactccaaaggaccaaaatcgaaaatatctcgaccatgcaaagagaagatggctgggcaacatgttcgtgcggctggcgctgggctcacgcacaaacgtttgcactcatgtgcaatcagctagtttgttgccataatttttgtgtatgtttgtttcgctatcaaaaccatgtcatgccacgtgtttttaagtacaactatatcatgtcacgtgtttttaagtcttaggatccagtgtcacaattttaaagctggccatgccacactttagataaggtaaaatctaattggagaaacctctccaattagtcttaaccagagacaccccacgtgctagtactttaagagttttggttgctattaatccattgagcaagtagggaaaatattcctatcatctatacttcaaataaaattttctcttaaattactcatccgatttacaatccgattacaccgttgtgttcgtaataattaaatctttacaacaagatctcacatgattatattttgatgaaaaatcacaaattacttttatgatatgtctaaattacttttaggtttcactaagttacttcttagacatataaaagtaaattcagtaaagcctaaaagtaatttacatatattatagaagtaacttataacaaaaaaaaaagtaactttaattaatgccttttttcattgaaaaaattatcatgtatatctaaaagttacttttagatttgattgaaatacttcctatacattcataatgctctgaggtgattacttttttttattattattagttaattccataatttgtgctgattaatttaatttgtactgataatgtttttatctctacaacagatttatgacatgctaaagttaccttcattttgttctaagttacttctataatatatgtaaattactcttaggttttactgaatttacttttatatatataagaagtaacttagtgaaatctaaaagtaatttagacatatcataaaagtaatttgtaatttttcatcaaaatataatcatgtgagatcttgttgtaaagatttaattgttacgaacacaacggtgtaatcgaatcgtacatcggatgagtagtttaagagaattgtatttgaagtataggtggatggtgcctcttatagatggagtggtagctggtttagacaaaccagctaccactagccgtgtagttacgtcctttagataactactactattaaccacattgtttgggcaacatgtcacaacttggttaaggacaagtttaggcaacaactaaccaaagattccatagataacagactgcagccctccagccgactgccgaggcagtaaggcaaagggtgcccccggcccctggcatggaggtactcaggtacaagtacaattgttatgtgcaactggagtactggaccagaaaattcacatcaaaaacagagagcagaaagcacataaaagatcatacatagacgaactgaactgaactgtttaatccgagggctttttattcttcggagccatggttgccatggcaggcatccattatttccggtgtccaatagtttctcagggaacactcaggcaacaacaacaacacaaggtgttttggttcctatccgaatctctgtttcccttcactgcgggaaggtggccacaggatggacacccaacacacaaggaagggttattactggtactggctcgcgagctgaccttccttgacgatgtagttctgcaccgggaagtcttcccctttgaagtacctgtccagcatgtccttcactcctgctgcgtatctcagctgcagcaattgttcatttgccgtgaaatttcgttacagacacagtcagcaatacttataggaaacagattataagaccaatccaaatgcccacatataatctatgctagacataatacaagcaggacccgttgccaatgtagtgagaaattgaccgccgaatctcaaccctatggctgaataaagcagttgtgcatatttaatctagcttggagtaaaaacatcttatatgattttgatcttaagaaacaattattgatgaatcaataaagtggcccttggtttgtactatgtatcatgcaaaacatgcgctgccatctgggtaactaagttactcatctcactagctgacatattgctctacagttttgttaaagcattgtgggggtacccacagaatcagattctagaattttatgctccaatgccctaagttaaagtagaaaacatatataaaagctgacctgtgcatcaattgtagtcccagagatatgaggggtcatggcatgattaggcatgtatcgccatgggtgatcctttggtgctggttgggggaaccagacatcaccaccatatcctgagaaggaagaatgaggttttcatgctaaaggaaatattgatcaagatagaaatattaatacggcatcattcttataatttttttttcaataggacaccaatattagttctctggaaggaaaggacatttagtagtttgtcacagattaaagaatcatggtaagagagctaatttacataggtgcagagaagttcttttatttttttaaaaaaagattcttcaataattgtgaacaacaagttatcatatttgacatacatactgctttactgggttagttgtcctggttttaagttttttcatatcacccctcttaaatgtgaagcatgataggctccaggaaaatgatatacttcatggatcaaaaagaaagatttagaccaaatctgatggcatgctagtatgcagtgtaggctataagaaatgaaaggatgatggtacctgcaacttgaccactagagcaagcgtctgcaaccgcctgggtatccatgattgctcctcgagcattattcacaatgattacacctttcttcatctttgcaattctttctttattaaacatacctctgaagaaagaatcatacaaagttcagataagtagatgtactatgtatatgattttgcaacaaacaagaatacgatcatcaggaaccttgttttctctgtaagaggtgtattgatcacaatgacatcacactttggaagcatagcatcgagatcctcttcatatttggccccaatttctttctcaagttctgggtcaattttaagtctgtcatggtacagcaggttgcagttaaagggcttaagacgctgaagtaagagcctgccaatacgaccagccccaacagtccccacagtttttccttcaagatcataagccctataggcaatgccagcaacattccattcaccatgaacaacctgctgatacccgggcaagaagttcctgagcaaaatcaaaatgcgcatgagctcatcttctgccaccgacacagtgttacttccggtaacctctgccacagttaaacctgctgcagcagctgctggcagatcaatatgatctgacccaatcccagctgtgagaagcagctcgaggttctttgccttcttgatcctttctgcgctaacataggctgggtggaaaggggtggtgatcaagacatgcatatcctcaatgtgcttctccagctctgacaacaagaaaagcatcagttatgtgcacaagaggagttaaaaggataggttcagagctatgttgctatttaaatactgtagttgttatctgtcttagaactaaagcacaaaaatagttgctacatgtttttcaacaaatcgataagagatatgcaaaagaaaaaaaaagttcaaacttgaaacatgtatgcaacataggcacagacaagaatttgagttaacagaacagcatgccagcatgaatagagttaatttcagccgtgtgctagaggaaaccacttggctgccaaccactcaacacgtgaaagcatgactaccctaaccacatacatcaagaacctcctttccaccttccatcaaccagatgaatatcatccttaattctcctgatcaaaagataaaaataatcatcggcgaagttaagtaaacgctcatgtccacctatggcaactccatccacctctattcagcctgtacagggccaacactacaagctgggagatgctagctactcaattcatcatgtgtaagcggctccatgcaaatcatacaccatgcacaactaaaaaatgttggtagaaacttgagagaaagctctgaaaatctgaacatctctcgcggatactaccacttaccgctgtttagcccctccttgtcgtcggtgacaatgtagtgatgccccttggactcaagccattcgcggatgccgagagcgccctccacgcagccgacgaagttgggattcttgtcggcgtactcgccgcccttgtagaacacacccacgatcttcttgctgcctgctgatgtctgcgattcagagagggaaaaccaaaaggtataccattcttcagagttgcagcaactgagatttgttcagacaccgaaattcacatcacagaagagatcaggaaaaccgattgcaattgttcatcacccattcccgtacaaaaggggagaaacatctttttgggaggagaaaaaaaaagaaattccgggaggggacaaagcatactgggaatcacgaaattagggaggaatccatgcttttgcaaaacccaatctacaatagaatgctcttgctctcgcaaaaagtaaaagctaaaacccaaaattcacctccgaactgcacccaaaaaaaaaaaaactcgcagcagaaacaaaaaagaaagagatactctagacaagaagaaccccggtcgatccagttggaagtacgtacgtgcgcggccctggagccgagcgcgcggccgagaagatgccccgccgccgccctccacatcgccatgatcccaggaggaggaggagaaatcgcgagacgaacgcacaggcaaccgcgagcaggcgagagagagagagtgatggaatcgatcagtgcagccgactcgatgggatagattgatatggatagataaaggcccgccacctcgcgccgccaggtgggccgcgtggacgcgggtaggtgggcgcggcgggctgacagctggggaccagaggctgtgtgggctccatttgtcagcgtctgcagctgctcacactattaggatatttattttcattttctggagtatatgtataagctacacatacgtggccccttggcgttgttaggataagacggagccttgctggtgatcatccaaaacaatgtaagcacttattagcaaataatctggttttaatttgtgacagggactgaacaagtgaggacactagggaagcacgcacgcttcgtgcagctttgcgccatggagccgtggcagaaacagaaaggctgcgtgagtcacccatgcacgtaggccctgtttatttccaaagttttttttccaaacttccaactttccatcgcatcaaacatttcatacacacacaacttttctatcacatcgtaccaatttcaaccaatcttttaaacttcagtgtgaattaaacacagccgtagaacctccgaatgctcaaaatcgggcgcctgatgcggcgaaaaaaatggggcgcccatatgcgcgggccgcccccactatgtatgtccatcattcgcgccccattacaatcagtggcggatataaatttaaaatacagatggggcggcagagctagccctaattaggtaatggcacaatgcacacaaatcatagtcgccggctcacggcactggtacagcaacgcacggcatgaacattgagaaagttaacaacgaaaattggtagtcgaacaaacgtatattaattatatgtagagagaaaaaaaaaggagaaacgttgttagacaataataaggggaaccactttcaatacattggaggtataaaacgaaatgaaaaattatttagaggtttaagtgttttgctaaaatagttcaagtgagtaaaatagtttcttttaccaatttaactttattgtagaccgtattatgtgctaaagaaatagaaaaaaagtcaaattttacatatggccaaaatcagaaacggtcgaaatggtactactcatacagaaataatactcattcagtcaagaattttcataaatgttgtttatgccatggagcagtgtattgttgcaatggcatggagcccgggcagctgcccgtgctggccgggccctgcctccgccattgtgtttcactatgtatggatgagttgcagtggattttgatattgtttcgtaatttcatcttagtggacacgtggtttattgatgtacacggggtttaagtgttgcaatgattttaaatcgtttgttgcatatgttgaaccaaattatttcatcaagtgatcttactgtgtttcactttttttaacaattgaaacattctttcgctatttgctgaaacattgtttttatatagggtgaaacaacgctcgatttttttggaaaccgttgttttatatattgtagcaaaatatttcatgaggtgatttggttgtgtttcagctttttacaagattgaaatattttcgatctacttggtgaaacagcgcccgatttatacagaaaaaattgggcgcccggtttgtaggcgcctccacagaacctgcacaagcctcaccaactcttagtctaaagccatgagtctctctagccgcctctaattattgttccatatgcatctatagtgattgttccaatatggtcccttttgtttcatagccaaaacagttctccttcatctttttttttctattttttaagtagtattattgaaataaaaaaacaccattttgttgatcataaataggcgaattttgaggtccatttaacaaggtggcattctccctcttgtttcaaagtaaagaccactgctacaaaaccctaaatgaaactagcatctatggatttttttttccacctctacgtgatgaaaaaatatagtatcgacaaatttgaccattgtaggtatcggttctagaggaaaacccgacatcaatactatagataccggtttttttataaaaaaagaagggtacccataaaatagattgagccaagccgtccatatacaccacaccacttgcattttatcctcttcccacccggctgtctctttcgcacatcgttcgatccccatcccactcacacaaccccgccaccgctccagcctcacttgcgcttggcctcctcctcattgtctgtcgctcctcctcctctccgtctgccgcccatcctcctcctccttcctctccatccgccaaccctcctcctcctcctttcccttgcagcgcccctcaccacttcctcgccgccttcgagctatgtctccccaaccacgtcggatctggtcacctaaaggtctgaggccaccggatccggcctccttgaggtcagggctcaccggatccgtcctccttgaggtcagggctcaccggatccggcctccttgaggttggggctcactggatcactaacgtggatcaccttgcatgtgcttggggctggtgcggtctggctagaaggagataatggcgacggtggcggtcagtcgaaggagagtagcaagggaacgaaggcgacagatccaatgggacagtgagcctgatatgttgaacatgtaatggtcagccatggcgaaacatgtaactgtgaattgttttgatctaatctgtgattagcttgttcttgtccttttggtttgtgatgtgcttctttgttttttgatgtatgcatatgctcttgtgttcttgttgatttgcaatgtggatgggggggattgcagatggggctaggtgtcggttctgtctcgagaactggcagctataatctctataggtaccggttctggaactagcacctatacatataggtaaaggtgcctccaaattggtaacagttgggaaacccacacctataaggggttcccaaccagcacctatggggtgctctgtagtactggactcaaaatgcacatcattcgatagagtttcagaggaggttttcgatgctagcatattataaccctttagtgaaaaagatattttaacacatgagcttgcacttgacaaatacagatccaatagtagatacatgcacactaaataggatcaaaattgataaattattattagaaaaatggcatctataccttctatatagttggtatccactagcaattattacaagctaaagcttaacatgcaagtacgtcacattaccacccactagtgattattactattctaaagcatgttaactctcatgcaagcatgatacgtcatatagaatataatattgtagagctcaacatataaatatgtcaaatgatcttccttacacctttttcacaatatttaacatttagcatttctataatattttatattcatccatatattccagaacgaagcgcgggtatactagcaattgtaaagaagaaaaagtttgagtcaccacatggcacacactaagattatttaaaatatactgaatcattttgtgatacattgtagacattgatataaactgatagcatccaaaaaattaaaagccttgaaggtgaactcaaattgggctagtggtattttcttaataattttcccatgcaccaaatattttttaaaaaaatatttcaaattttaaagcgcaagaaattttattgctttagttaaaaccccatatttcaattttattaattggtctattcatggaacctttcttttagttcaaatattaaaagccttgaagatgaacatgtcgatgggctatacatcactaaatacgtacctatatatatgccatatctttaaggacgtaaggaacagctaatttgaggatataaatgaaactgagaaagagccaaggagacatggatttttatccaacccccaagatgggtaatagccctagtcatgtttactggaggtcagtgttgccatcatatatcaatctcttacaagtacaaactatcgggaggaaaacataatctaatataccaatctattggcgcagagctcgggaatggtggtcagcggctagctattgttaattttctcgggtattgactcaacgagattggaggtggctctagatctctcttggcttactagtttctaacacattctcttctctcctcctaggggacttacatttatacccttgggtgctcctttatcgaagtaaaactacaagacaagtatgcatataatcagaatagtcctgaccatgcctacaaaagactcaacatttctttccttatctgggactccttccctatctactttagactttatctatgtgtatgaaggtttgttttcgtataaaatcacttgatctatggtggtcccaccgagttaaatgtgtgtgtgtgtgtaggatatctcaaacctaggacactgatagaacaattaaaacctttatcaaagttttttttacaacagaataactaaaagaaactcccttatgatctcaagtgggctgaatacgacccacccctcctttctctctcctgcgcccatgatctgtctccacttgttgatccaccttcctcacctttcttctaatagaatttcagtatccaaacttatcgcattttggagtgccttttattttataacctaccaatgttgttactgtcaaaacctagacaagttttcatgctaccaaatttagtagagatcactattgggtataactcaaaaatcgatagtattagcaacaattggtaccaaaccattcatctagatagtactattcagttaccaaagggcaaaaaaagtggcataagttagaatttatttggctccatactttcgtttcgctacaacttgcaacaaaaataactgcctccgcagcccattagttgggaagaaacatagcatgcctgatagaggctagctcatctgtctatggtgaatgtgttgtatagttcctagtgtagttttagcaagtcaaggaaatattaaggaagaggttaaagaactactagaccattttgtcgacggtggatacccgtagactggatatagagggtattggggtacgctggtacgaggatctacgtgatacgacatcaagcaaatagaagacaaggattatactggttcaggccccttgataggtaatagctctaatccagttggtatgggattatatggtggaaaccacatattacaaagataatagcagaactcggtgatatcgacaataccgtagtcgagttggtccgactagatcacccggcaacttggctcctataggctccgacttcctaggttgtggtcgttgtgttggcggtgagattcgatgccttaggtcctcccgggggtcccttttataccgtgggtcagttgatctctaattagaactcggagatatcggaccccacacgatatagtaacgacccagttctgtccgagtaggactccttccatccgtggactccatttctgttacgtgacggatttccttaacgtgtacaggaaacatccatatacgcgcaggtataccgtatctagggatgacaatgggtcgggcacgggtagagcaaaaccatgcccgacccgatgcccgacattgcccacccaaaccctacccattagagttagcgggcaaaacttcgtgcccgtacccatgcccggcgggcgcgggtatgtccggcgggtacccaatggatctcacatgaataataacttaaaagatatgtaacttaacaaagagaaataaaatcaataatttaccaaattatcgtttatcaacaataatttgaattacatcacaacttagtatcagttagcatcacaaatgaactgagagaaatggtataagaattaagaaatgagtcaaaattagctaatacatatgtatcgggttgggcatgggttacccacgggtaaaaaatgaaacccacctattgcccataacgtcttcgggtctcgggcgggcgtgcccatgggtaaaaagtcacacccacgcccgtgcccatcgggtcgggtatccacggatacccggacccatgggtaaaattgccatccctaaccgtatcggtatacaacatacatccaagggtaaagggtataccttatccgtaaccctggcagtagcccccgacttctgcttaaatgaactcatgtgaccgatcgcgacttctgatgtcggaatcgttatcactctcaacaggtcgatctcggtatgagaaccgtagagacatagagttatcgataactttgcacgaagttcaacggtcatgagtgaatttaaattgaagtccgaaaactgctgcgcgtaacggatccagaaatttccagcggccttctctctcctttccttggaattcgcaccgtcggtagtgcatttatttaagggagttttggggatccattttgaagtccgtttgctgcaaaacttcccagcctccaagcgcccctcgtcttctccgctcccgcagaaaaaaaccctagctttctcatcttgtcttgttctccggcgatctccggcggtgatggatctcgacaagtccaccaccaccaatgcgtccctgaagaagctgtaggacgacggtttcctccttggtcgcgggaccatggagagagaaacaggaggtactgaacccgaacctgtcctgggccgcatggttgcggttgaggattacattctttgtggttttcttcctccgccctccaagtttcttctccttgtcttgaatttttatggcctttccttgctccatctgaaccccaattccatcaccttcctcagtatcttctcttatctttgttaggcctacattggggtagagccatttcttggtctctttcgcttttactatgagttgcgctggatggaaccgaaaaaggtatccagatgtgtcggtttccgacttcgggatggcctgaagtcgcgatacatccccttccagtgcccctcttctcgtagcaaatggcgggcgaggtgattctatctccagatagagaactcggatccagtctttgttgttcctgaggagcaaccagacaagattccggagtggaccgccaaacctgccctaactccctcccttcagtctttcatcgacattatcgatgacctccgagtacgcgggttgttggggtatgaagtcgctgccgacttcatcggtaggcggatccaaccgctccaggcccgagcccatatggcctttgattattcggggccaaaggacgcgacccgggtttctcctcggggtatttttcttgtatttcagatttcattctttatgtgcatgttcctcctgacttatcgagtgctggttctcgatcctacaggtttgaacagcgaaatcgtggagcgccgtgccagtcaagtgatgatcagcggtcctacaacggcgagcaacatccccgtccccatttgcaagaaggggaaggccaattgcatggctgcgatcaacgtgagtgtatttgacgactcctttacttctgctttcctgggatcgcattgtgacttcatgtatgcaggctctccctctgacggatgtcatcgggccgctcgcggaccaccaggcggcagcgtcgttaaagcagggcgttgccaaggaggcatccgacattgctgctgctgctgctactacgatgagtggcagcaacgttccaatattttgacctcatatcgtgccatcttgcttaggcctcggatgcgtctcccccgtcctagcgaaggcaaaggctggtgacgcttggcgagaagtaagtagatgttttggaagtcttgcttgcctgtcttcatgaaatcgcggaaatcctttacagggcggcgcgggcgaaggcgacgcaagacgggtccggcgcaacctccagcgcgtctcctgtggcgacctcgacggatgtcgtggtcacaactagggatcgggaggcgacaccgagtggaccagctggcggtcttgtgcccgctcggggcccgcctattgatgccctcacctggggggagctccaagctgagatggagcgcatcctccaggctggagctcgcggcgtgggccgcgagattgaggaagccagggtggcggcgtcatcggcaactcaacgggccgagtagctggcgtgctatctgttagagacctgcgaggacctcctcaagatgagggagttggtggctggcaatgaaaggcaacggcagggactcgggcagatgtcggagctcgagaacaacctgtcggagatccgcggctcgctgcgggtgtcttacaccggcctacaccaactcgccggggacttcggtgtgtcacgaccaccatcccggcaacccccgacgagttctcgctgacgtcctcgctcgcggagctggctgtggtgatggaggagatcccctccaaacatgcggccaggatcagcgaggagacgtcaaatgggatctacaccggggcgtgccacgtcctcgcgtgcgtgaagctggcgtaccctgacctcgaccaccagaggattctggatcagggggcccccaatgacacgcgcaagggcgtggtggaagaagtcggtgacttgggggagtctattctccccctttttgaagagtaggattttatttcccttgtactccttaatcaattatgcctgtaaaacttttgtaggttcaaactgcctttgtgtatgcagttatttccttcattttctttagcatggtgattccgagtactttgttgtcattgtagagatgttgatatcgaggatgtctagcagcgtgggcaacctgagtcgccggtagtcgttctggcacttgcgcttgagccgtatgtgccgcgggacgatgtcgatcaaagccttaggttggtacaacttccttaggttggtactttagtcttcatctcctttattcttttgttcgaatcgacttaatttgccgtgttctcgaaagaggagaacgacttgacttagtcatttccgtgttgagcagacctcgagagtgcgttggccgaccaagatcgtcgaatccaatattggaagacgaagttcgaggtggccgaactcgagaggacaatggtggaagtgaagaaagaccaagccgtggaagcactccgaggtcgcgaggtgtggttcaactcgtacctcaggagctgttgtacagcgatggttggagtctgcagagagctccgagtaccccgttggaatcccgaggagtcggcggctgggtatatctcgtggttgaacggggcctgcgctcagcttgaaggcatcggcaagcgtatcgacgaggccctgaagcaggagtgtcgtcgatcgagccgatatgctggagggcacgtgctggcctgtatccgagatcactgcccgcagctgcacctcgagttcctccacgaagggttttcacgttctcggaggactcccgcagagatagataatctggcgaagtcgatggcaccgcttaaagagaaagtcttccagtccatggactggcgttggccttcctggtagtctttatatcctataaaaattatctcaaggagacgtgtaatatattttggagcaattatgaattgtaagaagtactcgtgaaatagaaaagggatctatctaactaagttttcttactctggatgtgctgtgtgagtgttttctcatttcgcgacttcgatcagtcacttgagtcatacactctcccaagcccccagccttgtcgtcggagaaacgttctcggagaataaggctcttggacccttgacctacctcagttgaaaaagcactgaccctagcccccagccgtgaagttggaaaacttagtttctgattggttaatacgcacggcgagaactcttacatgaccagatcttacatggtcgtttgtctctacatgatccgacaaggccttatccgctctgggcgtccccagccgaagttcccttaggttcctcagaggccttgtcaagacggcgtaaagggacatgaggataggtttcaacgctaggtgtcgtcgtggtaagggatcgtcgggaaagaacactttgatcgtagtctgtacctgaaatcaactttattgaagtcgtaagatgtcttacaagtatggatactattgatttatacataaaatttacgtaattgatcaatgttccaggaatttgctaactcgcgaccatcgtcgtctgcaatcttgaatgcaactggccgcaagacttgcgtgatcgtgtatggtccttcccacttgggtgagagcttgttacgccctgcttggctttgaacccatcggaggacgtaatcgccgatcgaaagcgtgcgtgctctgatgcgcttctcgtggtatcggcgaagggcctgttggtagctggctgctctgacggtaactctttctcgatgctcctcgagtagattcacatcgtcgctttgctgctcctcttgatcctcgtcagagtacttctgtactcgtgtgctctgatgtcgtagctcagtggggagcatggcttctgagctatacatgaggaagaagggtgtgtccttgttggacgttgtcggtgtggtacgcacaacccatagtacagaggggagttcttcaacccacttcttgtcatgtgacatcaatctgtcgtagacatgggtcttgattccttggagtactatgccgtttgccctctcgacctatccattgctctgagcgtgaggaaccgaggcaaagcagatcttgactcccaatctgatgcagtaatcctggaagtcagcaatgatgaactgggagccgttgtctgttatgatgcggtggggcaatctatatctgcagaatatccctttaataaacttaatggcgttgtcggccttgatttccccagtgggcgtcgcttcaatccacttggtgaaccgccacgaatagaaacatgtaggcgccctgtcctcgtgggaatggtccgagtatgtcgagcccccagcacgagaacgaccaagtaagggggatagtctggagcgcttgcgcttgtagccttgtgtgtttgctgtggaattgacaggcttcacaccggttaaccatgtcgcaaacgtctttgagcgcagttggccagaaaacctttgtcaaaaagcttttctgaccaaagtgcgaccggcggcgagtgacccacagatcccttcgtgtatgtcgaggagtagatgtttgccgtcatcgagcgagatgcatttgagaagtaccccgtttggtgccttcttgtatagatcgttgccgatcatacagtaaatcttggcttgtcgggttattttctcggcttttgcatcatcttcgggcaactcgtcactactcaggaaattgatgagtggggtctgccagtcatatgtggtctcgatgtcggcaacggcgcgttctgcctctgtagcccccgagccgatgtcggggacgactgtgctatcttcgccgtttgtggttttgtcaggatgtccaggaaggtgccaggttcgagtggctctcgtctggatgcacgccgtgctaggtcgtctggttcgatgttgtccttgcgatatacgtgtcggacttcgatcccgtcaaaccttttctcctgcttcctgacttctgtgaggtacttggatagctcggggctagagcacttgtagtctttgtgcacctggtttgcgactagttcggaatctcctttcacgattagtcacttgactcctagtgcggctgctgctcttatctccgcgagtagaccttcgtactcgactgtgttgttggttgccctgaagttgaggtgaattgcatgcttgaactggtctcccgaaggtgatgtcaagatgaaccttgcccctgctccttggctgttgagtgcgccgtcgaacgccattgtccatgtttcgctgtcggtttgactgtccggcctgttttcaggcataatccaatcagctatgaaatcggcgaggacctgggacttgatggctgttcgtggcacaaagtggacatcaaactggcttagctcgattacccatttcgcgatgcggccgacaacgtctttgtttctcacgacttcaccaagagggaaggaggaaacaactgtgaccctgtgggcttggaagtagtggcgtagctttcttgatttcatgattactgtgtaaagcagcttttggatctgtgggtatcttgtctttgcgtcatggagagcttcgctgacgtaataaactggtctttgcaccttctctctcgacaacaatgacggtactcacagaatatggtgtggcggcaatatagaggaataattcttcattaggttggggagcaacaagtacaggaggatttgacaggtagcgtttgagtgcgatgaacgcatcttcgacttcctgtgtccatacaaatttgtcttgtttcttcaacagagtgaagaagggttgtccttgttctcccatcctagcaatgaatctgctcagtgccgccatgcatccagttagcttctggatttccttgagtcttgtgggcgacttcatgttctcgattgccttgatcttctcgggatttgcctagatccctcttccagaaacgaggaacccgagcaacttgcccgatggtactccgaacgtgcacttctctggattgagcatgaggcgatatcatcagaggttgtcgaacgtttctcggaaatcgtcaatcaatgagtcgcttgtcttggtcttgacaacaatgtcgtcgacataggcctcgacattgttcccaagttgatcgttaagtgccccttggaccgtgcgttggaaagtatttcctgcggttatgagtccaaatggcatcttgacatagcagaatacaccgaatggcatgatgaatgttgtcttctcctcgtcctctttcgccatgctaatttggtggtagctagagtaggcgtcaagaaagcttaacaactcacaaccagctgttgagtctaccaattggtctattcgaggaagagggaagtgatccttgggacacgccttgttgaggtcggtgaagtcgacacacatcctccacttcccgttggccttgcgcaccatgactggattggctagccactctggatggagaacctctctgatgaagccagctttgagaagcttgtcgagctcttctcgtatggcttgtttccgatctggtgcaaatctccgcagtttttgttttactggcttggcatcgggtcgcaccatgagtttgtgctcaatcacctccctgggtaccccgggcatgtcgcatggctgccaagcgaacacgtctgcattgtcgcagaggaaggtgatgagcgcgagttcctatttctcgttcggtgatgccctgatcttgacggtcttgtcggggtggcgctggagagtggaacgatcttgattgcgtcgtttggcttcggcgtcttgtttgttttgctcactttcttgggtggctcagctgtggcgggtgggttggacgtgtgctcaaccatgtcgaggctccgcttgtcgcactgcactgccagctttgcgttcccctgaatagtgattgttcccttcggcccaagcatcttgagcacttggtatgcgtggtgagatgcggccatgaacttcgcgagtgcagttctcccgatgatggcattgtatgttgtatcaaattcagcgacatcaaaggtgatctgctctgttcggaagttgtttgcttggccgaaagtcacaggcaacgtaatcttgcccaatggcttggacgatgactgaggagtgattccgtggaaaggttgatcagtaggtgtcaactcgcttcgtgggattcccaccgcgtccaaggtgctggcgaaaagaaggttgatggagctgccgccattgatgagaacccgtgcgaccttgatattttgaatagtgggctcgatcacgattggatatcgtcctggaatgaccccagtcttggggtagtcttcctctgagaattcgatcttctgttcggaccacttcatcttgggcgcagccccctgccatgtcgaacaaacttcgcgctccactttcttgtactctcgcttcgaagagtacgccatagaacctccgaagatgtgcgagacatggagatcggaatctgggtatgctgagtccgagtcctgagtggctgcttccgtggccttctcgactacacgtacttgcttgcccttccccaatgcgagttgctttgtgagtgattttttgaaaacgaaacaagcttctaaggagtgcttgtccgatttgtgtatagggcatcatattttcttcatgtcgtcgccttatgggtctgggtgtttgggcaggtccacgtattctgctgcgaggacttccgtttgagctttctttttcccactcttgcgactcttcttcttgcttgattccgatgcgtctttggctggtttcttctcttcggcttgtcgttcttgcgtctcagtgtgtcgtccatgtgagcgcatcgatcgacaatctcgaatagttttcgagcagttgttatccgtcttgtcgccaactcctgggtggtgtagtgatctctgacaccagtcttgaaagcgcggatcacggaggcatcggtgatctcggggatcgtatttctgcactcattaaagcgccaaacgtagtccctcaatgattcgcccggattctgtgtcaacgcgtgtaggtcgtcttcgatcgcgtggcgtttgtatgttccttggaagttagcgacgaactgctgccacagatctgcccatgaagaaatccagtatggtgggaggtggactagccatgaatgtgcagatcctttcaacgtcgccggcaaataatttgccaatgcgttgtcgtctgctccggcagcgtagaatactgcggaatagacctgaaggaactccttagggtcggtgctcccatcgtacttctctattgctcccggtcgaaatctctcaggccatcggacatctcgtagagcacgactgaaagctctacacccgccaccgggggcggcaggttgtcggcgatcgtatgtcctccgtggatgcatgtctaatgacgaggatgatgacgatgatgatgagtcacttggttccggggtacgattacgaggatgacttccgggttctcgagaatcttgtcgtcgcccaccgttgttgtcccggcgccgatctttgtcgtcgtcatcgttatggcgacgtcctcgaccagtatcgcccggcatccgctgttcgcgatcatggcggttatggcggttatcatggtcttggttctcgctcgggtgtcctcctcactcttcgttctctcgacgtcgcgaagagacgcgatgccgggaacggtttttgttctcacgcgcgtcatgcttctcggcggacattcaaatggtcatggagatcactggtgccgcgaggtggaggagtggcttgacgaggtgatgcccgttgcccgggtagttttccattggcaccgccagttggcggttgctctggcagtactccggtggcggcctcttcgaacgcgttactgaggttagccactaattcccgtagtcgttctgtccactctgcgagatcatcgttcagaacgggatcataaggggtttccctcagtattgcgttgatagccctgatgtgttgggctggtgtaaccacttgatcctctgcttctgcgttagcgcgcgcagacgtgctggtcccatcgatagcgaacacatcacgtggtgtactcgttgatgatgaggcctggtcttcgagcaagtgtagtactgacggctcgtggggatcgatgtcgattaccccgatgaatcgatctgagataactgtcgctcctcgttccttgtccgcatctctaagagagatctgtgattgctggaccttaggaggtgacgtcctcatggcgctgagaagaaccttgcagcttgagaggtcgtgattctttgtcttgtgaataggacaatagacatcacgggttagagaagtacgttgaattccacgctctttgcaggcgtcgagaaatacccagcaagcttgtaaggtgtgtttcctggttttgtggatatgacaccaggactttgtcgcctcggaagttgtccttgtcggctcgtgattctcgtcggaaggacaagatttggccgcattaggatccttctcaggctcggatgtcgtcgatgttccgttctccacttctgcgggaggatccttcgacatggagccgtccagggttgtaaccacggcgttctcgcttctggtcattgatggaccagttgagatcggcaccatggtgtaaaccaggaagacgatttcgccgacttgagtccacaccagcattgttgaagtagaaactccttggttgatgccggggttgacgctgttgtcgacgaagcttgatgacatagtagtagaaccttgagcaccaagttcccctacctggcacgcccctgtcgacggtggatacccgtagaccggatatagagggtattggggtacgctggtacgaggatctatgtaatacgacatcaagcaaatagaagacaaggattatactggttcaggccccttgataggtaatagctctaatccagttggtatgggattatatgatggaaaccacatattacaaagggaatagcagaactcgatgatatcgacaataccatagtcgagttggtccgactagatcacccggaacttggctcctgtaggctccgacttcgtaggctgtgatcgttgtgttggcggtgagattcgatgccttaggtcctcccggggggtctgtcggtgacatgggaccgggagtatcatgactagaggcttgaggcagacacaatcgcccacgtggcctggcaccctcgggggacgtcgggcccgagggtgatgtgtggcccaactcttggtctccccgagggggggg

SEQ ID NO: 57860 - DNA, 12016 bp, Oryza sativa
gttgacaagttctcgaaaaccggtcggtttaggcaaaattccgatcgaaatcatcgaaatttcgatctgtaatactgtaatttggaccaactactaactgggcctagtacatgcaatctggcccatgtaagtgttttcctttttttaattctttattcttttctttcctgatgtaagtttaagtaaatacacacaatacatcatttttttttgaatatttatatcccaataggttctatgaatatcatagtatttataggattttatttgtttttttctttttttatcaattcaaatttgaatttggatcaaagtcctcgaaatcttagacggtttctactttcgagcctcgtcggaatgtcgaaattttgtgaaatccgattttatttcgttggaatcgtaaaccctggtgatagtaacaatcttaggttgagatcaacatatccaatccaacaattgtaacctacttggtacatatgctccataacagtaactgcaatgagttaagaaaaaaaggtcactggaacgtgttggttctctaccctaccaattcaatggtagtgccaaaatctaggtaaattttgacactaccaattatttggtagggtagaattcatataatgtgtttggtttggtaccatttgctaccaatatgcttgttatagtgaagaaagttctagaatgctaccaaattagctatgggtattgccaatactttggctctaatccaaaccaatcaaactactatttgaactgccaaacaattggtagggcacattttggcatcgatccaaaatggcccattttggattgaagccaaaacatgaccttaccaatctattggtatcttgaagatattgtatggttggattaaagccaaatcattggtaatgcccattaacaatttggcactaatctagaactttcttctctatatcatcaatatttggctttatattggtagcaattcaaatatgtaccatgcatctctaccctaccaaagaattggtagtgccaaaacatgccaaaaatttggcactagcaaagatttggtagggtaaagaaccaaacagcttttgtttcagtcagaaagttaagtggggcaaaaagattgcccaaaatattatgaaatacctctcgatatacctttgatttcacaatatgttgtattaatttatgttttacaggcatacaacagatccaactttcaatgacatgtttattgtttagtttagctacaataattgttgggtagttgtagagcagcacatggtacttatgccacaagcccgcaaataaaataattcgcatttgctcatcctaattcatgctagcatctctattgcagaacaattttgatactattttttttttaaaattagccttgaaaatgccacttcccctaaggaatgacaaatgcatttttttttacaaatgcaaaaacttgcaggtagacacatatttggcaggtgaattcgtgtcatatggacatatctttcattggaagatatgtccatatgttggagctatttcaccagttctttcattggaataatgttagcatttaatcagtgatataggagatgattcaccttcaacaagctctcatttatcatcatgacgagtcagaagaatccgattgtcaagttacgccttctaccatatactccccaccaaaaacagctaccactggtaaataaattgctttctgttctaattggtgcctgaatttctgtatgctagatctgattgtttgttgctttcctggtattgtgtagtttttagttatgatgtacataatcctaagttaatccagaaattaatttttgagttctttctggagtttattcagtagtttataggttgtgaccaccagtgtccttttatggctgaatacaactcaaagaatcttcatgttggagttggattcactttggcagttcatacagtggatgctgatagatgcgctcgattattcctgtcgatagcatcctagtattgtgtctttatatagctatatctagcattttcatgtaaaagtctatctgttctgtggatgggtgctcttattggttgcagcaatcaggataatcagctaaaataatgatatattgcagccttgtcagcctttattatatactgggttccctaaatggtcatctagtcattagtgccaaagtgcatgtagtcttctctgatcgttatttataactttatatgccaatggatgttacagacaacgtagtgtatgtcaatctatctggcgttttatttatcagaatactagaagagaatttgcaccagtggttcaagtaaatccctgaacattgaaactagatagtttgggctttttggcccctaatcttgtttgattgatacaaacaagtcaacgggtcacaagtgcttttgactgacagactacatccgtttctctcctttcatcttcactctttcccatcgaattctcctcttatctttcttcattcttccccatctttgaccaaattagccgcatcctatgcctggtggaatattctgacacacaatagcagtgtggcttgtttcagcagaaaatatttgacaggcgttgattgcaaagctgtcacagctgcacccatctgatcagatataggtaaactgagatgtggttctcagccagtgggaatgatgtacaaccacgttgtcattcaggggaactaaaaaccatctactcctgtttttagcaactcacatacagtacagatacctagaatcaacagatatccctactttaaccactttaaacaagtctgaggacatatattcctagtatcaatgttcatacactgaaccagtaatgcaaggttcaggacatacaatgcaatttactcttgttttcttttatagttcatttgtcctcattttggtccctgatttaagttggacattcttatctcactagacggttgggtaagtaatgttaggggtcaaaatatagtggagttatgctatccaatcttgaaagcaatgtagagctttgatctgttactatccagtactacagtgaacagctagacttggagctagtgatttactcccttattggatacggatattgaagtagatatgggctggatgcctatactatgtaaattcacccattgacggttcattggctcagtcagatagagaacatgcctgcttaactgaattagtgaaagcaacgccaaataactaagtggcaactcttatcagcaaaactaatttgtgattatgatctgtggcttgtttatttcaaccatttcttttatatgaattgcgtgtaactcagaatttcatgtgaatactgagtaactagcacatctattttgatttgggcccaatttttcaactggcaagaaagaattggagtacaagatcaaagggtgggagtaactcttagtcttaggcatcgggattgggcaggatttgttgtgcacctaattttctttcatttctcgtacttgaacttgtttgtgcatataagtatgtgatcatccaactatttctaagaggaaattagccacaagcaacaaataggaagtttttatattcatacctttgcctcagaacttgcgttcatggtttgatggggatcttctttcgtctcattgtatctctcaattatggatttcatgctggttgaaaaaaaaaatcaagatcccattagaacacatgtcaacacatgccacagtagtgttgaatgctatcatatagctcctgcaagcttattttgtagtacatgggcatcagtatgtaagatgacaaatgcaaacttttaatgaaggcctagttctttgacaagtaatccacgtggatagataactgtaaggtcaacacaaagaattaagtgtggagtgttttgagttaattggttcttactgcttaatttcctgttatcttaaaacttcctgttatcttaaaactagacactgttctcctaatttgtcatccttttcctatttagtttgttgttttctacgaatcttgagctatttgtatggagaaaaagcagtgacaatggtaaaagatggttttgaaggcactacaagacatgcctcaagttataaccgtgctgttacgaggatccaagcatccaaaacacttggaagattaagcttcaggcgttgtcaacataatgcataattagttgcatacttcagtggatgattgaacgggatgtttggatatgcaaatatttctatgcatccggactgaatactttctgaacacaaagcaagccaacctgccatggccatgacacgatggttctatccatattttcctatttgtcatgtacggctgggctgggcctagcaccaaaactattcgttgttgtttattattattaggtaattaggttattcgtagatcatggttgtttattttattatgaacattttgataacattttttttaaaaaattaaagcctttatttttccgatcatgtggaggacgcacactgatatatacgtatatcacacgttatataagaaacgtgcttgaacacacgggcaagagatagatactatataggagtagcgatgaatccataacttcactaaattaaacgtgcacccatatgtgagtaatcatgagcatcaagatttaaattctatcagagttgctcgcccaccccctttcaagaaaaatccattaattaatcttgttacataggagtatcgttgtgaatagcatggcaaacaatacagttgtctcctgatatgtcctagctccttgtatagattcgttggataatgtgtcccggataatgtgtcccatccagtttcaaattgctatattttgagacaaaaggagtaactttttttcccctttggatttactttgaaacctatttttaagtttcagaaaacaacgtatctatagatgatacataatatcttactatatgtagtttaataagccaggatgaacaatgtagaattaatcatattcttttgtacgataacataatagacttcgacaattgttgagggacataaagtaaagatcttgataaagctgttgtcctagctacatgtatctctctaccaccaggttgattcattgagtagctagtgagggaggaagaaaaaaaaaacaagcgttctttcatttcattctcattcaccaagagatggaaattttgaatattgtacgaatccttatacattgtagttaacgacaagtccattatcgcactaaattcaatttgaaagtactgagaatagtgataaatctttgatcatatttctattaaaaacacacgtatattacacatgtgtaatattattggacatcagaatttaaatcctatcatacaaagacatgcacctagctatgactcaatcttatctatgatagtttccattgattttgaggaaattttagcacgttctgtttgaggattctcctcattcaagggttggaatggtctattgatcgcgcagaaccatccaaaaattacttaaatcaaaccagtaaagtcgatttcagagtaagaatctaagtggtccaatcaccgtacagatctctccaaagcaaacgcatcatgtaccaagttggtacgaggtatctctgctacttgcacatcatcactgccctaaactaaagtcaaccaaagcgttctaacttccaagacatgcttaaccccgtaattagcagatctaattaggagcttagatcctaattaagctaactaatgtgggagtgaagcaaagaaaaaaaacaaatacctggagctggcaaagtcatagagacggctggtgctggagaagacgaggaggccgacctcggcatcgcagaggatggagagctccctcgccttcttgaacagcccgctccgccgcttcgagaatgtcacctgtcggctcgtcgcgttgtcgatcctctttatctctatcttccctctccccatcttccccttcgatctcctcctccttttccctcttacagatctacgcagaaataacaattagcagcagcaacaacctcggctatctttcaagccaagctctctatctatctctaatcttgtgctaatctccttagagtgctctttacaggtagctctatttctctaatcaaggctggttagctagctaggtagctagccctgatgcactacaacttcttccttaagaaagtattccaagagaggacataaaataaaaaaaatatatagttaaacaagtacagggcgcgtttggaggctgcacgatgcaggcagggtcttccaggatcaatcaattaatcccttttttagctttcgtctacctcgtcctcatttgttaatgtgccatgataaacatatcaaaaccttcatcgtatcgatggccgacgcgtgcatgagaggatgccccatcataatgctgcaaattaattgattaattcagctgtgtttgtcgtaagctataggttagcttctaatttaattaggttgctagctaatgcggtttcctttattgtttttctgagtttcgtttttggaaaggaaggtgtgatgactgacgaggttcatgaagatgtggaataattagctaagtaaagcaaatcttcatgatactctgtcaccctaattagtcttgctggctaattaactagctggccctgcctgcccttttttgcaaagcttatggactcatgagttggctgtcttcactggtggagaaaccatctttcgtcggtcggccgatttccacagtagtcccggatgcaataaaaaccggggctaaagatgttctttagtcccggttcaaaagggtaacgggcatatttgatctttagtcccggtttgtattaccaaccgggactaaagatgatctttagtcccggttcgaatgctgtcagggtctgtcaggccctcccggtatctttagtcccggttgataacaccaaccgggactaaagatgctaactttagtcccggttggtaataccaaccgggactaaagatcccggtgatctttagccccggtttgtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgtttttttttgtcatactacatttgcacctatgttttgcacactttttttgtctccaaaatgtagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttattacttaacaaatagtttttaagaattatttggtgtaatattttatgatttttgtatgaataaagatatcttataattattgtatgactgtcattattgtaagaataattatttgtgtacggtttttttgactcatgtagatggatcggcaatggatgtacgctgaccggcggtccaaagagttcattgacggcgtgcactattttttgagagtggccgaagctaacaggaaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcaatttgttggatttgaaggaaatcaaacgggcgaggaggaaatagctgctgatggtaacgacgttgcggatgatcttggtcaaatgttgcaggacgccagggaggactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtacgagaacctagaagcatgccctgtttgcaaagcactacgatacaagattagacgggacgatccaggagaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctccccccctggctatgcatgaagaggaagtacataatgatgccgattattattcaaggccccaagcaacctggtaacgacatcgacgtgtacctaagaccactggtcgaggatcttaaacagttgtggaagaaggaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcagaaggtcatcgatccggatagattagatgcccttcagaatgaagtggtgcaatgtctcgtcagttttgagttgatatttccaccttcatttttcaatataatgacacatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtaccggaatcacgccatgaagggagactacggggaaagggaactctcggaaggaaagcaattatgacggtagacaacaatttattccgtaaagcccatttcactgttctgcaacactcttcattggtagctccttacatcgaggagcacttggctctagttcgcgccaggaacatcggtaagtccgatgtatggattacacggcatcacattgatactttccccgcgtggctacgacaacatctcatgggtaacgagtcgatcaaccaacaacttgccttcctggcgaggggaccgtctgggtcgatcgcgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagttcaaatcatgtatatgctagttatatgtgatacttacaatttttaaaagttttaaatcacacaggtggcaatttcatatgtacgttaattagagtttttaacatttaatttactagcattcatatgctaattataattgactagaggatttttaaaagttttaaatcacgcaagtggcaattttatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacatatgttaattagagtttttagcatttaatttaatataattcctacgctaagtatatatgatgattacaatttttattaattttaaatcatgcagtatgtacatacatatcttaattagagtttttaccaatataataatatcattcatatatatgctaagtatatatatatatattggaatttttattaattataagtcatatatttgcttattacgatttatccacttaatttattacagacaaaaataatttttcgaattaattgtcattaatctttgtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatttactcccggttgttgagaacaaccgggagtaaagatccgggggtatatatattcccggtgcgccctcgtcttcttcaccaacacttagacgttttcggccgatcgatctctctcagcctctctccttcggccgccactgcctaaggcaaatccccgcgccgacgcccgccgtatctc

SEQ ID NO: 57861 - DNA, 57219 bp, Oryza sativa
ctcccggttgttgagaacaaccgggagtaaagatccgggggtatatatattcccggtgcgccctcgtcttcttcaccaacacttagacgttttcggccgatcgatctctctcggcctctctccttcgccgcactgcctagggcaaatccccgcgccgacgccgccgtatctcgccgtcgtctcgagctcgtcgtcctcgccgccgcctccgcctcctccgctgccgccgcatctctggggtgagagccgccgccgccagatctccctctctcgatctctccgatctcagctcgatctctctccgtctctctccgtcgccgccgccacgccacgccgccgccgccacggccccgcaacgccacgccgccgccgccgccgtcgccacgccaccgtcgccacgccgtcaccacgtacgccgccgccgtcgccacgccgccgtcgccacgccgtcgccacgccgccgccgtcgccacgccgtcgccacgccgccgccgtcgccacggcgccaaccgccgccccgatgccgccacaccgccattaacgaacgagaacgagaacgatcgaacgaacgagaagcgagaacgaacacgtcaacgtacgttgccgtgagaacgtgaacgagaacgagaacgatcgaacgaacgagagcgagaacgaacacgtcaatgtatgttgccgcgagaacgtgaacgagaacgagaacgatcgaacgaagacaagtgagaacgagggaacgaacgtgaacgagctagggaacgtgaacgagcgaacgaacgaggacgaacgttaacgtgaaatgcaatatatatatatatatgtatatatatatatatgtatatatatatatatgtatatgttacttctcatttatcctaatacatctttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattactttatttgtaattagacttagtatgtaattattgactacggaagtggtgcgacaagtagcaattgactattgtagtcttaattagacttagcatatacgcacgaaacacttagcatacatgactattttagtcttagcatgtaatattatttgagttttaatataagattactttatttgtaattagacttagtatataattattgactacggaagtggtgcgacaagtagcaattgactattgtagtcttaattacacttagcatatacgcacgaaacacttagcagacatgactattttagtcttagcatgtaattaatattatttgagttttaatataagattactttatttgagattagacttagtatataattatttactacggaaatggtgcgacaagtagcaattgactattgttgtcttaattagacttagcatatatgcacgaaacacttagcatacatgactattttagtcttagcatgtaatattatttgagttttaatataagattactttatttgtaattagacttagtatataattatttactagctagggttgtataatatacgtcacctagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgaggagatcatgagagctttgtcccagattcggagaaagagatgctgtggaccacaatgctcgagacattcacccttcctgcgggtacagaggacaaagtgaaaaggtggactctgaagaaaatggcagaacagtttcagaacttcaagggagatctgtacaagaagtatatactgaaggggcagacaccgaacttcgacacattcccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggaggagatggaggctagcttgattgagaggggtatcgaaccggcaacagccaattggccggaacgatcgaagttctggtactatgctcacggtggaacgctcaacccagctgatggctcactggtattcggcgttcagatacgagaggctgcgcaacgactaacagatgcagtggaagcctcctctcagggcacgttccgacccgacagagatagggacgagctgacactcgccctgcagactccagagcatccaggacgaacacgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcgcagagcatggacgccatgcaaacactggacgaatcgacctgtcccgttgatgacatcactcagcggacaccatgtgagctgcatattcctttcaagaacttatcaataaaggtaagatttagccattccgctagttcctgcttatatatgttgattactaataaataatctctcacaacatgaaggtggcgtcgggcatggccatcccaacggacccttcaggtacttaccactgcaggccgattccagcaggatactcgaaggtcgaagttgagttggtcgaaggcgcgtacgaggacctcgagctggattaccctggaggagacggtgagacgcatctacgagacacaagccatgccattattctatggcgcaggcggtacatcatcctccctgggcgacaagcggcgtctcgtgcaccatctcctccggctccgccatctcctcctcatgatcctgcaccgtctcctcctcatgctccgccagcaccgtctccacctcaggctccagcatcgactcctcctcaggatcctgcaccgactcctcctcgtgctcctacacctactcccccgcaagctcctcttccggcaccttcaaagtcaagggcccccccagctgcaccgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacgggtcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgcctccggtagagagatgatcggagcgaggatcagggacacggacttcttgcaaggagatgacattctctggatcaatttcacacatatctacgaactataccagctggacgccgtcgacgtctctattatgagttgctggattttgtaagtatatcgtccagttcgatttcttactatacgtctcctttaattaattaggtccttgtatataagtagactatagaaaataatatactcccttttatcgttgtagaatggagattcaaagggcccgacggcggagggttttcgatactggattcatcgaccctcggagagtaaacgtcgcaatgctcgaccaatatccacaagaaacagaggacaatctcgtccatctcctgaaggcgcagcattacaagacgttcatactgttgccgtacaacacagagttagtttaattttactgtcttcctacataccaaatttcattcccgtacgaacttgctaagtgtttcatatgtaatgcatcccacgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttaattatgttaattgctattacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaaataacttgtgcggctattacgtgtgcgagtattgccactgccttgcaaaccaaatcatcaccacaagagagctcgatgtacgtacaaataaattcaaaatttcagtacgtagcgatttcttgttttattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactactcgctagctaggacatataatggattgtaattaatacatgactacatctgtttctatatgcatgtgtacacattttctacaatgtaaatatattttggtcatatatttctatatacatatgcatttgcataacatatatatgtataaatacatatatattatgcatgtatatatatacatataatataatataatatatatatatacatatatatatgtatgcatatatatgtattgaaacatatatatgcatggtttatatatatatataaaccatgcagcaacagggccatgcaaaaaaaaaaaaggtcagctagatctttagtcccggttatctcacccgggactaaagataacgatctttagtcccggattggtactcccggtttggaaaccgggactaaaagggggttacgaaccgggactacaaagggtttctccaccagtgcttgtcccaaattaaaaacattttacttatttagtattcatgtaccggttcaatttctatcttggttgatgcttctattcttgatgtgaacttttttacccttaaaaagcatatatggtaaaacgtactacatgttacaattagacttgagtacctaacaacaatttactttaaattatacttgttttttagatgcatttaaattaagatagtggcagagccagcggcgtcgtcaagccccggcgactaatagtgttttacgatgattgattaatttttataggtgtcaacggctatggacagtggagatggcagcgactcggacggttgcccgacttgtccgggaggtggctccgccactaaattaataggacttttatgatataatttaccgataatatgccttgctagtattaataagtacactttaaaaatttgcaaaaaatttaaatagaaaaacaattttaattttatattaaattctatttaatttaagtgagaggacaaatcaatataaatatttggatcatttatgctagtagtatatattgcttgtaaattataaggtaaacgttatcaaattgagatgctaatttaattagtcaaacaacctactatgtgtttcctttcgctacctaggacggaaggattggtctaaacaactgtgctggtaggtacagcagcaagtgtttaatttatagggcttaagctgagtttgtttgagcatattggctaggctaaatacttacatgcaaaacaaaaaaaaagtaattagtatatgattaattaaatattaaatgttataaattaaaaaacagatttatttggttagaaaacttgtatatagaaagttttttttttaaaaaaatcaccatttaatagttcacggagtgtactaacaggttgaagctagttgctctttagaactgggcctattacgtactccatccgtttgaggctatttgacgttttgactttggttagagttaaattgttttaagtttgactaagtttatagacaaatatagtaatatttataatactaaattagtttcatcaaatcaataattgaatatattttcataataaatctgtcttaggttaaaaatgttactacttttttctataaacttagtcaaacttaaagcagtttgactttgtctaaagtcagaatgttttataatctgaaacgaaggtagtatatatatacacagggcttcgctttaattaatttgtaagtaaaaatagcaatgtccagttccttactcattactaatttgcttataaagcgaagatatgtaaattgggataactagcacatgcacgttgaatattaccagtcatgccatgaaagtaaagaaggtttaagtacgtgtccttaatccaccttagagaatctgaataatgtatttatcgtatttatatttttttgcagggtattcataatttatataataataatcaatcactacgtaaaagtataacaagtcatgacgcaatatatgccttaacccaaaatctctcagcttgaacatggccaaacgcatgcgtatctctgagctatacaaaccaccaaaccacatgaacaagggcatatatgcctttttaccgtgaagttaatactattaagttgacttaacggaatagagataaacttatgatttggttaaaagaaaagcgaggacaaaatcataaagttgatgcgaagtgggtatagctcaattgtttaggttccttgtggtagaaccaacccactcggggtcaagtcctagatttgacacgggttatcgtatttacgactatttttctttcagtggtagacgacgtgctcttcgactgcgagatgtctgtggtaaaaaaaaaatctcccaattgccatgcatatatcatctagctatattcatatataacaataacaaatctatatatgttctatattcatatataacaatgacagaaattaattaaagctcattttttacagcttttagacggaaaacttcaaccattacaatggagagataagggtttagtgatcaccatatatatagatgcggttgaccagctcatcaatatcggtcattaagttacttatcattgccatttctcaaaacattgctgaaaaggtatcttttaaatgattttagccctttgttttgtttatcctatatcgtgattcgtggggatatgtggtccattattgatttgtcgtctagttcatatgcatgtgaggaaaccactatattatatctctctcaggtgaagtcaataatacttctgaagtccaattcgtaaccgtgaagcaagacaattcaatttagtataattaaattaatcacttgattttaagcatgcgaaatagtgtatatattacgtaaacttaattacttgtttgggcttgtcagtcaagctaaaaagatgaagtccaaacaaacagataagttttcgattgggattttcataaccataaactcactctcttttcctatttaagctaaaagctagattttaataactttttttcttatgtggattagattagctagaatactatccttgaacttttgaggggcttaaaatctactggcttatgcaccataaaaaccgaaaaatcagcttaaaatcttaagctaataagtctaaatctaaaggtgccttactctaactttaagttttgttcatatatcaaaagaaaccatcatagttagcgtctcatatataaaagggttaattggatccatgccattgtaaatttgcctattagaagaatgctattataattcgtctatttggaaccgtgccactggaattttacaaaattagaaccgtgccactaccgtcacgttttccatccatctcttccttttccatcttcttccttctttctcccgtcttcttccctagcctcctccgccgccagccgcacccttcctcaccggcggttgtcacctctcctattgtctgggcacagcgagagtgagagcgacggtggcttgcaacgatgagtttcgatggatgaatcggcaccggaggaggaggagggcgcgcatccactctgcacaagcacgagaggatccatggagcccgagcacaagccgcactacatctcattcccccgctccaaaccctagccgccaccagctactcttccgcccgggcaagtcgacgcccttcaagcactccttcgctcgcccgcctgtccgccgaggaggacgcagacgagcaaacacctgtccaccggagtaggccactgcgtcggagtccacaccgctagatctgagccatagtagcattaccctcgtgccgtccagcgtttgctgatcctcctcgcgtcgttggtgtcgtccagtcgtcctcctcgtgtcgccgctacaatccgctctccatcctcgagctgccggcgggagcccgtccatcctgctcgtgtagtcgccgtcgtccacttgccatcggaggaggaggaggaggagctccagtggaggcctgggcttcactggacatgagaggggaaaaataagaaggaagaaaaggaaagaggaagaagaggaagatggaggaagaagaagaaaacaaaaaaaagaacaagagatggatggaaaatgcgacggcagtggcacggttctaattttgtaaaattccagtggcatggttacgaatagacgaattgtaatgacaattttctaaataggcaaatttgcaatggcatggatcctggtggtcctcctcgcgtcgttggcgtcgtctggtcatcctcctcgtgtcagcaccactgtcctctctccatcctcgagctgggagcccatccgtcctgctcgcgtcgtcgctatcgtccacttgccatcagaggaggaggaggaggaggtctagtggaggcttggcttcactggacatgagaggggaagaatgagaaggaggaaaaggaaagaggaagaagacgaagacggaggaagaagaagaaaactgaaaaaaaaaatgaagagatggatggaaaacatgacggcagtggcacggttctaattttgtaaaattctagtggcacggttacgaatagactaattgtaatggtatttttctgaataagcaaatttgcaatagcatggatccaattaacctatataatgccatcgaaattgtgcagttgaagcatctgaattttttttgtggggaagaagcatctgaattttgaccaaggccaactgatgatgggagcctagttaacataatttctccaaccaaccactgtgcatttcgaaatttagccatggctacatcatagctcatcgcgtggtaggctggtaagtggcggtgagtgcattttacaatgtagtaatttgcttcgatgtgtagcctcaagggtcctaggataggattgcaggaataggatgaaaccatacttaagccactctcctcttccaacgtatgcctttagttctgataaaggatttttttagtccctaaaattttctagtccgctccgcacaatgttccaatttataggtaaattcagaatctatctattactctctccgtttcatactataagtcgtttgactttttctctatgtcaaacttctttaagttcgaccaagtttatagaaaaatatagtagtattttcaacacaaaacaaatatattatcaaactatattcaatgttaagtttaataaaactaattggatattttagatgttattaaattttataaaaacttagttaaacttttcgatcggacggccgagcaccgagatcgaggcaacgaaaccttagcccgaccttggttgccaccgaaaccctagccacttctcctccctccctcgccggagcgggagcgccggtgaaagtggcggcaccgccgcacaccccctcgccggtgtgtgcactcgcccgagggtgagtgcgccaccgtcgagcagccgtgccgcggagctccggagccgccgtgaccgcgtgcccctcacggtgtcggtgatgtccggtggcggtagactttccgcgtgcatcggccggcaatgaccgacagctgcggttggacttcccgcgtgcgtcggcgatggccgacagcggcggatttcccgcacggcgtcggtggacttcccgcacaacgtctaataacaacaaaaatactaatcataaaaaaatttcaaataaaacgaacggtcaaatattggatatgcagaactatacttatattcggacggagggagtaagttttaaacttttaacatgattaaagtggttcggactaataattgataataattgtagtatgagtagtttaatggtaaagtcaccgttataagtatgggttgttataataaggacaaaatttaaacaatataagatgttatattttaggatagagggtgtaaggcagaggctatatgattagtttgagggctacctagttttcagccaattgaaaataccccaaatttcagtcaatttttttgaacggccaaggttgcatcgagatatttgtgtgaacagtaaatcttatcatctcctcttccctttccactccacaactgcattcaagctcaggagctccatgcactcgagctcgctaacaccaccctttttccatcgcttgatcatgttgtccctagcctcaccagcaagctagaagatcacgtcaatggtgctggcgagccctgccaaactgggatcctcccccttacaactcctcgccttcctccctaagccagcagtgacaccatcccctcccccccaacccagccatccactctcttcctcatctctggaggcttgcgttgtcggattcgctgccactgactgccacatcctaacccatagcctccctctcttccactgccaaccctgcccaccgtcagcccatctccatggctccggtggcacccctaccgcctcaccacctatccgtcgacaccatccaccactgttctagccactgcccaaggccatccctctaaacctggggaaacccttcttagcccccctcctaacctgacctcggccacaaaccctaaactctaaactcaccatcactgccacattgtcaacggagaagaggagctcgctgttgctgtcgccaccgctaggaagtcatcctcgggtgagtctctcctccggcttctccttcctccactggctgaagctttaagacgtatgattctctgatcgttggatttcaatctaatggctaggaagcattgactaagaattgggggaatcacagtcacctgaggagtattagttttatttttttacatggcatgcatgcaatattatattttaactattattttcttaaaattatatgaaagtagtttcaaacacaaattcaattgtgttacatactaattatatataaatatatatattgttaactaaattattattggtcagaatctagaaatgttgatttcttagtaaaaacatgcacggcttatattttaaactaccctaatcttcttcatagcggacttgtctcccacctccgcactgtagtagcatttgatgatttaatcgtcatgatgaacaattgtcaaaggtgagtgtttgttgaaaatatagtgaatagtgtttttggtttgagaacgatgttgtccactctgggaggcagttcagaccggacgggtaccaccggtcagaccggtggtgattgggtggtctgactggatagtccgacagtcaaactagtagactccaggaggaagttggtttcgggttgtcttcgtggattgtctagattgctttatgtttatgacttctagatggtatctatttgtatgtgatactattgtgtgctaatgtgagtgatcaagttggtgcaaacttatactcggatatggagtttctttgttgttcatgtgcaggtgttgcttgaggccatgggagtatagccagcgatggatcgggactagccactaggcttgggataaattgtggtctagacggtcaaggatagcacacgggatgctcagtctatagaacaatgcatgtggagatgaatgtttccatatggcatacacgtggtattgtgtgcacatggaaagatgagtcaaatttggattggagtccaagtttggaaagattggagtatggagttgtatggggatgttgtttcccttgtttggtaggtttcctatgtgattaggagtcctagttctagttggattcgtggataggggcaatcacattgagggtataaatagatgaggggttgagatgggaagatatcgattttttcggagagaaaagttagggtttgcctcaaggtttcaaccctagttcgtcagttgagagaggagtgctttagatgcacttgtagacacatattgatggaataaagttgatctactcacaagagtttcgtcaatacgtgtttttctggatcccgatggtttagactggctaggaggcagcggttagactggcgagacaccgacggttagaccggtgacatcaatctggtcaaaccggcagcggcaacagcagatgacaatagctataagggtggttgaaatggtgcatctacttcaatcagaccagtggcaagggcacgatcagaccagaggaatcacaccggtcagaccgatctccatttgctatacgaaggtaacttttaattgcacaaaaagttttaggtttttggtgttccaatcattcaaccccctctctggttggcttgattcttgtattcgatccttcacgcacctcccaccgagcctacttgtccttgtcccactgagcgcacctgttctcggccatgtccttgccttcctcctcgttttgctgtcgcgtcattgtccttatcattattgccatcgtccttgttgtccccatcatcggagtccttcagcggtggggaatcgttaaaaaaaccacttgtcatctgagtcccactcatccctgagcaatggcagcaaagaggggaggtcatcggaagacgacaccggtgccttctccgatgatggcgagctgcttgtcttctaatccttgtctagaaaggagcgatggtttggagaggaaaggattgcactgtgttttagggctggcgtcgttcgccgcatctcaactaacaaagaagagtaggagatgaagcggcgcatgatcactgaagtggcgctacaataagctgcgagaagatgaagatttctagagaacacacgtggttatgcaaggctcttgtgaaaatgtggttccagaggcagtcagctatgacctatggaaatacaaccattagtgaaaccgctttgcaaaagctattttcacactcggttgtcgtaagtaactaccttcactaatggaacattagtgcatgcggaattcttatgtagccatgtgtgaaaatgtgaaaaattacctgaagcctgtaccaattgtttctgtagcagttacaggtcttataaacatctacaaaccaagaataccatatctacatgcagttttgatgcagtaaaaaaaaaagcaacgggattgaaataagcatggtgtaggctcttctcttctactctggatggctggtcttaaaccattccaaaatgttccatctggtttgcttggtggctacgtacctcctagtcaaatctaatagctctttcttgggattatgttgtctaagtaaaattggcggattagatctggagtgacgctatgtcaaatggtgcatgacaacctagtctcgcaaaccaaatgatgtaaaagtctctttgaaagataatttgctcgaaagagaaagtgacacattttatttgtttcatacccgataagcaatagaagtaaataacaacctaagggagtgctagtttttgaagataaattaactatttgccactcctataatgggccactgatctctagccaattgccacggttacatttgtcactatatatttatcactggagagagaactttttttaaaatgttgtgcctctttcatccatatggagtgacatgcatacatgccgatatgaactattggtgcaaaatgtccattttgcccctagcccacatatgttcctctactttcatgatgctatccactaaaatgagttcttcatccagggacgcgatggctccagcacgccaaccgagaatagtaagaaagagacatcggcccaacgtcacgctctgcatatcaacattcaaggccattgatgacctatatttgcgaattgctcgacaaggcctgcaataagcatgtcatctaatgctctgacattgtcgccccatcatcgatagtgactctgtgcacctcattggagggttgtcgaccagttaaaagtggcaagaggtgggtaggggggtgtttcttattcggaatgctggacaacgttagggccttgttggcagtggagtgggatttgatgaaggcatggaggtggctgacatccttggagtagagctatagagccttgatgccctactccatagagacaaccgcgcgcaacaccattgtccgctatattgcggaaggcttcggcttgtgtgtgctgccagcttggtgtctcgatggttggcatgacaccatagtgctagaggatgctccctgtcgatagtgtccactaggtagcacaccaccgcgtgtcgcgccagttctttggtgatcatccatggcagatgcttctcgacttctggcgagtgagattgagatgataatgatattagttcaaggtggaatgggtatggttgcaggttgcttatgctagtcctacccttgttagtgctcaaagataaaaactttctggacaagataaagcgacaacagaaggagcaggggccaaatggacattccacatcagcaacgacacattggcacaacactctgttaccgttgcatggacgaaaatagcacaaaattataaaaaaaagaatcattccctctcttcgtaaacattagcgcaaaattaagaaacagggccgattctgagattttggtggcctaggacgaaattaaaaaacatgggcccttaattttacatctaaactcccgcaagaaaaaaattacatctaaataataatcaatatagcgctaaatagcacacaacgttttacttatgcataaatatttttttaccgctacatatttaatctgcatccaaaagcaatacttacagaaaacatcataaacatttctagacgcaaagtcattatgatagtatccatatcaatctcatctagtggtgtctcttttttttttacgaaatctagcatttctttgtcaatgtacaaagttgccaaaccgtttaaccatttaatttatcgacgacatggtatgtagaacaagcttagacaatgaaaagttggaatattagtggtcaaactcatatgggttacaaaacttagaaagtgcatagttaattcaaacaaatctttatttgcaaatatgcaaaaggatatattaaaaagaaatcaacatcatgatcagttggaagtcatcacaaagaagagatcagaagccgggatagcagcagactcttataaagaatttaaacaaggggttgtggctgggcggatgtatgatggtagatctgtactcgttggcttgtcaagctcgtaggctgccagcaggcttgtggcgggatcgggattaggtgcccctcccccctcccccatatcccgggatcgggattaggtgcccctcccccataccccgtggctccatcctcagcaccaggcaaatattctctctcttcgcaaacatattagaacaaatacaaaaatgattacaaacagtttaaaattttccgttttaaaagaccatatccaagccacaagggtgacctactgatcgattatcaacttgtcctactccgaatttttctatcagccccctcccagattttgtaggagcatatgcctctcaccacgtggacttacagtatcccgtaccctgcccccctgccctcacgtaatagggcctcagtgcctcaccatgatgccctttatcattcgctcaccactagagcacctacacctttccagtgggcccaccacgccctggacacttgttaacagtttatcaatgtaccatatccatttcatcaaatgccatatctgagagcgagagagagagcataaagctatgggtatggccaataataaagaggccaagcagcagctggtgaaagaagagacaaaatagagtacagtgatgtaaatgtacatgaacacagtggaacagcgacacacacacacacaccatgcactttgctcagcttgtttcagagcatctatcagctctgagtcgtcttgagtcttgactactactcgtactaccactagctctcttgagcttgagcaccagcccaggctctactgcagcagctgccatacatttctagtagctgattacatatcgtatacttaattagcactttgcacttgtgtactagtatgtgaatgtgaccatgaacaccccccccccctctctctctctcgcctgcatctcatctcttcttttactacctctgttttttaatatctaacgtcaacgacgttttggcaacgtttaaccattcatcttataaaacttttttgcaaatataaaaaagtttagagattttctccggtccagcaaaaagtacctcgaggtaccggtacattacggtactgaatcgtttccgatcgttggatctagctggacagtatggacattgttagatccaacaatcgaaaacgatttggtaccgtgaggtaccggtacctcgaggtactttttattggactatagcaaatctaaaaaaattaagtcatgtttagaaaacatttgacgataaatcaagtcacaataaataaatgataattacataaattttttgaataaaatgaatgatcaatcgtatctcaaaaagtcaatgatgtcatatattaaaaaacagatggattaaggtttagttttgccccttccattgatctggtcataccacaacacacaattgcacacatagaattaagaagaacaagaagacgtgtgtacaagtgtagtactccctccgtttcgtaatgtaagacttttgctcatattcatatatatgttaatgaatctagacacatacatatgtctagatttattaacttctatatctagattcattaacatctatatgaatgtgggtaatgctagaaagacttacattatgaaatggaggaagtagactagtagtgacggcaatggtagaattatcactatcagttattgcatccatattacatgtactatcactatgttgtgtacttgagctaggaagagcataattcagtttctgcctgatataaagacacacataatctcaagtggagttgttattggttggggttagtgctatcttcagcttcactaatgatacctccttaccctaacaacaaccttcaccatcaccaccaccattgcagctcaaaccaagaaccacacttaccattacatccaccagctttcctcatgtccgcgccgtcgtcgtcgtcgtcgccgtcgacgctggacgagtacgacgcgcgcttcttcttccccggcgccgacgcgtacaccgccggccaccggcaggatgaggagacgctggaggccgtgctgcggcagccggtgacgacgacggccgcggcggcggcggcggtggagggaggtggcggcggtggaggaggaggcgccgggggatcccccgcggcggcggcggcggcgacgcggaggcggccgttccggacggaccggcacagcaagatccgcacggcgcagggcgtgcgggaccggcggatgcggctgtccgtcggcgtcgcgcgcgacttcttcgcgctgcaggacaagctcggcttcgacaaggccagcaggacggtggagtggctgctcacccagtccaagcacgccatcaaccgcctcacccttcccgactccgccgacgcggcggcggcgcccgcgttcgccgccgctccaccgccggcggatcagcattcctcggccatggccgccgccgcagcatcggctgcgaaggagaaaggggaggcgagctcgtcgagcaccaccaatgcgtcgtcggcgcgggcgagaaacagagaccacgacggatcatcgccggtggcgcccatggacgagcgcgggcgccgcggtgtcgagctcgactggacggcggcggcggcggcgagcaccgagcagccgatggacggattggagtactacttccaatactacaatcatctggaggagataatgagctgcgacccaacgacgacaacggatgagtaaagccagtaaaggtgatttcttgtgttaaacaatcaaacaaaaataggtatgaaaactttgaaggctttgtatttatatggcttggttaatttggccttcctctgtcatgatattttgctacttaatttgctagttcacttctctatgaatcaattatcaataccggtttggcttgttatttgttgttttttttattttgagaaaagacttgttgatttgttgataacttgatatgctaatttcgagtatttgttacttccgatttttggatatgtgctatagtttttttctggctatattttctgatttttggtttgtttctatgtgctagtttttggctgacttaattttggtttgtccatgtgctaactttgagatttttgaagtttctctaattagttctccggtgatccgtggttggccatacgagtactcaattcttaggaacattttgtatcgaaaggtttgagctagaaatttcaggtgtaatccctgcaccctagaattctagctagatagaagaaatttaatactcgatcttgatgtttttataacagtaacagcatgatgacaaaccaatattttgtcctaaaaaatataccattgaacagtaattgatgttgtaaaatcatttcagtttctctgctaatgaaaattgagggttccttcctcgtcatttttctaaaataatggtaaaatttattgttttgcatgagaaggatgtttttaacttgctagcactagatctgcaatcacctgcatcaggatcataagaaccataagtgcctaagttgagaaactcaaaagcatgcataaatatatgatatatgatgatgtatgaaacattttatgaatttggtcatggtcagaaactaacatcaacaggtaaatgtatatcctttgtccaaattaagtttggggacagaggatgaacaagctagttacctatggttttgcaagtaatttctactatataaaagaacctagtggtggtgaatctgccatcccctcaaatagagatgaggtcttctatggatgaataaatatatcttttgtgcatgtggcttggactttttggatggatgtttgcttgctaattctatatatttttttccgagaatatataattctcaagttaaaagatatgatatttaaaaaaaatcattgcaatgcatgtaatttttgaaacctagtacaacataggacatcatgaatacatttaacatatatgtgttatagttgccttcacaaatgatagatgcttttgtagttgcaaaagagtgactataatatatactcctatatctttttagttaccttcacaaatgaagtaatacactgccaatataatagcttatttcatcctaattcttcaacaacatcaataccattatttttttcaatgacattaaccaatgcagtccttattttaattttattgcacgcaccatacatcccgcaatgaagatataaattgtgccttactacgcatacctgaatgcagatatacaatcatgctctttatatgatatgtactaataactgcatatgtccacataagagtatagaaagcttttgttactttcttacagacaaaaagggtaacttgatcatgctccattgattggttaagaatggcaaatatctcatatagctgtatcatacacaaagcagagcaacaccagctggtttagagtaggataattaatttatcccatgcatcagcaaaatttatctaggtggtataatcagttttctatcttaaagtgtataattttttttataacagataaataagcttcggaccacttttcataaatgtttttttttatgtagaggcagacctaattaactttaatttttggggtgtgatttggtattcttccaccagaaaacatttgaatcttaaattgaaatataaaatttaaatatttcctgcatatttattactgtacagtattgactctatataatttattgcaatcacttatgcaatgacaaggacaaattaaaaagtatctggagtcaattaaatcaatttcctttttattgctcatgtatttacatactgcatttctgaattatacagactagctatagtaaacgtatgtgtaattgtcattttcatgtctataaaattatatgtatgaaaaggatatggtaaattgaattgtatttatatatcatggattttttatgcatgcatttttttattccagttccatgaaattatgtatttttttggttgattgcatgacagcatgcagggagggaattaaggtcttgtttagttcacccccaacttccaaatttctatcacatcacatcacatccaaaactttcctacacacataaactcctaattttttttcaaactaccaactttccccaaactttcaacttttttcaggaactaaacatagcctaagacatgcatccatatcagtatattattatatacctaatcttactgatcccgcatatacatataagcaggaggaaattaaaattttgttttgttatttgttttagatatatcggtgcttacactgagatttgtctatggtgcactctacaacaattattattactctgtcaaacggaacataactaaatgtttggatgcatttgtaactgacctttttagcttcattgatcaaggtcttgtgaatatagagattaaaaaaataactcagaataaaactaacgggctaggtgccaacttttttaactactaggtgaaacctcgcacgttgctgcatgagtttagtatgataacaataagtaaaaataatgtataagatagctaaacaacataaacttatataagcactaaaatcaattgatgtgatatggcttaattagagaagagagaaataacattaacgaagtgaggatgaacttacatagattataaaaagtaatgaagatatatattgaaatattatatgaattatatgggataatgatttaacatgctttcattttaaaagctctaaaatgtaataaattttaaattatagataatatagcatgtttgtatgatattaaatgtattgactgttagtggatgatgatgtggcatctttgcatgttaaattttagtagttagtgggttataactttatagtaagataggattgctcatcaagagtgtaattagcatggatacattatattgaactagcaaaatcctcatgctttgctatgggtaaaaggaaatacattatactatgtcatagcaaaaaaaatatttttttattaaatatgttagtatcacttgtttgcttatttaaatatatagtattaactagtttgaattaaatattgggctattccataatattaataatatcaagtcataatttatatagaaactgcagtagtgggaaggcagattcactgccactagtagtaggtatagactatttgatttggttgttcacccttgtataaattaattaatgtaggcttatatctatagtacttgaatataatttcaagagctagcatactttaatatggaaatgatggcttaaatatttctccgctcttatggtatgctctttggcttatcagctgctaccagaattttaaaactcaattttagaattaatttgatttttttccatcatatataattaatttactttccagcattgctttaagtcactaaaaacatacataaagttttactcataaattattttttagacgtgtattagcgttacaacttaattataatcaattgtaggagtaatgatgtgaatggtacactagaggtgattcgatatagctagccagcttgccatgtatagcaaagaagttcggaataattcattctgttgagaggagtgtcattgcataactaaataactatacaaatatttcgaatcttgaggacattcaaatttctaaaattaacaacgtgagtcaatatcttaatttcccccaacatatatatgtacatgatactttctttcgaaaaaaaaatatatgtacatgatactgaaaagagatatgcatgtatgacgatgaaaatgcccagtgtgcatctgaatgctgcatgcatgtggcatattttttttttcggtgttcagaaactgaataaatgatgagtacaagaagaggcaaggaggttcatacatcaccatagaatttcgattgttattactccctcttctataattcttacgatttagacaacgacacggttttctaaatatatctttgactatatttttctattatattatatactataaatagatttttttacttttttttaagtactttgtaaaacaaatctatatatgttgttctagtgcctttaaactaaatgattttaaagttattgctagtcaaagttataaaaatttaatttaaatcttgtccaaaacgtcaagaattatggaactggagggagtaattagcaagcatatgtgtgtggctacgagagattttgttgaagcaaccaaccaaaacagaaaagagaatttgctggctagtctgatcagttcagtgctaattagcatacattctcatgaatggaagaagctagctggtaaataattaacagagggaagatatcttacaggtttaattactgtatgttcagaggagatcgaggaacggccgggacgatgcagctgatggagaagagcgatgtatacgatcgaccaagcatatgataagaagggatgcagaaagcacatcggcgaattgaagttgttcttccagagatatctatctatctatatatgatgtagggagaagggctccaggtaggggcctggccgtgctagccatctcactatctgcaagctgagctcctgacaaaatgctaagtttgccaatgccatttgtttttttttttctaccgtgtcagatcgagagcgtgatcggtgtcaagacaggtcgtagcagcatgagcacgtcgctacccgccatagcatcgtcctcgtcactaggggtgaaaattaacggaatcggtaacatcttttcgaaaacaatgttcgatcgactgataatggatcatatttatcatttaaactactcagtgccaacattaatacgatgaaaaataaattagaaaaaataaactttataaatagctaaaacggtactctttatatacggaaatagcgctcggttgatagggaatttctgtaaccgttttggcccgtagtcctcacggcctcaccctacccttctctctctaagatgaagttcgtgcgcttgtcttaatttctgattggatgccaagctagcgtgcaatccacggatgtttcctctttcgtgatctctccgtgattgatttggacggccacggacggttcagatcgatgtccggtattacgcgtttctcgtttcagaatttggcttagggcagcaccaatagtcccctaatccattcccaaaactggttttgagatattttagtccagaaaacagctccaacagatccctactctcatgcccaagatttggagttccctctcctgaatttgcctctcccgctcccagtcgtgtgctcctcacctctctcttcccattcccgcgcttgggtgcgatctctttccacgcgggaggaagaaaacgaaaatttatgttggtacgtagtttatttaatagaagggtccacttttagtttttaggaattgaatttaggctctcttttagagggagtaattttttcgcttcctatattttcagtttaggaaatgaaaaattaaattttgggaagctaatctattggtgatgctcttagctggatttacagatggtagggaattcattggctatcttggatgagtaaattttgctttgcgccaccctttattatcgttgtttcgatttggtccaccttttaataaatagtttcactttgaactgggtaatttatttttataacaatttggaccacactcaatgattttatctatctgcggctgtgtttagttcgtgtgccaaaatttttttcaagtatatggacacacatttgatgtattaaacatcttgtaaaccgcgagacgaatctattaagcctaattaatttatcattagtaaatgtttactgtagaaccatattgtcaaatcatggcgtaattaagctcaaaagattcgtcttgtgatttacatgcaaattgtgcaattgattttttcgtccacctttaatgctctatgcatgtgtccaagcatttaatgtgacggaaaagttgaaaatttgaagaaaatagtttgaatctaaacacggcctgcatcaacttgtcataatataactgtgggagtttattagtgtgtaggtgttgacgtcgcactttaaatcattagtatgcttgagaaatgagttgggatgatcctaaaattacctgatccaattcaaagagagaacatttgttaaaggttagcataaaataaaacatctggtactaaaagatgattcaaaataaaatttactttttatatgtacagtacgtggctatagatcgaattgaattgggcacagtgctggctggccggttgcggatggaacgttttgtaggttttggcggcacgtcgtcgcagcagcagcagcgattggacgcgcaggacatttgttattaaaaactggctgccggggccgggtataatgtacagtccgctgctagtagctgactgttcaaagcgcactagtagcagctggcagcagcatgcagcaggccagcagctactaggatggatatgatgcagatctctgaagtctacaaacctgatctccgagagcattcaccgtgtgtaacagtggcatttaactatttatcgcttttaagatacgatgataatagatttgccacttgttatctgacatgtagacccttatatgtgtctatgatatattaaaccggtgacaaatctgttatcaccatttataagagtggcaaatagttagttattcctatgtaatacggtaataagataagatccatctactatgcataaagcaatagagagatatgtgtaatgtatagaacacatcaactctataatgggacacatacctatgagtatcaagatggactcatgccatacttataataaaatattatttttttatttaaagtacgtacctggtcttaagggaagagcactacttttgctatgttagtgcttgagacctgtgtttgcaatgtgtagaacttttgctacattgaaaagattttctcagttacaatgtataataaaggttaatttataatgtgggaattagctagacatgtgcttgagacctgtatttgcaatgtatggaggctttgacggcaccgaagagggagggttcgacagtcgcactgatgggccaatatgtggctgctgcagcagcttccagagccagcacgttggtgagaagggaagcaaaatccccgagcacggctaggacgacctccatgagcaagcgctagctactcctaccactccaccgctgcaaaatcctcccccttctcaaggagcaacctgagcatggctaggacgtcctccacaaccgccacctccagagcaccgcttgctgcctcgggcactagaagatcttgccacggctgttgtagtggtgcgaggggaattcttggtggtgtcggcattgaggccggtaatggtgggaggtatgacgataggtgtggcaatttcctcgatgaggatggggacccagtggttacccgcccctacggggccggcggcagtcccaattcctacccctcaagtgagttgggtcgaggtttaagggtaaaatttttttgtcatgtcacatcggatatatggacacacgtttgaagtattagacatagtctaataacaaaacaaaattacagaatctgtcagtaaactgcgagacgaatttattaagcctaattaatccgtcattagcaaacgtttaatgtagcaccatattgtcaaatcatggaacagctaggcttaaaagattcgtctcgcaaattagttgcaatttgtgctattagttattttttagcctatatttaatacttcatataggtatttaagcgttcgatgtaatagggtgaaaaattttagggtgggatctaaatagggccttaggaccggaatgatacaatttaacaaattctaaaacccacatctatgttaataagattgcagtcctgagtttaaaaaccggccatacgctttattcgaaaaataaaaaaaaaacactaacgaaacacttaaggcggccatatatacacgagactgtgaagaccagtactgtggccactatagctagtaggagtatgttggatgttgctagtatagcgctagtacagtactcgatcgtacgtagctggtccgggctagctaggtgaggcgggcggcgaggtaagagctgcggagcgatcccaccaccggtggggcggcgccagacgccgcgacgtgcgtacaagcatatgatgatcatcaacgcgcgcgcgcggtgtgagggccggccggccgccaagaaatttaaggtgcgtgcggcgccggtggcgaggcatggcatggcgtacgtgtggattgcgcgcggagttcgatcgtgcgcgcgtcgtcgtcagagaggtgccgcaggttcgatcgtgcgcgcgggccggctgccggccgacggggctcgcccccgcgatgtgagaaagtactctgggatgccagcgaggatgttgctagctctcctcgagcaaagaacacgcaggatcgcagtgtctcagcagcacgaactcgttgctatgggttaatatggaatccatgtcattgcaaatttatccaattaaacaattccactattttcgtgacatcaattggttgccatcagaattacgtaaaatttaaaccatatcattacagggtggatccagaataaaatttaaaaggagactcatctccttcttccttttaagttcccctactcttcattttctccctattcttcccctttcatctccccttctatcaatggtgatccagcgggccggggtagggggactcaagtccccccagcacccacgctggatctgcccctatatcattatatacgtcgtctcggacacagctggaccaggtttttacctaccatacccggccctagcctttagaggctggcaagtggggcccaccttggcgaggctggtccttgcatgggagctcgaggaggacagcgacaggtctccaagtcttattcatgccactttggtcgtcatattcgagaaggatggggatggagctcaccgtcgtcttcgagtcttcgtcattgctgccacctggcctccttgcaacacttcgctccaagccgctgttgaacccgtctgtcactagcattggcaactttttttgacaagttgacaagcacgattgcaacacctaacgtcttgcggtaatcctagagtcgccaaccacctcaatctagtaaaaactagaccaagatgggttttgataactaaaccgactagcgaagccgatttctagataactacccgtctcatgggcaaaatggaaggttttcaggacaaacctacaaagaggtgtcgcactctcgcagtggcggcggacggtttacagcccaaaccgacaaagatggacaaactaaaagaaaactaaagcaatatgaaaaacgattcgattgattgattgtagattgattagttacaattaaaccggccatgtccctataaggggttggtcttaccctctacaggccctcctccacgttcaactcggggtagaaaccaaaggaaacctgaaacatgccttctcgagcaaggaaacttcgagacccgacaaaacacactcagactcggaccctgccggtcagaccggccacacaccgccggtctgaccggccaacacatggcggtcagaccggcccacttcagaggaaatcggcagacttccaaactttggcaattttttcctattttaatcctaggtgccaaatttgggtataaacaattggatcttctcgcgctactactagaccctccaccactgcgagaagctcgccgccaccaccagatgtgctccatccactaccaaacgtgtgttgacgaaaaatctgcactcgatcgatggtgctagatctgtgttggcgcgaactaagttgacgaacacaacagcctgggagttctgcttagctccagtgcaggttctaaaatcgatgagatgtgggcgtgccagtcaatttgatccagcaactggtaaaatagataaatatgttgatcaccaaagagtcgatcggctaacgagccgatagagcgatactagccgatatggataccagccaatgctgatgggattttgagcaatcggatatatgtccaatgtagaacctgacacttgagtaaatttttttttacggttaaacaatacgagaggctcctactgtgctatattaataaaagaatggatgtacaaagggtggatatacaaggggggaggaagaggaagcaaaaaataaagaaaaacaattaaacaaacaattagatcagctaaagttttgtttctatgattgccagctgggtttgtctgcaacctttcttcatggaagtgctaggaattggatgttggaatatctcgaatagaagaaatgatctcatattcaataatgtgcccatcaaccttagtaaatggaaatccgacttcagagaggattttactcggcatatgcacagagtaaaagttgcagacacttgagtaaataatggcataaagacaatcggctgatgataatgtaataaaacaataatataatccaacataaaccaatcggctaataatggtatgatacaataagcattgatccaaaggttaaagcatatatcggctggaagtttgatgttgttaaatccaaacgaatagataatcagtgaaacctttattgcgattggctaaaaccaatttgtatgtaatccttataagttgatgcaacatccagataactcattggctgaaaccccgatgaaacccttattggtaatcaaaaagtagtctagagactatggttctaagcacgacttagtaggtcaaacccaattgatacaacactaagtataaaaagaaatataatatcttgacaatcaagcctttgattgattttcaaggtggtggataccttagctaatctagatcaacaaaataatttagctgatactggcaaaaccctagaaaagatctgacggatacaagtaaattgaataatcgacttggattaactaagatatatgataaacaggtaggcaaatatatcaaccaaaccatagcgatacaagaggtcgaagcgatgtagtcttgaacaacgccaatgtagccgatacaattactaaagctgacggacgtaggacttaccccttcgccgaagatcgaaagccaatgcagccccgtgtgcaaggtgccaaattctgccggttggtaaagaaaacctcaaaaaagagggtagcgatgcgccaagagtagttgtattgatatgtgagataaatccagcaaccctgggtgtacatatttatacccatgggtagataagagtccttatgggacatgacacaaattttcttaaagataaaaagaaaaacataaaagccttatcggacactaaacacattttcctaacaattaaaggaaactaatagacatttactaattaataaataaacccccataccgcattctccttgaactcggtttcttttagataaacttactttaattgattaattttcttaaccaaatctacccagaatctgaattgcatgttgatatgacacacttgcatgttaagttttaggagtcagtggacatcaaatgtatagtaagataggatatggtatgtaaaaacttgatcagcctatagatctaacaaggtttttaattgtgccgcatatttcactttgttggatcagcctgcaatattaagagcatttgcaataaaaaaattatcatattatggtatctttctctatgcgagtagtttgagtagaccctaaaaagatagtactgtcatactatctcggtcgactgaattaccccccctctcaaatactatatattttacattctcaactatttaaatcggacaaataaccccctgactcgattcatagtggttcagatcctacgtggcagtccaatcagtgctttttattaaaaaaatatggagcccacctatcagatagaagatagaatctaacaggtgggctccaccgatcatagtgttgtgtttatatagttaatatattttatctatatcggtgggccccataataattcctagggatatttatacattgtaggaattttcactacttggtatagttaatataggccataactctaataatatcctactacgagcgctcataaaacaaatataccgcgtgaaaactactctttgggtatgtttaggggaagcttctagctgctgtagcttctcctaggattagaagctcctccaaacaattcagcttttgatccagattctgagaaactgtagttgtagaatatagaaaataaactagaagccagaagctgggaaacccagcttttccaaattctctgtgcatatgccgagtaaaatcttctcggaagttatttcttcgaattttaagctcccgagagtcactttgattgagtgctcataggccacatgtaccccttgttgagctggcaggtcaaatatgacgtggaagtatgaagcactcgcaagtcaccgtactgtcctcatgagaagctgctcagcaggcgtcacctctgcgcctgtagcttcagaaagcttgtacacaaaagcagcgacagacggggtagcagtagtagcacgtcatacctgtttagaagccgagcaacacatgtaccatcacaaaagtctctaaacaaaagcatcatattcataccacttatgtaacacctttttcttaggcattcctattgttaatcactggactatgcacggtatctcacaagcaacatagaggaacacaaaaaccaattagctagaagtagcagtttactacctcaaacaattgcaagatgctagctgtgataaagctccaaatgtacaagtatgtgaccaatgtttcatactgaaaaatgctacgtttagtctacgtgacttacatgatttacatcttcaaaagcggtataccgtgttcatcctgatgcatgacagcaatttttttttactgtaattaattcgttgcggtttatctagatttgatgggggctatctacaagctataagcatcgaaacagcagagcctcttcttcagcagccaccactcgcaggttcaatcgagctccggaggccattgcccctgagcgacgtgcagtgctcctctgcctccgactgagagcagatgatcaccactgacagcccgtttacatgagcctcctgcatgatgttgacggcattgtcgacggtcatcccggggataactttcatcaggacttggacgacgtactcacgcctgttgtagttgtcgttgtggaggaggactcgatacggaggcgtcattttgcgggattttctgcagatcaggggaattgtgttatatcagtattgaccaacaaaaactatttcaacaggtacaagacatccgatgtgaaaaaatattactcagtccgtctgaaaaccgatagaaattccatgtagcctttcaacaaggcaatgcttttgtgtagggacacatgtcttgctaaggcacaatgagcaatattcaagaatagcaactatgtctttagccaatctgctggtctggtcagactacagaacatcagctacatgacatatgctcacaaggataaaatgatcaatgtatcagaagccacttaattcagaaactagacagcgggtccagtaatcattgaaagtaaaactcaagacatgtcactatggtttcaaacagattaaagcattggcaaacaaatcattgtaatggtacttgtgtacaacacataataaaaatcaaacatgtttaaggaaaatcaagcaatgatgacaatagaacatctaaaccacctttaaaagaaaagaacatctaaacgagctaatctgaatatagaattggttcataatgtgctgcaacaatcaactttgtttatgcctgaaaaagatagtaaatgtaaaatgcgtagcaacaaaggtaatcctatcttcctatatatttggtacccactaaggggcatttactcttataaagcaagacatgcaagaagccacatcaacaattttaaaccatcagatcacattagcacaatgataacaacctttggatcaagaagctacttattcatccaattcaattttatttaacccttcctcccaaaaaaggcaatcaacggacatatcagtatatcccctactaggagaaaatatgcagagatggttctgacaccatttaaaggaacgattatgttcccacactagcagttgattttgatggcatgccctacttgacataactctgataagagcaagagggtgtttctgaaaagatgcaaactgaaaattgcgaaacagacatggctagaaaacacttcagtagttcagtttcagtcaagcgggatcctatgactcctgaatatttttgtacatgtgcaattccactatgcctaggaagaaattggctttattttgcaggagggctctcccttttactgttgtcctaacaaactggaatttggctagatgacttttatagtggtttggtccaaatatttgagtcataatgaaaatcttgaaatccgtttggtagcacttaatgaaaattctgtaattacaactttccatcattatctggggtaagttcacaagctcagacctcagagcctagtatgaaattttagttcacatcgtaccatttcttttcagaatcctagagaatctgtactttacacaagatagagaaaacaaatgaactgtaaatagcacattgttacctaacatcgaattcagactggcgaccaggagtaactttctctattggccgatcaagcacgccaccacctttccctggtgcagctgctgctgccagagccataggaatggcaggattcgggcaccttcccctgtaaatcgcatatctttctcctgcacaacatgtacagaaaagatgaacaaacaatcctgcaacagcaaccaccgaccaaaatgacatagcaaacacaccttcaatctaattaaaatcatcaaatttcttgcacataattctaaggagggtaatttgaaaggataggatgatctcccatggaaaataagagcaaccaaaaaaacatatataaccaattaggcaggaagtaactttggtcatggccacagcatatgttgcaagaattaacaggcacagcctattggtgagcagaacgatgtcaacatttactaactgatttcgtcaattgccactaccaagaaccaattaattgccaaggacacacacgccaaggccccccttccttccaggcctccagccaagtgccaacccacccaacaatttccaaaccgaccgaattttcgggcaatttccaacaggagcaaccctaagagcccaattacgcctatttcgggtcagtggcagtgccaaactaatatctcccatacttgtagcgaagaactaacttgcccccatcatccttatccagctactagaacaaatagacagagaggagagggggggttacctcccaccgcgtggtggtggtggttggagagccggctcgcggagagcgccacacggctgggcaccgccgcctccatggctgcctctccctctctctctctctctctctctctctctctctctctctctctcgccgtcgtcggagtgtggtggcctcgcggccgcggcggcggtggtgtggctcggtgggccgtgtggatgcagcgggtgggcgtgcgtgcggcgaggagagtaggggggagtatttgtggcccagttgggttgttgggttggcgtcgccggagccacctgttcggggtccggactcctaggccactgatcctgatccccccctcagattttttttttaatttccttcttcctctcgccacaaagcattgcagtagcaggttcaggttgttgataacgatggactaataatggacatgcgtctgcagggagattgggagaaaacccaaggaggaaaaaaaaagaaaatgctacttaatggtattccgttcggacggaatgatacctcacatgtattatctgatacctgataacctggtagatatcggctgatactctattcgaacgggatgatacctctgagacagtcgatatagctcatccgtctgaatagaataccgtcctcccaaaagaagttgtgaaatgaaatgataatgaggttaattagacagtgatgaggattgaggggggaaatttacctggttaagaaaacagcccctttgggcgatgattcatctctaagataataatacgtttttcttaggttttcgttaactcactttttaaaatgttgaagggtgcattttgtgtaaaaactttctatataaaaactgctatgaaatatcagataatttttttgggttttataataattaaaatttaattaattttatgctttaatggttatttctttcctctttctatgccataacttcattctttgtagaaacgaacagtcgaacaccaaatgcgacattgatttgtatggcaaaatagccattttcgtccctaaactatcgcccgaggctcagtttggtccctgaactatcaaattgtccaatttcgtccttcaacaattgatttcgaactcaatctcgtcagttccccttgatagcacgccacgtggccagctagacatgcgaaatgtccgtcctgcccctcgctcaattctttacatgttggatggctgatggcgtttcaggctccccgttgcctccctctcatcctcgtcttctctgttcgtcatggcaactatataggtaggttagggttttggcttgggggctggggcggagatcagtacaggacgacggcgtgttcgaaggggtggaggcgcaccccttctcctggtggaggcgtgcccttgtccttgggcagacggactgctcataggcaaccaagacacaggaagaggagaggacgtgctgcaaaggtaagatgagtggcacttcactagttttgcacttgagtttgatttccttgtagaatgtttaaatttgaccatatagttgatctatagggccacgaagcaatgtctgaatttgaggtactggaagttcaatttcattttaatggggaatttgttcttgatgagtcaaagatgtcgtattgcaatggggattgtggagtgtcccacatagagaaggacaagatctctatccctgaacttgaaggccacctattggatcacacaacttttcctcaatctgttaggatgtactggttgccatttggtgcagaattgaatagtggtatgaggttacttgtagatgacaagtcatgtttggacatgattcatgagctgggaactgctacaacagtagatacaccgaatcagttgatatgggtgggaatgaagaatctggaacacagtatgcagatgagaatgtatttgccctatttcaagatgataatatcatggatttggatcatgcagaacctattgtcaaggaacaaactgtccaaaatagggacaaatttgttcagggcgataacatgctgtgtttggaaggtccaacccatggtcaggatagtccgaatgaagaagcagcagaagatttagaagcagagagtgatggctgtgatgctacaggtttcacaagtgatgaagatgatgaagttagagagataagaaccaaatacaaagagtttatgtcagaagtaaagaagagaggagatattccaatagacaatccaattgaggttgatggcatacaaggtggagatattccattgggtaataatcaagtcttagaaggtggagatggtgctgaatactttgattcagatggtgatgcatcgtacgatgaggacagtgatggtgtctttacaagaaggaagtgcaggttcccaatatttgacagtttcgctgatactccacagtttgcagttgacatgtgctttagaggaaaggaccaattgaaggatgctatagagaggtatgctctgaagaagaagataaatatcagatatgtgaagaatgagcagaaaaggattagggctgtttgtaggtggaaaggttgtccttggcttctatatgcttcccataactcaaggagtgattggtttcagattgtaacttataatcccaaccatgcttgttgtcctgagcttaaaaataaaaggttatctacaagaaggatatgtgataggtatgagagtactatcaaggctaatccatcttggaaggctagagaaatgaaggagacagtacaagaggacatgggagtggatgtgccaatcacaatgattaagagagcaaaggcacatgtaatgaagaaaataatggatactcagactggtgagtattccaagctgtttgactatgctctggagttgcagcgtagtaatcctggaactagtgtgcatgttgcccttgacccagaggaagaggaccatgtgtttcagaggttttatgtatgttttgatgcatgtagaagaggatttttagaaggatgtaggaggataattgggcttgatggatgtttccttaaggggccattgaaaggtgagttgttatcagctattggcagggatgcaaataatcagctttatccaattgcatgggctgttgtggaatatgagaataaagactcgtggaattggtttcttgggcatcttcagaaagacatcaacatacctgttggagcagcaggctgggtgtttataacagaccaacagaaggtaaatttctatctatttttgtccattttatgtagaggcttttttaatcattaaaataaaatggttaaatcatttgtgtccattttatgcaggggctgctaagcatagtatctacattgtttccatttgctgagcataggatgtgtgcacgccacatatatgccaactggagaaagaaacataggctgcaggagtaccaaaagaggttttggaagattgcaaaagcacctaatgagcagttgtttaaccattacaagagaaagcttgctgcaaaaactcctcgtggatggcaggatttggagaaaacaaatcctattcattggtctcgagcttggttcagacttggatcaaattgtgaatcagttgacaacaacatgagtgaatcattcaatagttggattatagaatcaaggttcaagcctattattactattgacggagcgtggggctcctcaccgggagaccgcactggcccccctttgccggttcggccggggaccctgggtgagactctaagctcccaatctgtggaaggttcgcgagacaggaagcacacaaaacgccggcgatgtatacaggttcgggccgctgagaagcgtaataccctactcctgtgttttggtggattcgtgtatgaaggaactacaaagtatgagccagcctctccctcgttctgggttcccaatctggaaaaatccaaaatcccctctctaagtgggcaaggtcctccttttatatcttaaggggataccacatgcaccatctccccctctctttcttccaatttgacttctcttcattaacagacggagatttgcatcgtcgccgtccgaatgaccttctgacgggacggcccatacctacctccacttccgccggaggcaggcgcgacgtgggaagatggctgtctgctgatgacttgaccattgtcagactggtcacaaatcggtcattcttgtccaccacgtgtcagtttaacaatctgcatgttcgcccttcttcatacaatatcttgcctgtaatggttaggatgaagcctggcatatatctgaccggaaccaacgtgccatctccaggagctaacacgccggctccagctagggacgagtgcttggaggctctcgtcctgacgggatggggcgaggcgtgcgtcagaccgcctgtcgccacctaacccatgatctgaccggtctgtgactggtcacagaccggataaacgagcgtgctgtactgcgatacatgcggcgtgacgcgctcgtcaaaactgcaataaatgtggttaggtgagccccgccatgctcacctaccccatatacgtggcgcaaaacccacaaggggtcggggcgcttcggccctcggggccgagacgggagcggcccaaccccttggggagacaaagagaagggcggccgtatcaccctcgggcccgacccccccccgagggagttaggccacgtgggtgatcgtgtctgcctcaagtctctaagtcatgatactcccggtaaagaggagggcgaacacatcaccctcgggcccgacgccccctgacggtgccaggccacatgggcgattgtgtctgcctcaagcctctagtcatgatactcccggtcccatgtcaccgacagtagcccccggcgttatgccagggcgatcgccctctttaagggaagcggtcgggcgtgacgccactcctaaggcctggtgacaggtgggaccggtctccacgattgggcagaaacccaacggtcacaaatcacgcacatcggcagtggtaactcggctgtcaataatgagcggtctcttcaagactgccacattactcgagtagcacacgaatctggacatggcgattcgtttcgtttggagatatggtaacgtcgcttcggtcggcgagcgtaattaacgcgcgcacgatatgatctatctcgactgccacaaccgcatgtccacctcatgctccgcaagcgggcgaatgggattagtggaagcgtgggcgcgagaaacgagggggcgaaatagtgggcgcgagaagcgaggagccgggcacagcgttggtaagagtataaaggcactgaggaagggatctgtttccttcctttcgccattattccccttgtcttcgtcgcttgcgccctaactccttctttcctgtgccctaccttcaccacacgcgctcgctcttaatcttctcttcctccggggccatggcacggggctccgctctgctcgatggtagcgtgctgccgccttcccgcatcgtgagcgagaggcaggctgggctgccgcgccgcttcatgccggaatctgccaccggccgggagatagtcacgctgggcgagggacgcccggcaccagactacccggggcggtccgtcttctttctcccctttgcaatggcagggctggttccgccattttcttctttcttcatggatgttctggagttctacgatctccagatggcgcacctcacccccaacgcggtgatgacattggccatcttcgcgcatctgtgcgagatgttcattggggtgcgcccatctcttcggctgttccggtggttcttcaccgtgcagtcggtgtcgccgccatcggtagttggtggctgctacttccagccacgggggccggtgctgaaccgctacatcccctgcgccctccgcaagaagtgggacgactggaagagcgactggttctacaccccccttgccgacgaagcgcgcctccgacttccgagccagcccccggcgcaggcctccagctggcgggcgccggtagatctgggggatggctatgacgccgtcctcgaccgcctggcgggcctgcgatcccaggggctcacaggggccatggtgtacggcgactacctccgtcgtcggattgcgccgctccagcggcgcgctcggggcgcctgggagtacaccgggtccgaagacttcatgaggacccaccagggagtgagatgggactaggctcctgaggacttcaagatattggtccaacgggtgctgaatctcaactccgtggaggcgtccctcattccccaaggaatcctccccctctgcagcgatccagactgcgcctccatcctaaccattatgatggcggtcggggcctcagaggagcgagctccaaagggccacgacgacgcaggcgggagccgcaggggggaacaatctaccccgggagggggtcgtacttctgggtcccgcgacaggggcccggggagcagccgccctgccgacgcccgggggaagaggaagcagggaggaacacctcccccatctcctccccgagggggcggggcggtgcgcgccagcagcaggcggccggagggggccgtgccgacatcgcagcccgagggggagcgcaagaagaagcggttccgcaagatgggggagacagaaccatctcggggaaacctcatttcccctccaaagtggtcgtttaaccgaccccctcgcaggttcgtctctcacccatcgtggctgtattcattctctcaacgcgagttttcactcacccatcttgttcgtcttctggtcttttcttttgtttcagcgagatcccgtcgcgtccctcccgccattccaagcccggccagtctgaggccgaggatccggcggccgcagaggcccggaggcgggaatctgaccggcgagaggccgcggatcgcctacgggaagccgaggaggccgcccaggaggccgcccgggctcgccaggccgaggaaaccgctcgggaggaggccgcccgggcccgccaggccgaggaagccgttcgggaggaggccgcccgggcccgccaggccgaggaagccgttcgggaggaggccgcccgagcccgccaggccgaggaagccgctcgggagaaagccggatttcgccaggacgaggcgttggcgacttccgaggcagctcgcgacgaggccgcgggcgcgtcgcttgggcccactccctcgggcgacgctcaggcgacagcttccggggcagctggcgacgaggctgcgggcgcgtcgcttgggcccactccctcgggcgacgctcaggaccaaccgggtccgggggacatccccgagtccggcacttccatcggtggcccgagccgcatggcatcctctccaaggcggctcttccccacgccttctatcgccccactgaacgcagagccccttctgcaggccttggccgccgcaaacaccacggtgttggatgggttaagtgcccaggtggaggccctgcaggcagagcgggcggagctcgatgccgcgtgggcgcatgtcgaagaggggcgacgctcggtggaggccatggtggaggtgggccgtaaggctcaccgccggcacgtctcggagcttgaaacccgtaagaaggtgctggcggagatcgccaaggaagtggaggaggagcggggggctgccctcattgccaccaccgtcatgaacgaggcgcaggacaccctccgccttcaatacgggagctgggaggcggagctagggaagaagctcgacgccgcccagggggtgcttgacgctgccgctgcccgagaacagcgggcggcggagaccgaagcggcgtcccggcggcgcgaagaggcccttgaggcgcgcgccatggcgctggaagagcgcgcctgcgtcgtggagagggatctggcggaccgcgaggccgccgtcaccatccgggaagcaacgctggcggcgcacgaggctgcctgcgctgaagaagagctcgcgctccgcctccgcgaggacgcgctcaccgagcgggagcgagctctcgagggggccgaggccgcggcgcaacagctggcggacagcctgtccctccgcgaggcagcgcagaaggagcaggcgcgccgtaatctagaaggtgcccgcgccgagagggccgcactgaaccaacgggccgctgagctcgaggcgcgggcgaaggagctggacgcgagggcgcgcagcggcggggcggccgcgggcgaaagtgacttagccgcccgcctcgcagctgccgaacacaccatcgccgatctacagggcgcgctggactcgtccgccggggaggtcgaagccctccgcttggcaggcgaggttgggcccggcatgctttgggacgccgtctcccgcctagattgcgccggtcggcaagtgggcctctggagagggcggaccgtaaagtacgccgccaaccagggaggtctcgcccagcgcctctcgaagatggccggggctctccaacggctccccgaggagctcgagaagacaattaagtcatcctcgagggacctcgcccaaggagcggtggagctcgtcctggcgagttaccaggccagggaccccaatttctctccatggatggcgctggatgagttccctcctgggaccgaggaccacgcgcgcgcgcaggtccgggatgccgccgaccatatcgtcgacagcttcgagggctcggcccctcggctcgcgttcgcccccaactccgacgaggagggcaatgccggtggtgcagacgacagtgacgacgaggccggcgacccgggcgcatcggattgagcccccagacccccgccattcttcagttttttcttcttttctttcttctaaggccttcgggcctcttttttgtatagatcaacttaatctgtaatcaaaaatgaagaaatttttgtgtcaatttcatcttgctgtgtgtataagatgaggatgatctgtgccgtggtccttttgtgtcttagcttgattaagggttcatgcccaggtcccagtcctcaaaaggcgcgggtcggggctagtgcctggggagatccacatgtcgagactggccaggccgggaacgtggtgaccgagggttatgggtgacccgattgtgggtttttgccgattcccccccggagttcaccacgccccggggcacggctcggttctgggccccgtttggcgattttagccgacccgagcccccgagggcaggattgagcacgagtgacctatttcaagtcaagattcttcaaaaggaaaaaacagcacagatacagcctttaggaaattgaaactgcttttattgaaatactgaaataagagaaataagaatgtgcatgtgtggcagcccccggccaaccctgcacgcccgagggggtgcggggttggcccgagcccgaaacctgacacccgaccccccctcaggggtagaagcgacgaaggttatccacgggttaggcagctcagtgccgtcgcccgtggccagccgtatggagcccggccgggggacgccgaccactcgatacggactctcccacattggtgaaagcttgctcaatccagcacgcgtttggacgcggcgtaggacgaggtcgtcgacgcagagtgatcgggcccggacgtgacgctgatggtagcgccgcaggctctgctggtagcgcgcggctcggagggccgcgcgccgccttcgctcttccaagtagtcgaggtcatctctgcgaagctgatcttgatcagcctcgcagtacatggtggccctgaggagacctcagggtgagctcggatgggagaaccgcttccgcgccgtagacgaggaagaaaggcgtttccccggttgctcggcttggtgtagttcggtttgcccagagcaccgctggcaactcctcgatccatgaatcgccgtgcttcttgagtatgttgaaggtcttggttttaaggcctttgaggatttccgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaccgggctgtgatgcccttaatgaatttaagtgcggagtgcttatcgatcttgacgaccggataagcctcgggccacttagtgaacttgtcgatcgcgacatacagatactcaaacccgcccggggcccgcctaaacggtcccaggatatcgagtccccagacagcaaatggccacgaaagtggtatggtctgcagggcctgggccggctgatggatttgcttggcgtggaattgacacgctctacatcgccggaccaggtcgaccgcatcattgagagctgtcggccaatagaaaccctggcgaaaagctttaccaaccaaggtgcgcgaggcggagtgggctccgcattcgccttcatggatatcggcaagaagcacaacgccttgttcccgaggaatgcacttcaggaggattccattagccgcgcgccgatagagggtcccttctaccagcacgtagcgtttggagatgcgatggacgcgttcactcccttcgcggtcctcgggtagagtcttatctgtgaggtatgcttggatctcggcgatccaagcaatcaatctaagggagctgggagcactcccctcgggtcccgaggcctggactccgacgggcctcgggggccggtcaggcgcatccgtctcccctaaggggtcgggtcgcgccgacggctgggcaagcctttcttcaaaggcgcccggtggggtctgggctcgcgaggacgcgagccgtgagagttcgtcggccatcatgttatcccgtctgggcacatgccgaagctcaatcccgtcaaaatggcactccatacgccgtacttggcgcacgtaggcgtccatctgcgggtcagagcaccggtactccttacagacttggttaacgaccagctgggagtcgcctaacaccaggaggcggcggatccccagtccagctgccactctgagtccggcaaggagtccctcgtactctgccatattattggtcgctcgaaagtcgaggcggaccaagtatctgaggacgtctccactcggagaggtcaacgtgacccccgcaccggcgccctgaagagacaaggagccgtcgaactgcattacccagtgggcggtgtgaggcagctgcgaggggtccgtgctggcctcggggatcgagacgggctcgggagccggggtccactctgccacaaaatcggcgagggcctggctcttgatagcgtggcgtggttcaaagtgcaaatcgaactcagaaagttcgattgcccatttcaccacccgtcctgtaccctctcgattatgcaagatttgaccgagggggtaagacgtaaccacagtgacccgatgcgcctggaaataatggcgcagtttcctcgaggccatcagaatagcgtaaagcatcttctgggcctgagggtatcgggttttggcgtcccggagggcctcactaacaaagtagacgggccgctgcacctttcggtggggccgatcctcttcgctaggggccgcatccctggggcactcttcgtccaagcagcctcgcggggcgcacttgtcttctgtgctgatgacttcggggtcggaggataacaggggcggccttcccacagtggcttcggggccgtcctgggggtcgggggctcctggcatcgtcggacaagcgggcaaagggccaactccggtcgtcaggagccttagacctccgttcggctcgggggcctcttctccctgctctttcccgggtcgagtcagcacagggttagcctcggggtcaaagggcgataggtgcggccttcccacagtggcctcagggccttcctgggggtcgggggctcctagcaccgtctgacaagcgggcagagggccaactccggtcgtcgggggccttgggccaccgttcggctcgggggcctctcctccctgctctctcccgggccaagtctgcacaaggtgggggtgcgcggaatgaggtttgtcctcatcgcgctccacgaccaacgccgcactaaccacttgcggggtcgccgctaagtagagtagtaagggttcatttggctccggggcgaccagaaccggggagagctgagatacgccttcaactgagtgagggcacgctcagcttcctccgtccaagtaaacggcccggagcgtttgaggagcttaaataagggtagcgccttctcccccagcctcgatatgaaccgacttagggcggccatgcaaccggcgacgcattgcacatccctaagcttgctgggggggcgcattcgctctatagctcgtatcttctcggggttggcttcgatgcctcgggcagagaccaagaacccgagaagcttgcccgcaggtacaccgaacacgcacttatcggggttcagtcttatgcgggcggagcggaggctttcaaaagtttccgctagatccgagagtaaggtttcttggttgcgcgtctttacaaccaagtcatcgacataagcctcaacattacgtcctatttggctacccaaagaaattcgagtagtacgttgaaaagtaggacctgcattttttaacccgaagggcattgttgtataacaataagttcctatgggggtaatgaacgcagttttttcctcatcctccctagccatgcgaatctgatggtaaccagagtatgcatctagaaaacacaaaaggtcgcaccccgctgtggagtcgacaatctgatctatgcgaggcagggggtaaggatccttaggacatgccttgttaaggtcggtgtagtcgatgcacatccgaagcttgccgttcgccttgggaacgaccaccgggttcgccagccactccggatggatgacctcgcggatgaatccggcctccagaagtcgcgccacctcctcgcagataaaggcttgacgttccggggcctgccgccgcactttctgccggaccggccttgcgcccggccgtacggcgagacggtgctcaatcacctccctggggaccccgggcatatccgccggtctccatgcgaagacgtcagcatttgcccgcgggaaggagacgagcgtgtcttcctatttgccgtccagaagaccaccgatccgtgtggtcttggacgggccgtcgcccagggcaacctccttgaccgggacctcgtcgcatgtgatcatccgctgcctcggggtggcgggggcggaggcgccaagcctctcgtcgccaccctcgggcttggacgcagcggcgaggcggtccgcgcgttgctccagacaagcgagcgtgactttgaggtcgccatggacagagatggggccaccggggcccggcatcttcatctgtaggtaggcgtagtggaccgccgccatgaacttcaccaacgcgggcctccccaggaccgcgttgtagggcagactgaggttcgccacatcgaagttcacccgctccgtgcggaagttggcggatccaccgaaggtgaccggtaggtcgatgtggcctaacggccacgtgtgccccggcgtcacaccgataatcggctgggacggccggagcaccatccccggggccttgctggcgtcaaaggccgcaggggaaaggatgttgagggccgctcccccatcaatgaggacacgccccaactttacgttgcagatggtgggagaaaccaccatcgcaatctgccctccccgggcaacgcacggtgggtggtcggtctggtcgaaggtgagagcaacccccgaccatcgcgcccgacgcgtcgcctcatgagtaggggccgcggccagaagctctcgcttcatggccttgaggctccggcgagaaacgtgagcacacgctcccccatcgacggtggcaatggtggccccaggctcttggaaacctaggtcatcatcgccatcatcgatgtcctcggcgggggccttctgcttggcctcacttcgccgattaccggaaggaaccgccggggacttgccctctcggcgctcctgcctcctctcctcctcccacttcctcgtccgctcagccaaacttttgaccgcacggcagtccatgaggtcgtggagggaggtgttgtggacggtgcaccacttgccggctgggcgctccctgctgggagcgccggcctttttctttttgtcgctcgcaggcctccccttttgggtggctcgcgaagcgccctcgacggcgaggacatgaccctcgtcgtcggaatggactgacctcttcttcctcctcctgtcacgccgccctgtctgagcggcggatccgggggcggccgaagctgccacaccggaaccggaggggttccaagtccaggcctcctccttgcgagccactcggtccgcgagctgaaaaagctccgcggtagtctggggctccttggaggcgatcttttcgagcatgcggttgtgccgcacgccccccctgaacgcgtagattaccgcatgtgcagggatgcatggtatggtgttgcggacttgacagaaccgctgaatgtacgagcgaagtgactcatcatcccttcgctgtactgcgtgtaagtccgcttcttcacctgggcgcggatatgtgccctgaaagttcatggtgaactgttggcacaaatcctcccaggagtggactgacgcgggtggcaagttcattagccaaccccgcgcctgccccttcagggccatgggaaagaaattcgccatgaccctgtcgtcacccctggcggcctcaatcccggtcgtgtagacctggagaaactcggcggggttgacgctgccatcatatttttcggcgatggtgggccggaaccttgggggccaacggacattccgaagactcgccacaaaggctctacagccgacaccaccaaccgggggcacggagggctgattcccgtgtccgtgttgaggtgacactctggacgaggaagcgccctccgttgcgtgggtagcacgtcggtcattacgccgccgctcgatgctggtgcgggcgtccggccccccacgcagatcttcccgggtcgaaggagtcgacgaaggagtggtggccgaatggcgaacagcggctgccgctcgccgcgcccttcgtcttgacgacgcggagccggtggtagcagcaccagaggccttggtggcggaggaccgcccaccagcatctagacactgccgtgcagtcatgaccaatttggccacatcgtccagccaacgttgggctggagactccgggtcatgggcgacgggcgggtgacgtaggagcgcgcccgcagcttggagcgcgccctggggcgtgctgccgtcaccatagacgaggaggcgacgctccccatctcgccgccctttttcacctccagtggatgtcgaagtcgcggatccttcggccctctcgagcgcctccccccgcttaggactttggcgtggagggggcggtggagtacgagctcgacggcgtgggttcggctccccgtcgtcgccactcacactcggagagaggtcgtgcgcctttgcttgctcagccatgaggctgaacaggaaaagcttggcgcacacgaaagagtgcaagagctcagaagatcactcgcagagtcccctacctggcgcgccagatgacggagcgtggggctcctcaccgggagaccgcactggcccccctttgccggttcggccggggaccctgggtgagactctaagctcccaatctgtggaaggttcgcgagacaggaagcacacaagacgtcggcgatgtatacaggttcgggccgctgagaagcgtaataccctactcctgtgttttggtggattcgtgtatgaaggaactacaaagtatgagccagcctctccctcgttctgggttcccaatctggaaaaatccaaaatcccctctctaagtgggcaaggtcctccttttatatcttaaggggataccacatgcaccatctccccctctctttcttccaatttgacttctcttcattaacagacggagatttgcatcgtcgccatccgaatgaccttctgatgggacggcccatacctacctccacttccgccggaggcaggcgcgacgtgggaagatggctgtctgctgatgacttgaccattgtcagactggtcacaaatcggtcattcttgtccaccacgtgtcagtttaacaatctgcatgttcgcccttcttcatacaatatcttgcctgtaatggttaggatgaagcctggcatatatctgaccggaaccaacgtgccatctccaggagctaacacgccggctccagctagggacgagtgcttggaggctctcgtcctgacgggatggggcgaggcgtgcgtcagaccgcctgtcgccacctaacccatgatctgaccggtctgtgactggtcacagaccggataaacgagcgtgctgtactgcgatacatgcggcgtgacgcgctcgtcaaaactgcaataaatgtggttaggtgagccccgccatgctcacctaccccatatacgtggcgcaaaacccacaaggggtcggggcgcttcggccctcggggccgagacgggagcggcccaaccccttggggagacaaagagaagggcggccgtatcaccctcgggcccgaccccccctcccccgagggagttaggccacgtgggtgatcgtgtctgcctcaagtctctaagtcatgatactcccggtaaagaggagggcgaacacatcaccctcgggcccgacgccccctgacggtgccaggccacgtgggcgattgtgtctgcctcaagcctctagtcatgatactcccggtcccatgtcaccgacaactatgatggaggacattaggatccaggtgactagaagaatccaagaaaataggagtaacagtgagaggtggactatgacagtgtgtcctaacattatcaggaaattcaacaagattaggcataggacacagttttgtcatgtcttgtagaatggtgatgctggatttgaagtgagagacaaaaaatggaggttcacagtagacctgacaagcaagacatgctcctgtaggtactggcaagtctctgggattccatgccaacatgcttgtgctgccctattcaaaatggcacaagagcctaacaattgcatacatgagtgcttctcacttgagagatataagaagacataccaacatgtactacagccagtggaacatgagtcggcttggcctgtgtctccgaatcccaaaccattgcctcctagagtaaaaaagatgccaggccgaccaaagaaaaataggagaaaagacccttcagagccagtgaaatctggaaccaagtcatcaaaagttggtactaaaattagatgtcgtcgctgtggaaattatggtcacaactcgaggacatgctgtgtgaaaatggtgtttactgaatttaatttttccccttgctgcactatattcattccttactcattttactaacttggtatgtactgtacagcagcaagaacacgctgagtcatataatcctcccgccaccaatgcaagtcactcaagcccattgcaaattgaacctgcacagtcgaagcaaactaaaggaaaatccatagcgacatcatcaagtaagagtaagatgcctgagggttcatcatttatacaggttagtaataattacgacatgtccatgctatagcctaagtaatttgtatatttgcctaaattggctttgttgtttacagtctggccataagagaagactggtatcttttggaaagagtgctcaagcatctgcgaagtcaagtgctcaagcatcggcgaaggcatctgctggagggagtgcttctgttgtcattgaaaccaatgctgggactgctagctcatttgcaaaggcaacaatcaatgtaaaaggtgggcatgcctttgcaaaaatccattcaacttcacttggtcgtggatcagtatctgcccaaagcagctcatcacagaaaaatgggctgctgaattccaagaacaagatgatgtagcttgccaaatatagtcccaaagcaataatgcttttgtatcagttagtcatgatgtcatgaacgcttgcatttgttatgtcaaaaccatgagcataagacatgttaaatttgtttctggacaagagcataagacatgttaaaattgtttttcaattcattccacattgcctcaaatagtggttacacaatgagccatataccacaagcaattacaatgctaaaacaaattaagattacaatgcactctctttgttctctaatagtacattttagttcatgaatttgttgttttactctctgtcgatcagcatacatatcatcccattgtctagatgaatgttcgtacagctccgacatgctgtgcctcatggaaactaggtcctgaatcacccttttcgctctaccttcaaattgttcatcgatccaatacttgaaatcacagggctgctcaacttgggagcatgccaggaaccttcttccagtgtctggaccagaccaacaacaacacaaaattgggaagaatccatgccgacatgtaagccctgtcctcaccagcatcccctctgaatgttcttcaagcaatgtttcaagctgcaccaaatcgacgaatttttatcaaaaaacaaatcaatctccaattcaaatcaaccctagccccagcgccaacagctctgtactcacctccaccgcgcgcgcagctccatgagcgccagaactcgatgctccgggattcggcgctactcccattcttggcatcgaccttctcactctcccctccctggacccatgctccatggggatacaggcacaacggatgccgcctccacaatggagcgaccagatcggggaggaaacgaggagcgagtagatgggggagatggacgagatggaatggatgaagcagatgaggcaaagagaactggggaccggcggctagtgggtcttcctccccggcggcgacgacgacgaacagaagccgcaccaacacagaagacgaggacgacgccgtcagccatccaacatgtaaagaattgagcgaggggcaggacggacatttcgcatgtctagctagccacgtggcgtgctatcaaggggaacggacgagattgagttcgaaatcaattgttgaaggacgaaattggacaatttgatagttcagggaccaaactgagcctcgggcgatagtttagggacgaaaatggctattttgccgatttgtattgtaggagtaagatatttataaacggataaaaataagtcgtgttatgaaattgcttgggagacgaatttgtgcatatgatctgcgtgctaaggaaagtataaacatgaagtgaacagtttgaaatcggacttctaaaactcaaacaaccgagtagatgtgatcaacttccatgtacccctctcaaaatttaaaactaaataaggcttggcaaccaaatttgaatccaaatatatacacgtcagacatggtcacctaaattcaaaatcgtaacctttctttagaagattcagagtgctgactggtggttgggcttaaagatctgtactccatacccttcaacttatagggaaaatatgtggtggaaaccacaaatagagcaaacctggaaactatagttggagcgaaaaatggacgtccgagattcgtccacgtcatcacgagtataaattttactcacagatttactcatgaatactcatgatgacgtgcacgaatttcggacgtcatttttcaatccaacggtagttaccacgtttccactacatatatggttttcacaacatatttttcccagcttataagccacaattaaaatttaatttcaaagttctttcaatcacagtttatttttgagtatttgtgttttaaatgattaagaatataaatataaaataatatttacaaattattctctccgtcccataaaaaaccaacctaatactggatatatatgatatattctagtacattgtatctgtacatatctctattacgtctagttctagttttaatttttttttggacggaaggagtatgctgtagtggccaataaaccgtacaagcccatccttcttttctttttattttttcttgttcctttcctttcctttttcactgggctgtccctctctgctatagcccagttaatacagtccatcacttatctccttcagcccaactaaccagccacctacccacgctagcttgcatcgaagagagatatacacacaagcaggtaagtaccagggttcaccttttcaattgagtttcagatcgtgacatacgtatccctggtggcacgatggttttcactgaatcttaattaaattttggtcaaattcacaattctatatttgaattctcaaaaacaatttgaagttttactaaaaatctactttcactctatgttgaaacctcgaagttactccctccatacttacaaaggaagtcgtttaggataatgtttaagtcaaaccttgggaatataaatcatgaataactctcaagttgttgagtttgaaaatgtaaaacttatatgaatatatttgtcttgaaaaatactttcataaaagtatacatataccacttttcaataaatatttttatagaaacaagaagttaaagttgtgttttggagaccatatcgctgtcctaaacgacttccttaacaaatatggacggagtacattgctttcagtcagtttacatcgaaaacgtgaacctggtaagtactcctttcgtcttaaaatttgcctcagatcaatatatcaacttcctaactagctctctcatctcaaccaatcacaattgtctctaatctaattctcctctaactacttctacatctcaactaattacaactataatttatcccttatttttttaattcattctactttcaatcacaatacaaaactctaaaatatccttgcaaatttttgggagaaggagatggtagaaacagggtagcaaacaaaatgtcaaaataatatactccatatatcccagaacagaactgaatatgctactctcttcatttcaaaatatatatagcgatatttaattggacggagcctattactatcaatctaaatagagggttgtctaatctaatatttccttcgtcccaaaatataacaacttctagcctttataatttatcccaaaatataacgacttatccaccaacattcttttctcaaccaatcacaacccttcaccattcaattttcccacttaccttcacttctccttcaatcacaacactcccccatttaatcctaccaactttcttaataaccgtatccaaccctaaaaatcactatattctagaatgtaaggagtactagattactatagtttataatattttatgacgatggagcattaacctagatctaactcaaccctactagtacttataaccaatgattgccatgtaaacccttcacatggatcaattaaccctgttcccaggtggatcagacaaaaccaaggctccataccctactaatataatcatttgttcttttttttatttagagcatgtagaataataaaagttaacttttagctatggatcaataaagttcatatcacctgcagctaatttagctacgtttgtacaataattatctgatagtgccaccttagttctaaaaagagtttacttttctatacgaatttgagcagtcatttgtccagactccatagaagaattaagtctttatctattacctatccaaaagccacaaaatattgtagctcatcgtgtgctctataattcggcgacaaatctatattctctctttgttccttcgtcacttcttcaagtattccttcgatatgaatctctctatagagcatgttgttccctcgttgatctgctcttatcatttgggccactaacacaatcttcaatgcttgtgctttatcactgtcttttctaatcatacatttacaaaatctacataaaaaccttttaatgataaatctagtaaatcattctcagcacatcaaatcttaacattttcatatgagtaaattttacaaaactaaatatattttcaacaaactatcgtaaaattacagatttaagatgttgtattataaaattacggatttagaaccaaaattatcgcaaaaccatctatttaagggcaagtatcaccatactatatttaatatcgaagttatcacaaaactaaatatttttacagtttaaatccctagcactacccttatgttggagctataaagattgtaattttgtgattgaattagcgctaaacttatagtttttttgggtgacattgaacctgcagttttctaatacaatactttaaatctagattttttcgatatattttgatactccatccgtcccataatataagggat

SEQ ID NO: 57862 - DNA, 9118 bp, Oryza sativa
tagggcaagaaagcacttcattgtttttcacaacatcttccatgaactcaacacgacctaaaacatctttcaatttcaacttattcaaattacatgttgagcaatccaaaacatcatgaggttgttttaactttttagcagaaatcatgttaaacatcaaactaacatgaaaagcaatttgatatttttgcaacaactttttagttaaaaacaactcatccaaagtgcgtgtgtgcaaagcaaaactgcaagcaagagaagatctatttttcaaatcatgtgcagcattaacatctctaatttttgaaatctcattcattaaaacctcacaatttgagcaataatcatcattaggaataagagattttaatctagcaatttcagatttaagagattcaatgataaattcctgttttctatacatcttctcacacttcttttttttcactcaaaatattaatagcttcttcaaaagcacttacctcattatcttcatactctgtgtcagattcaccacgtgccatgaagcaaacatcggagatgttctttcccttatcatcatctccacttccaccatctacatcacttagtggctcaaaggcggcacaaacttgttgaaaagccttcctaagattctccagcatcctcccttgggatgaacccttcggcttgttgttgttggtcttctcaccatctttgtcttatcttttgcctctcccaagcttaggacaatgcgaacgaagatgatcaattgaaccacattcaaagcaacgatttggaccacctcttttcctgttcctggcattattcatagctcaagcaactctgttagcaaccaaagccaaatcctcctcctcgatctgttcgagttgatcatcggatgtggcattaaaaacagcaagaaaagaaggcttagatgaagaagcatcaatatccaaagaagaagaatacgaagaaatcaaagcacttgacttagaatcaacttatcgagaaagaacattcatctcatgtgttttcaattttgtgtaaagtgaatccaaagtcaaagtagtcatagactcctgaatagacgtaactttcatctcccaaatagacatgtcaagaccattcaaaaagtgacaagaaatctcagattgtggataattagtatcataagaagaatcaatagatctaagatcactcaaaattttattaaacctagagagatatcatccaaagcttctccaggtttcatctcaaatttaatgtactcctttttgaaaatatcacgacgaagttctttaatgttatttgttccttgatgaaagttactcaaagcattccaaattttatgagcagttcgaaagtgcgcaacacgatcataatcagaacgagaaatagcactcaaaagaatgttgcgtgctttgcaattttgttcaaaagcagttttttcagccgcagtattaatagcttcaggaatcacataaggatgagaaacttttctctaaatatcataatcttcagccataatataagattgcatcctactacaccaatgagaaaaatccgttccatcgaaaacatgaggcttagttgaaaacctagcgggagtagccatggcaaaaactctagatcgataaaaatccaaagaagaaaacaaggctctgataccacttgtaggatcgaaaaacaagaactaagccaaccaaagggggggtgaatggttggtatacccaaaaaaccgaaaacttttagcggaaataaaagttaccctcgaaatcgacaaaagtcggtctgaccgagattgatctaacggtttgaccgtgtggatgtcgccggtctgaccggtatagatcacccggtctgaccgccgatgtcacctgccgcgcctatcgcggccgccggtctgaccgcccgtatgcctccggtctgaccgccgcttgctgtcggtctgaccgccggtatatcaccggttggactgccgaaactcggtgaaacacaaatcgaagaactcttaaagtggatgacgactttattgattatctctgtatttacaaagtgcaccaacagcactccttacaaaaatttcgactaaactcgaaaccctaactcaaaactaaactcaattgctctcaaaagcgataccgggaagcctcacgctccccctctatttatacatgaggtaggcagcctacaaccacgaaccaaactcatactaggagtcctaaacaccttagaaaaccctctagtacaagacacaaactttacataaccaatcgtaccaaatttggactccttccaaattcgactccgcatcccatacgcacacaatacctccatcgtatgccatatggaatctccaccaaccacgtgcatcaactctagcctaagtatctcgcatgatctctgaccaccacagacgtcgtcttatccccaagccgactcccggtccatcaccgcaaatactctcccgaggcatcgagtcacctacacatgaaataaacaaagaaaccatattccgagaccaagctatctccaacttgactcattagtagcaaacaacagtattatatatgtatagtatccatctagaagccataatcatgaattaatcacagatatccaaataaacaacccgaaaccgaaaccgacacagcgtcggccggttagatcgcgggctggccggtctgaccgctcgatcaccgccggtctgaccggcatacacagcccggtctgaccggtcacataaaataacgaacctacgattcacctgtaaatccaatcatctccaaaaccacttcataaataaattccaaataacaaaaccaataatctccaatgcccaatttgttatcacagaataataatcaaaaacacctttaattttacagattatacaataaaatgttttgtagaaacatcattgaccaatatagaaatggtgggttcgctcaagaaatagaaattatttgtatattgaacaggattctgtgtgtgtgttatgtatgtatatatatatatatatatatatatatatatatatatatatatatatatatatatactccctccgtttcgaaatgtttgacaccgttgacttttatatatatatatatatatatatatatatatatatatatatactccctccgtttcgaaatgtgtgacaccgttgactttttagcacatatttgaccgttcttcttatttaaaaacttttgtgagatatgtagggcctgttcactgtgctgccattttcaaccttaccaaattttggtaaagttgccaaaaaaaaagtggctatatttagtttgctaccaaattttggtaactatataagaaatcaggtcaaagtgaacaggccctttatatagagctagctagattgtactccctccgtttcgaaatgtttcgacgccgttgacttaaaatcattccgattattttctcgtaagctgcggcatatttttttttataggagtagaatgcatggttggctctaggttataaaggctctaatcgatttgagcaagaattatcagccgtagaaaaaaagaaaaattatttgcgaataaagctttttatattagatgtgttatttacctatttacttatggtttcaacgttaaaaatttaagactgaaaaatacgcgctgaaaaaaaaagcataaaattgactccaaaacactttttaattttaaattttgtccacggcacattcgtaatcgattatgtgatctggtcgacgggacggggatggaccagccgtccgagagctcataagtccatcctcaatcacgggaaatcggtatagtcgtttactctgatttggaaacatcattggtatgaacaaacttttatcacacatacttcatcccattttgacttatggatttttatatccaacgtcttatttgatttttttttataattaatatttttttattataagatgataaaatatgaatagcattttatgcatgactttttttaaaaaaagaaattcataaatctttaaattagacgaacgatcaaattgataaggaaaatgaaacccacagctacactaaaaatagacggtgggagtattatccaggacaacttatggaaaacggtactggtacgaattaatatatgctgttagtagctaggagcacaaattaagctttgattgagtgttactactcctacatcacactgctaattaagtctgacccaaaatgccgccagctgtccgcactccacactggtcatgagcgtctgatcagtgatcagtccgtaccaagttgtactaaaaacaaaaggtgtactgctgctaatcaagccaaaacacggtgcaagctaaatactctactcctatgcgtcatctggttaagctacttcaccaacttgctgctactaacttagagtaattacagaaactaatcattaattaattaagcatgaactccttgcactaatgcatgcagcatgcatgcaatgcatcactttggctgctgcttgccgggcttgagggtggacgacgcgccggcgccggccgcggaggcggcggtgggtggccggtgctgggtcgtcgtcgacgtcgaggaggcggcggcgtggttggtgttgagcttggcgaggagggccttgttctcctggttgagtgcctgcgccttcctccgcagccgctcgttctcctccattatgtacacgttctccaggtacagcttcaggttcaccctctccatgccagtcgatctcgatctcctgcactcaaaaatgcccaatcaattaattcctagtcaactaattactagcatttgctgcatgctaagacatgactcaaacggtagctaactaagccatgcattcttgcatcgtcgtactaacagttacaaatgacgcaggatcatgcaaccaagaaatgtgcaagttgctgatgagaagatgatccatggaaaatggagcagtttcaactcgagacagataagaaacaccaagtagtccctcacctttgatctgaagatgctgctgagctagctagagagaaggaagaaggaagatagtactgggatagcaggtttggcagaggaagaagaggagattgttcttgagctgtgcagagcagtggtgttcgcgtagacggccgtctactgtatttatagccctcgtggagtatagtggctgtatgtactgtgtactgtatatctgctctgctctgcgggtcaatcacggcctgcagttcagagttgagaatgaaatcgcgatgaattgatgacgcacttctgcttcgctcaaagatacgcaatcattcctcttccaagttccaaagttgaaatggtactccagcttcttcttccttcccagtagagtctctctcgtgaatcatgatgtggtttgaactgtaatgacaaatcgttcaaatcaatttgacttcatttgactaaaatcaaatgatggaaatgcagagtactctgtccaaaaaagaagggagcagcagcagccagccagccagcagagaagcagtggcaaggcaactccaggatgtaaattgaggtgatgctagtgtaaaaaatataatataattaaaacaagtaaaggtatatcaactaaactattttccaatgaaaatgaaatgctcatatgatcaaaagaactttttctattttgatttgtggctatattaaaatgttcataagtatctgtgaatatattgttttgtatactcggaataaattatgttttatcaatttgggtagtagaatcagtgaggcagcttgcatccttgctatctaggaaatttcttcactaataacgccgtgtttattccaaagtaattcttcaaacttctaactttttcatcacatcaaaactttcctacacacacaaacttctaactttttcgtcacatcgttctaatttaaccaaacttccaattttggtatgaactaaacacccccaacttccaactttccatcatatcacatcacattcaaaacatccatacacacataaactcctaactttttttccaaactaccaacttttcccaaactttaaattttttttaggaactaaacacatccaactaattagacttgttaatgactataactaggaacagggattacacaccaaccagcctcaacagtggatccgccactgccgagaagtcgagaaggaacatttactcttgcactcgattatggcctactcgtagtagcagtgtggtgaagtcaagtctttgctctcatcatctgatctcgcaacggcagatctcttctcttgctgttccaaggcagcagctaatgatgatcagcattcaacctccacgtcttctcttcttccttccatcacttctgcttccaagcttcaattgctctctcgatgagcattattgcaagagctagcagagcagctatcatggcggcatggcgcatcacttcatacagatcacaccacgattcgatgtgaacaatgcatcatgcatgtcttatgagcacaccgattagtgcgagtacaaatcttgaattgtcggtgtgtagagagattttgggtcccggagaattgaatatgactagtagtagattctacagacattttaacatctgcactgagtgacatttgagaatttagcaattcccataaaacaatatgcatagcatacagaaatttgttcaaactactcaagatatggttccaatgaccgagcttttttgttggtttacatgaatcttgtagacttgtactccgtactgtactatactacttcatctgaatttctgatctgatggatgggcaagggatggatgcagcaggtcctactaccggcagaataatcttggattcgagatttggattcttggtctgatctgacatgttgaccttgtagcagcattgaactccatctgtatgactggatgtgtgtgtccgtcttgcattgcaatgtgcagcacagagatcatcatcatgacagagccaactgaagctggcgtcaggagttgcattttcgtaaagggagatctcatggcgcctatagatacgagcaccccatttctgtgagttgtgatcaagacttcctgctggtagttgatgattctgcatctcctctgacaacaacacaaatgcatcctttgcatgcattacttgagagtagttaagggtgtgtttagttcacgctaaaattagaagtttgattgaaattgaaatgatgtggcggaaaagttggaagtttgtgtatgtagaaaagttttgatgtggtggaaaagttggaagtttgaagaaaaagtttggaactaaaatcggcataaatagggcaattgaaatggatggattgattgatggtagcactcctattgagttttaattattaccaacttaaaaaatacatttgtaattattaccattagcaatttaaaaatcatgttaatgaaaaccgagataaaatctgtatcttaatcagaaaagagcatgatctaactaaatacaagaaggtaataccaaggataggtgcaattcccagtgaacaaaaacacattagctagtgatatacttttacgagcacgagcaagatcaacttgggataatggcaccgcatgtgtaaacttgtcagtactgaagaagaaacattgtgttacttaaacaatcttcagcagttagcagtctgatgattataaatcaagttgcagcagcagcagcagcagcagcttgtaaaggactggcaattttatctgaaagaaaaagggagaaaaggaatgggcaattggcaattggactagctgtttcttcctggattattgaccattttattagctttcggtcatctactagtactatactacaaccagaatattcccctagaagagattagcaaatcgacaacagaagcagataggagaccgcccaccaacccgaatatttactctcctttacttaaggaagaattaaacaaagacgtaatagttattagtagcatcagctactgatcattttcatacctaagcaagatctatcaccaccaaaaaaaaaatcattaacaagttcacaatcaataagcgcttccatgatcaacaagttcactgcaatggttcgaataaattcacaacaaaattgagctacatttctccttacaaagctcccaaatctgacacacatcttgtgtccgtatctcctcccattccccctgatttacaaattacaatgggattctacgtatcgaatatgaaatcagtttcaattttacaacaaaattcagcagcagctacacatacacccacgtcggggtcaccgtcaccagtgcaacctcaccggcggcacggtgaagccgtgggcgtcgtcgaggaagggcaccgccgccggccgcgcctggaggtcgccgtagaagtcgtactccgcctcgtagtcgtgcaggtccagctccttcttctggttggtgtggtaatggtgcttggcgccgggcgacttgccgaagccgaagaggctcacctcgtcgcagacgccgagcgccatcaccaccgcctgcatccccgacgagtagtggaagtacctctcgtcgtgcctccgcgtccagttcgccgccggctcgccggtggcggagacgaaccgcctcagcgagtagtacttggcgatgcgcgcgcacagcgcgtcgaggcgcgcgtcggtgacgaggagcgggaacggggaggacggcgtggcggtggcgttgcagatgagcgcgtcgaggaggtgggcgggctggcagacgtacatcgccatgggcacctcgccgccgtacgggtggcagccgcaggcggcgcgggtgatggcgttgcgggcggcgcagatgtggaggatgttggagttgacgaaggagagggaggtcttgacgccgacgtccgcggcgaacccggcgacgcgcgcgttgttgaggcggatgacgaggtcgtgcgcgtcgatctgcgggccacggccggagccgaggagcacgccgctgttcccgaccacggcgcaggtccggtaccggcggccgaggacccccgcgaggtcgcgcatcacgccggccacattccccccgcggccgcggcggcggcggccggccaagaacgaaccgagcgatgccctgaacgaggcgaggagcttcccgtcgggggggagcgcgtcgaccgggacgcggaggcgg

SEQ ID NO: 57863 - DNA, 3412 bp, Oryza sativa
cggcgtcatctattaaaaaacggaggtagtatttattaggatgatccaaactacaatatgataataattatttcttagtctttgggttaagggtggttgtgccttatattttggaatggagggagtaccttatttcgttagatggtattataaagagggaaatgcaaagtagagaccatgctagttattcagaaaagggaaatttaatttaatgagggaaatgtgtgttccatggatcccaataaaaagatcagtggatgataatagatgacagacacatcatgtttatcagtacatcagcaaaggagtgtcatttatattttttccacgaatatctacatgtatgttcacataagaagacaatctacaagaaagaaataacagatacggtgtactggcttaaatagattttctacctggtcatataaatactgtatctgctgagcttgttgtagaacatgtgttgacatgagatgattaagtgctgacatctctatcatctttgtctctgtttcttggacagcatcaagaagatttgtcaactccacctaagatacgagtaaaaggatgcaaataattaatcatgcatgacaattcactagaatttcatcagcataatacatatacaccaaaatattacctgaagagctcttgtttcatcatccaagagttgttcttgaactcttagtggtgcagtagagacctcctgatcttcaacctttgaaacatcagattttaatacaaggtttggcttagatggttcagcagctttggtttctcgtttcttctgaatccgttttcttggcatcgctctgttaatagcatcttgaaaacgcatggtccgaagacgatcaaattgtgcagttactgagtgaagacgctcactcaaaatcaaaacctggtgaaattatatggaaaacacacagcttagcaaacatgaccatgtaatttgcataaattcgtactaagaaagcaacatggccatgtggttgcctatactagcagcactgaatcagaaaacaaaatttcacattgttcaaattcacctatttttacaggatggttgcagcatggctgttttgtcgtatctaatgtccaataatagcaataaactaaggtatggatatcctgctaccagctacccacatcatccaacttcatcaggacaataaatgctggacctgtcaattcttctatttaaaggataatactcagatttatctgtgtgttaaacaacttgtctcagtaaaagataattttgtgcaaggggagaagataaattatccacaaggagttgattagtttaaaatatatatatacaaattacaaactgtattaacaaataataatgcccggaatatctgtaaaatggaaaatgaagtagcaaacatatatcagaacaaatgagattttactggtacaatcctccatgtgcagatattgaaaacacaagagtgctactgcattttgtattggaaattagcaaaatagttgatccatggcaagaataagaaggcataccacaccatgctggtgagctatcaaatccaaccgggagctctcatcgcttgtaccaagccatgtctttgtacttccacctttttcttcatggatcctgttctttaggatatctatttgttccttgcatgcttttacaaaaacactgacctagacagataaaaagttgagaagacatgcctaatccatagccgaaaattgccaaaaaaaaatgcacacattttaccagtatgaatatatcaggatgcgataatagtattagtaccaaagaaagatactccaatgcaatgtcaaacaaaccttagtattagattttcaataaactcatccaccatgttgcaaagtatatgttttaacatgattgcagtgtagtgttgatgtcctaatgtaaccccgtcggaaaagaaagagtagttcaacaaaattttcaatgaactcatccaccaggttgcagagtacgttttaacatgatagcaggttacggtagatgtccataatgctcgtaggaaaagaaagaataaaatcaacaagtaaccactattcacctcatgctcaatgttgtcccttcttgctccgtggtgcgatgcatgtcaacatagtccttcctatgcttcacaataaacttctccagttccctgatactctcaagctacacgaaaacaaaccataaatatagtagcaagctaccataccaaatcatcaccacagcattgcagcaaagacagaattcgtaccgtcttgattgcagcctttgtaaagggtaatttggggggcggcttccggatgatgaaagaagacatgagcgcggctaactgagactgtcagaaggaaatcaacacaagggtggatcaacaatattctttcaggcgatatctgtgatagcttccattccagcgaagatgggggagaatgccgcgcaatcgcgccgccgttgagctcacctccgtgtacccatggccgagcgcggcgacgcggacggactccttgaagtcctcggccctgtcgcgaaccctcgacatcgccaacgcagagtagcagctaacgcctacggcttcctcctgtcagatctcatctctccgcgcagcactgattcgcgagccggcgagaggggaagagaggagagctcgcctcctcgctttctccgcgtccaccttgaagcccaccctcggcgacggcgacggcgacggcgcaagggggaggcggcggcggcggtgcgagggggagacgagagggcggcggaagaaaatttcataggactgcggtcctttgctcctaggaaagactttgtctcctatgcgacacgtgtccaattggaatttcaaagcaaggcttccactacactattcacccaaatactattaactgacgccgccgttatagcatgtgtagtgcgtacctctaacttgtcaccccagagcacgccgtccatcgccatgagtttttccgcccgcgtcgtcccctcacgagtcgtcgcgcgccctggttgggggacgcggctctatctccttttcggccaggggacatgcgcgagggacacaatgcggggacgggcgccacaggcgacgatctctccagctaccatattccccttccacccctctcccctctctctctcgcgtgcccgttcccctcgagaatgtgggggtattttggaaacttttcacatgaggcttctttgggctaggatacgcactgtggattagagtacctttagccagtttcttcaaattttgaagagtccatctaagtgtggctttggtcacaagatgagtgcccttgagagtgccctcagttagtgaggacactctaggggtggctttggttgtacatgcccttatgtcctcctcttcttggcttggtcttcgtgggcagtgataggcatgaagcaccacgg

SEQ ID NO: 57864 - DNA, 686 bp, Oryza sativa
tttctgacaccctttcttttaagtggtaataacattgctgaagagacccaggtacatctgcttaagttgggttcattgatctgggtacatctgcctaagttggactgagcagtgccttataaaaggaaacttaccattgccatcattatggtgaatgtcatctgatgcatagtatgctatgccatctattccatttcccgtagtttacacacaccattggcatggggatctaactctccatatgtgccaagacaaggtactgtactgctcctactatatctttgatacatattgactcttttctcaggctttcttgatctgttgattgctaattgaagctttattatggtgatgtggtgttgcctgtcaacactatagtaaatttgtggtttggatctacattttagtgatttcaacatgcatattaacttataaaaaagattgggtgtttaacataaggaatttaataattggtgaaatcactggtaattttgtgtcctctgtattttgtttacatgtcaggattttgccaattccgaaccctttgctaggttcttagatgaggattaaaccatgtttttagaaacactcaacattgttctaactgcatataatgctacacttttcgtgcagtttataaacaacagagcaatcattattcatgcatttctgaaacaacatggcag

SEQ ID NO: 57865 - DNA, 933 bp, Oryza sativa
aaatggttacgaactatgtaagagcattgtaggaaagagtggttaaaatttacaagggctcgtaagccgtcgagacactgcgcaactcggaaaaaggaaaaatgagaaaacattccaggcacgcatgctgttggtgcgatcgcaggctaggaccaaggaggcgagaacacacagggaatgaacatctacgactcaaacaaagctgttctgtagattctgtaaagagaggatatggttctacagattttaccatcaccaaagtgaagagagtccacagaagaatcgagttacgcaaaccttgggaaaactatacaaaaattaccccccggtatcacacttttatagcctctttttattttatttgtcagagttgcatcaggggcaaggccatcaccgcaccaaaaacagaaaacataaccagcatcatccagaagggcactcgcttcttctgcttctgctcgcctgcggcctccgccgcaggtttcgccttattggctactactgcagcctgttgttggaccgcaggagatggagctggggcagggttctcttgagtttctggttccgctacggtttgctccatctgtttctgttggttgtatttctcgacgtactctggaaacattttcctgaagtgagggcaatttttgctgtggaaacaagagcaaagtttgttagtgtcccatggcttcaaacaaggatgggttgatggcagcatgtgaataaaaaaacttagataagtatcatcagcacaagtaataaatgtcacctatctaacataattcatttcgcttgggaagagcattcccactaaattgagctgtttcttttatggcaagtatgttactccctaacaatatatgcttgctgcttttatcattttctacaaacctacatagatgtatgatgaaattaatattatcttactgagca

SEQ ID NO: 57866 - DNA, 617 bp, Oryza sativa
ttgttgcttatataatagtctagatactcgaagcgtctgtgttctttttctagatactcgaactggttgatctatgaaactgcttcaagttagtggcaaaaataagttcgatctttccgctattctgagagcatctttttatcttttcagaaatcagaatggcattataacttttaagaattcctgcttgtttataagatccgaggctatatatccatcaaatcttcagaattaacatctagaaattccagatcttcttcaagtaagctccatatctacgtacaactgatcctcgaactaattaacacttctgcatcgccatacgttcagaattagtaggaattaagaaccgccggcagcggcagagcattgcaagtttgcaacttgcaagcgaagcgacagagggaacccattcgattcggaggcagcgacgaggaggaaacatgcatatgagcgctgaactagcttgaatttgcaatctttgtccattcttttgatcgaactaaatgttaaatatgtgatccgagtttttgtgcatatattttcataacgctaaattacagcaccttgccaatttgggatacacgtttatcttcttgcagtttcagtattcttca

SEQ ID NO: 57867 - DNA, 1838 bp, Oryza sativa
  unsure (1)..(1838): unsure at all n locations
accattagacatagacatcaactaagcaggacaatgatagcaagaaaaagaagttatagaaaaatcanatttgatcagcttggatttttnttcgttttttccattctacctagataatgcaggtgtagggctggaaaacatggtttttcaacagtgaaatcatgatctgggcaatggggaaagcaagccttacaaatcctaaaaagcagagtagcagagggttacgtaacctgtatgtatattcaaaggttaaaaaatattcagaaatataattgttgttgacaaacacaggttagcattaacggtacctattcttgattaaattctcaaagttacccaaagttgttgtattcatgaaattgggatttgtagtatgtaatgtatgagtttcttcattgctactttggggttaccggcatgcaacatactattatgccctgaaaatttcaggttttcagttagccctatagttgtcatgctcaacatagttttatccagttaagactgagttattaccattggctgaattcgtcaagaaatatatggatagctatacttatcgggctttctcatagcatgtgcagtaaaccagaatatgaaaaacctccttcaaagacaaaatccctgtggtgctgaactatttataacagcaacattatgagaaaaaaacagtgatcgacaaatcgacacatacatttcttaagggttgaacacaaatgaggtgttacatttcctaattgctgacatatatacttgatcctaacatgtttgacaattcttaagggttgaacacaaattcagttactacaacagaaattcagaactcatgtgaatcctcctgaacttggatgcattttgatttttgaaatgtattatcaaatttcataatagcattagcatggggagagaactcatgtgagtactcctgaacttgaggtaaaaggaaatgcaggagtcatatattacaaattaatgtcctctcttgaggtgctaaactgtcagatatttttccagaacacagcaatatataaatttgaattcctcagattacctcatagcagcctagcatgtagccttagatttaataaatctccaattgcttcagctggaaccacaagttgaaactacaatgcagaaaacaaacaagtcataatagttgcttgaagtgcttgaagatcatactatttattcacaaggaacatgatgttctgaaattaatgtgaatatcaactttcctaagctgttctcagagttaatctcagaatcttatttttaactctcattagtgaagtgattaacaggaatgtgaagtgattaacatgaagaaaatttgattcagaaataaatcaagaaacggttgctgattgaaaaacataagaggaaatttgattcagaaataaatcaaatggttgttgattgaaaaacaaaagaggaagatggtagcagaagcaatgccgcctacctgtggtgaggtagggattagacacggagtcggcgtgggaagaaggtggcgtagacctgctgcggcgaccgttcagcggggaaatccctctgcagtgcaacgccgacctgcggggcgacggcgattgacggcgacctgccgggacggcggttagctcgccggtgggttccgctgcggggttgctgcgtgaggcgcgcagcgggggcggcggatggggaagcgacgtggcgaggaagggatggggacgccggggaggcaagcaggcggggcggcagatggggaagtggcgcggcgaggaggggatggggacgtgggggagggaggcagcacagccaagacaggggcgtgacggcggcgtcgtagatgagagcgagca

SEQ ID NO: 57868 - DNA, 5290 bp, Oryza sativa
tgtttaaagtactgtagataataaagtaagtcacaaataaaataaataataatttcaaaattttttgaataagacaagtggtcaaacgttgcaagtaaaaacttaaaatcgcttgtattgtgaaagggagggagtaataatttgaaggggatttggttcctgtgcagtacctgaactgggttgagaggtgacaaagacttaggctgcgttcttcggttctaagttcccagtctcactttctctcactttctcgtttaccgtgcgcgtggtttgcaaaaattttctatagaaacttccccaaatatgaccataagctagcagcaacataccagattttactttatatgcacattagataaaaccgcatagataatactcatgtacatcaaaggaaacactactacctaattagcatccggatgcaatacaaaaaaaacaaaagaatacacatcaactgatgtgcaacaggcacacaatagctatagactatagagtagattgtgtcataagcctgaattagtcagataacttcctatgttttatgaccccctggattggatttcacttcattcacaaaacctgcagtgtccagcacatttctgcagccgttgagttattatgtcttctgcagttgttccccccatatttttccgatttcattttttttttcatttttcaggagggattgcagcagcagcagccatgcctttctggttggatatggccgaagcgagagcaatgggcatcaggcagagacccttgttctgaagatactgcatcgcgctgatgatgctcgtttccatcagcttcactacctcttgctcaaaggcagagctgtcttctgagtctggcatgtctggtggcccttgtgaaatggttgaagctgatagagatggattactatggcactgcagaagttcaatgagtagatggttatttcagacatagtgagatccaggtgaattgtggccccatcagttattacatatttaagtaaactcaatgaaaaccagaggagcaaatctcggatataaattgggactacaatgcacagaaagattcttccagtaggctacaatattatggtagaactgatctaggatgtcgaaaacttgaaactggatatgcatatgttgcactacatataaataatatattatttataatgtagccaattaagatgccaacccaagaaagcacaagttttggttagttatcttattaatttaatcagaacacacaaaaaaaagttaagcagtattgattattgaagcataatggcacaatgcataagcagttttgatcacagaaggttttgttcccctcgtacacaagtgcaaaggtatatcttcgtttgtcctatcttgatgccaatggtcgcaataatgggcaattcaaaactaatctcacagagcaaataaattaataaaggcaagccaatgttcatatgaaatcatggaatggtcatgaatatttggactgatgttatttgttatgtatctaaatgtaatttaaggggaaaaaactgaggttaaaataaattgacttgtttccatagctctacaatcttttaacatagcacagcctacattcaactagtctttctaacaaggattctgtttggaaacataaagaaataggaaagctgcacacctcggtttgagattccctaagaaggggaagaactgctccaggagctcctagcctgctcatgctcaatacctacagaattcaagaagactgtcagccatcagaaaaggagctaacgcccccacctcatcccacacaccaaataaacctgactgcagatgtaccttgacctgaagctgaagaaatttcacataatcaattatttcatcaagcattgatgccttatctgcctgctcatacaaagaagggttaattgtcaggagttctaaaccaaaatttgtatacattttattctatactagctaaatacacttgctttgctacggattaaaataaattatacatgtgctaatattgcttggaaaaattattgtgatgtttttgggacaatttattccctgtagatgtctttgcataataaatttgtattttagagatgaaataaaatagaatcatatgtagaaaactattttgtaaaacacatgaaggggtatttagtaaaagcataaacaatactctatataatagaggtggggtggcagattcactgccaccaccattgttttctttgaaaaggagtatagatagatgccaataaaaaaataattgcattgaaggcagaatatatgtatcagcaacattataaatcccatccacctgaaacaaagacaacggtacatctaacgcccatgtgttggctgcaccaaaagatcaatacttggatctgatctatttgataatccaaaaaaatgcttgcttctgtttgtcccatttggtcaatttcccaacatacttaagtatgtatcctcccctagtatactcttagttgttatcaatcaacagttatgaatatgacagcaataacaacagggggagaagcggattgcatttttgtggtgactcagaacaaaaaaagcaccttattggagtttgggacaaggacttggagatttttcatcctttctgaaattttctctcggcgaagctgcagcacaatgagaaattatatttaagaccatgggtgcacacaaattaaaaaaaataatcgattattatgcaacagtttgatttgtttcaaagtgaactgatcttataaaagaactcacccgttcagcaatactgtgaggatcagttgcctgtccacggcgagcccttgtacgtggcttcgcattggcactatttccaggagctgaatttgcttggggttccacatcagaagaatggttaatagggtactcactattatggtcatggatcaatggtggtatctgaacattttcatacacaaaattcaactgttgaggtataaaattgaagagaaagaaagtgaaacactgtcaatgagaaatgcaaatagaacctttgaaggaagtggtggcccttgtgcatcagtacctgccaaatgactaccagatgtgaatgtagggagaggtatattccggatattttgctcctgcaatatgaaaattgattcatcagtacagttagaattgagtggatagtgagctgcggatgtgggaattgctgtttagtggtaaagcttgaaattgaaacctgttgagcagccttcaaaccacccgctcctagtgcctgcaggacagtaccaaacgaagggatggaaccaccattgagaaactctttgctatcctggattgccaaaagagcaaaaaataattcaatgaagcagataatatggcaattatgtatatgtggtgaattggtgatcattacatgtagtgatgctatggcagcattatcaaacagcgagggattcccatttggaagacttgttttgttcaacatagcaacattttgtgccccttggaaaccgaaagcatctagatttactggttccatgaaggaggaaacgttttggaatgctgaacacaacgtcggggctgaagaaacggcatgcacatcagcaagaaaagcagaaatgtcactaccattgctatcaattgaactggacaaagcatgaggcagttctgcaagaccaggtgtatccaatttcgcatcaaatgttccagatgttgaattgcactgaagaacccctgggggaattgaattgcttcgcagattgctgctgttctgtagctgttgaagatccagaagattgttagggagctcacccttaggtagaatctggccagataatggatgagcctgggtgttgtatggcaagcatccatttgcaagcatagtggggttcctttcattctccgtgatctttaaactgcgatctgatccagctcccatgaaatagcctgaaggtggtaggcttccttcttctgcatatgattccgacgaaccgtcaacaaaattatagttctcagaacctgaattgccaggccacatgtaggaaccagcagagtagtccatgatagcacgctacaaaattgatgctccaaagtgttacagagaatggcctctagaaacagaaagtgttcacagctgataatcctgtaccaacagcagttcctttttgtacgaaataccctctgacgctgaaagtaactttgttaaccctgtgcacaatatttaaaagatattgtcaaatgagaagatggtatatatacaatactataatagctactacttataaagttggttatcttatagcacgcgttaaccacatcaataaacaagtattaaaatattagtaggacaattcttgcttgatgcatacagttgacaaaagatcctcagctaaaacacactcgtgtcatattcatgtcagtttaatacacaaattatttaaataagggattttgaatttttccatggtccgcatttattttccttaacaaactgcagagatgtcacaaacagctaaaccaagcatagttgaaattatatctaatatttgtgatgaactaactaaaagaacataaggacagcaaatatagcatggatggtagtgcattatgaaaacttagatacaagacaagggtcgactctgcaggatccccttatacacaaaacagaacgtacatgaacattgaaaccacagctgctgtcctaagccaccatttgtacaaatggaatgattctaattcgattgattgcagatcattaggacttattttctgttttgttctacagcggcaactcattttctttgggaaatggaagcaaccaattcatagttccatacaatcaatttgtaacaagcaaatattcttccacctttcagtagaagaaacctgacctcttaactttatcatgtaactattgtcgattataattacacacattcaatattcaataccatcctctctttaaagctaggctatgaatgtaataaaaccgacatgcatcctccaactgttcaaatgctagttcacattctgctgcataccatgcttgtagtcagtttggactgttcttgtctaggcagtaacaagaaaatgtatacttatctaaaaaaaagaaaatgtatagtactatgtatctatcagcactgcaaagatttgtcaaaattcctaaatctattatcgtaaaaaaaagaagtaacaggctatcaatgagcaataaaaccaaagggaaaggctgaaagcacacaattttcacagtttgagactgctgattgcaaaaactaaaaatggtgccagtggataaatcattacatgcaaaaaaaaaa

SEQ ID NO: 57869 - DNA, 1125 bp, Oryza sativa
ttacaatagaataacagtaagaactcacgtaaaacaaccatctaggtaaattccagttgcaacagtctaacaaagatattaggacaataagctttttagatgattcaatggtttgtagaaagcaaaccttgtccatcttgagccatatcaactagcacaacatgtagtttattttgagaacatcgcagcaaggctacctctctacacaaagagataaaacagtacacttaaaaaaaggagataaaacagttgtctggtgtacgacataaaatgacatggaacatgcagacagattttaaatagctaaagcttgatctgtatataacctcacatctatgcaaatttcggtttcagatcaagagaacctaaaagtgatagttactgaatatcgtatagaattaaatgctcaaggaaacaagtggaattgtaaaacggagccatttaacacatttaaggatatattattgataactgcacataacacattgaagacatggaagtaacttgaatcatggaaaatgttactggaaacagatgcatgtgaatttctaggtaaatatgcaagacgatgagccaaaagatttttttgttcatgaataatgcctgatttttctgttcacttttttttaagaagaaatactttggtcaccagacatcccctgctgttcatttttcagagtacagacaatttctttatgtagaaacttcgctgcgttaaattcatgatctcctaaagttcctcccacgactgtctgaaatgccattttgctgcttgactaaagaaatgaatattatgacgatcaaagacatggcctacaacccctggcatgtgttatgtcacagattgtttagatactttgcctaaatcctgccattattcacctggacagtacaactaagttcttcaattctcatttgcaagaatgtgaacatacaaaaacatattatacagagttatgagtttgaaacttttgaatatgacaacatgcactaatgcaaagatgaagaccagttttcactctaaacaacagttggaatcatattgattctggcaatttacaggacgcaataaatttttttgaagtggtgcgcagatgaagccccccatccccacccctcaaaaaa

SEQ ID NO: 57870 - DNA, 566 bp, Oryza sativa
cgccttggttaaatgggaggcaatgtcggtttgggaaccgacctaggcggtcaagggagagggctagcgctcggcggtcacggccaaaacggcgataaggggggggggatgacgccggcgggagagaaaagggaaaaaggagaagggaaagggggcttgccccttgccactttggggaaaaggaggagggagagagggcgacgcggcagagggaggaggagctctgcctccgtcccttggaggctagcacgcggagtggcggggtcgggttgtgacgacggcgatgaccacgggggcggtgtggagcggaacggcgacacgggctacaggcgcatacaagcgcggcagaggctgacggcggcggcgactggccggtcggccaccatggcgcgcgcgcgcgggaaggaacggcgtgcggcgacgatttggcggcgttggcgggaagcggcagcgagggcggagggcgctcggttcggcgcggcccacacgcacgcgcgcgcggcacacgggcagagcgggggagagagagagagatggggagggagggagagatggggagggaggga

SEQ ID NO: 57871 - DNA, 2330 bp, Oryza sativa
gactaaatattgtgtgaattgaagcatgagtttttgagtaggtcaactaatcttccggggggtccggagccggttacagtactaacttacaagcaaagtctacgcaactttcccatgaaaaaaacgtttatcagtaaagtatgcttgtctcatcctcatcaatcatcattcaaacctttgataaaagtcaaacatctttaatttaattaagtttgtagaaaaaaataatagcattttcaaccaaagacaaatatattataaaaatatatacaattaaagttttattaaaataatttgatattataaatattatactatatttatctataaactcagtcaaatttgaaaagtcaaaatatcttataatctaaaacggagggagtaaagtatttaaatgatcatattcatgcatgtcctagccctctgcctaaccactgaacccttggtttcaaaaagactttatttctatctcttaaaaattgtcaaaaagagtttgtttatccttttttccctactctcaagtctcaatccacaaatcaaagaaattttatttctcaaatattccattcctagcatttttcaatactactttatcattaataagataagtagtggataactttgtgagacggcgagtagtaataacttttatagtactttatcatctaatagttacaaataaaatctttgtgagacggcgagtagtaataactttgttagttccgtatacctaagggatgaaaacaacgatggaaattcttgatcggccaagtatcatttccataggagtgataatattttttttgaccattttcgattctagctagtatacataggatttcacttctaatttctattattagggttgtcattagatagtatgataaatatgtaaagaaaaatcccgagcaaaccgagaaccgtttcgttagaagtgatataatttccgactaaatctaatctgcctctggcatgtgggcatcgattgctcatcacttcatcagtgtgctgctatctgcttagatgaaagctttgcttgggcttcgttttgattgtttgacatgccattttgaatgggcctttttgggcctccagtatgcacagttaaaaattgggtaatttcctttcatatgggccagccctgccatgcagcttatcacctaggaataagttcacgggaggtccctcaaattaacagcggtggcggcgtccggtcctgcggggcccagccgcctttctcccgacgggacggcgctgtccgtcgtcgtgcacgacgccgtggccgcctcgaggctccgcggcggtggcagggcgatccaagttgtcatctggactttcggaggcaccttcgaaacgtgaacacggcagcttagtcgcggatgacggtggcgtcgttggcacgagagcggcacggtccacggcgaggatctcctcctccgccatgctgcaaggcacctggctgacgaacagccgcaacctctcgccgtcgccatcctccgcttcttcggccatcaccgcgatctctctctcttccccgtcttttttcctttttatcctctcctcgttcttgcctacgccttttgcctttctatatcagacgagcagtaaccactgattgattgatcagtatcagtgtcttgagtacaaattaattaatcgatgtgtagtatcaagtcttgatctcgagtagcagtgagccagtgaatgtaatcgaatcatctgattgcgcgaaaagcagcagcagcattgatgcctccgcctcaccgtccagcgcgacgacaatgtcgtgctcggcgtcggactccaggaaccgcgctctcgtggaccagcacccacacccgacgaggagacactagtcttccgcgtccgtccctgactcctctgtcggcagcgcgggacgaggcggttccgcgccgccggcgaccatcgcgtcgacctggtgtgggacctcacccgcgcgcgcttccctggctcgggttcgcccgagctttcttttgggtgcagccgacgagccgccatcgcgccgtggtgctgccccgcagccgcaacagctgtgtggatggaacggcggcgctggcctcttctcctcctcttcctcctccggtgcgtatagatggacggactacgtcgacgtcgtgcgtgcatgcatgctgcaatcttggcgtctcagtttcgtgcatggatcttacgaaggtcggggaaggacggtgatgatggcgtgccacgacgtcgagatgccgttcctgcgggggattgacatgaaccggccagcgctagtggcggagacgacgacggcgagggggggggggcgcagctgcagcgaggaggac

SEQ ID NO: 57872 - DNA, 607 bp, Oryza sativa
gctggatcagttcgagaggcagaagcaacaagtcagatgtatgtgctacagtactagtgtcttcagttcccccgaaacaacatgaaaagcacatcgccctctaataacagcctgtcgccatttagcattctgctatgtccaaattcatccagaacagagttcttgaatgtattccaacttgatgctaacttcgcgccacaaatcttgcccgacatggcacagtggtgatcatagatcatctgtctactcacacgcataatccatgagcaagagatccgatcccttggcaggggagtcttcggatcagtagcacgaagcatacgtatacaccaatctaattccatggtgatatctctatttatgattaaatatgcaacaataaataaatgacttcatttttatctagcttactccttccgtcccaaatttattatactaggggcctgttcactttgatgccattttcaatcttaccaaattttggtaaagttgccaaaaaagtgactatatttagtttgctgccaaattttgataactatatatgccaaaattttggcaacttttgggcatcaaagtgaacaggccctaggatgtgtcgcattcagtc

SEQ ID NO: 57873 - DNA, 8879 bp, Oryza sativa
cgaaagttggatgcacattatgaaagattagcatatttctctgcttccaaatatgccagcaagaatggactcatagttttcatccactaggataaaaggtatcctattcgcgtatataagattttaataggattttagtaaggctaggattataactttacttcattgtcatgtcaaaaaaagttacaagaacatcatgaaagcatttttaataacaagatcactagcttctatctcttgggaaatttgacctctccgtatgcaaaccgggaggagatcatgcacggtcatttccgcccgttgcttgcacgatcaacgcgatcaattaaggttacttattagcacatgattaattaagtattagctaaacatttgaaatatatattaatatgatttttttacaataactttcctataattttttattacaaaaatcacattgtttagtaattcgggaggtgtacatgtggtaaacgaggaagtgaaggttgggaatcttcacttaagaacacgacctaacacattgatcggtaatgccaaaacttgccctcctccctcagcaacatattaataggggagatcaatgctgtgtcgtggtgatagtcacttcacgataatcttctgcccgaaaccataaaacctcttacgaccccaattacttgtgttggagggagaacttgcgattgtcctagggcattgtagatggccctcggaaggcctctatggaatcaaaccgcgatcactttgtctgcgctactgctataacacaaatattgcactaatggcttacctatcagttttttacttttaaattccgcatatattaggatgataatgtttaggctaaacaattagattagtatattagataatttacaatatcatttttatgtaccaaaactatagtatttcatctcttttaaatagtagttgtcgttttaattagcttttgttttaagtcgatcattaaattataaagatatatatagttttacattacaagattaatttatattttggatatactatgcgaaatactttcttcatatataccacataattttattttattaaactaatgaattaacatgaattgatagtcaaaattaaagatgtctatcttagaacgaagctaagacgataattaattaatttgagtacgtgtctatgtgaccggccggtaattaaggcgcaagagtaaattgatgcagtaggtaatcgctcaagcatacatatcttctgtgctgcatttcacgcacaaaatccgatcgagcgagtctgatgccaacatctactaattcagattcttgctagctaggtatagctcgggcccaacgcttggtgccattatctgaaaatgaaagaaagcatggccacacgcactaaaaattcatccaggaatttttgggcgtcaaaatacatttcatttgcgttgaatggttttactactcgactggtcatatttatctgacgtcaggagtacatgaaattgataagttttttttatgagtacaagttagaacgcgtgcgtgcatacataccatacccatgcctatgtacacctttgtggtgcatatactagcacatgccaaataaaaaaaagatccgatatcacatagcatgggtatgcacgcccgtgtgcatgtactccctctgtcctaaaatataataatttagaacccggatgggatattttctaatactacgaatttagacagacatattaagagaactattttgggacgaagggatattgctgtacatgagattaaattttagtaaaatatgagcacatgtgaaaaatagaaaataacgaatcaaactaaaagtcgcaagttaaattaagagaactattgtacataaagaaaaccttacggagttaaaacaattacgttaagataatacaattagactgctcctagcctcttcacaattaggatgaacacaatctatgccttttttttttaaaaaaaagagaaggacgatatgatcacaaatgtgatggcactagtacagaaatcgttttttccaggcagcccaaaaggcattttcgcgtgtggaaggctgacctgtctgcccaggatggtctgtgaagatcatcatctttgcgtgtgggctgctcaactacacacgaatatatatattcgcaggcaggccgcttaacgcgaccgcacacgaagatcgagtatctttattttacaaccaaaaaggtttctttattttacaactaatatgtacatcattataattaagatagtatatattgtactcattgtacacaatcttatagctcatccgttatataaattaatctaataactgacaaatataaaattttaggtcgaccactaattaacaaatagagcaagatgtacatcttgatttatatattattctactacttcgcaacctcaaacccttttgaaactgtcatgatcttgtatcttaatttctggtcctactataccccccttttctttttctttaaaatgaaaagcatttatgcccttttttctggctcactgtacgtcacactgtatactacgtgagatgctacaaacagggcttgactcgatcggctgtcccttcttcttttccttgatgaaagaaccctgcaactgacaaacaggaaaagtttggagaaaaaggcagggatcgatgtaaacttgctggagcttttcgatgcagtgagaaggtcgtagctatcgatcgatttcctttctatttcttttaaaagaaaagaattcatttgagacattgaggtagctatcgatggtgcaatggagctagctagatttctccttacattttctgcctttcaagtttagatattcccatggatatatatggagttggaccatggttgtaaatgtccgcggtgcgcaattctctatgtccatatcatacttcctctataaaaaaaaaaccaatctaaaattggattctttttacatagctggattttttttacataggtttagggttagcctcggaccagatgaccaccatcggttggcatatgctatagcatatcaacacaaccaggctgatgcttatcagcataagcttttctatcatctgatgctacagtccaaggagccaaccaataggctgtagctgaaaatcagccaaccgatgaggccgataacttcttatttggcctaagagaaaattatatggtgaaaatgtatggttctttatgggctttcatgcctaggccctggaccatggcccaggtggcccgggatcagacattcagaactgagaccgtcattgaccagagcttctctcttggccggcctttaatttgtcgctgccgaattcttccacaatcaacgactgttcgtcatcactaacctcgcggcacagaaggattaattcgtagcactaatacagaattgattattactgcaatataacagaaaaataaatcagtaacaattctaaataatttaacactgccagattaatttaccattcatcagcaagcatcgatattgaaaaccaacctttcatggcctgcagatcaaacacataacccctgaacaatctcgttgccatcaatattcggctcaaacgccaaagagtaagggtgcgatcctgatcataaacctcatccagttagctggataggagatcaagatggaaattaagtcgactaattgcaatatcgcgtggttatcttatagatatcgtgatgatctcgtggtaactttctcatttttaaaacctcatggttttccacgataactaagtaccgtagtaattatcatgatatcgctgagtagcagtagccatcataaaaagggtaaggaagacgatggctgatgcaatcgatctggtgagctttgaactgaattaatcaaaattactagtagttaattactctatttgtttcatattataagccgttttgaaattttttttaatttaagtttgattaagtttataaaaaatatagtgacataacataaaataaatatattatcaaaatatattcaatgttagacttaataaaaccaatttggtgttttagatgttgccaaattctttttacaaatttaattaaactttgaaaaatttaactaggaaaacaatcaaaacgaaatgaaacggagtaagcgctatcctgagactttctgatcaggcagctgcaggcaacaaagcgtgttgattcagcaattaactgcgatactatcattattatcaactttacttttaattagacattgtcataacacacatgcatggatcattgaaaaattaataggccatttggaacaaatatacgaaagagacccacttataattaattaagttttataaaaaagtaatttaaaaagttcggaacccttcccacccagtaaaaaaacgaagcagtggattaacttattaattaaatattaattaatacgattttttaaagcaactcgaccatataattttttataaaaaaatacagtttagcacttgtgaaacgagagaaagatgaaaaagatcggcatgcatgacaggcatgcactaaaataatctaactaattactcggccaaccggttgctgggaacataacttgaatccatccactaatccatcaaattaaaatattaaagagtttcttgcccagaagcaatctaccaagacgaggacttcagaggagagatgaaccagtcgctatagatcgatcttctagttgaccacttcagaaacatctaacgctcagaggctataaatatggctgcatcctttccatatggccaaagcatcagatatagctccatacacaaaacaacaatcgactacttctacaggatctgtagatcaagagcaaaagttccatcaacttaaacatggccgcctccaacttctttcttctcacagctttcattgctttggtcgctactcaggccatggcttctgatcctagtcctcttcaggacttttgtgttgccgacaagcactcgccagatatattattttatcactgatcatgcaattgcatcaaattgattacacattcatgttgtacatatacatgtttctagcttccgatctgaccattgtatgttcttcaatgcagtacgtgtcaatgggttaccctgcaaggatgcaaaggatgtgagtgttgatgacttcttcctagcagctaaccttgacaagccgatggacacaaccaagagcaaggctggatccaatgttacattgatcaacgtgatgaaactcgcaggtctcaacacccttagcatctccatggcaaggatcgactatgctcccaaaggacaaaacccaccacacacgcaccctcgtgctactgagatcctaaccgttcttgagggctcactctatgttggttttgttacatctaaccaagcaaacagagaaaacaagctcttcaccaaaacacttaacaagggtgatgtcttcgtgttcccacagggtcttattcactttcagtttaatccaagctatgataagcctgcagttgccattgctgcacttagcagccaaaatcctggggcaattaccattgctaatgcagtatttggatcacatccaccaatttcagatgatgttcttgctaaggcatttcaagtggacaaaaaagccatggattggctccaagctcagttctgggagaacaaccataactaaattattgatgcttgataaggttcagaattagtgattggtataaaaaggatttgttgattattatattagccaaaggctatatacttcatgtaatcctaaactcgatatttatacaattctttttacgaataatgtataacagtacgcacatatatatgttacattatgtatggtctggggtattaatttaatatagttgatttcttgggtattttttaacactcataaagatggataattaaaatcatattatagtagggatgcatttccctcgttcaatacttatatttgttatgtagctcacatgatcatagtactcatccaaattaatctattctttttcaattcttgtgattatcatgaaaatttgaacgcttcaaaaacatataaaatttgtttttagatgtgaaccaaattcatttatatataaccgttagttactgacaaaaccaacaaaataaattcaaacaaattatctacaaatgaatttttgtttgatttttttataactagcaaatctaaaagtatgataaacatattataatgaatcaggaaacaattgtgtttcacgtatcatcatgtctgacaaatcataattaaaatttccaaatacagaaaaaaagaaaaatctaacaattcaccatcgcccgttctcgtcgctggcattgcttaaactcatgcctctgacactaattaagttgtagtaaaaaaaattagaagatttggtttctgctcgtatgaaagagtacaataataagcaattttgataaaagtacatatactacacgtaattcaattggtcatatatccatcatatctctattattataaaaattgaatatgtttttgccggtattttgttatatcatccgtgtatgagttggtttttaagttcgtttgcttttgaaaataaatattcgtatttgaattggtttttaagatcgttcacttttagaaatacagaagaaaccatataagaaatctgtttaaaaaaaactcgcatactaacttgagacgatcggacgtctaactgcagctcatgattttctatatatatatatatatatatatatatatatccaagcgaactgctacagtgaatttcatcttaactaaatcatataatagtaataagattaaaataaactttacccgttacaacgcacgagcaatttttctagtatatatcaagttaacaactctgctccagcacatgctgaagaggaaggaagagatcgagttcgatcgggctaattaacagaaagaaagggcataatagttttactaatctctttttaccagttaaaactactactataatgtttttagaacggatgaattataatatagtgcgcgcgaaaaggacaaatatttccattattggaactatttctttatctaaccctgtttgggtatccagctgatcgaccaggagaatgacgagccgccggccgatgtgatcgatcgatcgatcagccggtgatagagctttgaactgaaataatcaaaactacaaattagttgaaactgtctcagggcaacggggagcatgttgatcgattcagcaattaccgatatcctttttaattagcatgcatgtgtgctagctcttgaaaaatcagaccttattatattgatgtaacacacatgcatgcttaatacgcggagatcattgacaaattaaaagggccatatggaacaaagttactaaaggagtaaagaggccaagtatacgtacgttacatagagagaagacatggtcatatgtttatctgcacctgatactgtataacacagccaggcttcatcatcaatctaatgcatgcatgacaggcactaaaataatctaattgattaactaatcggtcaccgtgttgctgggaagacaacttgaatccatccactaatccatcaaattaaataagttcttgcccagatgcaaatctatcaagaccggttcagactttagagcagatgaacaagtcgttagttcagcctttttttatttttcttattgaccacttcagaatcacctcattctcagaggcctatatatatggatgcatcctttcctggccaaaaaccatcagctagctgtagctccatatacacaacaagctagcatcgagtaatacttctgcagaagcaacagttccatcaacttaaacatggcctcctccaacttttttcttctcatacctctcatcgctttggtcactactcaggccatggcttctgatcctagtcctcttcaggacctctgtgttgccgacaagaactcaccaggtatagtttttcgtcatcgatcatccaattgcatcaaattgatgattatctcaaacatccgtaatgtgtatatataagtttctaggtttctgacccatatatgtttttcaatatgcagtgcgtgtcaatgggttcccttgcaaggatgctaaggatgtgagtgtcgatgacttcttcctagcagctaacctcgacaagccgatggacataaccaagagcaaggctggatccaacgttaccttaatcaatgtgatgaaacttgcaggtctcaacacccttggtatctccatggcgaggatcgactatgctcctaaaggacaaaacccaccccacacacaccctcgtgccactgagatcctaagtgtaattgagggctcactttatgttggatttgttacatctaaccaagcaaacggagaaaacaagctcttcaccaagacactcaacaaaggagatgtctttgtgttcccagagggtctcattcacttccagttcaatccaagttatgataagccggcagctgctatcgttgcacttagtagccaaaaccctggggcgattaccattgctaatgcagtatttggatcaaatccaccaatctcggatgatgttcttgctaaggcatttcaagtggacaaaaaggcagtggattggctacaagctcaattttgggagaataaccataactaaattaaattattgatgcttatctgttgaaaattagttatctgtagtaaaatggtttgttgattgttagtagctaaaaattgtatacttcatgttatcctaaaaatatgttatttgattctttttacgaaataatgtataccactacgcacatatacatatgttacgtgatgtatgatctgggatattaatttaatatatttgatttcttggtacctttttaacactgaatgatacataattaaaatcatattac

SEQ ID NO: 57874 - DNA, 15489 bp, Oryza sativa
agttcaatccaagttatgataagccggcagctgctatcgttgcacttagtagccaaaaccctggggcgattaccattgctaatgcagtatttggatcaaatccaccaatctcggatgatgttcttgctaaggcatttcaagtggacaaaaaggcagtggattggctacaagctcaattttgggagaataaccataactaaataaattattgatgcttatctgttgaaaattagttatctgtagtaaaatggtttgttgattgttagtagctaaaaattgtatacttcatgttatcctaaaaatatgttatttgattctttttacgaaataatgtataccactacgcacatatacatatgttacgtgatgtatgatctgggatattaatttaatatatttgatttcttggtacctttttaacactgaatgatacataattaaaatcatattactagggatgtattgccctcgttcagtacttatatttgttgtgttgctcacaagatcgtaacaagcatccaaattagtctcttctttttcaattcttgtagttatcatgcttgagaaacataaaaaaaatgtttgtacatgcgaactaaattcctttatatataaccatgcattaattactttaaaaaccaatataatataaacaaattatgtaagaaatgaaattttgtttgattttttattacttcgctagtttagtgagcggtttataggtgtgaattgtttaataactagtgaatggtttataggtgtgaaccgttcaataactctaataatcaacatgtagtgtcttactttcaaatctacgattcagtagaggtgacgatacacaccactcgagactcaagagtttattactcttttgaatgtagtaatttcataagattttcacaaaaaaatcgttcaattcttacgagtatacttcacaattaccacgcacgttctaaagaaccccttgaaggccatctgatcctaaatctcatttggccaacaatggagttggtgacctaatcgatcgtacatgaaacaacattacaatgaactgaagacaaaaatatgaaacaacattaaaatgcctagtacaacattacaatctaacaaaaagaaacatgaaaaacattggcttaaacattagaaattttaaacattaaaaaaactgtatcggctatatctgacttcctcctcccctccaatggttggatcgggctttcttcgacaacctcaaacgctgcaatgtgatgacccggtgattctttctataaatgaccttgacttccttgttgtcaactgcgatggcatgaccaccacttgctccgtccgctgcttctctacgataggtttccctcctcctcgctgtcgtcgttgtagttgtcctcccgttgccatcggcatcggctacccttatggtgacatgtcatcatcgccacatcaaagccttggtgggagatagagacagacacacagagagagagagagtagagtaatcaagtgcgcgataagggggagagatgtgagtgagacaagggagagagaaatgattgaatgagtggatgggaatgattggcaggaagccggtttttttctcctagatccagtgcccagcttggagcgttttcactagaactatacttttttatacttttttgggaaattgctaaaaaaactaatcacaatttcattttggtaaatgctttcaaatataactatggtatagttgtagtaactataatataattacactatacttacattgtaactacattgtaattacaatatacctacattctaatctctatataacttagctgtaaagttgcatatttttttaatctttacaagttacattgtagttatagtataattattgtagaattatagtacaactatactgcagttatatttgagagtttttcactttaaaaaattgtggtacctttttttagataatcccttttttatgcaaaacacactcctgaagatagaggaaggataatataacaagcgctaaaaagataaatatttctatatattggaagctagtatttgttttaactcctctcctagctatccatatgcagctggccaggggaatgaagagccgccggccgatgtaattgatgatgtaattgatctggtgagctttgaactgaattaaccaaactaccaatagttattagcttgaaactgtctcggcagctgcaggcaacagagagcgtgttgatatattcagcaattaactgcaatactgacattatcaacttcccttttaattagcatgggtgctagctcttgactaattaatcagacattcagacgttatattgccataacacacatggatgcctgaatatgcggagacgaaagggaccaagtatactttacatggatagagaagacatggtcaatctactcgttaacgtacattcacggttatttttgttacaacttgaatgtcatattaaacttgtattgtatatttgtaaagagatatattttaatttaatttaattatcttatcatttttttaaatcttcttgagagataaaaatccatctccctatctttatcataatatgagcctgttcactttgatgccattttctgataaagttgctaaaattttaactacgtttagtttgttgctaaatttttagtaagcacatataaaatcttgccaaaatttagcaaccttgttaaaattttagcaaacataccaaaatttagcaatgctaaaacttggtaaggttgaaaatggtagtaaagtgctctgtgtttctattcacctgataacaaagacagccaagacatcatcaatctaatgcatgcatcatgcatgacaggcactggaataatctaattaattaattagtcggccaacctagctgttgactgggaattaagatagcttgaatccatcaaattaaatagtttctttcccagatgcaatcattaagagttcaagaccagttcagacttctgaggagatgaacaagtcactagctagctcatccttttcttattgaccacttcagaatcatttcatgctcagaggcctatatatatggatgcttccatggacaaaagcatagactacagctatacaagaagcatcgaccactacttgtacacaagcaaaagttccatcaacttaacatggcctcctcgaacttctttcttctcacagctctcatcgctttggtcgctactcaggccatggcttctgatcccagtcctcttcaggacttctgcgttgccgacaggaactctccaggtagtgtacttcttcactgatcatgcagttacatcagattaacaatgatatgagatattcatgttgtacatatatatgtttctagctttcgatctgacctttgtatgttcttcaatgtagtacatgtcaatgggttcccttgcaaggatgctaaagatgtgaatgttgatgacttcttcctagcagctaacctcgacaagccgatggacacaaccaagagcaaggctggatccaatgttacattgatcaatgtgatgaaactcgcaggtctcaacacccttggcatctccatggcaaggatcgactatgctcctaaagggcaaaacccaccacacacgcatccccgtgctaccgagatcctaactgttcttgagggtacactctatgttggttttgttacatcgaaccaagcaaacggagaaaacaagctcttcaccaagacacttaacaagggtgatgtcttcgtgttcccacaaggtctcattcacttccagttcaatccaagctatgataagccagcagttgccatcgctgcacttagcagccagaaccctggagcgattaccattgctaatgcagtatttggatcaaattcaccaatctcggatgacgttcttgctaaggcatttcaggtggacaagaaagctgtggattggctccaagctcagttctgggagaacaaccataactaaattattgatgcttgataaggttcaaaactagtgattggtagtaaaaagagtttgttgattattatattagctaaatattgtatacttcatgtaatcctaaactcgatattttatatgattctttttatgaataatgtatatcagtacacatatatatttgtcacatgatgtatgatctggggtattaatttaatatcgttgatttcttgggtacttttttaacactcataaagatggataattaaaatcatattactggggaagcattgccctagctagttcagtacttatatttcttatgttgttcacaagctcatagcactcatccaaattaatctattctttctcaattatccctacatgcttgagaaagataacaaaaatgtttgtacatgcgaactaaattcctttatacatgaccattaattactttaaaaaccaacaaaatctaaacaaattatgtaagaaatgaaattttggttgactttttattgcttggctagcttagtgggcggtttatagatgtgaactgttcaataactagtaaacggtttataggtgtgaaccattcaataactccaataatcaacctgtagtgtcttactttcaaacctacgatttgctcaagactcaagagtttattactcctttgaatgtaggaatttcacactttacaattaccacgcacgtcctaaagaaccccttaaagaccatctgatcctgaatctcatttggccaacaacggagttggtgacctaatcgatcggacatgaaacgacattacaatgaactgaagacaaaaatatgaaacaacattaaaattcctagtacaacattacaatctaacaaaaagaaacataaaaaaaacattggcttaaacattagaaattttaaacattaaaaaaaatgtattggctatatatgacttcctcctcccctctaatggttggatcgggctttcttcgacaacctcaaacgctgcaatgtgatgacccggtgattctttccataaatgaccttgacttgttgtcagctacgatggcgtgaccaccacttgctccatctgctgctttgccacgatgggttgctctcctcctcgttgtcgtcgttgtagttgatcctcccgttgccatcggcgctagctgcccttatggggacgcgtcatcgctgcatcaaagcctcggtgggagacacacacacacacagagagagagagagagagagatagtagagtaagcgagtgcgcgataagggagagagatgcgagcgagacaagggagagagaaatacttgaatgagtggatgggaatgattggcggggagccggttttttctcccagatccaacgcccggcttgaagtgttttcactaaatctatattttggaaattgctaaaaaaaaactgtcgcaatttttttttggtaaaagctttcaaatataactatggcatagttgtagtataactataatataattacactatagttacattgtaactacattgtacttacaatatgcttacattctaatcttgatataacttagctataaagttgcatattttttaatccttacaagtcacattgtagttatagtataattattgtagaattaaattacaactatactacaattatatttgaaagttttttacttaaaaaaattgtggtactttttttttataatccctttttttatatacaaaacacactcctggagacacaggaagtataatataagaagcgctaaaaagataaatatttccatatagggtatgtttagcaaataggatatgggaggtcggattgggaaatggaaatagatgaatggctaggattaaataaagtgtgaagaatggatggctaagatgcaatgttgccttttggagggtgggatattatttctcaatcctatttgccaaacacagccatattggaagctagtatttgttttaactcctctcctagctatccatatgcatctggccaggagaatgaagagccggcggccgatgtaattgatgatgtaattgatctgttgagctttcaactgaattaaccaaagtaccattagttattagcttgaaactgtctcggcagctgtaggcaacagagagcgtgttgatatattcagcaattaactgcaatactgacattatcaacttcccttttaattagcatgtgtgctagctcttgactaattaatcagacattcagacgttatattcccgtaacacacatggatgcctgaatatgcagagacgaaagggaccaagtatattttacatggatagagaagacatggtcaatctactcggttcttagtaatagttaacgtacattcacggttatttttttacaacttataggtgtcgtatcaaacttgtatgtttgtaaagggatatattttaatttaatttaattgtcttatcatttttttaaaatcttcttgagagataaaattcatctccctatctttatcataatatgtttctctgcacctgataacagagccaggcaagacataataaatctaatgcatgcatcatgcatgacaggcactggaataatctaattaattaattagtcggccaacctagctgttgactgggaattaagatagattgaatccatcaaattaaatagtttctttcccagatgcaatctattaagagttcaagatcagttcagactttagaggagatgaaccagtcacaagctagctcagccttttgttattgaccacttcaaaatcatctcatgctcagaggcctatatatatggatgcatcatttccatgggcaaagcatcaactatagctatacaagaatcatcgaccactacttgtacacaagcaaaagttccatcaacttaacatggcctcctccaacttctttcttcccacagctctcatcgctttggtcgctactcaggccatggcttttgatcccagtcctcttcaggacttctgcgttgccgacaggaactctccaggtagtgtacttcttcactgatcatgcggttacatcagattaacaatgatccgagacattcatgttgtacatatatatgtttctagcttttgatctgacctttgtatgttcttcaatgcagtacgtgtcaatgggttcccctgcaaggatgctaaggatgtgaatgttgatgacttcttcctagaagctaacctcgacaagccgatggacacaaccaagagcaaggctggatccaatgttacattgatcaacgtgatgaaactcacaggtctcaacacccttggcatctccatggcaaggatcgactatgctcctaaagggcaaaacccaccacacacgcatccccgtgctaccgagatcctaacggtttttgagggtacactctatgttggttttgttacatcgaaccaagcaaacggagaaaacaagctattcaccaagacacttaacaagggtgatgtcttcgtgttcccacaaggtctcattcacttccagttcaatccaagctatgataagccagcagttgccatcgctgcacttagcagccagaatcctggagcgattaccattgctaatgcagtatttggatcaaatccaccaatctcggatgatgttcttgctaaggcatttcaagtggataagaaggccgtggattggctccaagctcaattctgggagaacaaccacaactaaattattgatgcttgataaggctcaaaattagtgattgctagtaaaaatgttttgttgattgttgttagctaaatattgtatactgtataacactacgcatcaataatgtataacactacgcacatatatatgttacaagatgtatgatctatggaattactttaatatatttgatttcttggtactttttacactcgtaatgacgaagaattaaattcgtattactgggatgtattgccctcgctcagtgcttttgtgttgtcgctcacaagatcgtaacacattcaaattaatctattctttctcaattcctgtggttatcatctaaatttgaatgttgaaggaacatacaaaatttgtttataaataggaaccaaattcgtttatacataaccattaattactgacaagaacaaacaaaattgcaatatagtttccatacgacgacgacgccaagagacacgcctccgtggaccctgtattcgggcttcaagcgccttctcggcaaagggttatggaaattaatacttatggggttttaacagttttaacttaaaaaattgattttaactttagagagaatctaataaatgttattgacaagcaccatatttcaaaaaataccaatgtacaaatcaacttgtcacctactactaattaagcatggcaggcatgatctggaccatcggctgtggattaggcccatcaccaacgacgacatagataatctaccggagcaattgactttcatcatttggaagaatggtagtgccacagagaaccaacaaattaatcagttaatctgaacacttgacacttgcaggcactacaacaacaaagctcaacaccactagtacagaacagcatgtgtgtttcagtctaaaatactgcaaatctgcaatgcaactgaactgcttcagatagtagcatagtgctctgtacagatccagatggaaatgtagaactccgtgttatcacaaacaattactacattgtcttttcggacaactgtcttgcaaccctgtagaacatctatgccatctcccccataaggaatgtacaggagaacgaaaaaaatgcgatgacaaatgtatattaactgtatcctatagctatgacaatgatgagtttctagatggcgaatctatggcttcagcggtaaacgaaaacgcctggcaaggtttcctttgtatatcatacttgcatcaccagaaaaacttcacagaagaaattgtcatataaatcgcagatcacatactatttctcactgccatccttctcgtctaatgctccactaggcttctcagaccttactggaagaacgctccgccgctctttgccacctggtttcgctgatgcgttcccataccatatcatcccaacaacagcgaggatcatcccaaggactacctgaaaattcagaccttccttgccaaagaagagaaacccaagggacaacacgagcactgtcttcatgtggcccaggacttggaaggatacggcagaaaaccgaccaatgcagatgaattggctcagattaacaccaatggcaatgacacatgagagagtcaggaaaaactgcagaatgataaaaatgccatcgtaagataaaatggaaaatatgaggtcaaatacatacaaacaaatcaaacatgcactcaaattcatcaatattctaatcaagtacagtttacctatagattactaaaaagcaagacattgcacacaaaaggaaagctatagactatagttgtttgaagttacagataacgagcaatgctgtaaagtaaagacttctttggtcacaagatataacataatgctagtctaggccatttgataaacttgcaacattacagaatgtgaaccagcaaaatgccaaccagcagcaaatcaccattacacaactaaccaaactgcaaggcgaattacctatggaaaaactagaacatgtatatcagtgagatcagatacagagcattgtaaagaggcttgcctcttaccaaagcaatcgatgtgaaaccaaagtgatccacccttttgcctgtcaacaagaaatctacaaagggccccactagcagaagggatcctgcttgggctggagcagtgtgacccaggaggttgaatgagttcagagagtactttcgttggagaaaatgaacatactgcaaaggaaaatagaagagttaaaattgtattgtctatgcgtccaggtaaggaaaagaaattaaggtgctatttggctataacttaagaaatgacaaaatcaaacaatgattaaggagtgccaattattcataactaacaaggactacagggaaccaacaatgattcagggagtgccatctgccaattattcatcattcgtcaataagcagacccatagataagcagagtcattgttgtgccaccatgcaataatttctcccccgtaaaaatgtttatggttgccaaaggacagctataggaatagaaggcagtattatctcatagcagataaatgggacataaccatacaagtacaacataggttggtttaacttacatattgttgcaaagctgtgctccaaacagctataacagcagcagccagaccttttgcatttacactgacatcagtaactgtgcagaccgcaacacctataagcacaaccattatgctcagctttgtgtcccgagaataatgtacatgatcgaagacaacctccaggagacatgatgcaggtatcatgcagagctttgctatctgaagagaacaaaaggattctttagcttttgaaacttgaaagttcaaagccatgatggaatttagctagcagaaccatcctttgctaacctgataaaaccccacagagttccacatcaagctcacattcattccaacaatcgacaagttcgaaaagatcacaaatttaatcagatctggcagtggtaagtgggagggctggctgaggcctaaccaccgaaacacgatagtcatcaaggtggttgtcacaaaatgaaggccagttaaggttgtggctgcaaaacacagaacataatcagttacatggcatggcaggagataattccattatcatacaaatgaaacatgttgaggggcagcccataaatctggttggatataagaaatcagataagttacaatgctcccggtgttccattaaggtccttttcatgttcagaaggcagtgtggcaacttgtgacaaaaaaaaaagttctgatcataggctcatagcagctagaacagagtggctttgagagtccagaggatacctcatagctcatatttaactcgtgttagatcacaaaaaaagcaagcctatctggtgaacctttttggcatcattagattaggcatacaagttcagttaaagatttatcgatcgtctagaactcaaatgattggaatttgtgctagcattgcgaaaataaatgactgaaggtttacagatgcctgttagtcagttgatcaattgcatgtccaaaggaacaaacatctggagtctacaattactacacaagatctagtaatatttattcgttcaatattaaatcaaacaggatactgctagtttgtcattcagaacacggagtaagcctagaataaaacatcatcatcacaaaataaagaaccaagatatctgaaggtagcaagtaacacacacaccgaaactgaatccatgcgtagccatcagagccttgttgaccatgatgattccaacagacgtggtgatgttgaaactccatgccgcaaaatccagcaccttcttcttgtcggatttgctcagggaagaagccatttcgctcgaatttcctccagacttgaacaaatcaacacccaacacttggcacgggcgggcggacctaacaaaattttttgggagaaaaacaaagaacagcaagcattactaccaaggttatgacagagagaaaaagcagcttctagatctagaagagaaagaagatgaggtgcgggtagaacgagggagatgagagaagaagaggcaggggggaaggggggggacgtgggtaggggcgggtgcttaccggcggcagccaccgctgctcgccggatggagctcgtcggcggcggctggcgatggcgaggccgaggggccttttcgtttttgttttttttttcttttcttttcttattatttttgcagcgaaagccactctctcccagatctgcccctatgatgtctgagggctatttgtactatgtttggtttgaaattttgatggaaatttgattaaagagaaactggatcacaccacatgcgttgctgggaagtttatataaaaaaacaaatattttctctaggttgattatcttatcgtttttataaagacatgtctaaaaacaattttaaccactacttattattattataatatatataaaagtatgtgccaaatgcagcctcgatctgaagataagttattatgccctcctcctatgtgtgcaaagtcaatactcgctctgtcccaaaataaggctgtgtttgagggagaggggattgagaagattggaaagatacgcaaaacgaggtgagccattagcgcatgattaattgagtattaactattttaaacttcaaaaatggattaatatgttttttttaaaagcaaactttcatatataattttttttttcaaaaaacacatcgtttaatagtttgggaagcgtgcacgtagaaaacgaaacaaacaaactccctttgttctccaaacgaacgcagtcaaatgcagttttgcactgttcgcgtctaacgtttgaccgctcatcttatttaaaatttttctatgattagtatttttattgttagtgcatgataaaacataaataatactttatgtgtgactatttttttaatattttcataaatttttcaaataggatagatggtcaaacgttcaacacggattcccacaactgcacttattttgtgacggatgtagtactctttaagataaaccaccattgccaacttaaagttactatggggttgtttggtcctttaccttataatctttggtagcgccaaattttcactatattggcactaccaattctttggtagggtagagatacatggtacatatttgaattgctaccaattagtgccaaattgttaatgagcattatcaattatttggcttcatccaaacatacactatcactattcaagatgccaataaattgataagttcacatttttttggcttcaataaaaaatagccctattccttgagagcgaggagacagcagatggaagttgagaggtcgctgcatcagatctggttcttcctcttagtttctgtggtgctgtgcctcaaggggcggagcccaataggcccgaggggggttcccaggaacccggcccaaattctgaaataccttgttacccctataaatcaccacatgggcaccccctcagcccaaaacctggaaccccctcctccttcgtctggcccaaaacaaggcccatcgctgtgtatttattagagacagcccaactgagaggagaggaggaatcgcgcacgtggttggatcgacagttcgacacggcgtagcggcggcatcgtttcatctcccaaaatgaagcgcgtgattcggtgattgtttctttctcctcgtccgtcgccgctcctgctcgcctgctccgcgtgactccgcgaccggcgaccacgcctgacatctccgactacatcccgtcgtgcgcacgtcgccgttcgcccgcggaccgccacagcccgtgctcaacgcggcgaccgcccggcgctcgcctgccgacgccgcccgtttcccacgcactccggcgactccgcgacctatgacagccctaaatcctatcatccaatccaccactccgtaagtcatgtacccctgcttcttccctcttccaattttgctagtttaccactgatttaatcttaattttcttgcttgcttttgcgatgaacgcagccatgcagggcagtctgggcagtggcagcagcaagctggccggcaatggctggatccacgagctcgccggtttgccctcattgactcgtcaaatctgcctagtgaccacaagtgcttctatcaaaaatcacatccgatagccaccacttacagcaagtggtttatcggttcatgaatataaccaccgcaaatttgataaatatcaatagataactgtttttatttatgtcaaatcatttcatgacttattgtttgttgataactaaactatgcctctcttttttaaggtgattgttgcatggaggaatgaaaatggtgacatcacattttgcatgatatattcatttgttttgggtatggagcccatgacacattattaacttcatatatattattatcagttggtttcttcattatggtacgtattttttttaatttttccatgcactttttcatatattgttattaattagggagatgatacttatatgtattgggtatgcaactatttagtataatattgttgagctatacatgtcgatattaagcaaagaaagttaggaaccctctcgttttttctctagctccgcccagtgcctgtgcctgctcttgttctgtctattacttttgtaaatacgggaaggcaagacactaatgggtgggtgcatatggtaaaagagggcttcgcatcctctgccgttccaactgaaatggcatagagctacagtgtcaagccgttggggcatttatatctgttggataagttttggatgttcgagattaaacgctacagtaacgacgaaaataagcaaaaacattttttactgtagctacagttttcattgcatcagcagcatgttactgtagcttcctcacgtttcactgtgcgcctctgccgttctccccccaacggcacaggatgggaacccggtaaaagaggggtggttaacactgtgttggtctgcaataagcatgctgatgtagatagagatgtaatgtgacaagactagaggttaaatgcacatttcattcttctcttgtctaatatcaggaactgtgttgcctcgtccaaaccatctgagctttggtctgttttggtttgccttgcacctgtcccttactactttactgtacttaaacgcaatttgtattattagatggtgccagaattatttaaacgtagacttgtgataacatgccactgatggaatcatttcaggcttcagagcgcgtctatcatcatggcaaattttaaaatgggtaaacaccgattaattgaattttatgcccccaaaccaggcaaattaaagtgactgactgtattgaagttcaaaaattacatttcgttcgtaagattgcagctttgcatttcataaaatggttagcatcttgtccatttcacaaaacgtgctttgtcacgtttgcggcagagtctcagatgaagaatgcagtaatacattgcacgtaaaaggccagtaaacctagcgagacatggatgcactgataacttgatccactttcagaatgaaaagaaaaaaaaatcacggcgtttacataagcttcatttgctgtaccaatccagaaagaggacggaaaaggtaagaacaaagaagaaaagcaggaggaaggttctactgctgctgttgcgctggatcgcctgggatagctccttgttcccacgctccacattgtttgtagcttcaactgcctgagaagaaggcatatagcacaattggacctcccgagtcatcagttaaagatcttataccccctccattctataatataaggcacaaccacttttcttagatgtttcataatataaagcatgcatgcaagcatgcaattaactataac

SEQ ID NO: 57875 - DNA, 8140 bp, Oryza sativa
tggtcgaggtacgactacgacaatagcgtaacggtcctcataccacgacttcagatggtcgaggtacggctacactggtcttcgaccagcagcgtagtggtcctcgcaccacgacttcaatcggtcaagagataaggctactcctggttttcggaccagtaggccgtagcgatctctcgtacctcaacatcaatcagccgagagatgaagctactcctggttctcggaccagtaggctttagcgatctctcgcacctctacttctagtggtcgagttaaggctacacctggttttcgaccagcggtgtagcgatactcccactagcttttcttctcgtggtcgagttaaggctacacctggttctcgaccagcggtgtagcgatactcccactagctttacttctcgtggtcgagttaaggctacaccttgttctccactagaggtgtagcaatttctcacactacatccacttctagtggttgagttacgactactacatggtcctcgaccagtggtgtagcgattctcccactacctttacttcaagtggtcgagttggggctacaactcatttttgaccagcagtgtagcggtcctcccattacctctactccaacaaagttgatatcaggtacacaatatcgccaagtgttttacccagagatcccttaccacgacgacacttagagttgaaaccaatcctactgtccctttatgccgccctggcaaggcctccgaggaacctaagggaacttcggctgggcacgcctagagcggataaggccttgtcaggtaatgcagagatgaacgaccatgtaagatctggtcatgtaagagttctcaccgtgcgtattaaccaagccgtgtaatcggaaattgggttttccaacttcacgactgggggctagggtaagcgctttttcaaccaaggcaggtcaagggtccaagagcattctcctccgagaacttatctccgatgacaaggctgggggctagggagagtgtatgactcaacaaactgactgattgaagtcgataaaagagaagacgcttgtacacaaaacattggtctgtaaatttaattaatttttagtttttcatacatattataacatgtcaccctttgagcattcgctcggggggctatttttattaatattcttttatgagtattgatttcaggaaaattctattcgacattgtcgaagactccatgtctctatggttctacaccaagattcactaaggcgagtacgacaaatgttgacaaggcttcgtcgcagactctgcgccttctcgaccattcgagaacggttggtggatctcgacaaggaatacggaatgaaaagatggtatacccgccgagataaaatttcttgacttcaatccaaattctcgattacagcaagacgggagacttagtcgtatgctctgtaccttcttggttgacgtctgagatttactcagacaaaccctatacggtgcccacacgaggctgataagggaagtctaatgttatctctgaactcaccaagaacgatcacgtgagcttgacaacagttattccgaggtcttcggattaagaatatgaactcgttcatttgcattgaagtcgggggctactgtcagggttatggataccacatacctaatagtagttgactaaatctcggtaggacccaccacataccatgttttatacgaaaacaaccttcgggtatagaaggagttccggataaggaaagataaatagagttctacatggaaacgacaaggattactcggattgtatccatattgatttccctagttctacttggaaaaagggaacacctatgggtataaatacaagacccctaggaggagaggggggacggaacagtagatcaagacacaagatcaacatacaagccaacatacgccaagacaatacgctggatatcgactttagagataagcatggctagtcgcctgcggtgtctacggatactgataggagagacatagcgctgtctttgaacttgccggatgcggattcgaggaggaaggctaccctgttgtcgactacgagtcagcacttcagaccgccaagtcgacaacagttagataggctaccccaaatattgtactggtgtgattatggtgaataagagcaacgaccgggttcggccaacaggagtagggttattacctgacaattcaggagcctgaacctgtataaaaatccttgtccccatctcttttacctcaatatcgtatatatcctagtaccaacaatccccatactatgcaaataccgtagtcgtgacatcaaacgtcgatagatagatagatggattgataggttagataagtagatagatctatcaatagacagggagggattcaaggtaaggatttgatattttcttggaaacggggaaaagtatttggcatggattcaaaggaaagatttgaatttcggaattgatataggaagttgaatcggaaggggaatttcgaggaggcgatttttgattttgacaggagggaacaaggaatttaaactaagatccatggcacgacttagactctcactcaaagaacgaaattttcgcaattaggattttattgatttagtttttaacgtctcgcgaaaagcggggcgttacagatgctatatcattacccattaacaattattacatttaaacatcatgcaagcatattatattatctataatttaatagtttattaaattttagagatttaaaatgtaagcatgttaaatcatcccacatatttcacataatatttcaatatatatctccatcatctttttataatatcatataaatctatatatttcatcctcactaattccatgttatttttcttttctctcattaagtcatatcatataaattgtttttagtcctcagatgattaatctatggttcaaattatctctcttcttttcttctcccataaagccatatcatcttaattctttgtagttcttagatgtatggtctaaattatcttccttcttgtgttttttcataaagccacattatcttacttttacatttgatccaacgtgggtgctgagtcgctcgagtccctctaccccactggataaccattgatagaagaagacataaaagggagaaaaaaagggatatgagaaattgtgggggttgggtgtgggggccgaaggaggaagaatgagatgagtctccctataataggctatgttcggcacgcctggttcccaacatgaatagtgtgtacggaaaatagagcggttcattagcacgtgcttagttaattattaactaaactttttttcaaaatggattaatttgattttttaagcaactttcgcatataaatttttttgcaaaaaaacacaccgtttagcagtttgaaaagcgtgcgcgtaaaaaaaagaggaagaggggtaccgaacacaggcataatctagttctagatcctatttggatgcgtatgttacgtgcctcttgcgtttgaacaacgtttctaaaattttttttaaaaaaattggaaaataaaaaagggcctgaaaatggtataggaccaatttgcccccagtcgaccggtgaacgtgagtagcagtagccccaaaaaaacacaagcaaaggaaaaggacacgaggctgaggtaccagttgctcgctcgctcgctcgccccagatccgggggaatccccgcaccagatgcgcccgccggcgatgctccgatggcccgccgccgcggcggcgctcgcgctcctcctcctcctcatcgccgccgcgccccccaccgcggccttctacctccccggcgtcgcgcccaacgacttccagaaggtccgttcctcctccccctcctcctcctcctcctcctcctggtaatggctcccgctcctgcgcttgctggatctcggcgatcccgcggtgcagatccggctcctcgtgattctagccctcttcgctcttcgggggatgctgtttcgtaggcgtttctgtggatgttggtggggtttggttttgatgaatgatgaatctgtgtgctgcttattgccaatgctgaaaatgaactgtatatttcagtgctgtttgatgtctgggtgtggctaatcagtgctaaaggcgtaccgacatttggttataggatgcctccacggttgtagttgcatgcatctggaattctggatggacattagcatccttagattagatccattatttcacaagcctcagcgctgaggcaaaacatgtttttaactgaaagcgaagcaaagcagtggaaaaaacctctgcattgatcctagcatatgcacttcgtattatccctctgaacattttcagaacaaattatattgttgactatagctttatttgaacagtgcaattttttcaagcttgcgcattgagtaaacgtgctccaattttcaagatcttctcagcctctctatactgtaccctgtttatcttctctcgtaaactgttgccagttgtatgtttgtcctcaatttcgtcacttatgaatggcatgcatgtccttgcaagtcactcttttactctaattttttgcccactatcttttagtcattagttttaagaatgactgtgctactaggccttttctaggttattacatgtttattctattctgttacgtagagaagaaaacatcatgaagttgaccaaaagaaattattttttagtctgtgaagaaaaaaaatatctagtaatcttaaaaaacatacctttacatttacctgccgtactgaagtcatatgttttagatgtgctctaatggacatatatactacaatgcctgcagaaagatccacttcaagtgaaggtgaacaagctgtcatccacaaagacacaactcccctattcatattactcccttcctttctgcaagccagatacgatagttgacagtgcagaaaatcttggagaagttctacgtggtgatcgcattgagaattctccttacgtggttagtactggactctggtttacagattatctgagtgcactcacgtattaatgtacctaattatcatctattttacttctttggactatagtttgagatgagagagcccaagatgtgtcagattgtctgcaaagcaaccattagcgataaacaagcaaaggagctaaaggaaaagatagaggatgagtaccgggtgaacatgtatgcctgtgtggattgtgtagtttgattgaaatttattttatatgatgggttctggagtaacatggttaaattaccttacaggattcttgacaacctcccgctagttgtgcctattgcaaggacagatagggatgctcttgtttttcagggtggatatcatgttggtgttaagggccaatatgctggagtaagtatctgtgctcagcttaccattttttgtttggaaggtgagtaatgatcttacaaaaatatattttgcagagcaaggatgagaagtactttattcataaccacctggcatttttagtgaagtatcacaaggatgaaaattcagatctctctagaattgttgggttcgaggtcaaaccatttaggttcgttcacttaaccttttcatgtttgtttcatacaacgtctttgacatattgggcaaattttttattagtccctcatgtgcatttactaaattccctgactcagtgttaaacaccaattcgaagagaaatggaatgatgcaaacactcgtttgagcacatgtgatccccatgccaacaaaatagtaataaactcagatactcctcaagaggttgaagctgggaaggatatcatattcacatatgatgttggctttgaggtgatattttcatgacatctcttcttttcttttgtactgtgactctgttccttcacagctgttcttcgagtgttatctttatttaaacaatctcttttggttttcttggctgggtcttgtaggaaagtgatatcaagtgggcttctcgctgggacacctatctgcttatgacagatgatcaaattcactggttctctattgtgaactctctcatgatcgtgcttttcttatctggaatggtggccatgatcatgctccgcactctatatagagatatctccaggtacaatcaacttgagactgaagaagaagcccaggaggaaactggttggaagcttgttcatggagatgtgttccgcccaccaactaactctgacttactctgtgtctatgttggcactggtgtccagttctttggtatgctgctggttaccatgatgtttgctgtcttgggtttcctttctccatcaaaccgtggaggattgatgactgcgatgctgctcatttgggtcttgatggggctgtttgctggatatgcttcttcccgactctataagatgtttaaaggatcagaatggaagagcatcaccttgaagactgctttcctgtttccgggaattgcttttggtattttcttcgtcttgaatgctcttatatggggggagaaatcatcaggtgctgtccctttctccacaatgtttgccttggtgcttctttggttcggtatctcggttccacttgtctttgttgggagctatcttggtttcaagaaacctgccattgaggctccagtgaagaccaacaaaatcccgagacaggtcccagagcaggcttggtacatgaaccctgccttcaccattcttattggcgggattcttccattcggagcagttttcattgagctatttttcatcctcacttcaatctggcttcaccagttctactacatcttcggcttccttttcctcgtgttcattatcctcatcatcacttgtgcggagattgcaatcgtgctgtgctacttccagctctgcagtgaggattacatgtggtggtggaggtcctatcttacttcaggatcatctgccatctatctcttcctgtatgctgggttctacttcttcaccaagctgcagattactaaactggtgtcaggcattctgttcttcggctacatgcttctggcctcattctctttcttcgtgctcactggcacaattggtttctgtgcctgcttgtggttcacgagattgatttactcatctgtgaagattgactaggcgcagagttgctatacatccggcttccaatagttctgtatgattattgtggagaattgtgagacgaggatcagaatccactttgtattttgccgattttcaagaaaatttatatcgtagttcttagtttataaaccactgatgttcattcactataaatgagatgatacatctttgatatgaggttatataaggctaattacgattgttaatttcatatggcagagcatatttctcaattcttatggaccactgtatacattcattttattatatacagttgccgaatactactgttttctgcataacgtgcttggtagtaattggtactatcaccagcagctgctttgctccggtttttctttgggtgagttgaaaagttgccatattgctgtgtgacgtacgtgtaatcagtcagtcagttattgcggtccaaccacgtatgtcgtgaccagagaaaaccagtgcagaaggcaccgaagcttagctgctcctccgccgccgtccgccggccaactcgtcgttgtcatatatgagtgaggcttagtgcttctccctcctcaacgtcgccgccggccgactcgccgtcgtaccgtgaggctttattggctccgatgaggcagcggttgatgctactgttcatccacgaattcggcatcggatataaaagggcatccaaaaccttaaaataatcaaattcaagctgttcccagaaaaatcaaaatctcaacacctgatatccaaaaacctcccatatgcctcaaatgttaccatagacgacacgagtttgatattgacggctagctactagataaacttgatagcagaagaaaacacaacatgccatgttgccatccatttgaaccaatcatatgatctctcttgttttctcaatcctcattttgatttattagttttacatagtagacaaataaagagtaaattgtcccggtatatctgtgatggtattttcaaactcgttgacggataaaactaatgatacggggcggggggggggggggagg

SEQ ID NO: 57876 - DNA, 3438 bp, Oryza sativa
aatatatatccagattcatagcaataggatgtgtcacatccagtactagattggttttttgtgaaacggagagagtatttgtgtcagaagaatctcacagattcatcaccacaaaaatgcatagaggagacagatcatttttcttgacatgctcacagcagaattcgacagattcattaccaggaaatgaaaaaaagaagtttgttcagactcggttcctcgattacaatacacgcaccatagggtaccagcatctgaatgagctacatcatagaacaagaaaaggggagggagatgcaattttgcattgcattgacaggttctttgatgcaattttgctttgcagttgcattgccaagataggttttagaaattctcactctcaattggccatcaccaatggcctcttgtggtgtccctgcaggagctgcctgagctgctggtacccatggcggtagtgctcgagcgagaagcagagctgcctgatcgcctctcgcttcccctccgcgccatcggagaccatcagcttctgctcctccacctcttcctcgagctcgctcacccgtgctcgcagctccgacaccgccttcgtcacggcatctgcctctgcaatcagcttgacatgctccaggtgcagctggtgcaggtggctgtccatctccctgatcttctcatcacgagctgtgacatcggtcagtaagctagccaccttgttatcgactgtagttttctctgaagaaaggagttcaagctttgtttcgagatcggcgatggcttgattcagatcggagatctgcttctcactgctaatggatgcttctgatttctcggcgtggagttgctggagctgtgactctgtggatgtcagcttgccttcaagagaagcattggcttctttcagtttttggatctcggcaccaagtgaggatttctcctgcgagaattcttccaaattacaggcgattgtgtgttccagatcattgatacggctctccagctgtgatttctcttccagagctcttcctaggtcagctttcagattgttgattgtagcttgtagttctgcgacctcagtccttgaaccctccagctccttacgaacttgttcaaattcgatagcacgttcttcgagcatcttcttctcatttgaatcattgtccagccttctttgcagatccttgattatttcttggagcttcataatctgtgctgatgaatcatctaggctgcgagatgcttgttcaagttccttaacctgggccttgagctgcaatttctcttgtgacatttttgctagatcaccttcgaaattcttgacgatgtcttggagctttattatttctgtttcaagagtagatttatcgtgggaatacttctcatgaacgtgttcaagctccttcttgcacttctcaatttcatggtcatgatgagctagttggccttcaagttccttctgaaggctgctgatttctgagtgcgaatccttcaacttctcctcaagtttttcacattggcagcgtgtattcttttcctcaagtgcctcaagtttttcccttgcttcctgaagctcatcttctagctcggcaattcgttcgttcaatgcaaaaggacttccatcaccattgtcttctctcaattcgtcaacctcagaatcagattctgaagaagatgatgatgatccatcgctccccttcttggaaatgtctgaacttccaccagaaccaaggaagacatcaaagccagctgctcttggtttacgcttctgttttggtgttgtctcttccgagtcaggcttaggagttgggggagcagactgtgtctcagaatcagattcagatatgctaagagagccttgtgactggagtgacgatgggatattcttgcgtaattccccagtcacattgtcataacgctcggcaagagcacgatacatgcggtagaagttctcaacatgagttacaagcaaaggccgccgttcgaaatacatctcggccttctttgcaaaagaatcaccttcatcctcgatgagcttcagcatatctttaacttgcttatccatctctgtttgttgagaaaaatgttatagtaagaatcagttgtgctatgcatagttgttttgcaggatgaaatattagtgaaccacataaataaggtcctaaatattgctacttctggcaaataataaagaatcactagtacatcctgcattcccgaaacatgaggctttaccttctaggttctcggctaaccatttggagttcttgggactaatatggctgtcccaccaccatgaatgggacttccttgttggcatcctttgcatgcgcttcatcttgaccaaaaataagatgactcctcaaatgaagccctaatcatgatggaggaaaaaatgagaaggcgatagatacatgtgaagtttgatgatgtcgagcaatctgcaactaagaaataaatattttctaggcagttctgcagaaggaaaatgttaggactagaaccagtgtagttatgcacataaaacagcttaagggcccctttgattttaggaaaaatgcaggaattttggaggatttcaatcctatgaaaaaaaatcctatgaaggcctttgaaacaaaggattgaatcctatccaatcctttaaaattcctatggaatgggtaatcctatgcacattttggaggaaagttagcaagaggtctaacctcttggaacatttcctctgagtctatctctctcatctgattcctgcgtttttcctgtggtccaatcaaacagccattcctgtgtttttcttgtgttttgtaatcctctgttttacaattgtattcctgtcagaatcatgtgttttttctattcctctgttttttcattcctacaattcaaaggggccctaaaagtgtaacacaatactaacaaccaatgtaattcttccattgcataagtgcctatgtaaaggaaacatggcttccacttctcaaggggacaaggaaagggactaagcatggtaacctccataatgcatggaaccaaggaccataacaatcattggctaccaaaaagaggtgcagacagcaaactgctatataattcatgaatgtcttatcagctaatcagcactgacagagctgaatattgataagcatcagctatctaaaggagaagctgatgacacagtctggaagtaaaatataaacctatcaaacagaaaagggatccctgcattcttgaatagtaccttatcttctctcacacaaagctataactacacaatgtttaccacaaaaaagtttatctggaaactggaaatatcattaacccgaacataagcaagcatttatcccaaaatagatatgatacagagtaggaaagcccagaagtaaactttaaaagaaaaaagcttctaacgactaacttaataaatatgggcagagggaaaaa

SEQ ID NO: 57877 - DNA, 11261 bp, Oryza sativa
ggttaccccgcacatactcgtggctatcatgtacttattttggagactaacaaaattgttgagacttgcaaagtttcttttgatgaggctagtccaggtactagacccgatattgcaggtacactgtcacaggttcagggggaggatgattgtatttttgaagacgagagcaacgacaacgacaacgacaaggtcggctcggccggttagaccgggcgccaggccggtcagaccgccggcacacctccggttagaccggcataggaggtgcggtcagaccggccagggtcgtcggctgagggttctgttgatgctgtttgagatggtcctctagagattacaacttcgaccagtactgatacagaacatggatcaacttcagaagtcactgctcctttgcacatttaacgacgacatccgccggaacaaatcattggtaatataggtgagcggactacaaggtctaaggtaacgactcatgatgtttgtgcaaattctgtatttgttgctttttttgaacccaaagatgtgtcacatgcattaactgatgaattgtgggttaatgccatgcatgaagaacttgaaaattttgagagaaacaaagtttggactttagttgaaccaccttctggacataatattattggaactaagtgggttttcaaaaataaacaaaatgaggatggtttgattgtgagaaataaagctagacttgttgctcaaggttttactcaagttgagggtttggattttgatgaaacttttgctccttttgctagaattgagacaattagacttttgttggcttttgctgcttcaaaaggttttaaattgtatcaaatggatgtgaaaagttcttttctaaatggttttatataggaggaagtttatgtcaaacaaccaccaggttttgaaaatcctgattttcccaaccatgtttataaattatctaaagctttgtatggtttgaaacaagctcctagggcatggtatgataggcttaagaactttttgcttgcgaaaggtttttcaatgggaaaggttgacaaaacgctttttgttcttaagcatgctgataatcaacttttcgttcagatttatgtggatgatatcatctttggttgttcgactcacgctttggttgtagattttgttgagactatgcacagggaatttgagatgagcatgatgggtgagttattgtactttttgggattgcaaattaagcaaacacctcaaggtatttttgtgcatcaaacgaagtatacgaaggatattttgagacggttcaagatggagaattacaagccaatttcaacaccaattggttctacagctgtgttggatcctgatgaagatggagaagctgttgatcaacaggaatatagaagtatgattggatctttgttgtatctaactgcttctaggccagacatacaatttgttgtgtgtttgtgtgcacgctttcaagcttctcctcgtgcttcacatcgtcaagcagtcaagcgaataatgtggtatttgaatcatacacttgagtttggaatttggtattccacttcatgttctatatgcttaagtggatattctgatgctgattttgggggttgtagaattgataggaaaagtactagtggaacatgtcattttcttggtacatcattgattgcatggtcttctaggaaacaatctagtgttgcccaatcaactgctgaatctgaatatgttgctgctgctagttgttgttctcagattctttggcttttatctactttgaaagattatggtcttacttttgataaagtacctctcttttgtgataatactagtgttatcaatattgctaagaatcatgttcaactttcacgcacaaagcacattgatattcattttcactttttgagggatcatgttgagaagggagatgttgaattgcagtttttagacacaaagttgcaaattgctgatattttcactaaacctttggattctaatcgttttgcttttctttgtggtgaattgggcataattcatccttttggcatggtttgagggggagtttgtacctcatggttttatcaagtaataatatgacaatgaaaaattgagaaaagagagctttgtttatacatatggtattttcttgtgcatgctagcaatactatgaaggtttatttgtctctagcatagcttgtctgtattctaatcttttcatgagatttagattttacttttaagggagatgatgcatgacacttaaattctatacttgaattaagtaaatatgcaatgttgatgctagcatatggtttgatttgtaaatgctctatatatatatgctttattgacttgttattcctcaaatagctttaattgctcattgtgaaaaagagaataaaaatatgaaaaaaatgaataccgaatccttggaaacagtcttgacgacagggatgtattcgatgtgagaaaaataatgggtgccgaatctctagaaacagtcttgacgacagggacgtacctggaataaaagagaaaaatatgagcaaaaaggctcaagaaaaagaaaagttaaaaaaaattctcttggttattttgtgctaaaggttatttgagaaagagtgataaatgcaataggtgtatgagtttagtgtttattcttcaacctatgtgcttgttaagatgttgcattataaatcgtatgaaatcatgaattttgattgttgattcaagcttaattgtaaaatctttggttcatggttatactttaatgcatgcttgttatattatagatggatttatcttctttttattgcaacacatgacttgatatatatgtatgctaagcccttgaatattaataaacataattcctatgcttgatgaaatcattgtcaaaaggaggagaagtaatgtgaaaatttttggatttttggagaagcaaggtgaatttttgacgagttgttgagaagagcatgtttttttttgggttcatgagggaatttctttcttttaaaaagggggagaagttttcttctggattttcgagcacgatgtgtacttttgtacgaagtgtgctttttaccaattttgtttttatttttccaaacaccaaaacatttttgatggatttgccaatgtgttcatcaagggggagattgtaaaatcaaatgtgtttttgattattattctgtgatgaacaattgggcattggagattattggttttgttatttggaatttatttacgaagtggttttggagatgattggatttacaggtgaatcgtaggttcgttattttatgtgaccggtcagaccgggctgtgtatgccggtcagaccggcggtgatcaagcggtcggactggccagcccgcggtctgaccggccgacgctatgtcggtttcggtttcgggttgtttatttggatatctgtgattattttatgattatggcttctagatggatactatacgtatgtaatactgttgtttgctactaatgagtcaagttggagatagcttggtctcagaatatggttactttgtttatttcatgtgtaggtgactcgatgcctcgggagagtatttacggtgatggaccgggagtcggcttggggataagacgacgtccgtggtggtcagagatcatgcgagatacttaggctagagttgatgcacgtggttggtggagattccatatggcatacaatggaggtattgtgtgcgtatgggatgcggagtcgaatttggaaggagtccaaatttggtacgattggttatgtaaagtttgtgtcttgtactagagggttttctaaggtgtttaagactcctagtatgagtttggttcgtggctgtaggctgcctacctcatgtataaatagagggggagcgtgaggcttcccggtatcgcttttgagagcaattgagttgagttttgagttagggtttcgagtttagtcgaaatttttgtaaggagtgctgttggtgcactttgtaaatacagagataatcaataaagtcgtcatccactttaagagttcttcgatttgtgtttcaccgagtttcggcagtccaaccggcgatataccggcggtcagaccggcggcatacgggcgatcagaccggcggcggcgacaggcgcggcaggtgacatcggcggtcagaccggcggcatccacacggtcagactgacgatcaatctcggtcagaccgacttccgtcgatttcgagggtaacttttatttccgctaaaagttttcggtttttaggtataccaaccattcaccccccctctggttgtcttagttcttgtgttttgatcctacataatccttctacttaacggacaatctctactacttcctccgttttatattataagacttcctagaattgcccatatttacatagatattaatgtgtctagatttattaatatctatatgaatgtggacaatgctagaaagtcttataacctgaaacggaggtagtatttcaaagtgagtcgtggtggtctctgtttttcctttgtaattaaataatagatctaaacaaatttccaatgagctgcgaaatttccagctaactgtgctgtttctactagtaatacgacttattagatggtctgaaactctgaatttgtttttctgaaaggtctgaaactctgaattgataaaagatagtatcacgtttactaagtaggcagcctactgggcaacctaccatgtcccctacgtcatttcccaacaatctgcaccaacaaaatctaacaaaaaaagaagaaaaagaaaaagaagacatcgagacagacatatcaacccaaccaccatcaagtccccgactctctctaccacgtctatacgcgtgcaaaccgcaaagcatatatacacctacactgcactgcactgcattgcacgtacccaaccgatcgaaatcgcaccaccaagattaccatttcacatttcgcaatggcagccgtagaagcaaacgccgcaacgacccaccatgaaatcaccacggccgccgccgtcaccgccggagagcggcagcagctcaacgccggcggcgaggacgacaagaatattgggatgatcgtgactgacgacgatgacgaagacgaagacgacgagctgttcgagctcgacatcgccctcatcgaccaccgtgacggcgaagagtactacaccaagcgcctcgtgacgagcagctgttgcgtcgctgtcgccgccgcagccgccgccgccgacgacgacgacgaagaagacggcggtgacgcgctcctagccaactgcctgctgccggtgagctcggtcagcagggcggtgccggtgacggcgagcagcagcttcgtcgtcgtctcgtcgtatcccgttggccgccgctaccacggcggcggtgggtgcggcgacgacgacgacgacgacgctagctggaggtggaggaggttcttcttcacgtccggcggcggtggcaggacgcgtattggccgccacaacagcaataactctgcgaggttctccttctcaagattccaaagcttggcaaattttcagcgatactgatgaacgaatatgttctactgattcaaaggggcaagaaagagagatgaaatttgacgtgtatatatagccgatgtacagattgagtttctgggattgaaattttgtactagctagcttagatagggaaactattttaacagctcgagtggatgtccacccgtttattgcatgtcatctaaatggttataaaaaaaattaaaaaaatatgaataagatagatcaatatgtaatgtatcaatccacaaacatacaatttaaaattcaacttctacagattgtaacaaaaataacaaacaaaactcaaattactatatgtatatttacagttaaatttgttatttttgttacaacttgtagaaattgaattttaacttgcatgtttgtggagtgatatattacatattgatctatcttaccaatttttttgaaaatttttcgtagccatttagttgacatgcaataaacaggtgtacttccactcgagctattagaatccatcccagcttagatatggtaccaatcttatcaaattgtgcaaaattttcagttgtttggaattaagggcatttgtgattttactggacaaaatttatgtctgttacttcaagctttgcccggcaattgtacaaaattattctaaatgtaaatttaaaattaaacttaatttaagttagtatctttttgtggtaaccgccagtttagagcgtgattgaccattcaggtcaagagaagagaatgtgcggtggttgactggtccatatgtggccagttgaatcggatgcccacaaaagaagcccacttaggccttctctgtataggccgaaattttggcccatatacatttgagggccgaaccaaatgaggcctcaattgcaaatttacttttacaatgtgcggcccaagcctactactggtagacatacgctccgcttgttgaataagtacggtgtacggccacctcgccgtcgcggccacggcccctctcctcggcgagcacgccgccgcccgcggcggcgggatatcccctgtagatgaccacacggtgatcgtctccgccggcccgggacgacttccacggcgagccaggtgaagcgggtgaggattctctcggcctcggcctcggccaacccatccccatctgattttacagttcattgttaccgcatcattctgtttgctgcacctgcgctctctgctactctgctgctggtccgactgtttctgcgcaggagatttgggatttccagcagattacacgagtatgcttcaaatttctcatcatgttgtgctaatggggtacagcctgattagcaatgggggtacacttgtttgtgtaaattgggattagatccgaatccaatccgatttctagggaggttgagatttatgaaatgatattcatctagaatcaagttcttagagggaaatgttgtgattcaatgggaaaaggggaaatagtggaggagagctcatagcctgatagtcagattttttgcaagaatgtgtacatgctacagaatggattattgccggccgtttggatgttcctctggatcaccgacaatttcatatgggtgttcctctggatacaatgggtacatcccttttatgtcatgtttttaggaatgtggtagcaggctagcggcgctggtgcaatacagttaggagggtcaggagggtctttgtttgtccttctacaaggtgacacaacaagatctaacaaacttcatgtccagcagatcgcgtgtcaacaaaagtgcacatcttgtggagccagaaagtgcatttggtggataaagctttttttgccagctagcccctgtatcagttatagattgctaatatttgcatgtgaatgcactggtatttatcatgactctcaatcttcttacaaaaacaatccattacttaatttttgatacgggaaacaatctgacactgatacaatctgtcaaatgcatttggtttattgtagattttcttgaggcaaatgacgtaatgatgaagccttgatccacaatctagtgatgtggcagataatgtagacgacaggagaaactattggatggtttttatttatcacagcggggataatgacagctggaattttttagcgtctcctggcagcagtctctctctgagcattgaagtagacagcagcgacaggaaggccaagttcgttctcctcagcaaactggcgtgtattgaaatgatccctagaggatggcacaactacagcctgcctacgcttctgcttgaagagcacaaaaacgaacctgtggataccaatgctgggctttgggctctcatagcttatgatttcccgtcctgcaattcaaatgccagaaagatgcatattaagaacaaatacatgcaagcatggaatgatctaatgcaggttagggagaggacctaccaaaagaggcatccgttgttccaggtatatcagttacaatcctgcataaatattaagggtaaaatttaatgatttggccacaccatggtcattatctgttcagaaatatattgttttttggaagaaatatttttcttattagaaatatgatgttttgtatgaaaacaagaaaaatatgtggtattagactactagtgccatctccatcagaaacataaattttatagtgaatcaataatcaccaattggacacaaatgtatagattttggataagaagtgttgaaggttaccaatgtaggtgttcccttagatatggatcacttggtcctggcacatctgggtctgtcataacctgaagcattccgagttatggttaataggggggggggggggagagtatgaaatgcactgaaagctaactatggaactcccaggatagagttagaccagtccgtaccaatgtgaagaaagaacgcatatcacccccttggacctcgactcttggtttagatacaactgctgatgggtagaactcatggccattaaagacaagcttgtttgaattgtaggttactatcatcttcgtacatgggttgaatgaatcaataacttctccgatcacccgcccaacaacaagaggctccacagacctagacatggttggagccttggagggacaggtaattatattttccgaaattagtgctctggctagttgtaaatgacaaaacctagtgcacttcaatgtgcccttggttgcttattgggcattgtagagtgatgagcctctatttatagtggcaagaagcatgctgtcttctttcaagttgtagacttgtagggatatatgatagaattttccaccagaatcataagatatgtatgaatgtgcatatttgtttgatcttatttatacatattcctctattccaggccttcttttgattatttataattttatatgcatgtcctgaagattaagaaaacacttacttttttatttgattgaaattaaatgtttttaaagtaattttatttttcttgttattttggatatcaactctggacacaaacttgaccattaatttatctcactatatgttagtaatatattgatatgacaggtttttaattatcagtcctattaataccattttacatgacaaatccaattaccctttttttattgtagcataatctaaatcttactaggatagattgcaatcattctaaattatcattaaagaaaaacagagggagtatcatagatcactacctatgttatttctttatgaaacataagacacttcaggcaaggagatctctgaagattatgttgctgaatttatgttatagtggtgggaaaaggggctcatgaccctatatgtaaggcctgcatgacaatgcagtctgcagaatttttgcacactatcaaattgtcatgtaatttctatacttttctaaagaaaaacagatgagctattatacaaatttattttttagttttttggcaataaattgacagatgggttttggggatggagctgcaaatagccacaaataccttaccgaaaagaaacatgtagataaaatttcccacttttaggaggtatgcaattgtggataaaatgagaaaaaaaaagaaaaggaaagggactataatccttctggagtgatgccgttcacctactccctctgtcccaacaagaatcaatgaatctggacaaacacttgtccagattcattgtcctaggataggttatactaagttgattctttttgggacggaaggagtaaaatacaaattcattcttgattgctagatttgatgttacactacggaaacataaaggcttggcttgctgagattcttatcctactgttttcaatgaccttcttttgttatctatgaggcagatgcactctacactgtctgcgtggaagcctatcaacccccaaatgtttgtcgttagcagccttgtttgtctgggtaagtctcacgtagcttcttctttttctgttaacaaaaagcaagctatggagttgaaatgctgttggaatttttctttctcaaactgtgataccaactggattataccattattatctgtttactctcttccttggagtgctatggcagcacagcaaggaacagaataaacgaatgaggtgcagcgccgcactgctgccaccacttcaccgtgtgggggtactgtctagtgctgagatgtcacttcactgataaaaagatcataggttcttcttgattgaggaattaaaaatacttctatattgccataagtagtggagccaagtacagccttttgcactgtgctcttttggtctagtgctatcatatttgcttgacattttgtgcaagtaaaaatactgtagtcaagtacaccttggcagcatttttctactcctaatgccataatatttgcttgacacagctgatttagtggaacctcataactgttggctgtaactaatggtaacttatctgtgatgtagactagcagtgcacctttagcttggtgtgctgacttgtcactagtggtcaggacaggcgtgcaaggtcagctgtgagttatcattgtatttcttagacgaatatttcttcagctgttttgtaacaggtaattctccactagtcacagaagattaaaattgcttatcaatattgttctgcttcgctaatcggtttgtataacccttacacaccataagcactttccacttccatgcagacagtgatgttttctgtttgctgtcaaaattgttattgggtaaaaaggagacacccactgagccagaagatgcacaatggtaagctacctgatctaacttttttatgactaagttgcctgaattcatattggtgggaagatcattgtgggacaatgcaggtaggaaatcagatattcagatcatgacagggtgactctagaggaagccatgccccaaagaatctctattagatcaatgtgtcgctgcttgattgagtatgagtcagctcacaagattacactcaatgtgaattttggctatcttttttgtttctttgaaattgatttcaattccgtttatcagtggtgtggtcaatggccaatagatactgatatcataggttgctccaatcagtaaatgctgataattttcaataggttcctccaatccgtaaatgctgatatttttcatcttccagaataatatttcattattcaattaccgtatcctgatgcacatttcacttgttcacccagctccagaactttggcagca

SEQ ID NO: 57878 - DNA, 2988 bp, Oryza sativa
  unsure (1)..(2988): unsure at all n locations
cttttatataaacatcaagatgcaaagttttgccaaaagcttatcttttacccattgggatttattagctactttaatttatacccagagcaatcatttggctagtgcgctggttgattattgtatgcccatttaatgagaaaagtgaaattcacctaaaaagctaaccaatatttatatggatcgtactgaaactttttgaagtcatttggagatttgattgatatgtagcgaactttcatcgtccaattctttttttttggggggtggggggggggggggggcntactgcaatcaaaagagtgtatagtgtactagtactagacagacaaaaaaatttttttggacaagatgaaatatgcgttaacaggatgtgctaatataagggtgcttagagagaaaaaaaagagtgtgtagtagacaaaccaaatgaaatatatatgtcgtacataattaaacacatctcttctccagtgcaagcgtcttctcagacaaatataatgtggtgagatttcaacataagctcctactaatcatcgatgcttcatcaaagcatcggtggctcatgacaaggaatttagcaccttcctatcctacaagagaaaacggtaccccctccgtttcataatgtaaatcattctagcatttcccacatttatattaatgttaatgtaaatgggaagtatttggcatgcttcacataagcatgcatctatatgggggcacttgcattggagataacctcggaacgccatgcatccaacaccgtctcaagacttggagatatctactccctccgtctttttaatagattatgtcattgattttcagtcttttcaataaataacaacgataacttttagatatatttttatcattcgtcttatttataaagttatgcatatataaaaaaatctaaattatacttaaaatatcgttaatgataaaacaagtgagataaataataattacataaatttttaataagattatgttgaaaaataaaagttgtagtctatataaaaaaaaagagaggcagtattgattattgggaatatctgcctatgtagtaccggctgcgtattgagttacattgttacatatgtaatgtttataggtatgcacacttggatttcatcactagtatgcgtcgagagcactatcagatagtactatcaactccttgtacggcagagatgtttcctactcaaacggatgtatttatccctcaaatcaatacatgttactcgacttggtttggggtgtgtttagttcacgccaaaattgaaagtttaagtgaaattaaaacgatgtgatgaaaaagttgaaagtttgtgtgtgtaagaaagttttgatgtgatggaaaagttgaaaatttaaagaaaaagttgagaactaaaccagaccttggttgaaccggactgaaccaagcaatctctcctcaatctcctccaagacccctaatgtgttggctacaagtacatttgcaacttttccaaaattttaatttttcctcaaatttttaaactgcacgttgtgcaacattctagctatcatcaccctaagtgcattgccatttgctaccatacatcatactctttcggtcgtaaaataaatatacctattacaggatgtgacatattctagtatcgtgaatttggacagtgtacgagatgcaaacattttggagtttgaaaatgtgaaaaatcattatattagtcttttcggtgatatgcgtgagataagtaaaaattgatatctttcagatgaagatagtagctgagatgacacatgagtcttcaagtctgcgttcgacggtccctctttctatcttccactcattcatttttttaagtacgcttttcgaagtactatattatatttttaataattttttattaaaaaattactttaaaaataaaattaatttattatttacaatatttacgactaattaatcatgtatctttactcccccgtcttataaaaaataaatctagtaggaggtgtgacacatcttgatactacaaatctttatagaagtctattcaggccttgtttaggtccaaagtttttttttccaaacttacaactttccatcacatcaaacctttcgtatacacataacttttcagtcacatcgtctccaatttcaaccaaatttcaaactttgggccgaactaaacatagcctcagattcatagcgatagaatgtgtcgtatcccgagctagttttgttcgaacatacagcctcatcttttcgcatatgttttgcttaccagccaaaatttgaattttcgaccttacatttggagttgattttgggttttttttatcgtagtttatttttcagcctatactcgctaagaacacgtatataaaagttttattcaccgattaattttcgtttgcaaactgaataaaacaaacaatgggcatagtctcaggactcaggagtggtcctggactcgtggtacgagtagtataaatgtgcctgtgaagcctgtagtacactagtacctctgtactagaccattaccccctcctttaattctctcgaactacgactagcttcgagctttcatcactcgtcagcttgagcgcccagcagctatcgtcagcttaaaattagcgccccagcttagcttctgagctgactcgagcttgaagacagattttggtcgcatttcagctaacacaaagcttaacacacgagctcttgtcagctgatcgatccggggttgaagagatattggttggtttctgtgagcttgaaagaaatcacttgctgttccaagcaatctcgttttctttattgtaatccaggatgactgatttttcctttttcagcagaaaaagaagaagaagaagaagaatcaagcttggtgcacggcgtcgccgccatggcggcattgcgcgtgggcacgagggcggtggaagggaggttccaagcgagcaacggcggcggcggcggtggcggcggcgccg

SEQ ID NO: 57879 - DNA, 3481 bp, Oryza sativa
gccgctcttttctagtggatccccctcactggcacaattggtttctgtgcctgcttgtggttcacgagattgatttactcatctgtgaagattgactaggcgcagagttgctatacatccggcttccaaaagttctgtatgattattgtggagaattgtgagacgaggatcagaatccactctgtattttaccgattttcgagaaaatttatatcgtagttcttagcttataaaccacttgtgttcattcactataaatgagatgatacatctttgatatgaagttatataaggctagttacgattgttagtttcgtatggcagagcatattattctcaattcttatggatctctgtataaattcattttattatatacgggaccgaatactactgttttctgatcattttttacccttccaagatagtatcaccagcagctgctttgctccggtttttctttgggtgagttgaaaagttgccatattgctgtgtgacgtacgtgtaatcagtcagtcagttattgcggtccacccaggggtcaacggtcaaccacgtatgtcgtggccagagaaaaccaatgcagaaggccgtctcctccgtcgccgtcgctgtcgccgccgtccgccggccaactcgtcgttgtcatctcccagcacttccggtatcatatatgagtgaggcttagtgcttctccctcctcaacgtcaccgccggccgactcgccgtcgtacgtgaggctttatggtgcgtggtggcggcggtggccgcgctgctcgccgcgccaccggtcgcagctgtgttcatccacgaattctacaaggtactgaatctgatacgctctacatggtatctgtctcctttggaattgatctgctgaacattaattggtctaatcttctgaattgtttgctttgtttcttgtgttcattttcacagggagatgaggttttggtgaagatgaacgagctgatgtccatcgagactcagatcacctactcgtactactcacttcccttctgtagacctgacaatctaactgaaagtgctccgactctttggcaacttctccatggtgatcgccaacagaggtccccttaccaggttagtcacacactgccacctgccagggttttatcttgggttctatcattttttttttgtctgtgaagatcttggattatcatttttggactgcgaattgatgatccaactttgcgttttcactgtagtttgaaatgagagtgcccaagaagtgccaaattgtctgcagagtgcttgttggagaaaaagaagcgaaggagctgacggagaagatggaagatgagtaccgtgtgaacatgtaaggattgtagaggttagatttacattttctaaaaacaccgcaaagtttgtgagagatttaatgaagttgaattacagggctcttgacaacctcccattaagtattccaatcagaaggatagataaagatgattttttctatcagcatgggtaccatattggtgtaattggccaattctttggagtgggttcatcttctcaaaactctttttttagatgaaagatcattatattgatcttctcaaactctttatttcgctaaaatctttagttaaaaagaccctcatgcataagcatttttccgcaggaggagcataagaggtacttcatccacaatcacttatcatttttggtgaggtacaagagggatatcgacacaagtgcttctacaatagtggcgtttgaggtcaaaccattcaggttttgccaactttgcttcccacattttattcagcatgaatgagtaccatctttaccgttcttctggttaatttccttttgtcccagtgttaagcaccaatatgaagcgcaatggaacggtgcaaactctcgtctgagcacatgtgatgctaatgccaacaggttcatcttatcctctgattctccaccggagattgaagtcggtgaagaaatcatattcacctatgatgttaactttgaggtggctttcatccttcccttttatcatcctttcacctgtaaattgtatcttctccctaaaacagacattaatcagatattaaacctttctctaatgatttatcacatgcttgtgctactgctgttacaggaaagtgatatcaagtgggcttctcgctgggatgcctacctgtcaatgacagatgatcaggctcgctggttttccattgttaactctcctgttaccctgattggtctttctgttgcaatggccatgactatgcttcgaagtctgcatagagatatctttagatacagccaacttgaaacccagaatgaggctcaagtggaaaccgggtggaagcttgttcatggagatgtgttccggcctccatccaaccctgtcttgctctgtgcctatgcagggagtggtgttcaactctttggtactcatcaccgtagccttcgctgcgctgggcttcttttctccatcaaattctgcaggcctgagaaatgttgtgttgctcacctgggtcctgatggggatgcttgctggctacacctcttctcgcctctataagatgttcaagagcggttcagagtggaagcatatcaccatggcaacagctatccagttcccgggtttcgcttttgttatcttcgcaatcttgaatactcttctacaagatgagaattcatcagccacagttcctccaaccacaatgtgtgccttggtcctcctctggtccggtatcacgccgcctctcgtgtttcttggaggatatcttgggtacaagagacctgccattgagcctccggtggagatcaacaaaactccacgaaagattcccaagcaagcatggtacatcagccctgtgttctccatcctcattggtagtatctttccatttacaattgttttcattgagctcttctttggcctcatcttcatctggtatcaccaattctaccgtggatttgggttcctcctcatcacgcttgttctactcctcgtcgcctgcgctgaaatctccgttgcgttttgctactatcaactgcgaagcggcaactacaagtggtggtggagatcattccttacaccaggatgttctgcagtctatctcttcttatatgcgacattcttcttcttcgcgaagctgagcattgttaagccagtgtcagtcatgttctactttggatacatgcttgtcgtctcatatgccttcttcctgcttacaggcacaattggtttcttctcttgtttcttcttcacgaggtttatttactcacagagggcatttggatgaacttgagattagaattttggaattggaattagaattctgctgtgattgtaactccagtttgttacagtcacctctgtgtcctggaacaggagagcttgtcaatggcaattccattccagttattccaagtcccagggataattttttttccaagctaaacatgagaatgatagtatagcatgtgtgctact

SEQ ID NO: 57880 - DNA, 1953 bp, Oryza sativa
gcaccttatatttcctgttcttccggggcactttctggatatgtttttatcaggtaggttgaccaatggcactcttgttcaagtgtaacggaaggttaagagctttggaaaatctggggcagacaaataatgattgtgatttttctgcaagattacaatttgaaacatagttgtctgaagaagaaaaaacttagaacacattgctgttgtactaacttatgacaattggtgatggtttcctggaaacccaagacataaaaccatcatcggaatttatttgacagatggactgtatcgtgcactttctgtgcattttgttttggttagagtgggcttttgtggagtagtctcttttcattagtgttgcatggttttatcctaaaactgaatgcatgtccttttatcctccagttgtatgttacattaattgttgttactgttatctcagctgtagataatgttgttccaccactggattgcactcttttaagtgcttctcctatagagggactaaagaagatcacttctgcgtgcagcaatctgaaggaaccatgtaagggttcaaccttctttatatgattcaaaggaattcatcacaacgttcttgttttgttttatgacatggtatttcaatatactaacattgacatggtcatatccatccacaaagttcagaaattcagtagttctatttttttaatgtttctctcttgaatgcgcagctacctaaagaagaatgagatatgatattatttctgaagcatgtaatgtgcattttagataaaattcagtaattcatgtactgatttgttgctactgtgcaggttctcagccaaggtcagtatctccatgcagtatgataagtgcacacctggttaatcgatctagttttgtacttttgtgagatgtcatcttgtgcattggcagattgtcatcatcctctgaccatcacgatggtgcagcttctgctaacccatacaaggaaccgcttggttgcaaaatacccccaccaaaaagcaacagtgtcaagaaacaaaatccaaatgtggaactcaataatggtattttccttccctactatcaaccggttatttataatagagctacttgttcaagtatatgaattgcaaatatgctttaaaaaaatgggaagtactccctccgtttcataatgtaagttcttctagcattgcccatatccatatagatgttaatgaatataaatatatatgtgtgtctagattcattaacatctatatgaatttgggcaatgctagaaagtcttacattatgaaacggaagaagtatgtgcattgtaaatatggcataaaaggggaacaatcatcgatggcatgtattggccttaacgagaacgcttagtctgttcaggaaatatttcttgcaaccaaaggtaaaattatttgcatgaaacattgatgtaaaagtaaaatttatcaacacgtaacttgtataaatgagattgatgcgcttgttatatattattcgaagtttgatttaatgaactattgcatttccttgcagaaatttcactttttgatttggtcagtgatgagggaccaaataataaatctactgcacgacctgcccgtgaagctcatgtttcgttttctgttaaaggtgcatgttccaagaacattgaatgcataatcatcatttcatctattattgttgtatgtaattttgatcttgctggcttgtatatttggtggggatattttacttctttgcactgttgattcatgctgaggatattttcaccgaaacaacattattctattaagatttgttttattcaggttttattggtcacatatagttcttgcaacttgtgatattgtaaacatgattctgttagaaatttgctattgaattggttgcacgtgtggctgtcatgaagtcattatcattgagtccattgcctttgccttcaat

SEQ ID NO: 57881 - DNA, 672 bp, Oryza sativa
catggcgcatgtcgatcttttttcccggttggtaacaccaaccaggacttaaaaatagatctttagtcccggttggtgtcaccaacagtgcctaaagataaaggaggggtctgacaccacctgccgtcttttaaaccgggactaaaaatgatctttagtcccggttgatgttaccaaccaggactaaagatcaaaaaatagctctaaccttttgaactgggactaaagatcatctttagtcccggtttttagtggaaccgggagtattgtggatttcggccgaccgaccaaagatggtttctccaccagtgtaacaagcctgaactagtttactacactgagtaatggaagccggcatgttatttgctggtataatgatttctagaatgaggttggtccaaagttaggaaccatgaataagcgtgtgtttgttcaacaaaagttgcaaatttcacgtttaagctagaagctcaacagtcgaggtggtgcccactaatatcatgtatatacaagtgagcttttaacaggattttagtaagatcagagatatgccgctggtttccatctcttaaacatgtgttagcgtgtaggtgtgagtgtggtgtttcgagtgtagtggtgtctgtacgtatgcgtctaccgtgtagttaaaaaaatgatgaagtaaaaaaa

SEQ ID NO: 57882 - DNA, 3214 bp, Oryza sativa
  unsure (1)..(3214): unsure at all n locations
cgccgtcgccgttcgtcgttgcgcgtgtcggaggagccggcacgagcaaggacgtggaaggggacttcggccgcgccctctccttcctcttccccggcccaaggccggagagatttctcccgcgccgtcggcctctcgtcacagcgcccctcctcacctcggtgatgcctccctccgttcttcctccttgctccatctcccccccttagtttttggtggtagcacgagtagcctccccgtagctagccggcgccgccccaaccgttgccgtcgcccgccgtgtgctcgccgccgtcgccgctcgagctccgtagcacccgctcgtcgccagcctcgctcggcgtagctccgcccaatccaacgctagcatcggattcccgtggccgcgtaggtgctctcaccgccgagaatcggcccctcgtgacctcgtcgctgtttccctcttccctccccgccggttgccgacgccgcgattcgccgccgtcaagcttcctccagcgaatccgagccgttggctcgtctcccctcgtctcgtgcaaccacccggtgtgctcgttttcgccggtatcgccgtggtccgctccgccgctcgccgctgttgtccgccgtccgttccggccggcgtcgtcgtctacctcccgccagcccacgtggcagccacgtagacgccacatcagcgccagctcagccgaggtcgggacgggccgaccccggtcagcccctccagtgcgcgcgttccaccgcgagccgtgaggctgcgcgtgggcccgccgcattcgttcctccgcagaccgcgcgcgtgcaccgngttccttccccgcccgcgcgcgtgcgccgcgtgctccctccgcacggtaagccgagccgctaacaagcgggtcccacccgggaccgcgcacggtgagcccggtccaccggcccactctctcctcccctcccgcgcgcgcgcttgggccgtcttgggccggccggcccatttagctcagccggactgccccatctctctcgggccgcgccctagccggccgaggaaaagtctaatttccatccctcttttattttcttttcttttcttttccaaaaaggatttaattaaatccttttcctttagaccaaaaatccaataatcttagaaattcaatatcttcccaaccataaatccgtttgactccgttcaacttccaaaattcctcaaatctcgagatctatctaatggcacgcttagaggcattaatagggctttattttcgccgtttgttgagttgccccgtttcgcgtgtagtttcggagcccgaagacccgcagtgcgaggatttcgaggatcaagctccagatctcgagcaaggcaagccacctttgaacatcttgagcctatatttgaaatttaattatgttgcttgcaaaatattatgcattgataggattgcacttaatctgttgtcccgtttgcaaggcagattggcggacctacctaacttgttgcatttgatccttccattgttaattgctataccatgtccccttgtaaccatccagttgcgcctcgatattcgtgcactctgtgcgagtatcgacggtcgccttcaaacttaaaatctaagtaacaacttgggtaaaactggagttttacaaaagacttggaaaacccgacacctgggtcggcgcttgcgaactaaatgaatttccaaaactgcggaccggggaacgtaccgggtgtacggtttttcccgctctcgcacttaaggaccgattccttgaaatttcatccaaacataagacaagtacgaccacatgggtggaatgggacacccctggctgagtaactagcttatcaggggagccttgatgtcgagagacatgtggattcgccggggtggtgtcggggaggacccctgggcttcctggcacagtatggtctgggacctaacctgttgttggtctgggacccctctcgtcggcatatggtaaacctgtatcggctttggaaatgccttgtcatgaaagcttggaggtctctcgacgtggctgatccccacgagctgggtgatccgggttagtaatgtcgtgtgggtaaagtgtaccccctctgcagaggttaacaaactgttcgaacagccgtgcccacggtcatgggcggatgtgaggtgattcctagcgtagtttgtttgactactgcttgtgaaattgctgttgtggaaaggggttcgatgtttgaaaaatctgcagctgatgggatcagctaggcccgggtggccgtttgaaagttataggcccgggtggccgtttgaaaagctgttggccgggtgccaaccttgttttaaattttaaagactgatacattgcacatactccgaccggacgagacgcactgtctcatccgtgtcgtttgagaagcactcacttagttgtttttagaaaagagttcaactaaaatcaattgcaaaaacaacagcctttccttgaagcctgcattaaacacttatttcccatggcttgctgagtactcccgtactcacccttgctctatataaataatcccccccccccagttgctgaagaagatgaagcggatcctgctgatgaggagttcttccaggagcaagccggctacgatgagttttagggtttcggcctagttcccaagtcgcgcctatgttgtttggtccaagtcctgcttccgtttcccttttgtaatgcagttgtgagctcgggatctgtccgcagcccaacatgactgtactcctactctataataaagagaccgctgttgctgtgatattctgtctccctgtgataccagcactgtttcctgggactggtatcgatcaacaggttaatttggagcgtcacgggctagttccggtcggtactagttcggggcgtgacacttattaagtgtaattgtaaaccatgtgttggtgcagctacccctgatttgtacaattatgggaacagatccaattaaagcgcaaccaaatcttcatcatacatagaagagtagagatacctcaagaatcaagatatataccaaaggaaccaccagcttgcattaggggaggaaaaaggtacatacttcagagagattcatcatatatacataccaacacacaatgatcgatttcaataattcgatgcacgggttgatctatctgcaacttatctgctgatggaagttgcatgatgagtaggaatgtgatgtgtcaggaaattcagg

SEQ ID NO: 57883 - DNA, 1760 bp, Oryza sativa
tccctcctgccttgagccaccaaaatgtggggtccacctgttagcatcatcctttttcttcggcttgagagccagcaaccgtttcccacatcacgacctctccggtgggcctccccgcttccacactcgggtctccaggtgcgtggacacagtcttgtaaaatcaaaggtgtttttgattattattttgtgatgaacaattgggcattggagattattggttttgttatttggaatttattcacgaagtggttttgaagatgattggatttcacatgtgatcgcaggattcgtcattttatgtgatcggtcagaccgggctctggtagccggtcagaccgacgtgtaatgcgcggtcagaccggccgacactgtgtcggtttcaattttgggttgtttatttggatatccgaatttattttatgattatgacttctagatggatactatacgtatgtaatactattgtttgctgctgatgagtcaacttggagatagcttggtctcggaatatggtttctttgtttgttccatgtgtaggtgactcgatgtctcaggggagtatttgcggtgatggaccgggagtcggcttggggataagacgacgtccgtggtggtcagagatcatgcgagatacttaggctagagttgatgcacgtggttgatggagattttatatggcatacgatggagttattgtgtgcgtatgggatgcggagtcaaatttagaaggagtccaaatatggtacgattggttatgtaaagtttctttcttgtactagagggtttcctaaggtgtttaggactcctagtatgagtttggttcgtggctttaggctgcctacctcgggtataaatagagagggagcgtgaggcttcccggtatcgcttttgagagcaattgagttgagttttgagttagggtttcgagtttagtcgaaatttttgtaaggagtgctgttggtgcactttgtaaacacagaaagaatcaataaagtcgtcatcaactttaagagttctttgatttgtgtttccccgggtttcggcggtctaaccggcaactcaccgacggtcagaccggcggcattgcggcggtcagaccggcgggagcatggcggtcagaccggcggcggcgacaggcgcggcaggtgatctcggcggtcagaccggagattcatcaccggtcagaccggcggcatccactcggtcagacaggcagatcaatctcggtcagaccgacttccatcaatttcgagggtaacttttatttccgctaaaagttttcggtttttgggtataccaaccattcaccctccctctggttggcttagttcttatgattcgatcctacaagtctcctccacttgtccacctttagccccaccactctcccgcaaatcatacatcgtcaaagccgcatctcacttatgttgtacctatcgttggctcacctatcgcctctccccgccccaatccagtttctcgagggtataaatagcctcgccatactcctctatcttgttttccacatttcaaaagtttagtgcttttatgctaaagacggagttaaaagaccaaggtttatacctcagttgcgttttacttgtggagtgaaggtgaagttccagtaggatcgtcctttttcactgttgctttgttttttctttatgaggactaagtatttattctgtaagtatttacgtttgaatatgtatattaatttgtcattttgtgtatccgggtaccgagctcgaattcgcc

SEQ ID NO: 57884 - DNA, 42603 bp, Oryza sativa
atgtcaccaaaaatgtcacggggaaatgtcactgaatctgcgtccgtgaacacgtgtgagttcatgtgtgcagcgtgcgtacaccgagttgacagtggtggggggattgtcgagcgcacacacctagtcacatgtatcgggagcacgagagggcgggagcggcgtcgcgcgtggcagacgcgacgacaataagtaacgctctcgcgtcctcttcatgcaaacttgagacggaatcgcgacctcctaatcacgacaaaggtgatctaatcctgtaattcttttggctgtagttataccaacgcaaaaaaaagctgtaaacaatatattattttcttattaaggatgtgttcatttggaattgttaatccttctcccagcatgtaaaatggaacaatagatcaatatatgattaattaaatattagctaaaataactttaaaaaataatcaatataattttttaagcaattttactgtatatttttttaaaaagaaaatactccatttaacaatttggaaaacatacgtgtgaaaaaaagaaagtagaagtttggaaagtgtattatagaacacaatcttaagacttggtaagacttaagactttagcactaactcatgattgtcttgatatcttctgcatgctttctaactattccctccatctcataatataaggcatgatcaaatttggcacagtcttcaaaatacttaattaggctgtgtttagttcctgaaaagagttggaagtttggggaaagttggaagtttggaaaaaaaaagttggaagtttacatgtgtagaaaagttttggatgtgatgtgatgtgatggaaagttacaagtttagagtagttggggatgaactaaacacggtcttaatcatgcaataatatgagcttcgttttgcgtgtcggggaggaacccctcctcccgaatacaacctagctaagtgagcctaaatattgtttagggtgtaaagcataccaacacaatagttcggggttgcaaattagacttttttttcttaattttaaacagatttcgctgctttaattattttagcggatgatctggtggcacgctttcatcgacgctagttaatcgatctgtacttccatggacactccggcggccgccgactggtcggagcttccggccgacgtgctcggcctcgtcctcctcgagctcgagttccccgacctgttccgctccgccgccgtctgcaagctctggcgcgccaccgcccgcgacatacgccgcctcggcctctactcccgcgcgcagacgccctgcctcctctacaccaccgccgccgccggcccgcgcgccgccgtgctctacagcctcgccgacaagacgacgtcctacacggtccccctcccggacccgcccatcgcggagcgccacatcgtcgggtcatcccacggctggctcgtcaccgccgaccaccgctccgagctccacctcctcaacccggccacaggcgagcagctcgacctcccacccgtcgccaccatcgaacacgtaaggccactctacgacgacgccgggaacctcaacaactacaagttggtctactacgacggcggcggcaacagtcaccggagcaacgacgatgacatgcacacggtgacgcacccgccggagacgttcagggagttcttgtatctcaaagccgtcatctcctccgacccatcgcgcggcgacgactacacggtgatgctcatccatcacccatatcttcagctctccttcgcgagatccggcgacaagaagtggacatggatcaagatggggaacaatgagtgtgagtggttcgaagattgcatctaccacgacggcgtgttctacgcccagaccgttcacggcgccatccacgccattgatgtcgtcagtgcttcttcctccttcacccatagactgattctcaagccgaccatgggtgaattgggcaccctctacattgtacgtaccacggaaggtgacatcctgcaggtcttgcgagtcacggaagaagatgaaggtagcgagcataaggacgtacgaacaactgaaatcggggtgtacaaggttgactacaagaagcaagatcttgatgacgtcgatgacataggtaacaatgcattgtttattggcactagttactcgatgtgcttgccagtgaaggattatccacacttgatgccaaatcacatatatttcgacgatgactacgggtacttggttcaccgtaaacatcttcgtcgggacgttggagtttatgattatacgaatgacactgcgatcgatgtggagtatcctcagccgtggctgaattggccactagctccagtttggattactccaagttttactaaaactgcaaaatatagttgactatataaatgcgtgtaatgttaccctttgtgtacatttttttagtaaattttataaaactattgatactttaactaaattatcacaaaactgcagatttataatgatgtatcataaaactacttcgttttgttccttattaagtgatgtttcggacaatgttgaggtcaaacttttataattttgactatcaataactttaaaaatatttagtttaaaggaactagaacaacatatataaatttatcttttaaagtactataataaaagtaaacatacatttatttattatatatattatagtagaaaaataagatcaaacatatatcttgtagaccgtgtcattgtctaaaacgccaatcaaaatgaaaccggagggagtacagctttaataataaatttatcacaaaactacaaaactacaggtttaacactactagaaaaacaatttttttatggcattaccctataattgtcgctggtggctatatgtaaaaaccgctagcaaaaacataacgaggggtggggggttatggactaccagcgaaaaccgattttcacgggtggtcatgataagaggtcgaccataaaaaataactctattttttgaggcggatctcttaagtatccgcattttcgctggtagtaggtaaagagtactgctgcaaaaaaaaatttcgaggcgaatatataatcccaccgaagatctcagtctttccaccccacctacccttctccatctccctcctatcttcttacccttctccaaatccactcttccatcctcctccctccccaccgaggcgcaggcgacggcggctccggcagcggcaaaggggatgggtggcggcggtgaccgggctcggcggcggccagtctcggcgacgacgacacgtgggcgatggatccggcggcgggctctccttgtcctcctccctcctccaccgctgccagttgccgtcgccaccaccgctgcgggctgccatcgcctctaccgcctctccgccgcgagctcagggccggccggatccggctgccgcgacgtcgggggtggccggatccgctgccgcgtcgacgggggaggccggagccaccaccaccacgacgggggaggtcggatccgccgccgggtcaacaggggaggccggagccgccgccaccacgacgggggaggttggatccgccgccgcgatgacaacgtgaccgctgctgggccgcaggcggcggatccggtcgtgacgagctcctccccgtagagggtgacgagatcggcgtattgggattggaattgtgggttggaggattgggattggggattttagggttttttttttttttgcaggaatgtgaaatgtgatttttcggtttgtaagttcatttgttcttgatttctctctaccgttctctgcttgcttttctttctcctagagatcgatcgataattatttgagctcttatggtgcatgtgattgtttatgccagcaaaaagagcatgggtaagtatctgtggaaatttttgaatggtggagcgttgacggggctgacggagcgccgcttttttttttttgaaactttgcagtattaacactggcggctcacagtgtaaccagccagcgataattcattttccctagtggcctatcttaggctaaacgccagcgaaaatagatctttgctggcggctggcttaagacgaccaccagcgaaaatgaattatcgctggcgttcgataactgctagcgaagatcttgatttttattggcctttgtttgtggcggctccaaattccgccagcgaaagccaaaatggccgccatgaaagatggttttcgtagtagtgtaaggctaagtatcacaaaactaaaaatttaataataaaattaccacaaaactgtagagtttggggtttaaacccttagcactaatgttatggttaagttataaactttcaagttttgtgattgaattgatgttaaacttgtagttttgtgataaaatttgttattaaatctgtagttttgtgatactccaccttaaatttgtagttttatgataaatttgatgttaaaactatagttttatgattcatatataacttaaattagtttagtgaaatttactctcttttttgttgatactcaaattgaagcatcagaattctctggccatttgattaatcgatttggatggaaactttaatttgatatccgatttgtcctccaatatatcaacaaaccagagtgctataatatgctattatatggattctttttcctcgttttgctatttttgttttgagtaaaatgtagggcggtccttaaacttgtaggagtgtgtcatttaggtccctaaactcttaaaatgcatatacaagtcccagaacttgtcatagtgtgtcatctaggtcccaaatgaccacagccccttcaggatattacgtggcgttgatgtgacatgccacacggacatgacatggcattattttaaccgacaaatgggacccatttaatttctctttctttttcttttttttcttctcatttttttccctttcttctcttttctatgtgatccgtgtagaagaaagggaaaaaaaagaatgagaagaaaacaaaaagaaaaataaaagaagaaaaaaaaagagaaaaagacacgccacgtccacgtggcattgccacatcagcgccacgtaggatcctagaagggatgtgtcaatttgggatctagatgatacactttgataagttatgtgacttggatatgtattttaagagtttacggacctatatgacacaaccctacaagtttaaggaccgctaatgcattttactcttttgttgtctactccctccgtttctaaatatttgacaccgttgactttttagaacatatttgaccattcgtcttattgaaaaacttttgtgaaatatgtaaaactatatgtatacatataaatatatttaacaatgaattaaatgataggaaaagaattaataattacttaaattttttaaataagacgaacggtcaaacatatttaaaaaaagtcgatggcgtcaaatatttataaacggagggagtattgactaacgaccgacaactttttaaatctatgaattttgtactccctcctttttatattgtaagatggtttgccctcatctagatttaatagcatcaatataattttatatacatcttatcttaactacttacaaaattgataactttccattagtacactgctggagaaacccacaatagtctcggtttgcaaccccctttagtcccatgttgaccacgaatccaggtctaaagatgcgatctttagtcccgattggtgtgttaccaactgggactagcgctaccttctttagttttttcattgttttttgttgtttgcatattgattttgaactaaactcaacaataaaatcatccacgttcatagaaacataaaaaaatcatccacaaattcagagatcgaatcaacatactcaaattgttataaaaaattcacatcacaaatttacagatgcaaaaacatcacaaatcatccacttgtctacgccggagaaaaagtcgcgcaggcccacggcgccaggccaccttcgctcgctcctcgctgttgctgctacaagaaaaggagaggataagagagaggagagaggaggaaagggaggaggaggaaaagggaggaggagtttgtaatcgagaaggagaggataaatgtgagggattatatcccacacgttgatttagtcccggttggtaatatcaaccgggacaaaagatagtaggggttagacgttttttgatccgggactaaaatgatctttagttctagttaatgttgttgggcttttcaaccggaaaaaaaaagatgtttagttcctgttcctattggaatgggactaatatgatttttggctgacccagtagtggtaacaccttatttttgtctgtcaatcgtccgattctcaatctctccataatagccgactcgggaacgacgagatccggctgttgataaaaactacttcagtttatcccgaattcgttgggatgggaactgagccgaaatccacgggatttagcgcaagattgatggagctttcttgaggaaattgtagaggagattgggaggaacctattataatatccaatttagaaaggggagcaaaggggaggtgggattggaaggagaggcagcgccggcttcgcacgggcacaggggttcggtctggaggagcgagcgggaagaagacggcaatgtggcacgtgggccccgagcgatagagagagaggagggaccgagggaggctcctagacttgctctgctgctgctgtgccgaaggggaaaggaagaaagcaaacaggccgaaaggaggaggagacaaattagacttgaccggagagaaggcaagcctgctggagagagggacagaaaaacagacttcactggaattggtccaagaaggagggaggattttaattacttttccatttaaattaatcactgaaatgatctttgaattttcaaaaacacttaaaatgcttaaataattccaagaaaaatcaagaaaatagttggacactcaaaagtatttaaaaaaatatttatctagatcatttaatgattaataattgtttaaataattattgaattattctttgtattgttaaaattaataaaagaaaatttcagagagtataattaattatggagaatttaataatgattaaatccagccatgttttaattaggaaattgtatttctcacattaaacttcacttgtaaattagtgaacaaaatccacaatcccttgtgagaaggaaaataatattgacttggacattcatttatgttcttcaagggactacatgaatggaaatgatgccggaggaaccagtagcaaattgaatgatagggcagaggtgtctagtaaggacaaaactagtgtttcggagctggaggatggaaatgtttgttcccatcatgggattgaagagcctaatgaagaatcaatgcaaggcattgtaatggaacaagaagaattaagtgattcagaggaagatagccagcatgtcgaatttgaacgtgaggaaatggatgattctgatgaggaccaagttcaaggtgtcgaccccttgctggctcaaaacaaggtaatattgcagtttagcacatatctgttattctagtatcattttactgttcatttctggatgtagaattctactgatttccccattctctagaatgatttcaccaatggcttttaacatatctattgcactctgttgcttatatcatggaaggttacctttgtatgattgcttttgcaatttcttggacttacctgaataaaaaagtgaagcatcacattgtcacatgttcaatcaataattggtgacaacgctgcaattttccctgaaagatctcatgtttgaacctttcttctatgaattaatgcttgcaatatgttctttctcctcttccttttgacatgctgataggctgatagctatagatgtttccttgtgcaggaggtttcaacatcagtgggttgtggggagtatgaaggtagtaataatcagagccagaaccaacaaatggtgtgtttagttcacaccaaaattgaaagtttgattgaaattggaacgatgtgacggaaaagttggaagtttgtgtgtgtagaaaagttttaatgtgatggaaaagttgaaagtttgaagaaaaaatttggaactaaactcaggcctacaggtgagtaaacagggtgcagcaacgcagaaaccacagaggctttctaatgccacaccagcaagagaaaagctgaagggggataatgcgaaacgtataggatctagaacaagcccacgatcatccacgtcccctacaactgaacctaaccaaacgaaaaccagaaggcctaaagctcagcaggtacagattggtgccgagcgcaagtccagtgattcaagaagaagcagaaaaaaacctgctccaatttccagcatcttgtctcatttgcacatcggctacctgtttgcctggccgcaatattctccagatgatagcacggcaatctgctgtcattcgcatttctgtgaacggagcagcaagatcaacattcgaaggtgagaccttgcaagtacatgtccactgttgaatagcaactaagcaagactgaagtggtgttccttgcttcacctctgacaccattgacacattagcctgccattgagtagttaattgcttttgattgacttgactgagtttgtgtcctctccactctccaggaaagtctcagcgagtcatgtgttgtgttacagcttgtaacatgagccaatgtgttaatgtttctgtaaagttggcgtagcgccatggccattgacgctataatgttagtaatgttgattagtgcatggcttatttggttgcacatccatttttcctaccatcacatatcttcaacctgtactgcttgttatttagatagctcactccaattacatattgcaagcttgtaaatatttttcaagaaggcatttcattccttaaaacatttttccccaacggaaaccgttggccggaattgatttcgccttatttgtagagaaatagcatacacagaacagaatgtactgatgtatatacgagggttaacgacgttgtgaaaccgctaatggttagtttgtgaaaactgatacagtatgttttagctgttttttttacggtttttactggtttttggtaaaatggtgaggagcggtttttaatttaaaacggaaaggtaaaccctgggagtacaattcagtcgttcaaagaaacagaaaaaaaatcatcagtgcctcagaggcagaaatcacctgtaatatgtgtataatcattgttgtatgtgtgaagtatatatttccctatttttggcatagctaaattaatcctttattacacaaaatctatggccgtccagcgtaattatgcactcctgtccactcgtccaacaacaacctgctaaatttgcgtcttgcaaagatcacctgttcatataatactctgcagggctcccctctgaaaaaagttgagatttcagacaattaacatcactaggagagaaatcaagaaacaagctagccagcaatggtgtctctccgcgcggccatcgtcctcgtcgtcgccgcctcgtcggtcgccgtcgccttctctcgtacgccacgcaccccgaaactaattgcatcgatcgatcgatcagcaatggcgaatggcgattgaattgatttggatggatgcagatgcggaagggaacgaggggccggacttcacctacatcgaaggcgccatggacgggccgtcgaactgggggaagctgagcccggagtacaggatgtgcggcgaggggaggtcgcagtcgccgatcgacatcaacaccaagaccgtcgtcccgcgctcggacctcgacacgctggaccgcaactacaacgccgtgaacgccaccatcgtcaacaacggcaaggacatcaccatgaagttccacggcgaggtcggccaggtgatcatcgccgggaagccgtacaggttccaggcgatccactggcacgcgccgtcggagcacaccatcaacggcaggcgcttcccgctcgagctccacctcgtccacaagtccgacgccgacggcggcctcgccgtcatctccgtcctctacaagctcggcgccccggactccttctacctccagttcaaggaccacctcgccgagctcggcgccgacgagtgcgacttcagcaaggaggaggcccacgtcgccgccgggctggtgcagatgaggtcgctgcagaagcgcacggggagctacttccggtacggcggctcgctgacgacgccgccgtgcggcgagaacgtggtgtggagcgtgctcgggaaggtgagggagatcagccaggagcagctgcacctgctcatgtcgccattgccgaccaaggacgccaggccggcgcagccgctcaatggcagggccgtcttctactacaacccgccgggcagcgccgtctccttccaggaattcgccaagtgattctttcttttttttttctttcttttttttttggttttttgtatttgatgttgagttgatttgattaacatttcgacgtatgatatgcactatatataattaattaacatcgcaaaatactttttttttcgagaatacataaagggctcgcgtatctttgtattaactagtgggggtggggattaattactatatgcttggacatttttccgttcttcaagattgacgcatcgatcgataaatgtatatatttgtagctaagaaggggtaaatatactaggagagaatacactctattgtcattgagtttgtctctgtcaacgatttgctactgacattgtatgtttctatcagcgatttatcaattgtttgctaggttttcccccgttgttctactcttccgtgtcaaagagtgcatgtcagattaagcagaaccaccagctaatccccttcgatgcgcagccaccgcgccgcaccaccggccggggcttgagatgggaattgaagcacgacggagatcgagactcttctactttcaagatatgatggtatagtcttacataggtgtaggatcgaacagtaagaactaattcaagcagaggaggggtgaatggttgtagtaccaaaaaaacaaaacttttagcggaattaaaagttaccctcgaatcgatgtcgatcggtctgactggaatagatctgccggtctgaccacatcgatgccaccggtctgaccagtatagatcgcccgatctcaccgcccgaagatgccgaagtcgcctgtcgccgccaccagtctgaccaccgtgtactcgctggtatgaccggtacaaagccgtcggtctgaccagtggtgtctcgccggttggaccgccgaacccgagcaaacataaattgaagaactctcaaagtaaatgacaactttattacttatctctgtgtttacaaagtgtagcaacagcactcctcacgaaaatctcgactaaactcgaaaccctaactattctctcaactcaatgctctcaaaagcgataccgagaggccacacctccctctctatttatgcatgaggtagacagcctaaagccacaaaccaaacttatacaagaagtcctaatccacctaggaaaccttcccatacaagaaaccaactttataaactccaattgcaccaaatttgaactccttccaaattcgactccgcatcacatagacacacaatatctccattgtatgccatatagaatcttcaccaaccacgtgcattgatctttagcctaagtatctcgcatgatatctgatcatccggacatcaccttatctccaagttgactcccgatccatcaccggcaacactctcccgaggcgtcaagattacctacacatgaatcaactaagaaaccatattccaagaacaagctatctccaacttgactcattgttagcaaacaacagtattacatacgcatagtatccatctagaagtcataaacacatataatccacggatatccaatgaaacaacccgaaaccgaaaccgacacagagtcggtcggtcagaccactggctggccggtttaaccgcatgcatagcttcagtctgaccggcagcacctgccaggtctgactggaccaaacatccagcagcacctgttcatcacctgcaaattcaataatctccaaaaccacttcgccaataatctccaaatatcaaaatcaataatctcatatgccaattattcatcacaaaataagaatcaaatacactttgattttacaataggtgctcatagagataaagtatgtgtgtactcatagtaggtgagtgcacacgcgttatatgtgtctgcatttgtactatctttctaaaaaaaggagagtgtatatgtggcgtgcacatctttcgtgtaattgagagagaacaaacaatataggaataagtacacttgaggccccttaacttgttaatgaattcgattttcgtcctccaaccagaaaaccagatacaacaggtttctcaattgtcaaaatcagtgccgataactagataaggtccctcgatggtttgcacgacagttttggttgacgtggcgtctatgtggctaatttgattcggtcttcatctgacgtggcgtttacatgacaattcgatctaagaaaaataataaacctcgtgggatccacatgccagtttcacacaaattaataaaaaaatagtgggacccatgtgggccagcccacataattattctcagccctcctcttcttcctcctctctcggtctctctacataatattattaatttgtgtgcgaaactgcatgtgggtcccacggggtttattatttttcttagatcgaattgccacgtcaatgacacgttagatgaagacagagtcaaattagccacgtaggtgccacgtcagccaaaactaccatccaatctgccgagggacctcatgtgcactggttttgacaattgagggacacgttctatctggttttccggttggagcacaaaaattggattggtcgacaagttaagggacctcaggtgaacttatttccaacaaattgtaaatgggccgagtagagccagcccagcggctactggccttggtccaccttggctatatatatgaatgggcctcagattcctcggcccaggcggtacacgagcaaagcgaggcgattcttcttcttcttcttctctggtggtgtggtcgggaagctaaacccgggagaagccgcagcgcagcgagggtgacgaggaggaagacgaggggagagagagagagagagagggaagcagcattggggttcgtcgcctccagatctccgtctccgatccggcgactgagctctcgatcgcctcctcctccccgccggcaaccgccgcctgctctgggttcgccatcgatgcatgcaccctgctttaatttactcctcgttcgttgctctctctctctctcttatcccctatcgattcgattccttcgagttgatgagcaggtcccctccgcgatcgatgccatggatgtgaagggtcgctccgcctccgcgcccgcatcgccgtgcgtcgtgctcggggacgacgccgccgatgccgcagcggtgcgtgtgtcctcttcctcttcctcttcctgcctctggttcgattggtttgcgattcgatgcgctcgtgctcctagttttgcttttgcgctcaagagagtttttgtctgggtagtaagtagtaaccaccgcctaattaactactcctactagttaattgatgattggatgatgccgcgtgttacatagctgcctgttcaatttcgatcaatacaaaaactcgtccgtgctgtgatttttttttttaatttcattctgtttctctgcctattgagcaagacattgttactagaggtgttatggtttgattttgttttttcttcacaggttgccaaagttgatcggaaatatgggagtatgctcaatgctgggagtccactccaaattctttacacagatcagttagctgatgcgaaaggtggtcttaaggttagtttcctcactcagttgttattgttgtttcattacaatatctgcctccttggcacctgtatcttgtggggagaagaaaaatgagaaattatgctttctggaagtgaatcgagtttgtgaccagacattttgtatttttggcccttcccagtcacacgccttctgaaggtggttgatattgtgatctgcaacaacaatatatgacattcttctgtcctctttttttattcaggcaaatgcaccatgtgaaataacttctgttacagaatgcacctgccctctagaactacaaggcatgttgaaggaggaatgtgttgatcagtacaagctactatctgacaggctgcttgccaaggtaaggttttatacttattcacacatatgcttaatctatttgagcttcacgggttgtttcagcagtaattttcttgctatatattgaaatcttaagactagatcggcttgtgaaaaccagaactcttaggaatgacaacaaaaatatttttcagatagttcccaaggttgcaagagtcaagaaaccagtttccagttcagaggtatatgcagagtttggtgtttctgcatattcaaaatatggtacaagaacagtgagtacatcattgagaggtaagcccttttcccttagctattgaagtggctatgactgctgaacttttaagtatgttttgaggctttttttatgatttgtcatatatgtttgctagtggttagctacttagctgtgtgacacatttgcagttttaactcgatgtattcaatttaaggggtgcttgttaccattgctgaagaaaaatcactgcaaatagttcactactgttctaattcttgctgactgtatctactttaccttatgagttatgattagttgataatgatacaattctagtgtttttctaacttttagatattatttaactagattagcatttttgcttatttcctctaaatgtgtttctctttccatgtttttcagttcttaaactgagtcagatgtgggttttattcctggtgatccttctcttagtctgtcctgtctattcattaacacatgatggaagtgcagagattggtacttgtcggtttgacaaaacgagtgttgctgcactctcttgcaaacagcctgatgggaaatggaggccaccctcagtgacatgttgtaatgcattgctgaatgcaattgatcatttgccagctagcaatgagagcggagtgtgctgtctgtgtcgctatttgcaactaagataccctaatgatgggcatggattggtatcatcttatgttctatgccagggaaaggataggcatattgtcactacatggtcttcttttccaatcacatcatgttatacaggtatacatttcatttctgttacctttactattccatcttaagatctggagtaaattaaagtctctaaatatttttctgtcttgttttaatcagtatgcaggcaggaaaaaacttcatcgagtggtatgagtaaccctgtccagaaggatcatcctgtgagaaatgcacatggaactggcaatgaggtcttcaagatcccttggatatttggttcagtggcattctgtgtgatattacttattttcctttggtacctgtggtggtctaaggcagcatcaaatgcatgccaactgcagtcccttcccctgaaccgaaattggaggctgtcatcagatggtggtccatgggctgagcgcaggcgatcctctgggaggcgttcatcggcacaactgaaggagcgcaggatgtcatattcataaacttccctgaacagttggaaggattggaatatctggttctaaacaagttcattcttctttcttgacgggcagtgctttaattgttggtatgatatgcattgttgaggatgtgatggtgtttttgtctcaaggattgcacatacgtgaacatagcaattcacaactgctattgcttaggagttctgatatgccaaagaatgttgtctgaatataatggccatgtttaagtgcagtaagtctgtgacattgtacatcagttatactgtctaaaacctaacaatgaggagttccagaccagtgcacaaagatacttgctacttttttttgcgtgtgtgtggaaactactcactttgtcaacatgccctggccttaaagccaaagttcatggcttggatgtcaaaaacaagcttaaatgatctgacagctctattccctagcatttggacccctcggacacctgcatcatccggcagaaaagtggagcaaattacattgtttgagctttcatagaatgcattttccactggcagcttcaaggtagacctgataagtttcatctccactgttggaaagtcattccagtttgctgagccactgtttgaaatgaagcaaatcctcctttcatcccatcctctggtatatcccttggcttgcatttccttcgtcatcgctttgtccagtgcatcaaacaccggggataaaatgtatgtatcagcagtgccagaatcaacaattgtcatcttggatatatagatatatggatcaatttcaagcctgattccattgaccatcatatcaagctgctgaatagcatatgctggtttatgatcgtagtagatcaattttgtccacataagattgatatctctggcatatggcccaatggtcagtgacccttcattctcatgatctctggggaagcagtaagaaaacgcggtataatctgtctgctgacatacctggttgaagaatgagtaacttttagtcccaaaaccaattatcccagcattgactccattgtaaagattatcttctccacagccaaagatgaaattatcaatgcttctgttgctggcaagagtgagcctgtctttccctaagtacccaactgaatactctcctgacccatatcttaagctgtagatacaagtatcatcctcttctacacacccatactcaacagcaagatccatgtgcatgccattgcaagcctcagttgagcacccaactttactgtaagttgaagaattgtaagggttgaatatttgtccagcttttgcagcttggtcatagcattttatctgacaatttttacactgaacccaggagagagttgagccggtgtcaatggtcacaagattgaagacaggtggtgtgccaaggctgatgcccatgaaatacttgttcttgcgcatgctatcatcgcctatgacggtggaggagtctgcaggtatgtttgctggctggatcattgtagatatgaaggaattgtttatgtggaacacagagaatgtaaaggctccattcgtgtttaaaccaatacctgtgttgttcaggagaaaaacagtgtttcatgaatcaagaacaagaacacataagtatgatgtgttaagaatgtttggcttaccaatattaatgcaaggactacaggtaaactaccatgacatagttgcaaaagaagtacttaatcttggtttgttgatggtttttatatgttgcctcgtgtcataagtgtgtttatttttcatgattccatatttaatacgaaaaatccatacctaaccgaattgcattctgatggaatagaatacccatgcaaattgcaaaataaaactaccttgcacatcaggtttacaagatcacttctgacagcaaaagaaaaaaaattagtatttcacctgccaagcttttttgggggaaaaaaaagatggcactttggtatggcattccaacgtaaagcagagctttcttagcttcgattgtgagcataattaacagattagatgaaaaaaaaggaatgacgagcgcattttctagaagccatagcatcatatagcagtaaaatttgaaacttcatttctgagttgattttttgctttactcatcatagtcaagttttcagcattggcttttaaactgctaataatatggatatagaagttctgcccatagcttaaacgatcatagcataatacagttgaaattaaaaaattaaaagtcattaaccacacatttgactgaattttgtataacatacaaatcgcggccacccatgtatacgtttttcatgtaatcgggggaaaaaaaacggaaacatgattaccgtaggttgatgaggaggctggactagtaatgctcatgcacagtcgaattgtgcaccatagcgaaatcaccatgacagccaagaacagctccatcaactatgtcgatcttcacaaagtctaagctaggtgctgagtaataaaatgaaatgtctctaattctcctatttattatatgggttttaattaacacatgctgcctgacaatatgcatgctccaactaccaacaataacagatatttcatcacgatgaatatgctatttctttttttttctcccctagaaatccacttaatttctctactgtttggctgacatgtgggcccaacaggcaaaacccttcctgttctatctcattctcatcgtcctggattaattaatccaacccgaaaatgaatcggattaggatccaacgaacccgaagaagaatcggattaggattcaacgaggcagatttaaagccaaagcgatcgaatttctctacagagattgctcgatcgatcgatcgatgatggctcgccacatcttggcggcggcggcggcgacggcgctggtgttgctatgctgttttcatctgccggcgacggcgatgatggcggataccatcaggtacgggccaccgagggtgccccaccggctgggcaccgtcatcgccgtcgacctcggcaacaccaactcctgcgtcgccggctacggcgacgaggctgatgcgccgccgctgttccggctctgcatccccacctcggtcgccttcaccggcgacggcgacgccctcgtcggcgaggctgccaagaaccaccccgccgccatctccggcttcaagcgcctcctcgggacgaggtttggctcgccggaggtgcggcgagctgccgagcacctgccgtacaagatcgtcgactggtgcacgatggctcacatcgaggtgaacgccggcgccggcggcgcggcgaggagcgtgtacgcctccgacgtggcctccatggtgatcgccgagctgaaggctcgcgccgaggctcgcctcgccggcggcgggaagaaggtccacaacgccgtcgtcaccgtcccctactacttctccgacggcccacgtgaggcggccatgaacgccgccaggatggccggcctgacaaccgtccggatcatcgacgagcccaccgccgccgccgtctcccacggcctccaccacggccgcctgcgcgacggcggcaacgtcctcgtcctccacgtcggcggcggcacctccgccgctaccgtcctcacctacgacaacgccgtcttcgaggccgtcgcgtcgcgccacgacgcccacctcggcggcgatgacttcgacgccaggatcgccggccgcttctcccagctcatcaagcgcgaccacggcggcggcgtcgacgacatcgcccccgcgaagctgaagtcgcagtgcgagctcgccaagaggacgctgagcagccacgacgtcgcccaggtgaacctccacgccaccaacctcgccaatggcgccttctccttctccgggtcactgacgagggcgcagttcgaggagctcaaccacgacctgttcgagaaggtcatctccctcgtggacgcggcaatggcggaggccagacgcgcggtggcggggttcgacgtgatcgatgaggtggttctcgtcggtggaagcacaaagattccgaggattcgagagctcatcaagaactacttcgccgggaaggaggcgacggtgaaggcgacggcgagcattggcggcggggcggtggtggtggtggagcctgaggaagctgtcgtccatggcggtgggcttctgagccatcccatggaggatggctaccattgcatgggagccggtggtcgccgtcagatagggtcgccaatggatcgctgttaccatgaattttagctgaatttgaaatttagactctcttgtgtacaactactgttgtattaatcgttgatataagagatgtagtgacataatagatgctctcttcgtttcaaattaattgttctaactttatcctaaatacttctatcaatttttaaaaattcagattcattggagagctatacctgtaggcccaaaacagtccgaagttattttttatggaagtatcgtttggtagtggtaaataattcaacaacatatgaattatatgttatacaaaaatatttctcaagctgaatctaaaaattgtatgaatatttacaaatttatagtcaaaggctctctttggcatagttcttcgagttgggtgttgctagctcaataaatcaatgaatctagatttgcgattacaatgataacgttaagataaattattttgattctattttaaatgaaatttaaaatttctaaacatctggtgacaatattttggcctgaattcactcggatttgtttccctcggattagtctctgcatgaattaattagcagttgtgatacgtttccttcccacgcacgcatgcggccagcaacatataatctagcttggcccaaaattgatgagtacacacatcatgtgtcgatgcggctaggtgaagagattaaagaaattacaaataaaaattgtgtcactgcgggaatcccacgaccttcacgtcgcacacacatacctttcctactcaggtacaagcgtttcttatatttagatgagacttgcgtgctagttatattacagtaattacagtatatttatattgtagttacattcgtgtgattttaatgaaaaaattgttaggtgatatataggtagtgatttaaagatatgccaaacagggtcaaagatatgagtgtttaatttaggataaaattaaaacgataagtaatttaaaacaaagagaacataaattatgttgtgaacggctgattcgagcattagtttcatgcagtgagacttacattaagctgtaattaagcaataccagttcaactcaaagcttatcactcatagatcacgcttctctatggcaatatggcataatctaaaacagttagaaacccaagagcacatcatatcactttggttgtagcataccaaatctttgaatcagtgatgtagcacatgggcaattacaaatatatttacaagttttgggttgttctagaaacctgggattaattaggccaattcgaaatgcataaagaaaaagtataaaacgattggttcaagctctatcctactagtgagtacttttgtttgtttgaagaagtctctgacgttcatcacgagtaacaactaacggatcactaattgagttgtcgtgtggcttgtgcactgaagtccttttctaatctatggtcgaacctttctggtctttggtcacttggagctcatcagtttggactatttgttcaaacatttcctctttaactttattctttatgatgttgacaagacagggacagtattaatggacttgcaaatagcggaagaaacaacggttatatatgcatattttcgtcaattataaatgatagttgttatttgtatctttagcattatgctccgagtagtttcttataattaatttgtgattttgtcgttcacattaattggctctagctttttcgaagcaaatgcccaaaaaaattactacattattaaaaaacaatgggctctgaattctaataattaattaactagccagtggcctctggtacagttttcagctagattatgtcttttgcaccatacttccttgcttgatgctgtttaatcaatcatgccctatggctaccctgattaattaatacaaagtttattccaaataccactgtatcaattatcttcagagtttatttcagatacctgatctgtataaatcatcagagtttatttcaggcaacaccgtatcaatcatcttcgttttgttctgatgctctagccagttcataggaggtgacaggtaatatatgacgcagaatgagaactaaaaaataattatcgccttaatttaggaacaaaccacaaaaacaaaatgaagttgccctgcaaacgtgatggtactactaatcagccagtacactctaaagccatgaaaaaatatgtatgttcgttcttgtagcaagaaaagtattttgttacgcatgtcaactccagttgcaatgtgaacatgccatggaaaatttgaaatccacattccgttcttacgtacggtcaatatgcgccatattgcaaattcttcgtgcgctataattagtttgacaataatgtcatgatttattagagtcttccctcggcaggtttcgccgtttagagaggggttactcttcgcctcacggtaaacacaaagaactaaacaaaatctatcaaaaaaattacttttttcttctaaactttaccccgttacgcacccagacccttcctatcaccgacgataagacatacatcatgtatagattcatagtcaaggtttgtctattatttttggacggagagagtagatggtaagggaaaccctgctcctccacgcatgcttatagctgttggcaagagaaaaaaatcagcattagtctcgattctctgatcttggtctaaagatgctccgttgaagatatgtgagaatattttccttgacaagcaaaaaatggatacgtattttattccaaaagagacccctgaatcttcaacgagaggggaaggtggtgttgaaagaatgagcaactggatgatccttttatttttgttcaagtaaagagttgtactttctcttatcagacgtttctcaagttaacatatcggaactaaacttgtctatcatttaaaataggaaaaagtacgaattacccctccgaactatcgcggtcgtccgaattacccctgaaccataaaaccggatatttttcatcccaaactatgcaaaccggacgaattacccccctcgatctaatccgcggtggttttggtctacgtggcgtacacgtggcatcccagtcagcgttttctaattaaaaaattgtgggacccgcatgtcatagtcttcactttccctctctctcactcttcctctcttctctctctcactctatctcactcttcactgcttcgggaagacacggcggcaacgggagacacggaggagcgggcggcgggcggcggaaggcggcgcacgggggcggacggcggacggcagcgtcgcggcgaaggccgagcggaggcggctgcgataatgtacttttctatttgttagtagaagaattatgctttgcagaaaaacacgatgagctcttgtcaagcttggacttggtccatggactcataacatataatgtacttttctatttgtaagtagaagaattatgctttgctgaaaaacacgatgagctcttgtgcccccacaatatctttttttttccaaaataatagggctaaatagggataggataactcccttcatgatatcctattagcaacgaaaatagctagttctcgatccgatttgctcggaccgaatcgatgatgtacttcccttgtcttaaaataaatcaacttttatacataaattttaacttatagcctatgttcagaggatctaaacatgccctatctataaaagatgatttattttgggacagaggggagtacaatgtattttctaaaacgcaatggatgtggattaggataggtattgctaaaatttgatagatatggattattcgatcttttttatgcagatcattcaataaagtactactatagaataatccattttttatatattactaactaaggatatggtatgtattgttttctaaaatccaattaatgtgaattaggatatggtattgttaaaatctggtgtatatatattatccaatttttgtgcgaaagtgctattggacatgatctttttatattaccacaccatttttttaacatacaaacatattaggaagcaagatcagagtttaggggataaaccccagtacattacagataagatctgaaagcacagagccaccctattgaaatgggaatttaactggactaaaggagtagacttcccgatgaaactgagcagcaaaaaaggagcagattgacggggagctacggcaatgccgtgacaactgcttcctaaagactcatttgacgtgcactccacttggtaggccggtaatccccatcggctatctccatggaaacggcacaaaacagaggtttgatgctgagccgtagattttggggtgagcttcaccggactcagcaaaggatatggaggttgtcattgaatctgaagagctctaacatcaaacctatcaatcgaagtcgcgcatgtggtctgagctcaacccgaatgacaaactcggcatggtttctactgataaagaacaaaagagaagccaaatccaaagaccaaccaaccttcaacatgaaagagtttgagtggctgaaaagagacttcaccatttgattggaccatacaagctcatctatcaattttaataacaagtcgataattccttatgagcagactttgctacgcaaagaatattattttggacaactccttacaagcagactctacctatgtgtcttcatctgcaaaataatatattttcaaatatatcaacaacacaacatatgctatgcacgaagagtccaattaatatccatatataccctatcatgaaccaggtccactaaaatccccgcaaaatataaaatcattaatcattatagataatcaaagtactaaaaatgaggagaaaaaaattaaaaaaaaggcgataatgacacgtaggctggcagcgatcccgagagcacgtccctcccttaaatccacgcacctcgccgaagttccaatcgaaaatcaaatcaaatcaaatcccaaccaaaaaaaaaattcaaaatcaaatccccaaaccccaccatctccatggccgccgccaccgccgccgcgcgtgacctcgccggcgacccgccggagtcgacgctcctccgcgtcgggggcgaggtcgcgtggccggacgtctatgaccgcgacgactcgctcaaggagaacaccaaccccaagtgcatcctcaagacctacggcggcggcggcggcggcaactcgtcgcagaggttctccggcaacctgaagccgacggcggcgccgatcattggcttgtcgaggaagctgggccatggcgggggcggcggcggaggaggaggagggggtttccgtccccccgcgatcttcccgaagaaggccaagaccggcggcggcgggcgcaccccgagggcggcggtgcccgaccacgagcccgggtcgcccaaggtgtcctgcatcgggaaggtcctctccgaccgcgagcgcgcgcgccgccaccgccggtggtcgctcgagacgaggccccgcggcgtcggcggcggatgctgcccggggctcggttccctgttcgtccgccggagccggtcgaggaagaacgtcgtggagtgcgtcgacgaccagtcgccgcccccgcctccgccgccgccgccgactgcggccgcgctgaggcggagggaggagaaggtggtgttgatgaccgaggaggcagcggcggcgccggcgccggcgctgggagggatgacgcggttcgcgtcggggaggagggcggcggattgggcggctgagatggagatggatggccacgtggcgagatctgggccgttgtagcgtgatctggaaaccatgtgaagagaagacatcgtgtacatggaagtttggtttggtttggtttggtgtgatttttagctggttgttgatgtaatttagtgcaagttttgaagtttgtgtacatattgaaaattaggagatgagaatgatgggattcaggtcagcaaactttgtctaattttgttctgttttgatctgtttctgtttgatgtgagttgaatggagaagatttcagtactggcatgcttgcattgatgatatgtatgcaactctgactttgcatgcctaacttttttttttccttatgtaaggacaagtagtgcactagtgtgattttagtgtagtgttgatgtgtgtatgtctgaaaattaggatgtgagaataatgggtttcatagtactaccaaattagtcaaaatatgctctttctttttcttgtttctatttgatgtaagttggatggagaagattccagtgttgacatgctttcattcatcatatccatgttccaatgactttgcccttttcttttctttctttttttttgcaaggacaagaagcgtgcttttgatgagttgatagttgattttaagcgtactatgcataagtccgataggttatctgttacttgcaccagtcataaatatttgatggacgttacttacaagatgtgatttaacttttaaatatttgaaacaacaataatttctcgaatatgcttaatccaaaattaagaaaagggtaggcgtagatttaacttgaaaaatattatcataaaatcataagcgtattatattttatttattgttttttaatatatattgatagtgaaagttttaaaaagtttgggtggatcttttcctcgtcaaatatttagaggagtacgattaagtgggatagagctatgagcctgagaaaaggactaactacacttcacaatgagatgaaaaaactaacaagtacatttaacaacgagaaaatgttgatttcgaaatcgctggaatgttgttaggttgaaggtctgatgagtgtgtctgaaaatcgataggctgagagtaacatgaaattgatgaattatgctcaagaaacactacgtgtatgagaagtagagtatatgtttagcctgagaaaagaaccaaaggactaagaagtacagtttacactgagaaaacgtgaatttaggaaatgcattttccttgtctcatccttgcatctcccatgactttgcattgagtaacttgtcggagggacaagcagtgtgctttttggggattcggatcggttgcagtcacaatagttaatattgcacgcaactttggccgtctatttttgtgatcaacggtttaaattcataactacagtaacatgaacagtattccatgctacagtacaacgaaagtatttcgtgctacataccacgaatagtatttcgtgctacagtaccgtgaacagtacaccgcacgatctaggccgttcagcttgtatccaaggatgctactgctactgcttaattttctaaaacgctttttagaaaatctgctttttggtggttgataattggtaagacaagtcaacatgttgcgtgaatttaattaattagataaggtattttctaaaacgtatatttagataaggtatgaactgagcagatacagattaaaaactgcaatgcataatagttcagatcatagctagattcgttaatatacagtatatataccaataacttcaatcaatactttatacaagaagttaagcagtgcaattaactgaatcccagcgagaggaacgcatatatacgccgaatagggttcatccaaagttccaaactacaacactgcaactgaacatcacattcagtaagcataatacaaatatgtaaaacaccctatctgataattattgtctactcccatacaatacaaagatatccatgtgatgtaggatggctagagcagttccacaagcaacagcttcgtcaggcctcaattctgtattcagctcccatcaaagtaatccttgataattagttcttgaatctttgggatcatttttcttccaccaatgacaacaacctcatttgatcagattcttcttgttgttcaactctgttgtcatcttggaggtacatacggatcaatttccatttgatcatcacatcaggctgttgatgatcatagtaaatcaatttcagcatatatacctgattgaaaaatgagtaacttttacaccctcacctcaaccaattataccagcattgaatccactgtaaaaggtaacctgctccgcagccaaagatgaaattgcctttcaaagttatcttctctgcagccaaagatgaaattgcctttaaaagttatcttctctgctgcgttcatcgtcttaagaccaactttactgtaaattgaggctcatcaatccaagagagttcaacctttgtatcttgaccatagcattttatctgacattttttacactgaacaatccaaaacattttatccgacactttttacactgaacattaatccaaaagagagttgagcccagtgttaatggttgctgtcatcacctatgatggtggagccttccggtatgctgtcatcaccaattaattaaacataacgtgcatgattactttaatctagaagggccaccgtttgtggattaggctcaacaccaacgacgacataggctatgaaaaagaaaaaaaaaaggagtgccagaaaaccaacccaaccaatctgatgagcccatttgaacgagaaatttctccatttaacacgagattcaaatgcataactgtaacagttgacacaggccttgtcattcgactctactacactacaacaaccaagctcaacttcgaacgatgcttttgctgctgctgctgctaaaaaccagggtagtgaaggccgcataaactgtgtacagcatgcgtatttaagcctaaaatgctgcaatgcaacttaactgcttcatatagtaacatattactctgtacagatccagagggaaatgtagaaattcgtgttatcacaaacagttactatattgtattttgggacaactgtcatgcaaccctgtagaacatctctgctgtctcccccataagaaatgtacaggagaacgaaaaatgtgatgacaagtgtatattgactgtaatctatagctatgacaatgctgagtttctagatggcaaatctacggcttcagcactaaacgaagacgccaggcaaggtttcctttgtatatcatacctgcatcaccagaaaaacttcacagaagaaattgtcatataaatcgcaggtcacgtactatttctcactgccatccttctcgtctaatgctccattaggcttctcagaccttactggaagaacgctgcgccgctctttgccacctggtttagctgatgcattcccataccatatcatcccaacaacagcaaggatcatcccaaggactacctgaaaattcagaccttccttgccaaagaagagaaacccaagggacaagacgagcactgtcttcatgtggcccaggacttggaaggatacggcagaaaaccgaccaatgcagataaattggctcagattaacaccaatggcaatgacacatgagagagtcaggaaaaactgcggaacaataaaaaccatcgtaagatgaaatggaaaatttgaggtcaaattacaaacaaatcaagcattgactcaaattcatccatattccaaccaagtaaagtgtaactatagactaataacaagcaagagattgcacataaaaggaaatctatagactatagttgtttgaagttactgctaacaagtgatgctatgaagtaaagacttttgtggtcacaagaggaaatgtaatgctagtctaggtcatttgaaaatgagtaaatttcataaaatcccacatattatggtccaagttgcacaaaaccactgggattttggcatgtgacatataaccccacatattataatcctagagtttcacaaaaccacactattgatcattttaacttatatctaccacacttttgagttatacaatcacatctcaaatttatgagcgttttatccatcatataaatattacatccgctttgtaaaattttaatatatgagtatgtcaaaatggttaacggtgttggtttgtgaaactttagaatcatggttttgtgtcacatgccaaaattcctgtggttttgtctaacttagatcagaaacaaagcattgtaatgaggctagcctcttaccaaagcaatcgatgtgaaaccaaagtgatccactcttttgcctgtcaacaagaaatctacaaagggcccaactagcagaagagatcccgcttgggctggagcagtgtggcccaggaggttgaatgagttcagagagtacttcctttggagaaaatgaacatactgcaaggaaaatagaaaaggaaaggaaactaatgagtaatttgtctataattaaagaagtgacaaacaaacaaatgatttagggagtgccaattattcataactaacaaggactgcagggaaccaataatgattcagggagcgccaactattcatcattcatcaataagaagacaaatagatagccacagttactgttgtaccaccatgtactaatttccccctcataaaaatgttcatggctgccaaaggagagctataggaatagaatgcaatcttatctcatagctgatatataagacataaccatacaacaagggtggtgattttaacttacatattgttgtaaagctgtgctccaaacagctataacagcagcagccagaccttttgcatttacactgacatcagtaactgtgcagactgcaacacctataagcacaaccattatgctcagctttgtgtcccgggagtaatgtacacgatcgaagacaacctccaggagacatgatgcaggtatcatgcacagctttgctatctgaagggaagaaaaaggattgtttagtagttgaaagtttaaagccatgatggaatctagctactagaacggtcctttgctaacctgataaaatcccacagagttccacatcaagctcacattcattccaacaattgacaagttcgaaaagatcacaaacttaatcagatctggtattggtaagtgggagggctggctgaggcctaaccaccgaaacacgatagtcatcaaggtggttgtcacaaaatgaagaccagttaatgttgtggctgcaaaatacaaaacacagtcagttacatggcatccattatcatacaaatgaagtatgtgtatgttgaggagcagcccataaatcttgttggacacaacaagaaactggataatatagtgtgcttccactgttccattaaggcccttttaatgttcatcaagcagagtggcagcttgtgacaagaaattatgatcataattctcatagcagctagaacagcgtggttttcaggtccaccggataccttataggttcacttttaatttgttttagatcacaacaaaaacaaatccggcgaacttctttggcatatggattatctagaattcaaatgattggaatttgataaaaaattactcaaagtttaaagatgcctgtcagtcaattgtttaattgcatgccccaaggaacaaacatctagaatccacaattacataagatctagtagcatttattcgttctatactaaaacaacataatactgcaagtttgtcatcccagaacacggagtagcctggaataaaacatcacaaaatatatatcttaaggtagcaaaaaacataccgaaactgaatccatgtgtagccatcagagccttgttgaccatgatgattccaacggatgtggtgatgttgaaactccatgccgcaaaatctagcaccttcttcttgtcggatttgctcatggaagaagtcatttcgctcgaatccttgaggcttcaaatcaacaccaacactttggcaggggaggacctaacaaattattttgggaggaaacaaaactgtaagaattggtactaaggttaaaacagagagaaaaatcctcttccagatctagaaggagaagagaaggaaaaaggttaaggcacagagaaatggtgcgcgcgggtagaacgagaggaaaagaggacgcgcgctcaccggaagcacgccgtcggccggcgccgctggctcgaggggtgatggatggagatcggcgaactcgctcgcgagtcgagaggccgaggtggcgggtggggagagattggcttgggcgcggcgaggaggagccagaggcgagggtacgcggcggcgggagcagctggacgccgccgggcaccgccgctcgcgtcgcggtggtggagatcgccgcgcgacggcggaggcggcggcggcgggccaaggagattttgctcgtgtggtgttttttttttcttttgttttattttttttttagcgaaatgaaaacaagtgtctccaaatctcccagatctgccactatgtggagggttatttatagtgtgctttagtttggtttgaaattttgaatttagtaccaaaatatgtccaaattcctcgattagatcgccgtgatttcgttttcaagtaaggtgtcaagaaaatgccagcccatccttccatcaccgcgatattacaggagtaatattttttcttttttcctttttaagtagtattttctttgagaagtaataaggacctgctcgaaagtgtttgatcaatgatggatgaaactgaaaaattgtacttcctccgtttcagaatgtaagtcattctaatatttactatatttatattgatgttaatgaatctagatagatatatgtatatattcattaatatcatatgaatgtgaaatatgctagaatgacttatattgtgaaacggagggagtacttccttcgtcccgaaatatagcaacctagaaccgaataggatgtatcatagtactatgaatctggaattgctcgtccaggtttaacctgtccagattcgtagtactaggatacgttctatcgggacctaggttgctatattatgggacggagggagtaataattattcaagtatagagatgaataatttaaatattaaaaagttgattgatctatttaaaaagttttcagggaaatattaacgaacaattcttttctcaaaagatatcgcacagtttaaacatgcatctattaaactttaaatcaacaattgtgttgtgtggttctgtttgtgaaagtactatatgtatcagtgttccgcttaactggttgattatatttattaattaattaatacggttgacacaacgttggggttaagatctgtatactttttttagaacaatatctgtatacttaattgtttattaataatgtaaacacatacaccgtgcagttagggtgtcacataagcatggcagctcatacacgtagggtccatgcatccattatattcagatctcaaatcagatttgggcatgcaaccttttttgagattccaagccatcgcactcaaatcaacatttcatccaagttactactaactagtccgttgattaagattatatactcctacttaagtttttgtatgtatcttcaaaaaaatgtttcgacatgtgtattctaaaatgtgattgctgttttggggggggggggggggtttggaaaactgaccaagttaattctatatattaattccattgactatatagctcatgtatttatgaagtaaaggtgtgatttggcacgccaagctacgcatacaaaaggcatgagcaggtcagaaaccaccccatgttttatttgtatggagtaatacgaattgtatgttggtatcatgcatatgctgaatcgatcgatcatctgttggagtgttaattggacaactttaattgtcgtgcaggttgttacatgtgcaattaattggccagatagtagtaggagtactactgtgtttttagtcaagtcgtgtacactcctgagagtgattaactatcggcaacctagcttaattactgatttgtcggtgtgtgtacatggatgcacatgcacctgatgggccaagtaagcagcaaaccatctttagcttttcaggcccgtatgtgattgggccgaactacggcccaaagtcaaaacgtattaataaaaacaaagatcccttcacctagatttctttcataaccacacaagcataatagattaatagtatcattttggtgttaaaagcaaaatatcatgtttttttagaaacattacgagcgaagacaccttcgaaagattggaccagcaaatattaagattaataacgaagtcatcacagttattatcgacagatatattatatatcacttaagaaaataattagctataaatatagacacctatgtcgagtgtagaacttgaacctgatgagctgattccaccacagttgagtaacattcacttcagaaaaaaaaatcatttcctctctaaaaagccaaaagcagtgctgcaggctgcagccatgatgcgactgtatacgcgtacctgcaccgacaaattacgaaccattagtccatttgtactctcctggccaaaggaaaaaattggaaaccattaatctagttgccaataagcaatcaatctcaggagtgtacacaacgttgactaactactacaactcacacgagatatcatcgatgatcactgaattcagcagggtacaatatatccgtattatgggaactagacatggattttcaatgtgatcatgccctccctacgcatagctttcgcgtgccgaaccacacctttacttcacggaggaattgaccctatatcattgaaaaattatgattttagttttcacccaagattgtttaaatctcaattctgatgtacaattttacaatcctaattaagggtaagttcttataggattgactactttcttgtttattcttggtatgcttcctaaaccgttaaatgatacgtttagtgaaaaactttttacatataagttttttttaaaaaaatcaaataaatctattttttaagtttataataattaataattaaatattcacatgccaatcacatatttcggtatctgtgccactaagtagcagagttgaacgactcttttgaacgtctaagatgtctgattctacaattctgtataggcaggatatattactttacattttaatttatacaattctatgattgcgatcccatatcgaattttccaatccgatccaggatcgtgattttaacaaccttgataccatcgaaagttaactctattactctatttatcattgcatatccaaacttttgttagattcattttaattttatttatttatccccatctcacgctcaaagttggtatcgatatcactctatcccaaacttgactatggctacctctatcatcctcaagcttaccacggataaactgcccttaaagtcgcacatagccgtggtgattgaggttgcaaggttatccatggttattaccctcgattagactcacacaagcaatgtccttgaagtcacccatgaccacaacaaaatgaccattgtgctcacaaggccaccatgtacagtacccttgatcgggcttgccacatgtcgccatcctcatcacagtcgagcttgcattgttacccatgtttgccaccatagatctagctcgtcgataatcacttcctcacctccgcaagggaacaatgtaagtgaataaagatccatactgaggtctcggaggacgtcttggtagagtaatcttcacttgtgatcatctctagaagtttgagttggatcttggtggtcactcgaattctagagaaagacctaggggtgttggattgaaggccgaggacttctgtcgggatctttgcacgatgaggcaagaggttaaatcaagatctaactcttcagagtttctcgacaaatagtaggatccgtgtgatccgaacttcgggaaaaaaaatccttttgtctcccctgtgcatattttgtgcttgcccgtgtgattcaattactctgcttgtctactgtgtatcgtgctgattgaataggcctagaagtttgattagatttgaagtcaattctctcatttatttcaatcccagaagttcctgtcttagaactccggaagttctggggtgtctgagctgccaggaagttccgtcgttcttcacgaggaggttctgagccctgttaaaatttgaccgttgcgattgtttttagtatttttcaggaggaaaaagtacgaattaccccctcgaaatatcgcggtcggccgaaattctcccccgaacccgaaaaccagacatcattcaccctaaacttttaataccggacgaattacccccctcgacccaattcagagcagttttgtgctacgtggcgtacgcgtggaaacccagtcagcattttcctttttttaaacatggtggggcccagctgtcattctctcccatctccttttcctcatcccctcttcctctctctctctcgcgacgtcaggcgcagccgcgcgggtggtcggcacacaagggcggcggtgggtggtcggcgctcacggcgcgcgcgagggcgggcggtgggtggcggcgtgggagcgggatgtcggcggagaagcgaggcggaggcggagaggagcggtggccggagcttgttgacgagcggtggtaggcacgacgaggagggagaactggtctgtgggctccagacagcagtgggtggcgaggagggggcgtggctgggagggcgaggcgagcgtggctgggttcacgaggcgagcgcggtgggcggccgggagggcgcggcggcaagcgagggtgcgggcgcggctgggtgcacaggcgagcgcggtgggcggcatagagggtgctgtggtgggtgcggttaggtgcacgaggcgagcgcacggagattccggcgagccctctcctcccgcctccggccaatatgctcccactgcggtggccacggggaacatcacgagctcccgcagcggtggcggcggcctccgtggcagggcgatgtctgccaaccgcttcattggtatccctcgacgctccaggacgagcctcctcttccggcgctgacgcccgagtatgtcggtctttgcaggaaggcggtggagtacttcgattggatgtgccgtgtacggccggcctgacgccatgtccaacgcgttcaggatactcttaggtgttcttccgatttcctcgtcgttgtgatgtgaatgttttcttgataatgtgttgctgtttcctccctagtttggttaactactagattgcccatactatccataattgaatacctgcgccacctcccaccaaccgcgcggcagcacctaatgacgcgctgccgcccaccgccccctcgcgtgccgaccgcccgcgcggccgcgcctgaagtcacgagagagaggaagaggggaagaggaaaaaggagatgggagagaatgacaagtgggccccaccatgttaaaaaaagggaaaatactgactgggttgccacgcgtacgccacgtaggacaaaactgctctggatttggtcaagggggtaattcgtccggtattgaaagtgtagggtgagtaatgtctggttttcgggtttaggggggaaattcggccgaccacgatagtttaagggggtaattcgtactttttccttttcagcaacatctattcacccccctcccctctaggctacatctttaagctttcaccattgtcgaccacgtgtggtgtaccataccgccaagtcgacgacgaccaggtaggttttcccaaatatgatactcaagtgatactaatatatgagagcactaccagcttcgaccaatagaaatagagctattaccttacagataaggggcccgaaccttgtatagaccttgtatagaaatccttatctccatctcttatatctcaatctcgcatatgccctggtaccaacgatctccataccatgcaaataccgtagtcgtgatctacaacatcgtcaagtagtatatactgttttaaagttggctgcagtgtatactggttttcggtcaatattagtatatgcagtttttttttacattggtatatactgtttttttagtagtggtatatactatttatcagttcgtagcggtatattcttttgtttaagctagcgtcggtatatactgttttttatttactagcagtatatactgtttttaaagttagtttcagtatatcctatttttcaattagtagcagcatatgctattttaaagttagtatcggtatacggtgtctttgtcaggggttatggataccacatacctaatagtagttgattaaatctcggcagtaccaataacctgcggatataggaggagttccggataagaaaagacaaccacagttctacatggaaacgacaatgactactcggattgtatccatattggtttcctagttctacttggacaaggggacacttatgggtataaatacaaggccccctagaaggagaggggacaatcaacagacacatccaccacaatctacggaacaatagatcaagacagaagatcaacatataagccaacatataccaagacaagacgccggatatcgacttcagggataagcacggctagtcccctacagtgtctccggatactgtcaggagagacatagcgttgtctctgatctcgccgggcacgaacttgaggaggaagactaccctgttatcaactacgagtcagaccttcagaccgccatgtcgacaacagttagataggctaccccaaatattgtactggtgtgattatggtgaataagagcaataccggcttcggccaacaggatgtagggttattacctgacaattcaggggcccgaacctatataaaaatccatgtctccatcttttttacctcagtctcgcgtatatcctagtaccaatgatccccatactatgtaaataccagaatcgcgacatcaaacatcgacagtggcgcgccaggtagggggattttggtgcttcaggatttagacgagataggtttaagagatggattcttcaacaacaagctactcgacgacttcggctatggaagatctaacctgaccggagtatgtcttccgacgagatcggaagcataaccgaaaattcggtccttcgagatagatagcttcaagacgtcgctaccgctgcggcggacatcgactcagccttcctcatccttggttgactcgatctccaacgcggcgtccctagaaaaaacagcaaagttacggccggcgaggatatgcaactttgttcaacctcggacaacaattagatacggagtactacattggactcccatgcaaactagtcgtgctcctacgacctaaccacaagtaatcaagtcggacacgacaacagctactgcatgcccatgattgagcatgcacatggacaactgggaggaaagaaaaaaaacacacgtattcatacagtacgtgtccatcaagttagtatattaatttttttaattaatctactaatttcgtagatatatccggcatatatctacacaggtacgcattattttatataaaattttccgtacctattttcagactatacaatattgtcagatccaaaatttattatgtttatctagagcatgtattttatacaatatctattgcgtgagtgtccccggtgttaaatcgactacaatctaacgctgggggctcgctctatttccttccgtataaatcatgcttgtttacggtttacataatgcctgatatttacatctgctcgttatatcctgataatactaaaagatccatgcagtttttcgaatacatactcgacattatctactatatgtcttgccttctagaaaatatttttcaagaacaattgagcactcgagtaggttgtggtcaagtacactacattatcgagaacgatctcgacgaatgcagagtcgtcgcgcccaacctaccaacaaagaccgactacctatctcatagcaccggccatggctggactactcgagaaaaggttgttaacggataattcctcgcaaacgccgtcggcttgatcacccgacatgattgcgaacggacatccagatatgctacaagttgggtgtgtgagtcatgctggccacatgagacgcacatgtaataaaccaactctagcacctccattggtgttcgagagataattctacacattcgctggtcctcgaaccagtacatagcaatctctcgcaccgcaacctccattggtgttcgagagataattctacacgttcgctggtcctcgaaccagtatgtagcactctcttgcaccgcaacctccattggtgttcgagagataattctactcgttcgctggtcctcgagctagtacgtagcaatccctcgcaccacaacctcaaatggtcgaggtacgactacagcaataacgcagcggtcctcgcaccacgactgcaaatgatcgagagacacctactcactggttctcaaccagtcaatcgtagtgatctctcgtacatttacttctagtggttgagttacgtctactacctggttcttgaccagaggtgtagtgattctcccattacctctacttcaacaaagttgatatcaggtacacaataatgccaagtgttttacccagagatcccttaccacaaagacacctagcgttgaaacctatcctaatgtccctttacgctgtcttgacaaggcctccgaggaacctaagagaacttcggctggggacgcccagagcggataaggccttgtcggatccttcagagacgaaagaccatgtaagatctggtcgtgtaagagttctcgccgtgcgtattaaccaagccgtgtaatcggaaattgggttttctaacttcacggctaggggctaggatcagtgcttgttcaaccgaggcaggtaaaaggtccaagagtcttatcttccgagaacaattctccgatgagaaggctgggggctagggagagtgtataactcaacaaactgactgatcgaagtcggtaaaagagtagatgctcatatacaaaacattggtctgtaagtttaattcattttcggttttccatacattctataacatgttaccctttgagcgttcgctcgggggctatttctatctaatattcttttctgagtattgatttcaggaaaattctattcgacattatctaaggctccatgtctctatggttctacaccaagatcgactaaggcgagtacgacaaatgttgacaaggcttcggtgcagattctacgccttctcgatcgctcgagaacggttggtggatctcgacaaggaatacgaaatgaagaaatggtgtacccgccgagataaaatttcttgacttcaatccaaattctcgattacagcaagacgggagacttagtcgcatgttctgtacttttttggttggcgtcggagattgactcagacaaaccctttaggtgcccgcacgagactgataaaggaagtctaacgttatctctgaactcaccgagaacggtcacatgagctcgataacagttactccaaggcctgcgcgcggttgagaatatgaattcgttcatttgcatcgaagtcgggggctactgtcagggttatggataccacatacctaataatagttgactaaatctcggcagtacccaccacatactatgtcctatacggaaacaacctgcagatataggaggagttccgaataagaaaagacaaccagagttctacatggaaacgacaaggactactcggattgtatccatattggtttccctagttctacttggacaaggagacacttatgggtataaatacaaggccccctaggaggagaggggacaatcaacagacacatccaccacaatctacggaacaatagatcaagacagaagatcaacatacaagccaacatacgccaagataagacgtcggatatcgacttcagggataagcacggctagtcccctacggtgtctctggatactgtcaggagagacatagcattgtctcttatctcgccgggcacgaactcgaggaggaagaccaccctgttgtcaactacgagtcaaaccttcagaccgccatgttgacaacagttagataggctaccccaaatattgtactagtgtgattatggtgaataagagcaataccggcttcagccaataggatgtagggttattacctgacaattcaggggcccgaacctgtataaaaatccctgtctccatctcttttacctcagtctcgcgtatatcctagtaccaacaatccccatactatgcaaataccggaaccgcgacatcaaacgtcgacagtcttttactagttagtagttggcacgggatttccagttatcggagaatattaaggtgcacagaaggggcgagaacgtcggattttttctacaatagcctttgctttttgtgtagtttgaagccaatgttttacgtagagaaacccttcgaaagaccgaatattctatgtgaaggagagaaaaatcgcaaattagaatcgagctgtaaaagattggcagacgagaggcgttttcgcaaaacgacacccactaaccctagccaccatcgccgttggaagaaaattgcataggacaatagtccttcgctcatccgaaggactttgtccctgcacatgacacgtgttaggttatattctcaaagcacccctcctttgtccctactaatctcacgcacgatgccgttagacctagtcgtcgtcttcttcccacgcgggagacgactaggtgcaacgaagtaaccgggccttcgtgcttgatcctaattcatgca

SEQ ID NO: 57885 - DNA, 15120 bp, Oryza sativa
tattttgaaatcatgtactgcatagcatgcaacaatctattattacatttttcttatccttgtatttaagcaacgtgtggtaaagactcttgtaaaacaactctactctaaagaatatatggaaattttaaaaatgatttgaatcctccaatgtttgtatgaaaatcatctgttaaaatttttatgaacaagaagggggtttttccaatcttacaaaaatctcagcagcaattctaccatccaaatgactaaaattccactttgaaacaatggattgagaatatggaatgaaatttcctttagagattttgaaggaaaataatcatgaggtttcacctcaagtttttcctataactttaaattcctatgtatcaaccaaacgataggtttaggaccttgtttttagaaaaaaatttaatgagaacgtcattctattttacaatcattcatttagggccccctttgattcaaagtaaagttagaggaattttggaggatttcattgctatggatttttttttcataaatggccctttgaatcaaaggaatggacaaaattgaatgctataaaattcctatggaatgcttcatgccatgcaattttcaggaaatctaacatgaggtagaacctcatggaaacgttcctttgagtttttatctctcttataatttctgagtttttcttgagatccaatcaaacgattattccggtgttttttctgtgtttgacaatcctttgttttccacttacattcctgtcaaaatcatacgttttctcaatcctgcgattcaaagtggcctaaaattttcggagctcacaaaatgaggcaagggttgtgagcgtcctaggactaaggaatattttcctatagtacagtaaagttctttgccttgttcaaattcaggaactagggcctctttgaattggagaaaaaaatacagaagaagcaaaggaattggaatcctttagaaaaggttaatgttcattcctttggttcttaagaatgagcaaaagaaaaacacatgaaactcgcatttcctaatgattctgaaggcactactatagaaagtgtcataggtgtcagttaagaagcctctatacgtgtggattttctagccagcaccacagagacggcatagatgaccccgagtcattggtgtcatttccacaactaacacctttgaggcactcgctaagcgaaaaaagattggctcgatgcatcggctcgaatcgaggttctcccattgccccaaatccaaattcaaatccccgaatcaaaattagatcgctaccaagattgattgacatcacaaaatcatgaacatatatagaatcaacaaaagaaaaaacatccaaatcagcaaaacccgtcggtatgcacttgacgacattgagataaggccgacgccaccacggatatggtgtagggcaacgacgcccccggggggggggagcagatccggaggccctcaaggttgggcccgttggatctgtcatcggtgccaccaccctcgccgtcgctgatgaatccactggctggggagaggccggccgttacctgctagggaaaggtgccagcgaagagggagagctggaatgagaggaaacggtgctcgcaagagaaaagaaagagggaggcgtgggcgagagagagaacaggctaagggataaggacgggagagagagggtggctaaaaaaatttctcgtcctgatggtggctcggctcagtttttctaatagatgttggttgttttagaaccgactcctatactacatgtgttggtttttatctagaaccgacacctataatataagtatatatgctattttttttaaaaaaaccaacacctatactatgtgtgtcggtttttatctagatttttgcctgatagaagtgataaatggaaaataggtgttagttttaataaaccgtcacttagagccgtaacctataaggtattttgtagtagtgagggaaacatagggcatttaacatcgactataagctcatgtttttttttctagctcacgtaagatcgaggcaaatctagggcctgtttgggatagttttacattctgagaaacagccaggggcggatccaacgtgggtgcaggggggactcaaaacccatggatacctcaggagcacccccttcgattttttcaccataaatgataaactaaaggtctttaaatagctagaggttgaagaaactgtgtaattgagcctccccaattttttgttcctggatccgcccctggaaacagcgagaggggatttagcttgtgagagtatgaagaatttgggaaaattagcttttgggtgtgtttagttccacggccaaaattagaagtttgactaaaattgaaagtttgaagaaaaaagttggaagtttgtgtgtaggaaagttttgatgtgatggaaaagttggaagtttgaagaaaaagttgggaactaaacaaagactttgtcttctagtttatttgctgaattcaacaactacttgttctcaaaacctaaggccttgttcggttactagggatttaatccccaaggggaatcaatccagggagggattgagtgaatccctctcatgtcactcaatccctgttggggatgaatccctccctacccactaatccccctctcaaatccatgtgttcggtttggtcaagatcaacaatagcaggattggtgctttcctgcttcaacgctgctattgagttgatgttcagcttggcagtttatatgcatcaacttcagagcatcaaatggaggaagcatcaaacatagcaacggaatttgataatatcttatcgtacaaacaaaatatactcagtggagtaattactgtaatctccaatgaacatcaaatgtcacttttgcttttcgtcgaaacatagcattatctaatataagttagaatatcgatcagtcctagcttctacagtctatgcttgacggagcgtggggctcctcaccgggagaccgcgcaggcccccctttgccggttcggccggggaccctaggtgagactctaagctcccaatctgtatgtggaaggttcgcgagaccggaagcacagaagacgccggcgatgtatacaggttcgggccgcttagaagcgtaataccctactcctgtgttttggtggattcgtgtgtgaaggagctacaaagtatgagccagcctctcccttgttctgggttcctaatctggaaaagtccagtccaaaaaaaaaaacctcccttctctcagtgggcaaggtcctccttttatatcttaaggggataccacatgcaccatccccccctctctgtggggacttaccctaccttttcataaatggacggagatttgcatggttgccgttcgagtcaccttctgatgggacggcccgcacctacctccactttcgccgggagcaggcgcgacgcggaatcatggctgtctgctgacgacatgacctgtgtcagactggtcacaaatcggtcattcttgtccaccacgcgtcagcttagcaatctgcacgttggcccttcttcacacaacattttgcctgtaatggttaggatgaagcctggcatatatctgaccaggactaacgtgccatctctgggaggtaacacgctagctccagctggggacgagtgcctagaagccctcgtcctgacgggatggggcgaggcgtgcgtcagatcgcctgtcgccacctaacccgcgatctgaccggtctgtgactggtcacagaccggataaatgagtgcactgcaccgcgttacatgcggcgtgacacgctcagccaaaccgcaataaatgtggttaggtgagccccactgtgcccacctaacccatacacgcggagcgaaaacccacgaggggtcggggcgcctcggccctcggggccgaggcgggtgcggctcgaccccctcggggggactaagaggagggcgaacaccaccctcgggcccgacgtcccccgagggtgccaggccacgtgggcgattgtgtctgcctcaaacctctagtcatgatactcccgatcccatgtcaccgacagtagcccccggcgttatgccagggcgatcgccctccttaagggaagcggtcgggcgtgacgccactcctaaggcctggtgacatgtgggaccggtctccacaattgggcagaaacccaacggtcaaaaatcacgcacatcggcaatggtaactcggctgtcaataatgagcggtctcttcaagactgccacattactcgagtagcacacgaatctggacatggcgattcgtttcatctggagatatggtaacgtcgcttcggtcggcgagcgtaattaacgcgcgcacgatatgatctatctcgacctcatgcaccgcaagcgggcgaatgggattagtggaagcgtgggcgcgagaaacgagggggcgaaatagtgggcgcgagaagcgaggagccgggcacagcgttggcaagagtataaaggcactgaggaagggatttgtttccttcctttcgccattattccccttgtcttcgccgcttgcgccctaactccttctttcctgtgccctaccttcgccacacgcgctcgctcttaatcttctcttccttccggcgccatggcacggggctccgctctgctcgatggtagcgtgctgccgccctcccgcatcgtgagcgagaggcaggctgggctgccgcgccgcttcatgccggaatctgccaccggccgggagatagtcacgctgggcgagggacgcccggcgccagactacccggggcggtccgtcttctttctcccctttgcaatggcagggctggttccgccattttcttcttccttcatggatgttctggagttctacgatctccagatggcgcacctcacccccaacgcgatgatgacattggccatcttcgcgcatctgtgcgagatgttcattggggtgcgcccatctcttcggctgttccggtggttcttcaccgtgcagtcggtgtcgccgccatcggtagttggtggctgctacttccagccacgggggccggtgccgaaccgctacatcccctgcgccctccgcaagaagtgggacgactggaagagcgactggttctacaccccccttgccgacgaagtgcgcctccgacttccgagccagcccccggctcaggcctccagctggcgggcgccggtagatctgggggatggctatgacgccgtcctcgaccgcctggcgggcctgcgatcccaggggctcacaggggccatggtgtacggcgactacctccgtcgtcggattgcgccgctccagcggcgcgctcgaggcgcctgggagtacaccgggtccgaagacttcatgaggactcaccagggagtgagatgggactgggctcctgaggacttcaagatattggtccaacgggtgctgaatctcaactccgtggaggcggccctcattccccaaggaatcctccccctctgcagcgatccagaccgcgcctccatcctgaccattatgatggcggtcggggcctcagaggagcgagctccaaagggccacgacggcgcaggcgggagccgccggggggaacaatctaccccgagagggggtcgtgcttctgggtcccgcgacaggggcccggggagcagccgccctgccgacgcccgggggaagaggaagcagggaggaacacctcccccatctcctccccgagggggcggggcggcgcgtgccagcagcaggcgcccggagggggccgcgccaacatcgcagcccgagggggagcgcaagaagaagcggccccgcaagatgggggagacagaaccatctcggggaaacctcatttcccctccaaagtggtcgtttaaccgaccccctcgcaggttcgtctctcacccatcgtggctgtattcattctctcaacgcgagttttcactcacccatctcgttcgtcttctggtcttttcttttgtttcagcgagatcccgtcgcgtccctcccgccattccaagtccggccagcctgaggccgaggatccggcggccgcagaggcccggaggcgggaatctgaccggcgagaggccgcggatcgcctacgggtagccgaggaggccgtccaggaggccgcccgggctcgccaggccgaggaaaccgctcgggagggagccgcccgggcctgccaggccgaggaagctgcttgggaggaggccgcccgagcccaccaggccgaggaagccgctcgggaggaggctgtccgagcccacaaggccgaggaagccgctcgggaggaagccggatttcgccaggacgaggcgatggcaacttccgaggcagctcgcgacgaggccgcgggcgcgtcgcttgggcccactccctcgggcaacgctcaggcccaaccaggtccggaggacatccccgcgtctggcacgtccatcggcgggccgagccgcgtggcatcttctccgaggcggcttttccccacgccttctgctgccctactgagcgcagagccccttctgcaagccttggccgccgcaaacaccacggtgttggatgggttaagtgcccaggtggaggccctgcaggcagagcgggcggagctcgacgccgcgtgggcgcgcgtcgaagaggggcgacgctcggtggaggccatggtggaggtgggccgtaaggctcaccgccggcacgtctcggagcttgaaacccgtaagaaggtgctagcggagatcgccaaggaggagcggggggctgccctcattgccaccaccgtgatgaacgaggcgcaggacaccctccgccttcaatacgggagctgggaggcggagctagggaagaagctcgacgccgcccagggggtgcttgacgctgccgctgcccgagaacagcgggcggcggagaccgaagcggcgtcccggtggcgcgaagaggcccttgaggcgcgcgccatggcgctggaagagcgcgtctgcgtcgtggagagggatctggcggaccgcgaggccgccgtcaccatccgggaagcaacgctggcggcgcacgaggctgcctgcgccgaagaagagctcgcgctccgcctccgcgaggacgcgctcaccgagcgggagcgagctctcgagggggccgaggccgcggcgcaacagctagcggacagcctgtccctccgcgaggcagcgcaggaggagcaggcgcgccgtaatctggaaggtgcccgcgccgagagggctgcactgaaccaacgggccgctgagctcgaggcgcgggagaaggagctggacgcaagggcgcgcagcggcggggcggccgcgggcgaaagcgacttagccgcccgcctcgcagctgcagaacacaccatcgccgatctgcagggcgcgctggactcgtccgccggggaggtcgaagccctccgcttggcaggcgaggttgggcccggcatgctttgggacgccgtctcccgcctagattgcgccggtcggcaagtgggcctctggagagggcggatcgtaaagtacgccgccaaccagggaggtctcgcccagcgcctctcgaagatggccggggctctccaacggctccccgaggagctcgagaagacaattaagtcatcctcgagggacctcgcccaaggagcggtggagctcgtcctggcgagttaccaggccagggaccccaatttctctccatggatggcgctggaagagttccctcctgggaccgaggaccgcgcgcgtgcaagtccgggatgccgccgaccatatcgtcgacagcttcgagggctcggcccctcggctcgcgttcggccccaactccgacgaggagggcaatgccggtggtgcagacaacagtgacgacgaggccggcgacccgggcgcatcggattgagcccccagacccccgccattcttcagttttttcttcttttctttcttctaaggccttcgggcctcttttttgtatagatcaacttaatctgtaatcaaaaatgaagaaatttttgtgtcaattttatcttgctgtgtatatgagatgaggatgatctgtgccgtggtccttttgtgtcttagcttgattaagggttcgtgcccaggtcccagtcctcaaaaggcgcgggtcggggctagtgcctgggagatccacatgtcgagactggccaggccgggaacgtggtgaccgagggttatggatgacccgattgtgggtttttgccgattcccccccggagttcaccacgccccagggcacggctcggttctgggccccgtttggcgaatttagccgacccgagcccccgagggcaggattgagcacgagtgacctatttcaagtcaagattcttcaaaaggaaaaaacagcacagacacagcctttaggaaattgaaactgcttttattgaaatactgaaaaaaaaaagaaataagaatgtgcatgtgtggcagcccccggccaaccctgcacgcccgagggggtgcggggttggcccgagcccgaaacctgacacccgaccccccctcaggggtagaagcgacgaaggtgttcgatgttccacgggttagggagctcagtgccgtcgcccgtggccagccgtatggagcccggccaggggacgccgaccactcgatacggaccctcccacattggtgaaagcttgctcaatccagcacgcgtttggacgcggcgtaggacgaggtcgtcgatgcagagtgatcgggcccggacgtgacgctgatggtagcgccgcaggctctgctggtagcgcgcggctcggagggccgcgcgccgccttcgctcttccaagtagtcgaggtcatctctgcgaagctgatcttgatcagcctcgcagtacatggtggctcgaggagacctcagggtgagctcggatgggagaactgcttccgcgccgtagacgaggaagaaaggcgtttccccggttacttggcttggtgtagttcggtttgcccagagcaccgctggcaactcctcgatccatgaatcgccatgcttcttgagtatgttgaaggtcttggttttaaggcctttgaggatttccgcattagcgcgctccacttggccattgcttctggggtgggcaggtgaggcgaagtagagcttgatgcccatgtcttcgcagtagtcgccgaagagttcactagtgaattgggtgccattatccgtaataatacggttaggcactccaaaccgggccgtgatgcccttaatgaatttaagtgcggagtgcttatcgatcttgacgaccggataagcctcgggccacttagtgaacttgtcgatcgcgacatacagatactcaaacccgcctggggcccgcctaaacggtcccaggatatcgagtccccagacagcaaatggccacgaaagtggtatggtctgcagggcctgggccggctgatggatttgcttggcgtggaattgacacgctctacatcgccggaccaggtcgagcgcatcattgagagctgtcggccaatagaaaccttggcgaaaagctttaccaaccaaggtgcgcgaggcggagtgggctccgcattcgccttcatggatatcggcaagaagcacaacgctttgttcccgaggaatgctcttcaggaggattccattagccgcgcgccgatagagggtcccttctaccagcacgtagcgtttggagatgcgatggacgcgttcactcccttcgcggtcctcgggtagagtcttatctgtgaggtatgcttggatctcggcgatccaagcaatcaatctaagggagctgggagcactcccctcgggtcccgaggcctggactccgacgggcctcgggggccggtcaggcgcatccgtctcccctaaggggtcgggtcgcgccgacggctgggcaagcctttcttcaaaggcgcccggtggggtctgggctcgcgaggacgcgagccgtgagagctcgtcggccatcatgttatcccgtctgggcacgtgccgaagctcaatcccgtcaaaatggtgctccatacgccgtacttggcgcacgtaggcgtccatctgcgggtcagagcaccggtactccttacagacttggttaacgaccagctgggagtcgcctaacaccaggaggcggcggatccccagtccagctgccactctgagtccggcaaggagtccctcgtactctgccatattattggtcgctcgaaagtcgaggcggaccaagtatctgaggacgtctccactcggagaggtcaacgtgacccccgcaccggcgccctgaagagacagggagccgtcgaactgcatcacccagtgggcggtgtgaggcagctgcgaggggcccgagctggcttcggggaccgagacgagctcgggagccggggtccattctgccacaaagtcggcgagggcctggctcttgatagcgtggcgtggttcaaagtgcaaatcaaactcagaaagttcgattgcccatttcaccacccgtccagtaccctctcgattatgcaagatttggccgagggggtaagacgtaaccactgtaacccgatgcgcctggaaataatggcgcagtttcctcgaggccatcagaataacgtaaagcattttctgggcctgagggtatcgggtcttggcatcccggagggccttactaacaaagtagacgggccgctgcacctttcggtggggccgatcctcttcgctaggggccgcatccctggggcgctcttcacccaagcggcctcgcggggcgcactcgtcttctgtgccgacgacctcgggatcggaggacgacaggggcggccttcccacagtggcctcggggccgtcctgggggtcgggggctcctggcgtcgtcggacaagcgggcaaagggccaactccggtcgtcaggggccttaggccaccgttcggctcgggggcctcttctccctgctctctcccgggtcgaatcggcacagggttagcctcggggtcagagggcgataggtgcggccttcccgcagtggcttcggggccgtcctgggggtcgggggcacctggcaccgtctgacaagcgggcagagggcctgctccggtcgtcgggggccttgggccaccgtccggctcgggggcctctcctccctgctctctcccgggccaagccagcacagggtgggggtgcgcggaatgaggattgtcctcatcgcactccacaaccaacgccgcactaaccacttgcggggtcgccgctaagtagagtagcaagggttcatttggctccggggcgaccagaactgggggagagctgagatacgccttcaactgagtgagggcacgttcagcttcctccgtccaagtaaacggcccggagcgtttgaggagcttaaataagggtagcgccttctctcccagcctcgatatgaaccgacttagggcggccatgcaaccggtgacgcattgcacatccctaagcttgctgggggggcgcatccgctctatagctcgtatcttctcggggttggcctcgatgcttcgggcagagaccaagaacccgagaagcttgcccgcaggtataccgaacacgcacttatcggggttcagttttatgcgggcggagcggagactctcaaaagtttccgctagatccgagagtaaggtctcttggttgcgcgtctttacaaccaagtcatcgacataagcctcaacattacgtcctatttggctacccaaagaaattcgagtagtacgttgaaaactaggacctgcattttttaacccgaagggcattgttgtataacaataagttcctatggggtaatgaacgcagttttttcctcatcctccctagccatgcgaatctgatggtaaccagagtatgcatctagaaaacacaaaaggtcgcaccccgctgtggagtcgacaatctgatctatgcgaggcagggggtaaggatccttaggacatgccttgttaaggtcggtgtagtcgatgcacatccgaagcttgccgttcgccttgggaatgaccaccgggttcgccagccactccggatggatgacctcgcggatgaatccggcctccagaagtcgcgccacctcctcgcggatgaaggcttgacgttccggggcctggcgccgcactttctgccggaccggccttgcgcccggccgtacggcgagacggtgctcaatcacctccctggggaccccgggcatatccgccggtctccatgcgaagacgtcagcgtttgcccgcaggaaagagacgagcgtgtcttcctatttgccgtccagaagaccaccgatccgtgtggtcttggacgggccgtcgcccagggcaacctccttgaccgggacctcatcgcacgtgactatccgctgcctcggggcggcgggggcggatgtgccaagcctctcgtcgccaccctcgggcttggacacgacggcgaggcggtccgcgcgctgctccatacaagcgagcgcgactttgaggtcgccatggacagagatggggccatcggggcccggcatcttcatctggaggtaggcgtagtggaccgccgccatgaactttaccaacgcgggcctccccaagaccgcgttgtagggcagactgaggtccgcgacatcaaagttcacccgctccgtgcggaagttggcgggtccaccgaaggtgaccgggaggtcgatatgacctagcggccaagtgtgccccggcgtcacaccgatgatcggctgggacggccggagcatcatccccggggccttgatggcgtcaaaggctgcgggggaaaggatgttgagggctgctcctccatcaatgaggacacgccccagcttcacgttgcaaacagtgggggaaaccaccattgcgatctgtcctccccgggcaacgcacggtgggtggtcggtctggtcgaaggtgagggcaacctccgaccaccgcgcccggcgcgtcgcctcatgagtaggggccgcggccagaagctctcgcttcatggccttgaggctccggcgagaaacgtgagcacacgctcccccatcgacagtggcaacgatggccccaggctcttggaaacctaggtcatcatcgccgtcatcgatgtcctcagcgggggccttctgcttggcctcacttcgccgattgccggaaggaaccgccggggacttgccctctcggcgctcctgcctcctctcctcctcccacttcctcgtccgctcagccaaacttttgactgcacggcagtccgcgaggtcgtgaagggaagtgttgtggacggtgcaccacttgccggtcgggcgctccctgctgggagcgccggcctccttctttttgtctcccgcaggcctcccctttcgggtggcccgcggagcgccctcgacggcgaggacatgaccctcgtcgtcggtatgggctgacctcttcttcctcctcctgtcacgccgccctgtctgagcagcggatccgggggcggctgaagctgccacaccggaaccggaggggttccaggtccatgcctcctccttacgagccactcggtccgcgagctgaaaaagctccgcggtagtctggggctctttggaggcgatcttttcgagcatacggttgtgccgcacacccccctgaacgcgtaaatcaccgcgtgtgcagggatgcatggtatggtgttgcggacttgacagaaccgctgaatgtacgatcgaagtgactcatcgtcccttcgctgtactgcgtgcaagtccgcttcctcaccggggcgcggatatgtgccttggaagttcatggtgaactgttggcacaaatcctcccaagagtggacagacgcgggtggcaagttcattagccaaccccgcgcctgtcctttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacattccgaaggctcgccacaaaggctctacaaccgacaccaccaaccgggggcacggagggctggtccccgcgtccgtgttgaggtgacactctggacgaggaagcgccccctgttgcgtgggcagcacgtcggtcattacgccggcgctcgatgctggtgcgggcgtccggccccccacgcagatcttccgggtcgaaggagtcgacgaaggagtggctgccgaatggcgaacagcgcctgccgctcgtcgtgccctccgtcttgacgacgcggagccggtggtagcagcaccagaggccttggtggcggaggaccgcccaccagcatctaggcgctgccgtgcagtcatgaccaatttggccacatcgtccagccaacgttgggctggagactccgggtcatgggcgacgggcgggtgacgtaggagcgcgcctgcagcttggagcgcgccctggggcgtgctgccgtcgccgtagacgaggagacgacgctccccatctcgccgcccttctccacctcctgtggatgtcgaagtcgtggatccttcagccctctcgagcgccttttcccgcctaggactttggcgtggagggggcggtggagtacgagctcgacggcgtgggtttggctccccatcgtcaccgctcatacttggggagaggtcgcgcgcctttgctggctcggccattgggctgaacaggaaaagcttggtgcacacgaaggagtgcgagagctcagaagatcactcgcagagtcccctacctggcgcgccagatgacggagcgtggggctcctcaccgggagaccgcgcaggcccccctttgccggttcggccggggaccctaggtgagactctaagctcccaatctgtatgtggaaggttcgcgagaccggaagcacagaagacgccggcgatgtatacaggttcgggccgcttagaagcgtaataccctactcctgtgttttggtggattcgtgtgtgaaggagctacaaagtatgagccagcctctcccttgttctgggttcctaatctggaaaagtccagtccaaaaaaaaaaacctcccttctctcagtgggcaaggtcctccttttatatcttaaggggataccacatgcaccatccccccctttctgtggggacttac

SEQ ID NO: 57886 - DNA, 13777 bp, Oryza sativa
aatacagaatcagcaagtattaacgaccaatgatgctcttcaagttctctgtttctggatgacataagccactccacgtaccacgtggatcttcagaagaatgtttgcttcgatttgcgtcagaacgatcagctttcgaaggcagacaagtgctactacttattcacactaactggggtgtggctcagcaaaaatatgagccttgacagttaaatgaggaagtttgttttgcatttcctgaaatcagctgatcagactattagaatgacattgaattgatactgctttaccgcaattcactttggtctcctatgtacctgcagcctaccaggcagctttcatatctcagtatgttttagcttctcccttcgctttctcgcagctccaagacattcatgtggattagcatagaagtagtcctcttcctttggctgcccggcaatagctttccttctggtgggttcgctcattcggccctcgtgtagctccttcacagcagtagagaattcgtcccaggacagctcctgatcttcaagaagatctataagctcaactagctttttcctatcaagctgtatggttttgtgaaagcccataaacctgcatttccaacataaacatttgcagttaacctagtggtggtgttcttctaaactagtctttctcactattgtgatgattcttaaaagcaaacatataccatttctcggacaaaaaaaggaacacctataaccttgtgacaggacacagtgcagatgtaagtgtgcacgccaataaacattttgttccactccttactatacttaacatattgcagtaatacacacacaatggcaagtcaaacaagaacaaacagaaggaatatcgaagtggcagacctgcgatgtccttctacaaccttagccatgtttccgtcattactggggataaaaacatcactagcaatagacacaagatagtccagggctgccatttgagtcgaatgcttctggaaggggcgtaactcatcagcagataaaagcatctccttccgaatctaaaattgcaatagtggataagcatctttctagcattagtatatgttttcatgggcgttaaattatgatgtgcttacaatgttagggaattctgtcttcagttcagttaatcttttttcaccaccatagatttcacccgaggcaatatatatccgagtgtccctggggaaaccaagagctttgagtagtaatgttgtttctccgggtgttagggggcataatccttcgagccttttcttttcagaatctatttctttttctttccaccaagggtacgcatacctgatgtccaaatagcagataacagtagagattgattagagtctgggagaagtaagtgcagacagttatgaagttcaatatcgaatgaaacctcattctcgtgagctctgctgtttcttcgtcagaacatccatgtgtacaaccagagaatgcaagcatatccatctcgtatctcagatgaagcacaataaaagatccagttttcctaagagctgatatcatctttttgccaagagcctcaattgatggtgcaaattgtagtgcattgtagttaacacggcaacgaagcttttggagctttaaaggaaggccattatttgcaaggcgagaatctgtcctgctaaaacgtaccaccttatgcttccgtactagaggcaagatctgaaagcaagagcactaaaaaagtcaaaagaagcagtggatagcatagaaatgtaaggccccctttgaatcataggaatgaaaaaacggaagaataggaaaaacataggattctcacaagaatacaagtgtaaaacagaggattacaaaacacaggaaaaacattgaatgaccgtttgattgagccgtaggaaaaacacaggaatttgaggagagataaagactaaggattcttaacatgaggttctacctcatgctaaatttcctctaaaacttgcatgggaagaggcattccataggaatttcataggattccataggattcatttctttgattcaaagggctatataagaaaaattcctataggaatgaaatcctttaaaattcctatgaatttcctttgaataaaagggggcctaaacctatgccttggaggaagattagtatcaacctgtctcaaatagtacttctcgctagaccagctgattggctgcattgagaatggaactttcctgctgaatttctgtggcagttccctgatgatctttacttcatcttgtaaagaattgatgaagtggtttacatcaaaaatatctccaaaatcactggaaaatataactacattgaatcaataatagtgcattctaactgtaaaatcaatcatgaaggaagtgagaatgtgggactggtgggaaaaccacacacctaggatcagcccagaaggactgcttatcaagttcaggtaccaccatagtcaggttcatatagcgtgctacagttaccatgtcacatatctgcagaaaacaaacatttctgcaacattagtaaaacataattacacaggttttattgtagacagaagcattgtgagatactaccgcagctcgcatttggttcagaccaccattgcatgaaataagaagataaccattactcttataaacccctgcatgagagattgtactttatcagactgaacctatcattaaaaccaagacatgctttgtattgttctgttgatattgctaccagaatgctgtatatgccaagggtgaagctagatggggtaaattcaagtaaaatcgagcaaacttcattcttgaggcatcaggtcctctcgcttacatataatggtaaaaaggaagctagaaattatttctttttgaagcctatcacccacatggtgattggaattttactttgcaagggaaaccacctcctaatttctattttccagcttcatgtgaaaataaccaaaacagctatcctggaaaaaaaaattccaaagtgtatccaggtatacaactatttatcgaatcttttttcaggaaacacatttatcattttgttctatgaaggatgcaaatccctgtgtcacatgatttaacaaggaataattaatgaagagagcaatctttatatactactactgctaaaagtgaagcacattccaggttttgctaatcagttacggcttacagcttccaggttccaagttccaacatgtgaagatctcaaattctgacataacgttaacgtatcactagcttcagagaaccaaaatccatagcacaaaatccatcacaacaaaccgtggaactccgttttcgataaacaaactaaaatcggtagcacaaactaaacggtaaatcaagaactcaaacacccagaaccaagaacaggcgctgcgagcaaaaataattcagtcgcaagtctgtcaagacccaaatccccgaacaacaccagtttaacgatccacaagaccacaaccaatgactcagtttagctaagcttattcagttacttcctggaacagttcgatccaactcatgaatgctcgagagcttccacattccactccatccattcagatagtgggaagcgccttacccaagaaccccaaccaagacccgagcaaggaggtcatgattccaagaaccaagaaccgcccagccgcccacagcagcgagatcaacaagacaagaaccactcactcctgcgaggcacagccgggggcgcgaggcgcccgacctcgtcggcggcagcgacggttacagcagaggaggcgctggagttgctgccgccgccgccgcctaggcaggagggccgggcggcgaggagcggcgggcgggggaggccgaggaggctggataaatggaggagggccgtccagagcacgatgctcgaggcgacgcgcaccgcccaccggagcatgccgaccccgcggcggcggatcgccggcggcgagctcttgtgcctggccatggcgccttcttcctactgctactggtataagctacgctttgcagtgctccccactactagtggtggaagggcaaagacggtaagagcagtgtccgttattttgacttgtgcgtgacgtgacggaaagaacagttgggatttggatcggtgttagggtgattattaactgcaaccggaaagtttggtggcctttctcattgcaaggggactagtgtgccgtgcactagtctcgtcctaattcaaatatggcgtgtatattaaccattttgaaggacgtggacacgaggggcagctagggctcggagagagggataggagaatttcactgttttatgtcaataaaatatcatctaaattcacaccacttccaaatttttttatcggagatacaaatttctatccctccgtaccactccctctgcacagtttttggattttgggaaacatgcagaaagttttggcaagaagttttgggtcctgacagaattcctgaattgctcatatttaatgccatgcatgcatggctgactttcaaacttgcttcataggcgatgttgctacaaacaaataataaatttggcatacatgcatggtacagcaaacacagctgccatgcgacgtcacacacatactgacatacaacataaatctcttggcttacatcctccataacagtagcacattacaaatgcagtcaacaattatgcaagcaatagaaatccacaaataagttgtcaaacatacacatcagccgcatacatgacagtccatacgcatgttccaaatgacaaacaaaattcaagaaccgtgtaccaaagcaagtgcaatggaatcacgaaatgcattcatcagatcacaatcatcaaacacttcttcggtctcaggttgatcgtcactagcttgtggcggcacatagttctcatcacagtcacaacgatcgaagtgcttgtcacgtatgccacttttcctaatgaagttatgtagcgcacaacatgcaactataatttgtgcctgtttacgaggatcataactagggatcttctccaacatcctccacttcattttcaaaactccaatgacctttcaatgacattcctaagagatgagtgtgcatagttgaagttctcttccttaccttgtggttcaggggcatcgcgatactcctaaagatgatacttggttcccttgtaaggagcaaggcaacctggccggttagggtacccagagtcgacaaggtaatatttccctacagcatcaaacatgagttagtatgacatatttcaaataacaaagaaggaacaagtaccattcaagcatatacctgtaggtggatgtagaaacacatgggtgtatgttgtgtgggcatcatcaaatactctcatgtcatgtaccgaacctggccatccagctagtacaaatgtaaacctcatgtcaaagtcacagacagccatcacattttgtgttgtcatgcccttgcggcacaagtgctgcacaaacttgttacttggcaccacgcaaggtacatgagtcccatctatagcccctatgcaatccttgaagtagggaaagaacctacggttcctcagtcttggatgcattgttgtgaattgtgggtcagccggctttatgacatcaacggcaagcttgatgacagactgcaaaactttgttaaacagcctacttacagtccccattgacctctcaaatctgtcctcagcttgtctaacagattgtggggcaccaaccatccaaagaaacatcgtaagtgcctcaaccgaggttgacttgctactagatttaagctcatacgactgtaccaatagatcatgcaggcgaaggaacatagttggactcattctaaacatgttataacaggcctttctatccccaagttttttatgtacccattccaaaccagtcatggcaggttgcctatactcagctctagtcaaatgcttgtcaatgtgcatggcatacttgtacataccgtacacataaccgtcgtcatcatcatccatcaatgcaatgatcaactcgtctatctcatcctcccaacgcttaagccgacggcgcgactcctcataacctgattggtcatcatcctctacataacctgattggtcatcatcctgtcaaaacaagcaatgcaaaatattagcaatgaaaaatatatagacatgattaatatgcatttctttctcagccatgcattacatagttcaaatcagcagcatacatagaattcatcaatagtagtaccatgctgatgtttaaataacacacatcgggaacatagtccaaacacacaaatacatgcaccatacatccgagtgaacatacggccattagtacataaagtaggaaatatagccatgacaaaacattagctggactagttgtcgacccctgcatatttcttgatgatgagcatccttccttcaggctcggtgacaatgaacaagtccatcacactttgatacttgatgatttcgaggacacccatgaacaatgttggggtctcagagggagttaccccacactcctttcccagctcgttaacctttgccaccttccgctcaatagctttgcgttcttcttgcatagcatcctgctttacttgcatcatggtctgcaggacactgagtttgttccttgaaatttcgttgtactcactcatgtttctgtccattaccctcactgctggactcctagacttcttacttggactcgaggctgtggtgctcgtgctgcttgtccttttgttgtcgacactaagaggagtcagctcatcgtcgtcctcatcatcatccgcttcatcagagctgtcacactctacaggctggtcggcagtcgcaacaaaggatgtagaaccatccactgcaacaccctcaaacattctgtccatttcaggcaaatattcaggcaagcctttcctgaacttcttccaatcgggatgtccctgtccaacgaaagcacatgtcatgacctgctgaacttaacatgtgttcacaacattagagagacatgaccaatttaccttggtgttggcagcccaccaatcatcttcggcgacaacagtcccatcagggttcctccctaagccagagctggagcgaagcttattacagaatgcccattgcttcctaagctgcctgtgtctccccatgaattgctccctgttgtgaactaaaccagtggcttggaagtacctcttaatgatgtccctccagccatttttttgcataataccgcgaacacagtttcctatgtccatttgatggcaccagatggaacagaaggtgcgagtatttctcgctgaccaatttgccttatctttcctaacctaaatgcatcaatagtcatggaaaacaacatcgaacatgtgaactaagtttgcatttaacaaaattttaaactagtcggaagcaggcaatcaattgtaattggaattgttgtacgtaccggaataccgtcgttagcatcggagtgctcggccgcaaggtccgagacattgtggcacactgatgcgcgtgatgcaggccgtgcgctcacggccacgcctcctcctccgacgactgcgcctgcgactcctcctccagcgcttgcggcccctgctcgtcctcctccagcggccgcgccttgtactcctcctccccccgcactgcgagtgggccggattccgagggtgcgagatattcgccggggaggaacttgaacgggcggtggaggaatttcgatgttgtcgtcgtcggcctgcagcatgcccgcgtacgtagccatttctggccacccgtcgctgtcgttgaggtcgagcgactcgaaccgcacccgggaggtgttgccgctagaggaatcaggcgggggatgcgccgcgtcagcgccgaccgcgccccctcggcgtgcgcaccaaggcccggacgcaaggaagtccttggtgcagccgtcgtggccgtacacgtcgtcatcgtggcctttgccgccttcgttgccattgtagccgcccccgtagctggccatcacgggaatgaaggcggatctgggcaccgacggtgaatcggaagggtgggcggcggcggttggagggatgacgtgtgtcggcgggggagggacgaccacacaagcggtggaagaattggagttgggcggcggcggtgtgagagacgacgggcggctccgctatgagcaacgaatgccggagcagcagaacctgctggatctgggcggcgggggtctcacggacagcgagcggcggctggctattttagggagggcgagaggcggctgagagaaggagggcgagcgtaggggaggagggggtcgatctgggagggggcggtgtcagggatggcatgcagcagcggtgggacgaacgaaggggcgagcggctgtgttggggattttggtggagcgacgaggagcagggtgaggggtactactcgtccatgggtgaacagtaattgcacatctgccaaaaaattttgccccccgtttagttcacaaaacgcaaaaagtggccccatgccaaaattttttggcccatcctaaaagatttcaccatctaaaccgggcactatccgtgcataaccgttcgacgccaacgagtcatcatacctgagcttaagcttagccactgcatgtgtcgtaccccgctcgcgtcttccctgagcttgtgccattcccaagcttggtcaatagctgccgcttgccccataacccgcttgcgtcgtccgcgagcttggccgccactaatccgggataccaccattgttctcgagctgttggttcaacctctacccgccatccccaagtcagtcttcgcctgagctatcccaggctcaacctcgagtagtgcttgcagtcggtccattgcctactacctagcagcaggaggagacagcggatatgttgccattgcagttgcgtcagcctacaacaacagacaaagagtttgaattggcggctcgcacatggtgatggcatcctgaagtggcgatgggcatcagacgaatggtgcggaagggcagaaggagtggcacgaaatcgagaaattcacatcttcgatgtatagatggctaaaaggcccggcccaggcacggctaggcacagcccaccagccatcaggctggcacggcccggtcggcacatcgtgccagaccgtgctggcccatggattgcacctctggcctaggcacggcccaccagtagtcgggccgtgccgggccagcccaacgtgccagtggaggggcccaggcacgacccggtggtcgggccggaccagcatgggtccaacccccgtcgggccgtgccgtgcttgggccggaccaaaatgccatgccgtgggccaggttgtcgggccttgggccttttagccatttatacttcggtgacacgttttaaaagaagggtgaatttgaggtaatttctaaaaaaaaaacccgatgaattgaatggcaactagtaaaatttatggggagagaagattaggaaggagccgaaaactagtttggtctctggtggtattctaacatgtagacatgggttaagggtaacatttacgaagtgccatttgggtgaagcctaatataatttgataatctcatcttttactctacaatgtatcaaccgctgacaaaatttaaatttaaagttatttttaggatattttcaaagataatatttaattattttttttagcattgacattttagggctctgtttggctatagttatagcgcagccagcacgaaaagcgctgcaaacatataaacaccaagccagcagctgcatcatcaattttccaaacagatctttagtcgctaagtatcttatatataagttctaccccctccgtcccagaatatattggatacggttattaagaaaatatgtagaattaaataggaatgggttatgattggctgagaaatggaggtaggtgagaaaagtgaatgacagaagattatgattgattgtgaagggaatgttggtgaataagttgttatattgtgcaacaaatcctaagtgctcaaagttgttatattttgggactgagggatcagtatttataaattattatttgatcgctaatgagccatttgacatgcaatcaatcaacttttattcgtgaagtaagcgtagcacaactggttaggtttcttatagtggaaccagttcacccacaatcaaatcctaaatttaacatgagtgctctcatttatagctaattattattttaatggtaggcgacgtatccgtcgacaagtccgtagtgacttcgtcaatctaaaaaaatgtcgacaacgagatgtccgtagtgacttcgtcaatttaaaaaatggccagtcttttgaaggtgtttagaggagtagggtgtgtacgtttatagggatgtacatgtgttatgagtatatacatttttattatgttccaaaaaaaatgtaagcttttcttctactctctctatcctaagtgtaattgtaggtttctttgcccaacgtttaaccaaaagttttattttaaaaaaatatgataaaatttaaaaataagttattatttgtgttttatcatctaataatattaaaaattatcaaatgttcaagaaagaaaaccgcaattacacctaaaatgacacgaagggatgataggtctgcagcctgcagttacagctatcccgccctcccatgcttcgagcgttccttccagtgacttccatgaccggcagctagatctcatctcgcaagtggaatgaccgcctcgaggtctctcctcgccgtcatcctcctggccgcgaccgccgccgacgtcgacgccctggtgttcgacgtgccatcgggcggctccaagtgcctgaccgaggagctccgccgcggcgcgctctcccacgcgtcgtaccgcgtggccgaggccacgtcggcggcgtcctccgcggtctcggcgcgcgtggcggggccccgcggcgaggagctgcacctgacggagggcgtggaggccggggagttcaggttcgaggcggcggaggacggcaggtacaccgcctgcttctggacgccacgctacttgcgcggcgccattgtctccatcgacgtgcagtggaccaccgaagtccgcgaccacgccggtggtgccggctccccgccagccgtcgcagccgccaaggaaggccacatcgatgtatgctctctctctctctctctctctctctctctccactactactacttgcagattagttgtcactagatcagatagtgtaaagatcagatttaatttaagctacaaaatttgtgtcgatatagtgctggacaaagctataagtaattaatgggtttaatgtattttagatttcgtccagcggtttgtttagaaatttgtccgcgtgttccgtttatgaaacggaaataagacaactacaaatctcatttagatggtcaatgaaaatggaagtgattgatccgtgtggtgcgtgaaggtgattctggtgccaaatgcagtgtgtacaggtgattttgatgtttcacttcattgtaattcacacaagcataatggggattaggaatgtagatgcacacgcttctgtaagttgaaagtcaaaattaggtgaacaatggtagcatgtagtgcctctgtctcaaaatataacagcatagaataagataggatatatccgtactacgaatatgtactggctttatcgagatttgtagtagaggtgtctaatctgattttaggttactataatttagtctgttttttaatagctgacgttcaaagattagaaatgtgcctattcattgtgttgagctcagtaggatgtaatttaatctcaagggagaattaaatttgaaaatatactattcattcgattttttctcacgaatattcgggatgcaaaattttttacagaaataaaccgtcggtctcgcacaaccgttgcacgaaaacgacgtgggaatgacgtcgcaggcggtatcgcacgcagaaagcgcgagccgcgcgggcatcagcgcgagaccgcgcgatctcgtggattagaatatcaatactgagcagattgaaagggatgtctcgcggtctcgctcattgcatgagcgatagcggttcaatgccgatgtaattagcggttaattctaattagtgattaattatcctaattagtgatttgattaatcactgattaggataattaaccgctaattattattagctaattgtatattaaataattaatccctaatcaaatcgagccgttggatactatagttgtttgattttgcgagaccgtttggtctcgctcttccattccacgagaccgtgcggtctcgcgctttccctgcgcgataccgtccgcgatgtcattttcgcgcaatggttgagcgagaccgacggtatatttttataaaaaaaatttgcatgtcgaataatactgagaaaaaattgtatgaacagtgtatttttaaatttaattctctcatgggaggtctaaaagcagtattataagaattttcattttcgaatcagtcctgtacgatatttttttttcattttcgaatgtcctttcctagtcgatgattggagagttgaagaaattggaggtttctactcggctcatacatgaagagatgatttctctccgacggaggtacggtactcgaagactattccaagttctctttccaatgtaacattgttgcttattgatctcttttttttttctctgccagcgagggtgagatgcaaaagctcaacgaagacacgaccatgaaaatacactcgttcaccctgctatcgctggcagtttgcgttggagttgcagggctgcagctgtggcatctaaagactttcttccaaaaaagacacatactttagggactagatggaacaaggagggccatgccttactgattttttttttcaaaaaaaaaatcatgtacaaatataatgaactcggagggtcttgcctctctccgagttcatcactgtacatttattcttcagaaaggaaattagtgcaagtccatctcatacgtttgcttgttttctgcagcattttgttggctgtttcacttatcggtaatgtgctccaagagttccagaccttgaaagtgcctggtgtcatttggcggtttacggaagagcgctcaccaagctatacacatgtttagtctttgggatgttcgatgctttctgtaaattataccaagctaacaaaagggtcacaatgccggcatattttcatgaaactaaagcccgcataagtacataacagaaatgggactgaaggagacacatctatgcatcagattataagtccaaaagaatgaaaaaaaggctctgatatggctttgcattaatacaaaaaaaaaatccttacaatggtcagtacttaacatctgcaagctatattcctcatgtgtacgtcaaggtgtaggcggccaaacaaatagaatcgaaaatggacaacaaatggtgaatcaagtaaaaaaagaatctaacctcaaacataggatctacactccctactaagtcggtgaactaagccaaaactatatgctgagaccttcctttctttcataagttatagccaagctatttctgctatgatgaagatgcaacctcaatggcactaccaaggggccatgctgcttcaacaaatgaattgctataaggcaccttctttaccaatgtaatatcctggtagggatccacacctgaaagaacagcaaacagaatgaatttaaaaatgtctaaatcttacaaaaagtatcgtgttttttttcactttgcattaagatataccaaatccatccacaag

SEQ ID NO: 57887 - DNA, 17314 bp, Oryza sativa
tattttgattttccatgcatgcatcatcccgatcactactccaataatgtcaaaactgccaatgtattaatttcctccatatcttctatactctctacttctcatcagtactgccactactagaacaacgatttttgcatgtagccaaaacgaaacagcagttggacgtggtggtggtggtcatcattgcagggaggattgatgccgccattgccaccgagaagccgatccggaagccggctttccatggacgccgcttctaccaccacctccagtgccaacattgtcaccaagaccaccacgaggaagacgaccacaaacagcgcgaggagggtgcgcccttgccaccatgacgaggaggaggccaagacgaaccatcgccagatccgccgcctccgccgccctcattgctagatccaccaccctcgtcggagaaccgtgcgccacggccgggggagcaccaccgctgctcccttccccgccaacactaccgagccccgccgttgctgccgttcgggtgaggaaagaggagcttgagagaggaaaagggagggagttagggacttagaaaaaactggtgtttcagtttccttttgcgtctatttaaatgccacaaccaaatttcaccatatggcttaagaggcccgcctgcaaaaataagggtattattgcaggcggcccttttaagccatctgcttgcaaaaatgggaataggatattcccaggcggtcggccattggactcctctccacacaacaactacacagccaggcaatcatagtcgaaaataagatcttcctgtgaaaatatatgtgttcattgtagaaaatcgtttttctagtagtatgccacccatcatcagccgcaaggagagagagatgaagcaatgagcaatggctgatcttcttgcaatgctagctatctactgtggctatgaacaagaaggcagacatatggaaacaaacctagctataaaaaaaacagggagaaaaagatgcctactaaatttgggcataaattaaataaaaaaatcatttacactctttgaatggaaaatatgaataggatcacatttttcccaatacttttgtagaggaagctagcaggtcctagtccttgaacactaaaatacattatgtaatgacaaatttaattagtttatcataaataaaagaaaatgttattagggatggaactctgctaattaagggttgttcgagttcaggctgctccttaagatcatctcggtgcggttttatggattggcgaagcatggtaaaagaagattcaaaaagcttacttttctacattttttttgaaaaaaaatacctttgttttgttttgttgtttcttagttaagatatttgaaaactaacgatttttgtaagttttgtctatgtatagtatatctatttatggtagaaggtctgggttctctatctattatattgagacagagagagggagagaacaaacaagtgcagtgctttccttccctcttttcttcattggcccggttcttagcataaaaccggctattgtttggtgaagacaagcgctcacgagccggcctccttggtcctccccatccttggttgtattgcattggaggcatatgattgaacattggcggtgttgccccccatggcatgtagtaaggaaaaggataacccggcgacggcattggataaggcccccatgacatgtcttgaggacgatgatatgttggtgattccgaccgtcttggtgaatgaccaaatcactccctaggaggtgatcttggtcttttccctttattgccagctttctcaccaccttgcttctcatacttgtccaaaagcatatcgaaggtcaccttagtcttcttaggagctttagaactcgaagcttcattcctattctccttccacacgccaacctccggattctttggcaccatcatctttggcctagtctccccaatgaccactcatttccccttagtagatgtaacgcaccgattttctttcgggattaaaaatcaattaataatgcattttctagaaattaaataaaagttaaagcaatttaatcaagtgaaatagtgagggaattaaaaattttctttaaaaaatcattagctgagaatattttgtaatattctttgtgccctagtataccctccggatttttccatgaattttcagagctcaagaagtaattataataatacaaagttcaattaacaattaaataaaaaagaaaaacaaatttaattccctcttcttccttttgggctgacccggcccaatccctcctttcccctcctcggcccgcttgcccctctccccttccccttcttccccctctcgggccgtcggcccagctcgctccccttcgcaagtccgtttgtcctccctctcccgttttcccctccctctctatctccgacaggtgggacccgaggccccacctgacatccccttcctccggctccaaccgcccccatggccgcccgagccaccccatgacgccgccatttccgccctcctcctccaccccgcgcgcgagcccgccggccgtgggaccccgtggccccacgtccttctcatccccacctctcccctccaaaaccgccgcccacaccccacgatgccgcccacgccaccggcggttgccgccctgtctccgcctctccttggctcggtccgacctcccctcccctataaaaacactccccagcctcccctctctcgtttcccccaactcccgagcttccccgtgccctaaatcgcgctcgcgacgcgagtccgagctccgccgctcgtcgccgtgctccggccgccccatgtggccgctcctggccacctcacgccgcgcctccgcctccaccgcgttcgccgcaccgcgtggaacccccggccgccactcctttttcccccttccaccccgaaacaccgttcccaccgtgcacccaaagccgccacctctttcaccgcctccagccgctcgccaccaccgccctagtcgtcgccgcgctgcgccactgccaccgacggcttcgccgcgaggtgctgcacaccggcctcagcttcgtttccccaaatcaccaccgcaaccgcccctccaccgtcgacccgagccaccgccaccattggccgactccagccgtgttgtccctctgctccggtcgtcgccgacccacgccgtcgcctccctcggctccgcaaggacgaggagaacctcggccacctcttcccatcgctgaaaactcacaggacgtccgctatcccgtgcgttggtgagcccttcctcccttcttttcctctccggccggccatgtcgtcgccccgtcctccctaacacctcccctcccatcctatggtgcagctgccgctcgtccgcctcttcccgagctccgctcgtcgccggagcatcgtcgtctccctctaccccgagctccaccgtcgctacctcccgttgccatcccgccgccggccgcctccttccgccgtgtggcgctcggtgagaactcccccacccttcttcctcctttccccttcgctggccgcctcccgtgctgtgcaccgctgctccttgcgtcgccggccgtcgccgccggttgccgcgccgtcgctcagccgagccggccctttgccacgctcgtgcgccagccgcgccacccgaccgtccgatcggtctcggtcgatatgggccgtcgggtgtgtgcccgcgtggacctggtaggccgtgccgctgacgtgtggggcccgcccctttgtggacgcggtccacgcctcaccccttgctgcgtcagcagagtccatttcctttgagaaaataattaataattgcgcaataaatcaataaattctagaaattcatttaaatggctcaaaacttctaaaatccatatctaattcattcgaactccaaattgggccattcaacttgtaaaattcatctaaaattgagatctacatgtttgtttgctttctatgtactatttacttggtttttattagggtttttcctcaatttccgtgctagcgtgtataatccgtcgtttcgaaaatccgcggtcgcgaggaaaagagttcagaagataaaagtgaagaagcaaggcaagtcacacattccccttgagcattttgatcctactttacaaatgttttcccgtttgcaaataaatatgcatgttttgctaattaaatgggatcatggtttacctatctgcttgcgtgtgccatgtttacttcatatctgtcctttgtcaaccttgggtgataaatcgactagcttgtgttacttatgttgacctagctagaatcatttatgcttagccatgcttaattactactagctcagttgatgagataattgcagtattagaactttttagtatcatggcgagctgcgtgctcgagacatcagaccatgttccattggtcgtaattatccaactaaaatgcgactgaatggtgggtcgtgggtgcatggttttgctagtcgcacccatggcaattaaggaccggttcgcgggatgcactggaagacttacagcgcttgccacaattgggaatgggtaactgcctgacttaaagtatagcttttctctagctgacgcatccaggcaagggtgggcgtgatggagcgggatgggccctgcgacggcctttgtcgcttccggattcacctaggcacgagaggggactgcccgctgcctgctgggggcgggggtgaaacctgaggtgtggtgtgtttggtcagagggggttatatgaagggtcttgtcacaatcactcgacatggtgacgtgtccggccgggcacggtgacatgccggtggattgtgtcttgtgggtacagttgtgcacttctggccaaagtaaaactattcgaatagctgttgacgaaaaaatcgaacacaccggcctgggagatctgcttagctccagtgcaggtccaaatatgatgagatgcgtgcgtgccagtcagtttgatcctgccactgacaagatatgcaaatagtagatcaaaacagccgatcggctgacaagccgatggagtagttccagccgatagccgataatagccgatgccgataccagccgatagcgatagggtttaagcaatcggctatatgtccaatgtagataatgatatagaggcaatcggctgatgataatataatataacaataatatagtccagtagaaaccaatcggctagcaacgatatgatagaataagcactgatccgaaggttaaagcgtatatcggctggaggtccgatgccataaaatccacatattagattaaacagtgaaacctttgttgcaatcggctaaatccaacttatatatatatatgtaatccttatgagctgatgcaacatccagataacttatcggctagcaccccgataaaacattagtatgaacctatcggcttcacaagacttatattatcaacaacaatctagtaggtcgaacctaaccgatgcagcatgagatgagattgtatatgataatctaatactcgatgagccgatagatctgtctaatgtgaaggatataacaaatctatttataacagcattgcgattatagagatatatcggccaagatagaagatcagacctaaccgagacagttccaactaaaccgatgcatctctaaacacaatgcaactagagatagaattgagatatcaggtaggcaaatatgtcaaccaaaccagagcgatccaagagatcgaagcgatgcagccttgaacaacaccaacgtagccgacagattcatcagggcccgacggaacataggacttaccccttcgccggagatcgaaagccgatgcagccccgcgtcaggtgcccaaatcccgccggaagataagtaaaaacctcgataaagagggtggcgatgcgccgagagtattgttgatcgatagattgataaattacatagaccccgggtgtacatatttatacccatagggagatactagtccttgtcggacaagaaagaaactaaaaaggaaaagattaaagtccctatcggacactaaacaaactttcttaaagataaaaggaaactaacaaactatgcctaattaatagataaactgtcatgtcgcatccttcttgatctcagactcttctagataagcttcctttgattgatccgactccaccaagaacatgatatcgtggcgacttgactcccatcggctgattctagaactttgaagccgataagtggagattcaatgttaccttaattaaccaattgttttactgttttgcgcaataaatgttttacaaccgcctttatgcaaatagccacaaaccgtccttgtatccccttgcacgtctgcattattggtgtggcttgctgagtacggtggttgtactcagccttgctattgtttccccttttcagaagtgtagtgcttctaagatgaagacggagttagaggaccaaggctcagaccccagttgagttttgcctgtagagtgaagctgaagccccgttaggatcgcctttttccgctgctactgctttcgtttcggtgtgaggactaagttcctcttctataattattttacgctttatttacatttagagctgtatattacttgtcgttttgtgtaccctggctggtcctgtacagggatttaatacacaaaatagtttggaaatttgggctaaatttttgggcgtgacagtagattcggcttgctccggccgaatcaacaccttcttatcattgaaattaattgtatttaccggaaaaggatcatgatcaagcttcatcttggaaccatgggtaaacttcaatcgtccttcatctatggccgattgaacctgtcgtcgaaacacattgcaatcattagtagaatgagaataagaatcatgccatttacaataagctcgacgcttcaactcttcttgagatgatatgatatggcctttaggtaatctaatttttttttcttgcaaaagataataaaaaatcttatcacatttggccacatcaaaactatacttaacctcactttgccgatctttacgaggagtcggcattaaattagaacaaacaaaagccttatttttgttagtccatgaccactcaacaacatgcatatcatgatcaccctcaccatcactatcactagcctcggggtaatcaatcaaattaacattaggcttcttctcatatggtctaacaaatttcttactatccttaacccggctttcctgagccagaaccatttgcataagttgactaacatcaagaaattgttggccatctaatctttctttaataggagcaattaaaccattaaaagcaagatcagccaaatccctatcagttatattcaagctataacatcggtttctaacatccctgaacctcttaacataatctatgacagattcattatacttttatttaaccgatgttaaatcagataacctaagctcagtttcaccagtatagaaataatcatggaatctttgttctaattgagcccaagtatgaatagaattggccggtaaagaagtaaaccatgtaaaagcaataccggacaaagataaagaaaacaagcgcaatttaaaagtatcggaactactagcctctccacattgcgctaagaattatcctacatgttcccatatggtcctactatcctcaccactaaatttggtaaattcgggaaccctataactacgaggatatggtacatcgtcatagtaatcaggatacggcttttggtaaaccttagcacgattcctagcttcaatcccgaatttatccctaatgattccactaatcaattcctctatattatcaggcctatgttggtttggtggtgggtttggtggcctaataggttgaggttgtggcgcaatataattatattggccatgcctagtatcggtgggatatcccctactaggatcattataagcattgggaacatgtgggggaacttgggaacaagcaacaacagtagatacagggggatcaaatgttctaagatggtacaaatacgcgttatttgtaataggatctaccccctgtataggaataattgcgtcggtctgcctggtccaagacccggtctgaccggcgtccagaggtgcggtcagaccggtctgaggtccggtctgaccgccggggtaatacccagtctgaccggccatctggccggtctgactggcggcaaagtcgcggtctgaccggccatctggcccggtcagaccggctgtatgcgccgactacccctcgccggtttgttgcgtcttcgccccatcagttttactacttatttgatctataggggcttggctagcactggtagaggctttatctttgaacataaaatcggccatgagagagccgaatgtagtcctcatgaattcttcacaacgagtttcaatagatgcatctaatttattatttaaagtaaccatagatgaatctattgaatgtgcaatttgttgttggatagattgtgataactcttcagcacttaccatgtcaaaagtaggtttaggcaatgatcccggcttgaaaaccacaccttgacgggtcctagcgcacgccttcgtcaatagatcttgagtatacgccttaagatgttcattcaaagctttgcgtgctccctcgtcaagctcctccaatgcgactggtatcacattgcccggttccacctctgccttggttgatggaagctttgtcatgacgacgtcgaagttgagatgcctttgagcagatttcccaagcggaatcaccaaaaatcgtgttggcaactttttgtgacaagttgacaagcacaatcgtagcacctaaacgccttgcagtgatcctagagtcgccaaccacctcaatctagcaaaagctaaaccaagatgggttttgataactaaaccggctagcggagccgattctagataactacccgtctcgtgggcaaaacggaaggttttcaggacaaacctacaaagaggtgtcacactctcgcagcggcggcggacgatttacggcgcaaatcgacaaagatggacaaactaagagaaaactaaaagcaatatggaaaacgattcgattgattgattgtagattgaattttacaatgaaccggccttacccccttatataagggttggtcttgctctctacaggccctcctccacatccaacttgggatagaatccaaaagaaacccgaaacatgccttcccgagcaaggaaacccgagacccgatgaaaacagaaccggactcggactctgccggtcagaccggccacacaccaccggtctgatcggccctcattcggcggtctgaccggccaacatacgacagtcagaccggcccaatcagaggaaaaccggcagacttccaaactttggtaattttccctattttatccctaggtgccaaatttgggtgtaaatacttcccacgggattaaacaaatacgatacccttggaatactctcgggtgaaatgctacaatggtatatccgtgcgcttgtggatgaactctgtaaccatatataccaggagtatttctgcaccattgctggaaattatatttctagtaatgtcgttaagaaataccaacaactatccgcaactcgtggaaaaggaaataaaagatgaaaagaattagtaatacgaataaattggacgcggttctcctacccccactgtaacgccccgattttcgttcgggattaaaaatcatttaataatccatttcctagaaattaaataaaagttaaatcaattcaatcaagtgaaattattgggagaattaaaattttcctttaaaaatcattggccgagaatattttgtaatattctttgtgccctaaatatcctccggatttttccgtgaattttcggagctcaagaaataatgttaacgatacaaagttcatttatcaattaaaataaaaagaagagcaagaaaatttccccctctttgattttgggccgtcccggcccaatccccctctccctctcgggctctctctctccctcggcccagctcgccgctcggccctctcctccccgaagtctactttgcctccccaaccagccaccctctcctctttggccgacagatgggacccatgggcccacttatcatccccaacttcaggccggcaactgtcgttgccgcaatggccgccgaaaaccgcccacgtcgccgccattcccagcctcctcgagccctttcttgcgtgggaccggaagcaacccctctcttccacctactcccccgtttttccccaaaaacaggcgccggtttggcccccacgatcctacgatgcctcgccacttcaccggtcgttgccgccccactcggccacggttccccctccacgagtgtatataaacaattcctggagcatcctctctcgttttcccatttcgcccgaacccgccacactccccctcgctctccccacgccgttccccatcgccgccgcccgccggcgctctccagccgcgcgcctcagtcgctgccgccgtctccgtgctgcgccgttgccaccgccggctttgccgccgcccgggaaagctcgtccactgctccatttcccctcttcacctccgaagcgccgcagccacgcgaaccacctctctccgccgccgctgccgactccagccgcgtcacgccgccgcttcggtcgacgccgacccgcgccattgcctccctcagctccgcaaggacgaggaggacctcggccgccgcccctcttcgccagaaatccgccgtagctcctccttcctcagtcgccggtgagcgcctcctcatattgtcgtggtcggccatcgttaccggtcaccacgcaccagtcctcccctctctaacccctcctttatcttcctcagatcgaggccgagcccgtccgccccttcccgagcgacgcccgtcgccggagctccgtcgcatcgtcttcctgaggagccccaccgccgccggtccttgccgtcggctgccccttcgccgtcgtgcccctcgttgagcactcccttccctctcccttttcctccccttcgtcggccacctccaaggcgtcctcgcgatgcgctgccgccgccggtggccgtccgaccgggtcactgccgccgccctccgcgcccgcgccgttgccggtggtgccgggcagctggttgccgcctcccccttgccgcaccgcgccgccgctctctcgcgtgcgccgccatcgcccgcgtgagtcgttgccggccgtcgccgcaagtggccgcgccgccgcgagccgtcgctcggccgggccggcctgagccgtgcccgtgccctgccgcgccaccccgtggtcgcccgatcagctcgggctgatctgggccgtcggttcccgtggaccggcggtggaacatcccatggtcctggtccacggtggaccgattcccttgacacgctgacgtgtggggcccgcttgtcggcgccggcctctttgatgacgtcagcgcttaagccttttcctttgtaaaaataattaataattgcgcaataaatcattgataattatagaaaatcatttaatggctcaacaacttctaaaattcatatctaattcattcgaactccgaattgagccgttcaacttgcaaaattcatctaaaattaagctctacatgtttgtttactttttatgtactgtttgcttggtttttattagagttttttctcgttttgtgtgccagcgtgtagaatccgtcgtttcggaagattgcgatcgcaaggggaacgagttcagaagatcaaagtgaagaagcaaagcaagtcacatattccccttgagcatgttgatcccaatttataaatgttttaccgtttgcaaataaatatgcatgttttgctaattacatgggatccgggtgttacctatctactcgcttgtgccatgtttacttgatatctgtcatttgtcaaccatgagtaataaatctcctagcttgtgttacttatgtgaccgagctagaactatatgcttagccatgcttaattaccactagctcagttgatgggataattacagtattagacctttttagtatcagaatgagctgcatgctcgagacatctggccaagcttcatggtcatatttatccaactaaaaaagcgactgaatggtgggctgtgggtgtatggttttgctagtcgcacccatggcgattaaggaccggttcgcgggatgccctggaagaacttatcatacttaccacaagccagcgtgggcaacggctgggcttgtagtgtagctttcctctagctaacgcatccaggtaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagtgggggttatgcgaagggtcctgtcacggcctctttctggtatgtcatggtggcatgtcggcacacggaaacgtgtcgtgggactgtgtcttgtgggtacagttgtacacctctggccagagtaaaactattcgaatagccgtgcccgcggttatgggcggtcgaccaaattcaccgtcattagtcccaccttaataaatcgactcaatgcactgtagttcaggtgggttggttgggcctgttcaacgtggtgtagcgttgataagtggagatttaatgttactttaattacttaattgttttacggttttgctcaataaaatgttttacaactacctttatgcaaatagcctcaagccgtccttgtatccccttgcacgtctgcatcattggtgtggcttgctgagtacagtggttgtactcagccttgctatttccccccctttttcagaagtgtagtgcttctgaactaaagacgaagttagaagaccaaggctcagaccccatttcttttccgctgctgctgctttcttttcggtgtgaggactaagtgcctcttctgtaagtatttacgctttatttatgtttggaactgtatattacttgtcgttttgtgtaccctggctggtcctggacagggatttaatacacaaaatagtctggaaatttggggctaaatttctgggcgtgacacccaccacttccaatttcacttgctaattaagataaatataaccgtacaaattttaagtatctacggctaattattctttcaatggtaaacgatgtatttgtcgataacgagacacccatagtgacttcgctaataccaaaatataccgatctagttttttagatgtgcttatagggataagcaagagtggatccaatgtgggtgttgggtcactcgagcccctgtaccacactgaatcaccattgatagaagaagagatggaaggagaagaagagggatatgaggaatagtggggtttgggtgtgggggccgaaggaggaagaaggagatgagtctcacctatatatggctgagttctttacctcacttttccaacttatttctcttgtttttcgcgcgcacgcttttcaaactattaaacagtgtattttttgtaaaaattttccatacgaaaattgctttttaaaatcatattaatccttttttgaaaaaaataactaatagttaattaatcatgcgctaatgccatgtcgttttgcgtgccgcacccctcctcccgaacacagctaatctagttctagatccctatttgaagatagggtgcatgtatgtctgcgtttgaacaacttttctaaaaattttaaaaaaacttggaaaacgaaaaaaaggcctgaaaatggtataggagccatgtttagttaaaaacaaaaattttcacactgtcacatcgaatgtttggacatatgaataaagtattaaatgtagaaaaaaaactaattacacagtttgcgtgtaaattgcgagacgaatcttttaagcctaattgctccacgatttgataatgtggtgctacattaaacatttgctaatgatggattaattaggcttaataaattcgtctcgcagtttacaagcgaaatctataatttgttttgttattagtctacgtttaatacttcaaatgtgtgtccttatatccgaggggcgggcccacctcaattcaaagggtattcaaatgaatacccaagatttttagacaaaaaaaatacatatgtgagatatatatttcgtatgtatatagagaaataaagaaaatatacgttattgatcgaaagaagtccaacaagaaagcctagcaggctggatccctcaaaatcgaacccaattatgcatggttgtctaatttgtgcattaaccatgttgtaatggcatgacgccaatcgatatatacttggttggtagattgtactgtatatgttttctcacaaagtatatcataataaattaagaaaattgctaaaagccttgtcgcaagttctaattcaataagcagtactaaaatactatactattgatcattcatacctaatattgtgctcgtgttgtaaaaattatttttttatcccctttacatttctaataactaatctcaaaatcctgggccgcccttagacgtgacaaccacacacacacacaaattttcgcccaacaaacaaggcccccaacttgccccccaacacgaccggtgagcgtgagtagcagtagcagctcgaaaaaaggacacgagggagggagagggagtttgccagatccggatcccgcaccagatgcgcccgccggcgatgctccgatggcccgccgccgcggcggcgctcgcgctcgtcttcctcctcctcatcgccgccgcgccccccgccgcggccttctacctccccggcgtcgcgcccaacgacttccagaaggtccgttcctcctccccctcctcctcctggtaatggctcccgctcctgcgcttgctggatctcggcgatcccctggtgcagatccggctccttgagtcctcgtgctctagccttttcggggttgtccgtacgcgccaaatcgttttggcttttttttttctttttttgaaaaccgaagccagcaaagctggtgttataattttggcgtgatcgtcgtcctgttcttccacacacacacacacacgtaggggatgctgtttcgtacgcgtttctgtggatgttggtggggtttggttgatgagtgatgaatctgtgtgccgcttgtcgccaatgttgagaataaactgtatattttcagtgctgtttgatgtaggggtgtggctgatcagtgctaaaggcgtaccgacatttggttagggatgcctctgtcatgtggttctagttgcatgcctctggaattctggatggacattagcatccttagattagatccattgtttcgcaagcctcagtgctgaggcagaacatgtttctaaccgaaagcgaagcaaagcagtttatctctttgagtggaaaaaacttctgcaatgatcctagcatatgcatttcgtattatccctctgaacattttcagaacaaattatattgttgactatagctgtattctgtaattttttcaagcttgcgcattgagtaaacacgctccaattttcaacatcttctcagcctctctataccgtaccctgtttatcttctctcgtcaattgttgccagttgtgcgtgtatcctcaattttgtcacttacgaatggcatgcatgtccttgcaacacctgcttaatcacccttttacccttaattttttttgctctctatcgttcagtcattagttttaagaatgactgtgctactaggcattttctaggttattacatgtttattctgttctgctacgtagagaagaaaacatcatgaaggtgactgaaagaaaatatttttgagtctgtgaagaaaaaaaatatctagtaatcttaaaaaacatacatttacatttacctgccgtactgacaatatcttaaaaatatctagtcatatgttttggatgtgctctaatggacatatatactacaatgcctgcagaaagatccacttcaagtgaaggtgaacaagctgtcatccacaaagacacaactcccctattcatattactcccttcctttctgcaagccagatacgatagttgacagtgcagaaaatcttggagaagttctacgtggtgatcgcattgagaattctccttatgtggtcagtactggtctctggtttacagattatctgagcgcactcgcatgttaatgtacctaattatcttctattttacttctttggactatagtttgagatgagagagcccaagatgtgtcagatcgtctgcaaagcaaccattagcgataaacaagcaaaggagctaaaggaaaagatagaggatgagtaccgggtgaacatgtatgcctgtatggattgtttagtttgattgaaatttattttatatgatgggttctggagtaacatggttaaattaccttacaggattcttgacaacctcccgctagttgtgcctattgcaaggccagatagggatgatgttgtttttcagggtggatatcatgttggtgttaagggccaatatgctggtgtaagtctctgtgctcagcttaccttttcttttgtttggaagactagtaatgatcttacaaaaatatattttgcagagcaaggatgagaagtactttatccataaccacctgatatttttagtgaagtatcacaaggatgaaaattcagatctctctagaattgttgggttcgaggtcaaaccatttaggttcattcccttaacctttttatgtttgtttcgtacaacgtctttgacatattgggcaaatttatgtttaatccctcatatgtgtttactaaattccctgactcagtgttaaacaccaattcgaagagaaatggaatgatgcaaatactcgtttgagcacatgtcatccccatgccaacaaaatagtaataaactcagatactcctcaagaggttgaagctggaaaggatatcatattcacatatgatgttggctttgaggtgatgatattttcatggcatctcttctttccttttgtactatgactcttttccttcacagctatgcttccaatgttatatttatttaaacaatatcttttggttttcttcgctgggtcttgtaggaaagtgatatcaagtgggcttctcgctgggacacctatctgcttatgacagatgatcaaattcactggttctctattgtgaactctctcatgatcgtgcttttcttatctggaatggtggccatgattatgctccgcactctatatagagatatctcc

SEQ ID NO: 57888 - DNA, 1880 bp, Oryza sativa
tgagtacttacagtatctgacaggctaatttttatcagcaaagaattagtctaagcatcaattgttattctgattctgaaacaagcactgaacactctctgaatttacagtcagtcaaggggcaagttggatccggcacatgacgaaaacaagctgagaatttgcgtgtccctccggtgtcggtacatccggatgcagcgacatgctggcagtagattctgtgctgtgtgtgattgatgctgcatcgctgaacaggaggaacatttcacattttcttaatgcgtgtgcttaagacttggacgctggaacaggtcgacggattggcagtttgattagggtgattggtgatggatccgataaacaagtgtcgttgtgctggtgtaatagtataatctggtcgtttgactacggggttggctagcctggcactgcagcctgcaggagtgcagggtgcttgcaaaaatgtctctggcgtctggtacagtgtactgatcatcttaccagtgtttgggggattgagatttctgcacttggaatctcatcttgcttgtcaatgttctgctaatcaagccaataaaatcgagtgaaaattttcctgtctagttaaaaatatattcccttcgttataaaatatagcaatataagatttgacaggacacgttttagtattataaatctaaacattcgtctgtctagattagcaatattaggatgtctcccatcatgttttaaattgttatattttggtacgtagtaatactgaatatcttttttttttcattggacgattgaaagcatgcagattttaggacacaaaatgaagcactaaggccattcccaacccaatgactaggatggtgtccatagcattaaataagttgccacctaggataaaaactgatgtggcaagtgaataaatgagaaaagagaagaaaaccatgtcttgcatgagacttgatttctacacaacatccaagacatcatgtgagataagtagcattaaatttaagtatgaaatagtagtgtttgcattggaagagtagtgtctagtactagtttcttgatgatgtgaagtttatggaaactatatctagtgtcttgggttgggaatagcctaacagtctgtcagtttttatatcggtgtagtaaatcgattgatctactatcctgtcagagagtaatgggtgaagccagggtggcgtgcgtgtgaatatgtgatgaacgatgatgaactgggggctgaatctgaaacacaattcattttgccgtgctgagcacaagctcagctatccgctatgctgaatgaatgaatgaatgaatgaatgaatgatcagttcatccattagtcgccacgcatgcatgccatggtcagcctgaatccctgaagtgctcctcttaagtgtatatggcttagctcagcgacgtcttcaatggctagcttgggcgcatctcgcattcactccatgtaggaccaagccatggatgcgtcgagctcggatgattggagattaatttgagaggagtggttgggtacgtggacctgtggcgccattggtgcgtgggtcagtgggggagatgggaggaggtggaagaagaagaaacgctgcgatccgcacggacgcaacaaaaactgtcccagttatcattcatttcctgcagctgcaggggccactgccaatgatcaccatgtatgggctacctccatgattccatggggggttttcacgaacccgctaggtgttagtttatgaaaacccgtcaatattagtcggttttcgtacggcgttgactaaaacccatcggtttttactagtttttttcggatttcggtaaaccaatgagatatgatttttaattccaaatcgaaaaagttaaaccct

SEQ ID NO: 57889 - DNA, 757 bp, Oryza sativa
agctgcaggggccactgccaatgatcaccatgtatgggctacctccatgattccatggggggttttcacgaaaccgctaggtgttagtttatgaaaacgggtcaatattagtcggttttcgtacggcgttgactaaaagccatcggtttttactagtttttttcggatttcggtaaaccaatgagatatgatttttaattcgaaatcgaaaaagttaaaccctgaatctccatctccttgttcaagttcatcttaattttttttttgttcttttttcctctcctattctcctctacaagatccgaaaccatttctctcatctatacagaagtatatccattccgatctagtatgtctgaataatggtgtatggacgagctaggcttgatgggcgttgcgagaggactggctggctggctggctgcatgtcgccagctgtacaaagcgccatgaaagcgtcgtcgcgtcggagcgagatcttgagcgacggtcagtcctgtactaacgtcaggactggggctgtacagctctgacattgtgtgtgtgaccatagttacgacatccctctcgagtaaaaacgcccatgcatagcatatagtaggactgtatgggagctttcaaccaggaagaatctatgtcaaaacagtccggtacacgcgcatttaaacacatcttaataccctgctaatcaaagtttcttgcgctacgctattaatcaaggtccattcttaccagcatttgtcgcctcatgcaaaaa

SEQ ID NO: 57890 - DNA, 3104 bp, Oryza sativa
gggcgaattcgagctcggtacccatttattttgaagatctgaattttttttgacaccgatctggttggcgtgttagcattgtcttgccatgccacctggctgatgtgataggacgttcgttgcgggtgatgtgtcagtgttgtattactcttttggaaataagttttgaaagtatttatttttaaactaaatgttgacgctttttcatggccaacacaaaatcacctaacgatttgcggtgtatgtaatcaacagagtcgccaaaatcgatagatcaaaatcggctagtgaaaccgatttcgagattaattcactttcgcggaatcaagcgactaatttacaagcaaattagtaaagaggataactatcgcacttacgtgatgatgaacgactagtttccgagcaaactagcaaaggataacctcctcgctttcgtggagaagcacgaccgtttttcagcgcaaaacggcaaagattaaccaaattctagggttgacagaactcagccatgaaaacaaaatagaataacaagaatgtaaagaagaggaaaatagtagattgaaattgtttggggggttctcaaactgatctaataccccactatatataggggcacctaaccaccggatgtgtaaatcctacattcatggaaactcttaattaacaaatcagctgctaccaaaaatgtatattccatagctgactttaccgcatagtcgcataatccagtccgcacacacgattctgccttggttgcagagccaagcagcagtgtacgtaagtgcatcaatttccatcgcttgtccagcacagcagctctcaacaaactgaaatacatatttcctcgctgcactccatcatgccatcaacccatcaactgatccatacatatcccaatgccagattaaatactatgatcacccaatgttttgcaagcatgatctagccgatgcaccgaagatccataagccaaattataccacaaacactaaaaaggttaaaaaaaataattaaaaaccgggtaatagtgtcctcgtcgcagaaggagcgagtccccttcatcatcggcagcatggcctccggtgccgccatggcagcggcagcgagaacgtcagcggacgcagtcgcgtcgtcgtgacgatgacatgggctacgcgcgccgggcagaaactgactcctgcactgcacatcgtggttgtcgatgaggaggtaggggatctcacacatgagctagctccttcgtgatctcggcgatggcacacgcttcgtctttcccggcgcccccacgatcgagccagagatgcaggagtacgttggcctgcatggcccctgaaagggggcttttaacttaggcctgatatgcgtgtgactcctgaaagcccactttggcctgatagcagagtataatcaggagttgggtacccacgggccacggacactttcacagtcctactcggtccttgactccttatatatgttttacggaattgctaaatggccttcaaccaaaaaaaatcgagaggatttcttacagcttttaaaccaccccatttgcttgaacattcgtgcgtccaacttcttctccagctccagcgatcgttacctgacgagttaggatatagggtttagggtggggtgaattaggggatggtgagttcagattggagtactaattagttagtaatgattttggcaatcatttttcctgacttcgcccctcatttgtttggaggagacgtagggttcatccattgttaacaacctgtcaatgtagcgtcaccattgacaacttgctaagagagcaccaacgtgaaaggatcttattgttgaggcttcaaccgatgggaactagtggtggactagctctatggaattgtgtgcgtatgaaaaaaaaatataatctggaggtttctcacagtcaccggagcatgagggagggaggagtgggcgggggaatgaatgtggtgagcaaggagaatccaaggataaatatgcaaacaatgtgagggtttttataaaaaaattcctatgcggaatttgtgtgcttcaatctaggctgcaagatctcttatcggcaagattatggaacaactttgtttggattgctaccattcttagcgatcataatctataaataaaatcccttcatttgggaggaattttaccatccagcaagctgaagcggtaccaaatctaggtcattggctagtccaaatcgaacggttcatagaactcgatactgccaggtaccaatttaggctttgggatggtaccgtagaataaaagagacgtagaagggcaggttcatattttcacgttgcaaattttgctggttcaatctaaggttgatggaggataaggcaaaatcccgagcgccgccgccactctcatcgtggaatcgctgcattaccgtcgcctcgtccccgcacgagctatgccctcccctgtcctgctacttggttgtgcctccaccttcattggctgcccacgtccaccgttgtccactcggggcttgccgcctctaggggagacctcctccctgccagcgagccggaggccgtgatgggtggcagtctcgccatatcccctcactgtcgtccaagtccaaatccttgcctcgtctagatctcccgacctcctcctcctcctccctcctcccctccgatatacagcgcaggcggcgaccgtgggagtaggagacagcgacaggccttctccgcccatcttcaatttgtttccaatcttgcccctagtaattcaatggttggatttcatttagtacctgatagtactagtacctcgaggtactatctgctggacagtaacaaacctcttcatttggactgccaccacttaccagcactccaggagcaacagtcattcttttcccaaacagacccctactactcgttatttctgcttcatatctaatcagatccgggatcgcatgcctcatgtcagctttgtttcggtgtggcacatatcaagcgacaatgcctgatcctgctaagtgcttcatcgcactctcgatccatgatcatatcaagacatgacgctactgcaaaaaataattttaatgaacactcccttttgttttttacaag

SEQ ID NO: 57891 - DNA, 1808 bp, Oryza sativa
ttttgccgatcgatacaacgacacgagagagacgagtgaaaagaaaacggtaatacacactctattccagaaaaaaaaaataacttttgaaaataattctagataaattcataaattatactaccagtattattaagggtaaattgagataaattagtaatttacttttataattagaagttactttgtcatttaagttttttcacagctaaatcgatcattgatagtctattacactagtatcgctcatatttcatcaaaaaaggcaaaaaaaaaagtttattcactgctaaatgatgattatacccttcgcatctattttttctaacaataatgcccctccatatttctactaccactaactagggttgtagtataaataaatctaaaccctttgattaaataagatgtttaaattaatttttattataacttgagagcacctcagtgaggctcataaataaatgtttgttcggattcatttttaaaagttagtttatttttaaaccaagggagtaagtcggtgtagctactgctgcctcttttccgttccctgcgtgcatgatgattaatttgtttgtttgttcggggtttggtgcagcgtcagtgtcatcctcagatatgacgatgtttttcaggctctctgatcttatgctagctgatcgaatgatgattgtattattaagggagtggttagttgtgcattggtaattatagccttgcacttatttgtgtcagtggcaggtgccggctggatataacaacggccatctaatcccttggctccggtcatgcacctgcaggtttggggtttggacagatcgatcggaatatcggatgcagggagggcataagcatgtgattccaggcttccagctacgatgctgtactgtactgttccgttttttctttcagaaaacaaaattttgctgtactgttctgcatgcagactgtcacaagatctgagctagagctggactgcttcagagttcgattttcctatttgtggtcctctggagagttggacggtccattagtgtatctagaatgggctgggctgtgaagtgatgattcaacagtagagatggccccttcttatgggccaaatttgatcgcccatttttcttttttgtcaaatctttttttttcttttgaaccgaactttgttgttaaatctgacagactgttcattagggaatcatgcattctccatcatgaagttacaagtagaagtgtgaagtatgtataaaaaggataaaccaaatcgaaacataactgagcataagttttgcattgaacatcacaataaactgggaatactacatatgaataagcacccgatgaacttttttggtgctaatcttcaaagagggtaattaacaatcctctaacgtcaacctataaaaacagtttgaaattatccccttttattggttcccaattaatcttgatttcaatcgatccttaagatgaataccaagtcgcggcttcaactagtacacatcagatatatgagcatgtatcaaaaattccccccggccactttctgaaagcaaacttacctatatacgctcttcatttctaccacttgccgttgcagcttcagatgttcatggccagaaatgatgttgatgctattcatttcatacttgtcttcatcacagtatatataggacgtgtaacaaacaaaacccagcaatttccttcaattcgctcaaaccgttagccatcagagaggttcatgacgttgatctgcccaattgtaaggtgaaaatttcttcttggaactgatcaaaatggtgcattgg

SEQ ID NO: 57892 - DNA, 780 bp, Oryza sativa
ccaacatctttggaataattaatctctcactaccaaccaatgcaaagcttcagttttagagcagcagagtgcagtgctcagtgctcggtagctagtagtagtagtgaatatgagtgtgtgtgagttgtacgagcaaactgggccgctattaatagagaagaaggcgagcgatcgaacgactgaacgagaggctgatcgatttgaatattgtttaaggtgcacaagatatttgcgatcgatatgtacgtgaaaagcgtgcgtgtgggtcgcgcgcgcgcgcacatgctttgcttgcatgggcgccattgcggcgtgctttcttttgccttggccccgcgcgcgggcgggcgggcggacgtggcggcttcgtcgtcgtcggactcggatcgcgaggacgaggagtaccgcgtacgtggttgattcatccggccgtgctagagagattagagctttcgcgcacatatttcttcacgtgtaccgtgtacgcataccgtgttcaacaatgctccgatcaagctttcgcacacatttttctctatgtcacgcggatgacgtcgattgcatgacgtatatctaagtttttctagtacggtaagtcccgaaagacggatttcaattccttttcgaaagagatgtctcaccgcttgatgtagatgcacgtacgcttccattcacttatcgaatacaatgttgatatcctttacattctcccagatctcactgccagcatgcaatgaactttggacgtgatccgtctttcatcgtctcgtaggaatctct

SEQ ID NO: 57893 - DNA, 7649 bp, Oryza sativa
agagcagtgccctgagcacgagttgccttagtcctattgggacactgatgccctccgtaaggcatcgggagtctccatggagacacgacgagacatggttgagttagagccacggctccaacgtggcgagccaaagcggcgcgctgtaaagggcctaatccctatcacgggaacatgtatatgtagtacactctccataaggactaaatgtaagtttagaatgatctcagaatattttttttaaccaagagctccaagtttgagaaccctatgtcaagaacattgtgcttttgagtgttaccaacggtgtggcacaatccagcgtccgctattggtgtaccatcgtaaccatcatatactttgcccatcggcacctccccacaactccgtctctccattctccaattctggaagaactgtctctttttctcgtagaggaggaacggagctccaaagcaccgggacatccttataaaatttgacgacaacgactctacctcgcgtgtccgagtgtagcaaatgttgtttccctcacaaatcaagggacaacaaagccccacaactttactatagaagtaggggacatatctgtcatggttatggataccgcatacccaatagtaatcaattaagctcgatgaggcctaccatatgccaagtcttatacggaatcatacctcgtatatagaaagagtttcagataaggtaggacaagtagagttctatatggaaacgacaaggactactcggattgtatccatattggtttccctagttttactttgataaggagacatctatgggtataaatacaagcccccctaggaggagagggacagaagacacagatcgacacacaaaccgagacaagttagacatcgacattagatattagcctagacaaacccaatcagttgcttgcggaggccgataacaaggatctagggctatttctgatctcaatgagttcatattcgagtagtaagactaccctctcgtcgactacgtgttggtgttcatgccgccacgtcaacgacgattagataggttatcccaaatattgtacttgtgtcattcaaaagaataaagagcaataccggcttcagccaataggagtagagctattacctatcagataaggggcccgaacttgtataaaaatccttgtctccatctcttttaccacaatctcgcatataccctggtaccaacgatctccataccatgcaaataccatagtcgtaacctcaaacgtcgacaatatctagtgaaaatcaaataagtgaaaattcatgaaagccagagctaaaagttttataaatttatgaaaatttctagagatagttataaaaatgaaatacatattcactaaatgttaagttgaaaaccaactttatttgcgagtaaaaaatgataaatttcgggtgaatagtaattaaacgctattcacctgaatctttgtctcttttttcctctcaaatgaagttgagttcagatttgtaatttggtatgaatatattttatgcttatatgtaatttttttcataaatttagagaacttttatgtataatttttacgggtttttactagacattttcttatagacgtattggtaagtgctgctacctcttctaaactgactataaacaataatcgcttgtataggtgaaaagtcaacattattattattattattattattattattattattattattattattattattattattattattattattattattattattattattattattattattattattaagcggagatactagctctgttccaaaaataacttcatttttacgctccatttgatttcgctgtaggggtaagcaactttatcattttttgttagcacatttcccgaactactaaacgatatattttttaaaaaaatatatatatacattgaagtttcttaaaaaaaacaaatgaatcattttccaagttttaataattagtaatatggagtactagccctaatggtttgcttcgttttgcatgccgctcaattttttttcaaacaacttagtcgaacggagcctacaaagtttaaaagactaaaacatcctttgctttatcaaattactccttgattttatccttaactctatcaagcctaaattaaatatatgtgtccttgatttttttcaagtgttaacatatttcacctaattttatcgaatcacaatgcattgccttcaaagttttttgggacgatgagtgaggtaaaagatagtaatagttatcatggaaaggagggagcgttaacttgaagctagctgatgaagtgagtatagctcgattggttatgttacttatgataaaatcagcttagtggattcaagttctagacatgacattattactcacatatatgactatttgttcttctagtattagtcaacatctcgccacaccctcgccacacccatgatgacttcataaatatatgttgacatgtcttcttattagtattattagtattatgtttcttttttttgaaaaaaacttgaagcgagctgtgatacacaatactacccgcttgcgacgcacgcgcacatccattatgatccttgactatctcgcgggacatgaaaatgttcgtgtgaggcttgttgggggtgtcaacctcatggtttacaaaactgacgataaccgtgtggttatcgtgtttactgccggttacgataaaccatggtaagctcattaaactgaaataaattttaaaagtaatttaaatttttaaaaaatattatacaattactgcgagtaaccatgcagtgtgcggtaaacccacgccgatggtaaggaaaccctggtgaacccaacacaagcaatgcgattagagcgtatcaacgagaacacacgcgggagccacacgaggcggagtactacacaccaatccctccatctcataaaaaatctaggaccggatactactataaatctgaacacatatatatccaaattcgtagttttagaatatgtcacatttagtactagattgattttttaatggaacggagggagtacacaggagcacgagcagcagtggcatctttgttcttccgttccgtgtcgtgtgcaaaactaaaacaacacaaggagggggaggcaggaggcgcacgaagaaaccggccgcggctcgaggaaaatataaaaggaaccatcaccgtgcaggggaggggaagggaatccggcgcgtccgccgtggctgcgcggaaacaaacacgcagcgcacggtcacccacgtccggttctggaatcctgcctcggaagcggcgaggctactccagaggccaggttggtggataaattcaccgggctgtttggatacgagcagcaagttttccaaacatttttctctctgattaatttttttaataatgttctctctgcttaatttgttgtggataaggaaattgacaatttaatcatgtttggtaacttttggaccgtgtcagaacactacggctcacacaagtcggtggaaacaggtcaaacttatgggcaagtttcggccgactttggcagtttggtcttcaggaagcaggcctatttcgtttactgactgactgaccggagggtactgcttttggatctgttgaatttggttggcgccgaggtcatttgtttttttagtaagcacataatcgaaacacgctatattcgcactaccgcattttctatacttcattgaaatattgtaagggcactgaaatccacgtaaacatgaagtatatactttctccgtctcaaaataatttaatctagaatgatatgagatccatcatagtataacgaatctagctaatctaggatgtgatatgattctaatatggataaagttatgtgcagatttattgtattatgatgggtctcgtcgtatcctagctcgtattattttggaacagaaggagtattcccttcatcccataaaggacttgagggatagtgaaaaaaaaaagaaaataaaaaaaatcttgagttaaccatttatatgttcacctctctctcattataatcatgtaatactagaagtacaagtcacctatatataagaaatgttcaaccaagcgagagtcggctacaaaacaaatattcaaactttaaaattcacatttcaaacctttgtgtaaaccgtgcggtacatttcctaaaagattagtggacactatcctcccctatcgttttcctttcatttcgctcaaaatcctgcctcgcgaatacttcacacaacttatgatttctttggaacgcatgaatcgaaaaatatagaaataacaaaaacaaagtattaagtgtcgtgacttgatgaatacatcaggaactaaaaccacaataattctacataataattacaggaaaaacacatgaaatttaatatttatataattgatttactagatagaaagaagagatacacagaaagtgcttgggcttctcaaataaattctgttaacacgaggtgagatcacatattagaattcctctaaaatttggaagattttttactatcctgtaatattactctgaacaatttcaccatctaacactactgaaaaactgatcttcgatgggtcaagcaaaatccacattagtcccggttcaagtaggaaccgggactaaaaaatatatttagtcccggtttaattttacgatctttagtcccggttcaaaataggtcagacgtcccactatctttattcccggttgataacaacaagcacttattctcatctcctccccccccccaaacaaactcctcctcatatctgtatctgcatttcctctctctctctctctcatcctcatcctctctttttttccaacatcctcagcgggcggtggccgaggccagcgtggcgccaggcggcggcggccgaggcccacgccaggggcagcgtgctagcgccggtcagcggcctgcccgcgcggggtggcggcgggctgtgcggagagcagtggcggactgtgatgtaaatttgtgaatttgttcatactgtagatctatgaatttatgatgtcaatttgagtattttcattcgatctgtgaatttgtagatgattttgtgatgttttgtgaatgggaatgattttgttgtagagatcagtttgaaatcaatataagtagtaaaaaaactgaagatgagaagaactttggccacgtggcgttccgatccttagtcgtggttcgtaacacgaaccggaactaaagatacccatctttagtctcggattcaaggtcccagttacataaacgggactaaggggcttacgaaccgtgagtgaagacactttctccagcagtgtaagagctcctttaattcataggatgggtaaagaattttcgtaggatttagattgttgttgattttttcctacatatccctctaattcataaaaaggaagaaaaatttgtataccaaccaagaggtgcgacctgtttgtaaactttcctttgtttttcctattgcgctcctattatattatcctgtatttattttattcttgtaggatttgaaaatcatactaaagtttcttctatcctacgaatctaatgagacctcttatagaaagttttgttccttcgcactagatatctctaattttctacaaatttcctccattctaaagagccctacacacacgtcattattcatccccacaccgaaattgaagttgatcaaattgctatgatagcgatagcgctcgccaaacaaccccaaccggtggacccctcgtcgagatatgtagtactcactccgtcccaaaataagtagttttgtactattcacgttcaacgtttaaccgttcgttttatttgaaattttttatgattagtatttttattgctattagatgataaaacataaatagtactttatatgtgactaaatattttcacaatttttttaaataagatgaatggtcaatcgttaggcacggatatctacggctgcacttattttgggacggggtagtagtacatattgtactatgtgtcttaaggacacccacaatgtatgaaaaagatagccttaaaatattgattgtacttataaaataatccataatagtttattatttatgagctcactcttaaggttgcactacatcttaaacaatgatcttgccctaacacaatgtctaatgtatctcatgcatgtgtagccgcccggacgtagcgctagcccgatcggttccgagttccgactacgactttgcgagacggctgcgtctgcgttgtactttcacgccacacccgcgcgcaccacagaaaactcacgctctcagcctccaagcctccggcggcgcgtcggcttgacggactgaacatgaacagagaggcaagcgggggcgcagccgcgcaggcagcgcacatccgcaggcgcagggggcgcgcattgaagcgttccgctgccgcggaggcaatctacggggcccaaacggggcgcggtggcgggggcgcacatgcatccgctgggcgcggcgcgcgcacagccacaacaaaacaaagggggaagggaaggacgtaacaaaagctgcacagtgcgcgcgtccggcccggcgtccgctgtaggcggcatgcattgcctgatggatgaacaagggggtggggtgtggtggactggtggggtggccggccggcgtccatgattccgtaggtcggtaggttattgttgccgggcggtgcgtctctgttcaagtgttggtcctttggggtttcaggtttgactccgtataggtgacgtcgttaccgattgcaccaaaccttggattacatgtgcatgcgagagattgtgtgagcctactactagtaacgaaaacaaccgtgcagttctatttcattgttttagaaatcaagagcatgcactgttgtgacttgtgcgcccttttgctcacgaagctagtacagcgttttctcaaacaaggaaaagagaaactgtactcctacactctacagctacgtaggagtagcaaagtactagcacggctagtttagcaggtctacgacaagaggaattgcgctacatcgtggctgctgctgcaaccattccgtacactctccgtagcacagagacacagtcacgcagacaggttggcctgcgaacgggccaaagccacgtactgtcgccgttggactcgataaaagcctgggggcgcacagcctgcgtcgcccacatgggcgtgacgaggcctgctactgtgggcccttaccttggggcccaccacctctcgctctctgtcaaacgccctttttaccccctcgcgtatctgggcctgcggcccacccttgatctaccgcacgtagtagtagtacaactagtagtaacgctgttctctctcgcggtgcaacggacgatagagacttgatgagtgagaggcatcatggtcatcaggtatccgtcgatgtgcacgcccaaaacgacaaggcaggttgcagcgtttacttataggcaaagtcaagacaaatcgagcgatcatcaagttgatcaccatacctaccttgttatagggtgtccatgcctagcttattgcatggagtatttgcatgtcggcttgattggaagattttgcggcgctccagtttgggccacaagttggcatcacagtaa

SEQ ID NO: 57894 - DNA, 30138 bp, Oryza sativa
caaaccttgagaagacaatttcagaatttgctaatgaaggagtcagagaaggtaaaagactatttctcaagagttattgagatcgttaatcagatgcgcctctatggtgaagatataaacgaccagaaggttgtggagaaaattttaatcagtctgcctgaaaaatacgagtacattgttgctgctattgaggagtcgaaagacttgtcgactctcacaattcagcaactaatgagctcgttggaatctcacgaagaaagaaagcttcagcgcgaagggagctctattgaaaatgcatttcagtcaaagttgagcttcaggcctcaaaactcaaggtttcgcggaaattttcaaaaaaaatggatttccaatgcgagaccgtggttatttttagaaaaatggcttttccaggcagaaggaagatggtcaagagagaagagaaaaaggtacgtccagttcaaatttgtggtgtgacatttgccaaaaatctagtcatactacagatatgtgctggaagaaaatgacctgcaacaagtgcaaaagaaagggccatattgcaaaatattgcagaactcgagaaattaatcgggctaatttttcacaagaaaaggaaaaatctgaagaaatggttttctcttgccatactgctcaagaagaaaaagatgatgtttgggttattgacagtggttgtacaaaccatatggccgctgatccaaatttatttcgagaaatggattcatcatatcatgcaaagatccacatgggaaatggctctatagcccaaagtgaaggcaaaggtacggttgctgttcaaacagcagacggtccaaaatttataaaagatgttttgttggtacccgatttaaagcaaaatttgctaagtattgggcagcttctagaacatgggtacgcggtttattttgaagatttttcttgcaaaatattggaccgtaaaaataatcgtctggttgccaaaataaatatggagaagaacagaaattttctattaaggatgaatcatccaactcaaatggctctcaggagtgaaattgatatttccgatttatggcacaaaagaatgggtcatcttaattacagagcattgaagctactcaggacaaaaggtatggttcaaggccttccatttattactctcaagtctgacccatgtgaaggatgtgtatttggaaaacaaattcgggcttcttttccccacagtggagcttggagagcaagtgcaccattggaactagtgcacactgatatagttggtaaagtgccaacaatttcagaaggaggaaattggtactttatcacatttatcgatgattatacaagaatgatctgggtatattttctaaaagaaaaatctgcagccttggagatattcaaaaaattcaaggccatggtggaaaatcagagtaatcgaaaaattaaagtattgcgcagcgatcaaggaggagaatatatctcaaaagaatttgagaaatattgtgaaaatgctggcatccgaagacagctaacggcaggctatagtactcaacaaaatggagttgcagaacggaaaaatcggacgatcaatgatatggccaattctatgctccaagacaaaggtatgcctaaatctttctgggctgaagcagttaatactgcaatttatattttaaatagaagtcctaccaaggcagtaccaaaccgtacaccttttgaagcttggtatggtaaaaagcctgtcattggtcatatgagagtatttggttgcatttgctatgctcaagtgccagcacaaaagagagtaaaatttgataataaaagtgatcggtgcatatttgttggctatgctgatggtatcaaaggctatagactttataatttggagaaaaagaaaattatcattatcagagatgtgatttttgatgagagtgctacatggaactggaagtctccagaagcctctagtactccattattgccaaccactaccatcacactaggccaaccacatatgcatggcactcatgaagtggaagatcatactccaagtccacagccatcaagtccaatgtcaagctcaagtgctagttcagattcaagcccgagcagtgaagagcaaatttctacaccggaatcagctccaagacgggtaagaagtatggttgaattattagaatctacttctcaacaaagagggtcagaacaacatgaattttgcaattattcagttgttgagccacaaagtttccaagaagcagaaaaacatgataattggataaaggccatggaagatgagattcatatgattgagaaaaataatacatgggagttggttgatcgtcctagggacagagaagttattggagttaagtgggtttataagacaaaattaaatctagatggctcagttcagaaatacaaggcaagacttgtggcaaaaggctttaagcaaaagcctgggattgattattatgagacatatgctcctgttgccaggctagagacaattcgtaccataattgctctagcagctcaaaagaggtggaagatttatcaacttgatgttaaatcggctttcttaaatggctatcttgatgaagaaatctatgttgaacaacctgaagggttttcagtccaagggggagaaaataaggtattcagactcaagaaggctttatatggattaaagcaagcgcctagagtgtggtatagtcaaattgacaagtactttattcagaaaggatttgccaagagcataagtgagcctactctatatgtcaacaaaacaggtacggatatcctaatcgtctcactctatgttgacgatttgatatatactggcaatagtgagaagatgatgcaagactttaaaaaagatatgatgcatacatatgaaatgagtgatctgggcttgctctactattttctcggtatggaagtgcatcaaagtgatgaaggaatatttatatcacaaaggaaatatgctgaaaatattctaaagaaatttaagatggataactgcaagtcagttacaacccccttgttgccaaatgaaaagcaaaaggctagagatggagctgataaggtagatccaacaatttacagaagcttagttggaagtttattatatttgaccgcaacacgaccggatattatgtttgcggcaagtttattatcaagatatatgtctagcccaagtcaattaaattttaccgctgcaaagagagttttgcggtatatcaaagggaccgcagattatggtatatggtataagccagttaaagaatcaaaattaattggctatacggacagtgactgggctggatgtcttgacgatatgaagggcacatcaggctacgctttctcacttggttcaggtatgtgctcctggtctacaaaaaaacaaaatattgtcgctttatcttcagccgaagcagaatatgtagcagcatcaaaagctgtttcacaagttgtttggttgaggagaattatggaagatctgggcgagaagcaatatcagcctactacaatttattgcgacagtaagtctgcaattgcgatcagcgaaaatccagtcagtcatgacaggacgaaacatattgctatcaagtatcattatatccgggaagcagttgatcgccaggaagttaaattggaattttgccgaactgatgagcagttggcagatatatttaccaaggctttatccaaagaaaaatttgtccgcgacagagagctcatcggagtttgcaagaaataaattaagggggagtttgttggagttaatttatttctagaacataccagcctactctctaactctctctctactactcatgaaacaaaagtcaaggagcaagtccttcctctgtgaaatttctagagtagtgtagacaataatatgttctttgtgagttctagtattttcatgcatgtaccagtactagttgtgttcagaaaagttcctagccatcctataaataggcagctatgtcctagatgtgatgctgctgtccaacaatcaatgtaacgtgcaatacttgagcaaagcataaccagtttgtgaaacaaacacagagcttctctcctctgttctccttctctgttccattgctagcaaaataatccacaacaacaagattgacatgaggtcaagccccaccgattcattgttagttgttagggatattaattcttcttgtcggctctagcgctagctcttcgtcactatggccgccgcgtcaccaccaccgccggtcaactagttagacctaccggccgacatgctctgcaccattttcaccacgctagaattctcaaacctgcttcgttgtggcaccgttcgcgccacctggctcaccaccgcgcgcgctctcctccgcgacggcttctactcccaccctgaaaccccctgcctcctcctccgtcgccgatgccgagctctgcagcctcgccgacaagaccacctatgccccctccttcccaggcccacccatcagtgaccgatacatcgtcggctctgctactcccatcagtcattgccgacgcccgctctgagctccacctcctcaacctcatcaccggcgatcagatttcgctcctctccgtcaccaccattgaataggtaaaccccattctgaaagatgacgccggcaataatgtcaccgcctataacgtcttcttctacgacaccaatatcccaagaaagtaggacatgattccggcaatctaccagctcgacgagctccacaacttcatctacatgaaggcaatgacatcctccgacccagcgactggcgatttcaccatcatgctcatccacaatccttacatgcagctagatcatcagacaagcaatggaataagatcaccttccacaacaacatccgcttctccgactgcatcttcgatgacggcctctttctacaccatcacttaccacagagtggttcatctcatcgacatcaatccggattcttcctacgtgacaggagtgattgttcaggagactttacccatgatgtatctcattgtctaccttgctcgatccccgaatcatggtgattttatacaaatattcagattcacaagctcgttggagacggatcaaacggtgacacgcactactgaaatttctgtgctcatgcttgatcttgatgataattaaggacaggtttgttgactatgatttaggggacaatgatgtgttcatcggccgcaattacaccgcctgcctttctacaaaggattatccggggttgatgccaaatcacatctatttcactgatgatgatgagtgctcgcttcaggcctttaaaggtactcctagggatattggtgtgtacaactacgaggacgatactttgagtgaggttgtgtctcctcagccatggttgaaatggccgcctcccttttggattactcccagcttcaaagacttcccaaacacgtatagacaatgaaaaattttatggtccttaatatatcaggtacctctttttcaagataaattttggtactttgtgatacatgaggtaacttaaaaaaatatggtatcaaaatttatattagaaaatttggtatattctcaagtactgtaaaataactggtggatcatcacaatcttccctataaatttgtaaattttgttgaattcatttagatattatttggaccgtgaaataatcatgaataatgaaaatcttccctgcaatatttttttcgatttattcaatcttattgctttagatacttcgcactatgtgcttattatattagctaacgggctgttcgatttttatatttttgcatggggctactggatttggtatacaactcttatttttaaaaattttgactcgacaaatacaactgtaatttatatacaatagttttgaaaaaaatcaaattggatttgatatacaactctcaacatatttttcatagatacaatttttttttacttgataggtttatatgattgggttatgtatacaactctcttttctttccataaattacaaatataattgtaacaatcaacattttttttctttttctattcttaatgttagaatttctaggctctaaatgacatcttttttaagctatctttagatagatagacagacagacagacagatagacatacatatagatagatagacagatagacagacagacatatagataaatagatagctttctttttatagaaaatgtacaaaaccatagttagatatagatagatagattatatatctgaattttagtgacctgaagaagtagcttcatttttttttggatacgcacaaatgaaattgtttcgaaaatttctagttaaagaacagttagtaatgctttcatgccttcgttttgtgttaaagattttgaaaatggacaagaaagacgaatgcatcgaaaagagcattatttcccattatatatatttcaaagcaaacaccatctcccattattgttttcgataaaattgcaaaaaccaacatgaaagtatgttgttctttttgtaattaagacatgatacgtgtgttaactggaactttaattcttccaatcttctatgcaataacatccggtgtcaaaagatcatctgctgatgaggaaatacactatgattatcacttatcatgtatatatggtgatccaattatgctcctggagcacgcaataagttcggcacggggaaatcttttcggttttgcagagtgagaacctgacaaattttgctgaattttgtcaagagagtactgaaaggatgaagtcaccgtacggttcagagagagaaatgcctgcaagtttaagcaaagaacgtttatcttttcgtacttggctttgtatgtggcgtacttgcagatcttaccctatgcataaacatacttatccagctatcctcttgattaattatctaattaagagcatttcaattttttgggagatcctaaaaaggaaaacacggcaacgaccatcgtacgtttatataagaaataatctcctgatcaaactgccttccttcgttgaccacagaaattatattgtttagcatgcttgatggttacttatttcaggcatggtcggcagctaaatactagaaaaaaaaacataattaatgctcccttaacatgttgatcatacaattaggcagccagcaaggacagtgttctatatataaagtacagttgcatgtgtctcaattctcaaagaaaagcaaagtcgtcaactcgccataccaaaatggaatatgcttagcataataaatttttcataatcatcattatcttaaaaaaagcgaaatatttcatagtgatggtcagatggacacgtggaaattgcttacattgtccagccaagcatccggcagaagaacatgagcttctccgagcttccccatttctgcactcaacaaagccagccttctcctctgtttctttttcctttccttttctttttttttgttatgaaaatattgttcggtttctgtttcttaagggagcaaaatatttgaaagacaagtcatccaaagctgacgaaacactatatccagaagcttgatttgcagctgaaatgtatccaaatttggacgacattcgctcactcacggcaggctatatctatttatctatctatatatcatgtactttcgttgtccgcatagtttagattagatttacacggctttatatatctatgcgcctcttgttgtgtcatatcgactgatatatatagttcttctcatcttgcatgcaattgcaagcttgtccaatatcgtcgactgatcgatttgggcgagagacgacttttgtgagcttgtgaccatatggcaatggcgagcgtagcagcgttgcgtctcgtcgtcctcctcgccgccgccgtgccgctgctgccgccgccggcggcatcgctggccgtgacgtcgacgtacgtgcggccgacggcgagggcgacgctgtccgtgctccacgacggcgatggccgaacgccgcagcaggtaagctctcgttcgatcggtcgatgtccatgtcagatgtgttctcctcctctttctttctttcgctcgttggttcgatcgatttcagaggaatctgaaaatgtttacgtacacgaatgaatgcttcgaccatacagaaagttgagtacttatgagttctttctttgtgctcaatcatgagtaatacgaaaagttactttctgtaaattttgctgatagtgcaagtaatcagcatgcatagtttcagtacagtaatcttcctgactcctgagccatccttcatccttttctttttctgttggaggttctgaaaagaaatatctcaattatctgcatacattaagtttcaacataatctgtgttgaaaagattatatgttattcatgttgtcagaattgtcaatgatcataaccggaaaatgatttatattttgtactgcatgatgcttaatctctctttctgaagaatgaagtttatatttcaagtaatttcagaagaagtggtgaggggtctagagtctagacggttctattagacagtttgcatgaatcaggaagcaagtactcggttttatacatattaattttgtcattttcatgcatggtagccctggtactacttgaaaaatatgagaaacaaagttggaccaaaatttcctaccacatgttgagttggaacaaaagtcaattgcaaatatgtgcttcaatctattcaggtcaattttaacatgagtggattagcaactgaaacttgtgggcactgcacccatgcccaaatttttttaataagcacaatcatttattaccattgttgtccctgctagctagtatacatgtatggctcggtatatatgtaatagagttaaaaaaacataaactacaattatgttgctgtctttcttctgaatcatcaagttagctaacaaaataagcaatagcattggcgtattatttgccagtagaaagatagcccatgaaatttctgagaaagaaagtgaaataattaaagaaatatgttaatgaattgtggattgctatatatttagcctgaaattgatgttcatgtacagcttagaagattgcaaagtcatgccagtgaaggtgatcaatatcatagaatctgagaggaaattaaactgatttccaaagaaaaacctcagagaaaatcaagaacccagtttcttcctgaatctgtgttcagagaactcaatcgctgctctgaataagattacagtttgtctatcagattactacagtttttgcaacaatgaagtgtatcttctcaagaatgataaaaattaaaattacccttttgcaatagttgacaaatgacttggcaattaactgtagctaaacttcatttgctagtgagcttgacacattttgctgaaacttcaggtgcatatatcagctgtaggctctgacaagatgagggtgacgtggatcaccgacgacgacgcgccggccaccgtggagtacggcacggtctccggcgagtacccattctcggcggccggaaacaccaccacctactcctacgtcctctaccactccggcaacatccacgacgtcgtcatcggcccactcaaacccagcaccacctacttctaccgctgcagcaacgacacgtcgcgcgagctctccttccgtacgccgccggcgagcctcccgttcaagttcgtcgtcgtcggcgacctcggccagacggggtggacggcgtcgacgctgcggcacgtcgccgccgacgtctacgacatgctgctcctccccggcgacctgtcgtacgccgacttctaccagccgcggtgggacacgttcggccgcctcgtcgagccgctggcgagcgcgcggccatggatggtgacggagggcaaccacgaggtggagaggatcccggtcatccacccgcggccgttcacggcgtacgacgcgcggtggcgcatgccgcacgacgccggcgcgtcgccgtcggggtccaacctctactactccttcgacgtcgccggcggcgccgtgcacgtcgtcatgctggggtcctacgccggctacgccgccggctcggcgcagcaccggtggctgcggcgcgacctcgcgggggtcgaccgcgccaagacggcgttcgtggtggcgctggtgcacgcgccgtggtacaacagcaacagggcgcaccgcggcgagggcgacgccatgcgcgccgccatggaggagctcctctacggcgcccgcgtcgacgcggtgttcgccggccacgtccacgcgtacgagaggttcgcgcgggtgtacggcggcggcgaggacgcgtgcgggccggtgcacgtgaccgtcggcgacggcggcaaccgggaggggctcgccacgaggtacgtcgacccgcagccggcggcgtcggcgttcagggaggcgagcttcgggcacggcaggctggaggtggtgaacgccacgcacgcgctgtggacgtggcggcggaacgacgacgacgaggcggtggtcgccgacgaggtgtggatcaccagcctcgcatccaacccggcttgcaacaagaagtattccatcagcttgtattgatgtgtgagaaactaggatgacgataggtagtgtgattctcttgatgattatactacttgataaatctctctcacataaattatatagtatatggttaatttgtaagttatgatatgaaaccatatttttattagcaaaactaatttataaattgattggactagaagtgcattcgtacaaagaaacacacacctcataaagctttgtaaatacttcgtactactttgtaaagcggtttataaatgtatatactttgtactgtaccaaagaagcaataaagcttcttgaattttaatgttgattgacaactaaaatatacactatatgtgacaaggtgtatgcatttatactatagtctatacgtattttaaaattttagtaaaactctgggtaatccaaataggaagtgtggctaattcagaaagggtttaggtgaaaaagtactcttcatgacttcatcatcatcattcaagtagatgtcatttggcataaattgtgggtaaatctttcaccgacagttagttcaggagacgccgccgccgccgtcatggagtctagcctcgtcgcaaacaaccttccctccgtcgcacccatacctgctccaccggcggtgcgttggcgtctccccggtgccaccttgctctggctcttctcgcgcctcctctcctctccttgctgatcctgctacatttccccgtatcagaggcagcgacgaagcttgatgttgtcgacaaactccccaatagagatggcaatttcccccgcaggactgggtcccctacgggggagtcggggccggggacccacatttgggcggggaggagacgggggagacatttcacccacgggtgacccgctggccggggagtgtatatgaactctcaaaatatagcccataaaaggtccaaaacagtccaacccagaaaaaaacggagatatataaacaaaattactaaaccctaaccttatcctctcactagtccccccatccccatctccctcccgtccacaccacgcacggcggttgggcggcatagggcgcacgacggtggcgcggcgcagggtgcacggcgcacctctggatctcgtcgtcgccggtcgccctctcccttcccctcctctcctctcccctccagcctcccatcccgtccccttcacttctccctcaagagtccacctccacctctccctccggcagtgcaaacgacgcacgggatggcgcatagacccgatcacatggtaaggcgcggcggccggcgaggttgtggcaagagcgcggcggccagtgaggttgcggcaaaggcgcgacggccggcgaggggataggtgcggcggcggccggcgaggggataggtgcggcggcagccggcgattcacggtggccgacgattcatcctattttttatggtgtgtcaagtatgtgcaatttttgtttttgccaatttgatgaatgtcttgtttttttttcctgattggatggagatgctatccaatgtggggccccggtcaggttgcggggccccagagagatcagggacgggggttgatttggccccgtatcaacagtcagggccaggggcggggggtgaagtcgggggtcggggacggtggcgttccagcctaacccggccccgccccgtcccgttgccatccctactccccaagacagtgatggagccgggcgccggatctgccctctatgccacatcatccatcgcaccgaaaggatgaaagcagcatgcgagctcgggtaggtgatggcggagctagcgccaagctcgaggagagggttaatggcacgggtggcttgggcgggggcgttggcgagcagccgacaggtagtcacgtgcgcgggtgagggatgacggtgcgtgcagctggccagcggcgtcgtgactcgatgccttgctctctgtggccgtgaagatatggacgacagggtccacatgtcagcggggtgtatatgggggtattttagactatacgaaaatacattggtctattcatgggtccaatagcctttgggacgtagaatatggcatatttaagatatatgaaaaattgtaatggtatccttctaattaggtgaattgtgatgatattttttaaaacatgcacatttgtaatggcatgaatccaattgacccatggtgtgtttgagaagagatgagaagatcaagagacaaaattgagacccataattagggcatgtttggcagagctttggctccacttatcctgaagccagagtccagaaaaatagtttcagttccatccaaaatgtgactagaattagctggagttttttcacaaaatgaactagagatgtggagctggatttagactgctccacaactctactccagaccgagcccttggagctaaatttaggagttggagccctactaaatagacctttaattgattattaattgttttaaatttgaaaaatagattaatatgttttttaagtattttttctattaaaagttttaaaaatacaccgtttattagtttgggaagcgtgcgtatgtaaaaagggagaaaataatacgaggatatataatacatgtactattggtcaggggcggatcccatgtgattcatgggtattcacctgaatacccatagaattttaaaaaaaaaactatatataggtatgttatgcatatatacatgagaaattagaaggaagtgcagcatgtatagtccaaatgaaaagaagcccatttattcgcaacagaccatacattcctccccatcttggcccaacgaataggcccactggcccaaaaacgaacaaatccctagttcctatcccccagtcagccagtccccacccctcttgtcgtcccagccccaatccgccacgcctccactcatccccaccgacgggcgacggggcatcgagagcatgacgctcggcggcgccggccgccggctcggcgcgtcgccagaatcgccaccagcctcatctccctggaccctggtccctgggcctgctgctgcggaggtggcgcggcctgcgacgacaccgccgcctccttggggacgggtgacgctgagcagctgaggttcgcacggatggcggcggcgttgcggcgcacggcggcagccagttgcggcgacacacccccgcgtcggcgcgtccccttggtccctagacggctggacagtggactgacactggtaaaataaatcctcttgtcaaattccccaatcgattggccattgcttaattgctattgcttagaagttaaattagtcagtcagaaatttgaactgtaggtcttgaaatttgaaaaatgaagaagaattgaagtctttgtgggaaaggtcaaccaagtctcagaaagtagcttccacctctgatccaaaaccattaaccaatgagagtgaagttcagatcccagaaaatgccccttctagtcctattcagctactacttgaagcacccaatgcccatgatagtgatatgtccccaagtgtgcatttggagatagacatcttgactattgtgctactgtttgtacctttaaggctttaaacatgtcattaccactcctgtatgattttcccagtccaattttttgagttctgtatgattttttttttcaactttgaataccctttgctcaaatcctggatccgttactatgggtatcgtcaacatgttttgggcaggtactatgactcctaacactccaatgccgtcatgtgatgggctatagcatccttttttttttgactaaatcaccgggggaagagaatccccacctaaatatattgagccaaatgatcttacacagagcaagctttacctacgcaagcgcagggggcctggggccctggaggatagaaaaacagaatacacggagaaatacaacgaagagagaatagagaaagaaaaactcctaaaagattacaattgatgaacgacacctgcaaaattatcttgccaaattccaaaacctactgctaaaccccaactaagcaacatccaattcctcacacagccacaagcatgtcgaaaaaaagagaggcaagggaatgctgttgaagtccaaagccaccagcatgaagccatcaagaagctgacttgatcttgttgttgtttggatcagagctcgccaacgccctttgggggaaggaagccctaaaggagggagggccactgaaggttgcggctcgaggccacccgcattaagttttcttcaatcaggctttatcaaattgcttgttagatcaactttctccaacgcccttcaagggaaggaagcctcaaaggagggagaaacactgatccttgcggtcctggacatctggagaaagagggtgaagacgagcacggggctagacagaaggggaaatggctaaggggattctcacagaggaaaaacatcaacgacaacttttggaggagggcatagaaccgtagcaatccgagctgatagaggagcacaatttccaaacaagcacgccagattgagaagaagttgaagggcaaaatcatcagcgatgtttggaactagggggtagagggcacacaaacgaggatactagggggaggggaagcggaagaggttctgttgcaagggacgacgaaggtgcggtggcgacggcacccgcaggacgcaccgccaagtcgtgccatcactagccgcagcatctccggaggcacgtaggcccctgagcatcgaccgagggccggggcaccgaccaccattgccgttgtcgcggtgcacgccgcccgaggcacatgccggccggaacccgccctcagcgccggggccgcttcgacgcggcgccgctcctgccactgccgtccaccgcgccgcgcgacgaggcgacaaccccagatccgaccgctagggtcccggatcggcgcgccaagcctagccatcaccgacgagtggggagaggggggggggtggcgccgacgaggtcgtgccggcccgccgtcgctgtagcatgcgccgctagccgccaccgggcaccgggtccagcgctccccgccgcccccttccagtcagaccgcgggagggccagctccgccgcgcccactctggcctccaccccgcccactccggcctccaccccgccgaccgccagcacaagcgccgccgctccgcctcctccgtgcggatggtagtgacgctcgcctccggccaggtccagcggcagggcgccggatccagccacgggggtgccagatccggtggtggcaccgccggatccgaagcttcatgccgcgccgttgccgtcgcccgcccatcgcgcgccgcgtcgtcgtcctcgcgctgagtcgtcgcgtcgccggggaaaggcctcgccgccgccctcacggttggtcgcgcggaactccggcggcggcgaggggtgggagaggaagggaggaggcggcgggggctagggtttgccctccgtgtcgcccgcgcgagagggcgacgcggaggtcggaagatccagtactgtttcctgtaccctcggctataacatcctggattagcgtattcttttatgtgagaccctggttaactaaactatgtgtcacttggttttgaaggatttgatgaacatggaagatcccaaaaagtactcgcaaacagcttaagcaacatgataggagtagaatagaagttcaggcatgatggatcacgtgaagctggactgaagtgccttcgccatcagtgtggcgaagatacgaagaattccagcatttttgatcttcctcttcttcaaccattcaatactcgtaactcgtagtaacatgacaaataaaatagggataattacatatgtacccctactttaaaagccaattgctgttttacccttatttttcagggtttgcatttttacccccactttttaatctgaagcaaccgtctaccctcacttgtgacagccgtttgatgggtcccacattgtgcgttaaagaaatacaaaggaaaataaaaaaagggtaattatgaaattacctttgtacccctgagagtggatagggttgagtgagtcttccacccgtgcgtacgggaaaagcaggtcgaatccctagcgcggggcggcgcggaggcgacagcgagagcgcgcggcggggaggcggcggtggccgagggcgtgcggccgcgccggcgcccgctcccaggaggtagacagcccgcctcttcttcctccgcacggaacagtgcctcgccgcgccgcgacaggacgggaagccctggcggcgcgcactcgcctccgcctccgcctcgtcctgccaccgctcgcggtgctgctcctcttcgcgctcctcgccgtcgcggtggcgcgggcacgcggccgcggatggaggaaccatgaggggaggaggagagcaacctccgcctgccgtctgagcgcggcgtggcggatgacgcggtggcggaggacgacgccgccgaggacaccagatgggccgtcctcatcgccggctccaacggctactacaagtaccgccaccaggtgattttgctcgcccgcaacccctcgaaaacaaaccacgctctcgccgcgcggttaatcgtggcggcacgtatggtttggtttggttcggtttgatccttcgcgtgtgtgcgctcttcgttcggtttgatttggttggtttcacgggattggttccatctccaccaacgcgcgcaatcgccgcagaagtagaaaccctgagccgtttcgtgttgccgcaaattccaaacgtctgttaaatctctcgttaatctgattcatgataaacgtaatccacaattaatttgagattactgccgtgaagagagaattcgtcgtgaagagagaattcggcgtgcaaaatcacacgaagctgaaaaaattggagcaaaattgcaataaccactgagagcataattgtccttttcctctacaagtaacacagataaaaccggctgttagaagcaggggcacatggctgcttcagattcaaaaagtaggggtaaaactgcaaactctaaaaaagtgggggtaaaacagcaattggcttcgaaattggggtacagatgcaattgccacaataaaatattatccacatatggcagtgttcgtttctaaaaaaaataagaaaaccattaacgcatagttaattaatttttaagtattataaatttgaaaattttatttcatattttaaatcaacttttatatataaaattttctcatagaatgtacctacttaaaaccatggtaataaaaaatgaggtaaaatttatatcttaacgagaaaaaaaaattagattcatattactatcaaacttacgtaatgaactaccagtgattctttgagattacgacagaatatcgctgtatcagttcacctccctaacctttgcctctcactcacacaaagtgcaaaccatattttcgtcggtctacttctgggaattcgttgtgagcgtgcgtcgcaaccaaccgtttctcacaacagcaaccactcaccgaacgaacccggcccctgggccccaccgttgcagcccaaccacacaccgaccccacctcatccctggccccacatgtcatccacccaaatcacccacttgggtcggggtgggtcccaccacatctctctctctccctggctctgattaatttctccccaaccccactcactcgccgcgtcggcgaccaccaccactcgagctctaaatggcagccgccactagatctcgccaccatcaccgacgacggcgacctcaccgccgccggggatgaagcgccgccacctcccgcccgtcctcgtcctcctcctcctctcaatcctctccctctccttccgccgccgcctcctcgtgctgcagggccccccgtcgtcgtcgtcgtcgtcccgccaccccgtcggtgaccccctcctccgccgcctcgcggccgacgatggcgccggatccagccagatcctcgccgaggccgccgcgctgttcgccaacgcgtcgatctcgacgttccccagcctcggcaaccaccaccggctgctctacctccgcatgccgtacgccttctccccgcgcgccccgccgcggcccaagaccgtcgcccgcctccgcgtcccggtcgacgcgtcccccccgacgggaagctcctcgcctcgttcagggcatcgctcgggtcgttcctcgccggccgccgccgccgcggccgcggggggaatgtggccggcgtgatgcgcgacctcgcgggggtcctcggccgccggtaccggactgcgccgtggtcgggaacagcggcgtgctcctcggctccggccgtggcccgcagatcgacgcgcacgacctcgtcatccgcctcaacaacgcgcgcgtcgccgggttcgccgcggacgtcggcgtcaagacctccctctccttcgtcaactccaacatcctccacatctgcgccgcccgcaacgccatcacccgcgccgcctgcggctgccacccgtacggcggcgaggtgcccatggcgatgtacgtctgccagcccgcccacctcctcgacgcgctcatctgcaacgccaccgccacgccgtcctccccgttcccgctcctcgtcaccgacgcgcgcctcgacgcgctgtgcgcgcgcatcgccaagtactactcgctgaggcggttcgtctccgccaccggcgagccggcggcgaactggacgcggaggcacgacgagaggtacttccactactcgtcggggatgcaggcggtggtgatggcgctcggcgtctgcgacgaggtgagcctcttcggcttcggcaagtcgcccggcgccaagcaccattaccacaccaaccagaagaaggagctggacctgcacgactacgaggcggagtacgacttctacggcgacctccaggcgcggccggcggcggtgcccttcctcgacgacgcccacggcttcaccgtgccgccggtgaggttgcactggtgacggtgaccccgacgtgggtgtatgtgtagctgctgctgaattttgttgtaaaattgaaactgatttcatattcgatacgtagaatcccattgtaatttgtaaatcagggggaatgggaggagatacggacacaagatgtgtgtcagatttgggagctttgtaaggagaaatgtagctcaattttgttgtgaatttattcgaaccattgcagtgaacttgttgatcatggaagcgcttattgattgtgaacttgttaatgattttttttttggtggtgatagatcttgcttaggtatgaaaatgatcagtagctgatgctactaataactattacgtctttgtttaattcttccttaagtaaaggagagtaaatattcgggttggtgggcggtctcctatctgcttctgttgtcgatttgctaatctcttctaggggaatattctggttgtagtatagtactagtagatgaccgaaagctaataaaatggtcaataatccaggaagaaacagctagtccaattgccaattgcccattccttttctccctttttctttcagataaaattgccagtcctttacaagctgctgctgctgctgctgctgcaacttgatttataatcatcagactgctaactgctgaagattgtttaagtaacacaatgtttcttcttcagtactgacaagtttacacatgcggtgccattatcccaagttgatcttgctcgtgctcgtaaaagtatatcactagctaatgtgtttttgttcactgggaattgcacctatccttggtattaccttcttgtatttagttagatcatgctcttttctgattaagatacagattttatctcggttttcattaacatgatttttaaattgctaatggtaataattacaaatgtattttttaagttggtaataattaaaactcaataggagtgctaccatcaatcaatccatccatttcaattgccctatttatgccgattttagttccaaactttttcttcaaacttccaacttttccaccacatcaaaacttttctacatacacaaacttccaacttttccgccacatcatttcaatttcaatcaaacttctaattttagcgtgaactaaacacacccttaactactctcaagtaatgcatgcaaaggatgcatttgtgttgttgtcagaggagatgcagaatcatcaactaccagcaggaagtcttgatcacaactcacagaaatggggtgctcgtatctataggcgccatgagatctccctttacgaaaatgcaactcctgacgccagcttcagttggctctgtcatgatgatgatctctgtgctgcacattgcaatgcaagacggacacacacatccagtcatacagatggagttcaatgctgctacaaggtcaacatgtcagatcagaccaagaatccaaatctcgaatccaagattattctgccggtagtaggacctgctgcatccatcccttgcccatccatcagatcagaaattcagatgaagtagtatagtacagtacggagtacaagtctacaagattcatgtaaaccaacaaaaaagctcggtcattggaaccatatcttgagtagtttgaacaaatttctgtatgctatgcatattgttttatgggaattgctaaattctcaaatgtcactcagtgcagatgttaaaatgtctgtagaatctactactagtcatattcaattctccgggacccaaaatctctctacacaccgacaattcaagatttgtactcgcactaatcggtgtgctcataagacatgcatgatgcattgttcacatcgaatcgtggtgtgatctgtatgaagtgatgcgccatgccgccatgatagctgctctgctagctcttgcaataatgctcatcgagagagcaattgaagcttggaagcagaagtgatggaaggaagaagagaagacgtggaggttgaatgctgatcatcattagctgctgccttggaacagcaagagaagagatctgccgttgcgagatcagatgatgagagcaaagacttgacttcaccacactgctactacgagtaggccataatcgagtgcaagagtaaatgttccttctcgacttctcggcagtggcggatccactgttgaggctggttggtgtgtaatccctgttcctagttatagtcattaacaagtctaattagttggatgtgtttagttcctaaaaaaaatttaaagtttgggaaaagttggtagtttggaaaaaaagttaggagtttatgtgtgtatggatgttttgaatgtgatgtgatatgatggaaagttggaagttgggggtgtttagttcataccaaaattggaagtttggttaaattagaacgatgtgacgaaaaagttagaagtttgtgtgtgtaggaaagttttgatgtgatgaaaaagttagaagtttgaagaattactttggaataaacacggcgttattagtgaagaaatttcctagatagcaaggatgcaagctgcctcactgattctactacccaaattgataaaacataatttattccgagtatacaaaacaatatattcacagatacttatgaacattttaatatagccacaaatcaaaatagaaaaagttcttttgatcatatgagcatttcattttcattggaaaatagtttagttgatatacctttacttgttttaattatattatattttttacactagcatcacctcaatttacatcctggagttgccttgccactgcttctctgctggctggctggctgctgctgctcccttcttttttggacagagtactctgcatttccatcatttgattttagtcaaatgaagtcaaattgatttgaacgatttgtcattacagttcaaaccacatcatgattcacgagagagactctactgggaaggaagaagaagctggagtaccatttcaactttggaacttggaagaggaatgattgcgtatctttgagcgaagcagaagtgcgtcatcaattcatcgcgatttcattctcaactctgaactgcaggccgtgattgacccgcagagcagagcagatatacagtacacagtacatacagccactatactccacgagggctataaatacagtagacggccgtctacgcgaacaccactgctctgcacagctcaagaacaatctcctcttcttcctctgccaaacctgctatcccagtactatcttccttcttccttctctctagctagctcagcagcatcttcagatcaaaggtgagggactacttggtgtttcttatctgtctcgagttgaaactgctccattttccatggatcatcttctcatcagcaacttgcacatttcttggttgcatgatcctgcgtcatttgtaactgttagtacgacgatgcaagaatgcatggcttagttagctaccgtttgagtcatgtcttagcatgcagcaaatgctagtaattagttgactaggaattaattgattgggcatttttgagtgcaggagatcgagatcgactggcatggagagggtgaacctgaagctgtacctggagaacgtgtacataatggaggagaacgagcggctgcggaggaaggcgcaggcactcaaccaggagaacaaggccctcctcgccaagctcaacaccaaccacgccgccgcctcctcgacgtcgacgacgacccagcaccggccacccaccgccgcctccgcggccggcgccggcgcgtcgtccaccctcaagcccggcaagcagcagccaaagtgatgcattgcatgcatgctgcatgcattagtgcaaggagttcatgcttaattaattaatgattagtttctgtaattactctaagttagtagcagcaagttggtgaagtagcttaaccagatgacgcataggagtagagtatttagcttgcaccgtgttttggcttgattagcagcagtacaccttttgtttttagtacaacttggtacggactgatcactgatcagacgctcatgaccagtgtggagtgcggacagctggcggcattttgggtcagacttaattagcagtgtgatgtaggagtagtaacactcaatcaaagcttaatttgtgctcctagctactaacagcatatattaattcgtaccagtaccgttttccataagttgtcctggataatactcccaccgtctatttttagtgtagctgtgggtttcattttccttatcaatttgatcgttcgtctaatttaaagatttatgaatttctttttttaaaaaaagtcatgcataaaatgctattcatattttatcatcttataataaaaaaatattaattataaaaaaaaatcaaataagacgttggatataaaaatccataagtcaaaatgggatgaagtatgtgtgataaaagtttgttcataccaatgatgtttccaaatcagagtaaacgactataccgatttcccgtgattgaggatggacttatgagctctcggacggctggtccatccccgtcccgtcgaccagatcacataatcgattacgaatgtgccgtggacaaaatttaaaattaaaaagtgttttggagtcaattttatgctttttttttcagcgcgtatttttcagtcttaaatttttaacgttgaaaccataagtaaataggtaaataacacatctaatataaaaagctttattcgcaaataatttttctttttttctacggctgataattcttgctcaaatcgattagagcctttataacctagagccaaccatgcattctactcctataaaaaaaaatatgccgcagcttacgagaaaataatcggaatgattttaagtcaacggcgtcgaaacatttcgaaacggagggagtacaatctagctagctctatataaagggcctgttcactttgacctgatttcttatatagttaccaaaatttggtagcaaactaaatatagccactttttttttggcaactttaccaaaatttggtaaggttgaaaatggcagcacagtgaacaggccctacatatctcacaaaagtttttaaataagaagaacggtcaaatatgtgctaaaaagtcaacggtgtcaaacatttcgaaacggagggagtatatatatatatatatatatatatatatatatatatatatatatatatatatatatatatatatatatatatatatatacatacatacatacacacacacagaatcctgttcaatatacaaataatttctatttcttgagcgaacccaccatttctatattggtcaatgatgtttctacaaaacattttattgtataatctgtaaaattaaaggtgtttttgattattattctgtgataaacaattgggcattggagattattggttttgttatttggaatttatttatgaagtggttttggagatgattggatttacaggtgaatcgtaggttcgttattttatgtgaccggtcagaccgggctgtgtatgccggtcagaccggcggtgatcgagcggtcagaccggccagcccgcgatctaaccggccgacgctgtgtcggtttcggtttcgggttgtttatttggatatctgtgattaattcatgattatggcttctagatggatactatacatatataatactgttgtttgctactaatgagtcaagttggagatagcttggtctcggaatatggtttctttgtttatttcatgtgtaggtgactcgatgcctcgggagagtatttgcggtgatggaccgggagtcggcttggggataagacgacgtctgtggtggtcagagatcatgcgagatacttaggctagagttgatgcacgtggttggtggagattccatatggcatacgatggaggtattgtgtgcgtatgggatgcggagtcgaatttggaaggagtccaaatttggtacgattggttatgtaaagtttgtgtcttgtactagagggttttctaaggtgtttaggactcctagtatgagtttggttcgtggttgtaggctgcctacctcatgtataaatagagggggagcgtgaggcttcccggtatcgcttttgagagcaattgagtttagttttgagttagggtttcgagtttagtcgaaatttttgtaaggagtgctgttggtgcactttgtaaatacagagataatcaataaagtcgtcatccactttaagagttcttcgatttgtgtttcaccgagtttcggcagtccaaccggtgatataccggcggtcagaccgacagcaagcggcggtcagaccggaggcatacgggcggtcagaccggcggcccgcgataggcgcggcaggtgacatcggcggtcagaccgggtgatctataccggtcagaccggcgacatccacacggtcaaaccgttagatcaatctcggtcagaccgacttttgtcgatttcgagggtaacttttatttccgctaaaagttttcggttttttgggtataccaaccattcaccccccctttggttggcttagttcttgtttttcgatcctacaagtggtatcagagccttgttttcttctttggatttttatcgatctagagtttttgccatggctactcccgctaggttttcaactaagcctcatgttttcgatggaacggatttttctcattggtgtagtaggatgcaatcttatattatggctgaagattatgatatttagagaaaagtttctcatccttatgtgattcctgaagctattaatactgcggctgaaaaaactgcttttgaacaaaattgcaaagcacgcaacattcttttgagtgctatttctcgttctgattatgatcgtgttgcgcactttcgaactgctcataaaatttggaatgctttgagtaactttcatcaaggaacaaataacattaaagaacttcgtcgtgatattttcaaaaaggagtacattaaatttgagatgaaacctggagaagctttggatgatatctctctaggtttaataaaattttgagtgatcttagatctattgattcttcttatgatactaattatccacaatctgagatttcttgtcactttttgaatggtcttgacatgtctatttgggagatgaaagttacgtctattcaggagtctatgactactttgactttggattcactttacacaaaattgaaaacacatgagatgaatgttctttctcgataagttgattctaagtcaagtgctttgatttcttcgtattcttcttctttggatattgatgcttcttcatctaagccttcttttcttgctgtttttaatgccacatccgatgatcaactcgaacagatcgaggaggaggatttggctttggttgctaacagagttgcttgagctatgaataatgccaggaacaggaaaagaggtggtccaaatcgttgctttgaatgtggttcaattgatcatcttcgttcgcattgtcctaagcttgggagaggcaaaagataagacaaagatggtgagaagaccaacaacaacaagccgaagggttcatcccaagggaggatgctggagaatcttaggaaggcttttcaacaagtttgtgccgcctttgagccactaagtgatgtagatggtggaagtggagatgatgataagggaaagaacatctccgatgtttgcttcatggcacgtggtgaatctgacacagagtatgaagataatgaggtaagtgcttttgaagaagctattaatattttgagtgaaaaaaaagaagtgtgagaagatgtatagaaaacaggaatttatcattgaatctcttaaatctgaaattgctagattaaaatctcttattcctaatgatgattattgctcaaattgtgaggttttaatgaatgagatttcaaaaattagagatgttaatgctgcacatgatttgaaaaatagatcttctcttgcttgcagttttgctttgcacacacgcactttggatgagttgtttttaactaaaaagttgttgcaaaaatatcaaattgcttttcatgttagtttgatgtttaacatgatttctgctaaaaagttaaaacaacctcatgatgttttggattgctcaacatgtaatttgaataagttgaaattgaaagatgttttaggtcgtgttgagttcatggaagatgttgtgaaaaacaatgaagtgctttcttgccctaaatgtcgtaaaagcaaatgtgttatggtagattgtgaaaattgtgctaatttggaaaaggaggtttcttatttgaaaaattccttgttaagattttctgatggtaaaaagaacttcaacatgattttggatcaatcaaaggttagcacacataaccgtggtttaggttttaatccttatgctcataattctagacatcctcctattgtgttaggtgttgatgctagaagtggtgagatttttgttaaacctgatactaataaaattgtgtttaaatctgctggtatcatgtctactatgggtgcatcttcttcaaaatccaatgttgtgcatgccaaatctcctgttgttgcttgtgttgctaaatcttctaatgctaccaatgtgtctaatcatcatgaaaaatatacttgttctttttgtgggaaagatggacatattgttggtttttgtttcatattagctcataaacagaaaaaggagagagagattgcttttgcaaaatcaaggtggcaaaaatcggattttccttcgaggaaaccagtcagaccgcagtgggtcccgcagtcagaccagcgaccggtcagaccggctactgagcgtcggtcagaccaggcaccagtcagaccggcggtacagtggccggtctgaccgggagtcggtcaaaccggcctcagaggaatttttctgaaaattctaaaattgattttgcatgtggttatatgcctattggatcttctgatcgtgtgtctcagtactggattcctaaatttttattatcatctaaccccagtactgaggcttcgacttctgcttatgtgtaggctttggtggcaaggaaggagaacgtgtggatagtggattccggttgttcgcggcacatgaccggtgataaaaattggttctcctcactcaagaaggcatccaagactgaatcgattatctttggtgatgcttctacaagtgtcgttctcgctacaggtttggttaaggtaaataaaaaatttgaattgaagaatgtagctttggttgaggacttaaagtacaatttgctttcggtttcacaaattgttgatgaaaattttgaggttcactttaagaaaactggaagtaaagtttttgattcttgtggtgattctgtgttgaatatttctcgctatggaagagtgtttaaagctgattttgaaaatcctgtttcacctgtgataacatgtttggttgctaagtttgataaatatgtgatgttttggcatcgtagacatggacatgttggttttgatcatctcactaggttaagtggtttggatcttgttcctggttgcctaaacttaagaaagatcttgatttggtttgtaaaccgtgtcgtcatgctaagatggttgcttcttcacatactcctattgtttctgtgatgatggatgcaccgggacaactattacatatggacattgttggtccagctagagtgcaatccgttggaggaaagtggtatatgttgattattattgatgatttttctcgatattcttggattttctttatggcaactaaggacgaagcttttcaacactttcgtggtttgtttcttcgattggatcttgaatttcctggttctttgaaaagaattcgaagtgataatggtggtgagtttaaaaatgcttcttttgaacaattttgcaacgaaagaggtcttgaacatgaattttcttctcctcgtgttcctcaacagaacggtgttgttgaaaggaaaaatcgtgttttggttgagatggctagaacgatgttggatgaatataaaactcctagaaaattttgggctgaggcgattaacactgcttgttatatttcaaatcgagttttcttgagatcaaaacttggaaaaacttcttatgaacttcgatttggacatcaacccaaagtttcacatttgcgtgttttttggttgcaagtgctttgtcttgaaatctggaaatttggataagtttgaggcacattctaccgatggattgtttcttggttaccccgcacatactcgtggctatcatgtacttattttggagactaacaaaattgttgagacttgcaaagtttcttttgatgaggctagtccaggtactagacccgatattgcaggtacactgtcacaggttcagggggaggatgattgtatttttgaagacgagagcaacgacaacgacaacgacaaggtcggctcggccggttagaccgggcgccaggccggtcagaccgccggcacacctccggttagaccggcataggaggtgcggtcagaccggccagggtcgtcggctgagggttctgttgatgctgtttgagatggtcctctagagattacaacttcgaccagtactgatacagaacatggatcaacttcagaagtcactgctcctttgcacatttaaagacgacatccgccggaacaaatcattggtaa

SEQ ID NO: 57895 - DNA, 10199 bp, Oryza sativa
ccggctaatggcatcttcacttgtggttttaatagagctacccactaaaaagggcaaccaaaaagaaataaacaagggagctaacactatgctgacacttcactccttttctcctatattccactatcgcttttcttttgcttcttgtgttcctgtcacagacaaatagaaaaaaggagcggaaagaaaacaagacagcaaaatcagaaggtgaaaggcttattattttggaagcatagtgggaataaaggaaggattaagtgcttactatgattaggctgggggattcactcatccattgcagagaactttacatcccaatcgctccgtgatcagaggccagcctgcttattgcgttcaccaaatcatttcaagcatcgatcacaagatatcggatccatcaatataatcacagtacatgccatacctggaaaccgagaagaagtctcttggcgaaggtatatccaaagtagagggccgcagatggttgattccacctccagcattagtgcccgcgctgatgcctacatgagatgcactgcagctacttgtcgcgacgacaccggtatcagtggtggtgaaactttggtgagctgagacagaggacttagtcggcgaagcaaacgggctgtccggcaaattgtgctccaagctgcagaatatccatatcaaatgaaagccatgagccactgaagcagcccaaccttttcagcttctatgtgcatcaaatcatgaaagctaactgcaagaataataagcaaacagaatgatgatgatggtctgtctagtgtagtttagtaagatccacctttggtcgctatcagcattcaggctcgcctcaccagcagattcttccttatcacctcctccgttgaccattttcctctcttctgtgaagtaacctgttcccttgagctgctcgcctataaacgaccaagaaattacaaggatcagtagtgtcgaatgagtggatgaactcgtcttacaatgcttgacaggcagaccgaccgaagtaacacataccagaatcaggcggtgactcgaccatggtggtggcaagaggctgactggaaccgaaggcattggcggtgggaattgtcatcgccattgctgttgtgacagcagctgcggctctattcttgaggtcgagcagctggaggtccatgagacggcgactgtggagttcgatggcctgttgcagctcggcagcctgctgctgctcctccagtttcctacgaagcatcatctcgtttgtgctattggagtgctgcagcatcctcgcacctgccaggcaccaaacttcacatcagcagatcgctctaatacaccataccaaagatcaagcaggaaggcattgaggctgttcgtttgtgcgacttgcagctgcgttacagctgcagcaacagtatccactatgaaacaatgaactacagctgtgctgccacagctagcacaaacgatcggagcgagctaggatatttttaccgagctgatgcagatcgaatgggtctctgccgtccaggccagtgggggtcgtgcagccggagaagtcaccttgatgtttcctgcaagatgagtggaaaaaaaattataagcaaccaggaaaactgcatgcacggatacagttgcagtttaaagatgcggaattaaaacgccggagcgtgttccaagcgtgcctgtacttgtcggggaccttgcccttctccttgtaaggcttgacgagcacgcgggcgtcgcagatgaaatgcggattgcccttggccaagatcagcttcaccgtctcagggtacacgaaggtgacgaacccgaacatgcgcttctgctggtacgggatgcgcacgtcgtgcaccggaccgtagatgctgcagcgcgggcgcattgccaagaacagcaaacatgccaatcagatcgcgttctaccgagtccgccatgaaagaagaaacatcattgcaacatcgcattatacctgaagtagttggagacgtcctcctcgcggaacgtgctgtcggccgggaaggtgaggtaaatctggcgcgatccggggttcatcatgctggcaaagtcgacgcggtccaggcgcggccgccccatgaacttgtgcgcctcgtcgctgccgccgagcatcagcgccgccgccgccgcggctctgcacacgcgcaaccaaacaacaaaggttggaactttgaaagcttcgagcttggaatatggaggttgtaaaaggcggtcggtacctttggttgtcgttgtgctgctgctgcagcaagaggctgaggcacttggtggcggcggatggcgagccggggagcgaccctgtgggtgaataggggaaggcagcagggccgaggcgctggctcttggaacggaggaggaaatcctggcactgctgctgctcggcggtggccgcgtccatggcggcgcccgtcagagcggcggcgtcgtcgccgtggacgaacctgcagctgctgccgttcttgcagaacccgcgcgcgtagtacaggcaaggcttccacccgaagccgtcgctgctgccgccgccgaggcagagctcgttgaccgacgcgctccggcggtgcccagggccaccgtttgcccagccgagaccgtacgggaacatcccgccgccctcgccgggaccggggctccggcactccgctccatcgaacccctggagagggtggctggggttgacgcccccctcgttgaggaacgcgagctgctcctgcagctggaagtcgtccaggagcacgtccccaccccgaggaaagaagggcggcgcgttcgccgcggcgcctcccccgctgttcgccgggctgattagctcctccccagcgcccaccacctcatccacggacccattgctcctcgagaacggctgcgcctgcgcccacgaggacggcgaggacgcggacagcggcgacggcgacggcgcggggccgcggccggagttctgccgcgacagcaggaacggcgagtgggccgccggcacggtgggcgacgacgacgacggcggcggcggcggcgggaggagggcgagctccttgcgagcctgcgccatgacgctgtggagcagcgcctcggggccgaaggcgaggcgtatcatctccttgtcgccgtggtcctggatgagcaggaggcccatgatcttggcggcgtggtcagggtccagcgcctggatccgggagaacaccaccttggtcgcctcgtaggcgtccatggccgcgcccaagaaacgcccggagcaacaagttctccttctccttcttcttcttcccctcccttcgccccacgcacacacacacacacacacacacaccgctgctgctcacgagcttctcgcttctcccctcgccttcacctcacacacctttacccctccttttccgctggtgttgtgtagtgcctacagccttaagtagcgcagttgccgcagcaaaaacaaaactagctggcgctgctttggctcggtccggttgctcggtagcctccgcttcccggagctgcggcagcgagcagctccatttccgaaactttggtgcttagccgcggcctatcaccacaccgtgcacctcacgctccctctattaagcaaagcaaagcaggcacagcggatggcctggcctcttcgcctcgcttctcgtctcctctcttctcctcgggggtcggttgacaggggacgggggaccggcgagggtgggtttcttggggcttgggactttgtactgttgcgggacgagcgagtacggggctgatggggcggtgtgtaattgccattgttttttaaggggttccggggcaatgtttgcttctgaaatttggggtctagtagtatcagagaggaacaaattaaatgttggctccatttccccaccggttaaccacacacaccgcagctccctccttctccgccccccgtcgcttttatgtcgtcaccgtttccctaagcacacgacttcatccgtcacgctttgtttcgaccctcagcaattcccgacgtaataccataacttagccccttttattcgtagaaaaattataagatatttggaggatttcaatccttcgaaaaaaaattcctatgaaactcctattgaatgagtaatgctatagagattttgaagaaaagtttgtaacagattcaacctgttggaaaattttctttgagtgtctatttcattcgattcctgtattttttgtgatccaatttaacagttattcttgtttttttgtttttttctagtattttgtaacttttacacttacattactgtcatagacctccggttttcctattccttcgtttttccatttctacgattcaaatagccccttaaatgtattttatggtagatatttgacaaaaagaataggagtatgtcttactccctatgttccatttttaagtgtagccatggtttttcgcgtccaactttaaacatccgtcttatttaaaaaaatttgaaaaaaaataaaaacataagtcacgagtaaagtattattcatattttattatctcgtaataacaaaaatactaattataaaaaaataatacggacgatgaaagttgagcacgaatacttatgattgcatttaaaataggacggagggagtaactcttaagaaaataatggttttttgccataccataatttggatgttattttactatgactttggcaatataaatagggatcaaaagtcggcaatatatcttacacgtgacatttgtttcgaatagtagatttttttttcatattaatgaataaaatgccagctaacataaattcagcatgtgccaaatttattgaagtattacatttaaacatgagctttgatcattggttttattgactccctccattccaaaatttgatatttaaaagtgtattagggttaaggattggggtaaaagatctacttgtctctaaataatgtcatataggattgggagatgggaattaaaatagtcttgttggaaagatcaggtccaccgggagctgtttggaaagtaatgagagaaaagccattttttacatgtcatgtgtacttttatttaggacaaaaaagctaaaattagcttatttggggataaatggattgtcatttatttgttaggacttatttttaccattaaaggtaaactttgcgtatttataccaaatatttctaaactagataaatgataaagtattatgtgaaaaagttaacaatatcatatattaaaaaacaagtccaaaagttcagtagcttcgtataatttaaaacgaaggccttgtcgacaaattttttatatttaatatatgtgctcttttgagtaagtgcaatatagaaattaacagttaactataagattaaatatgttgcatcaggcccttattttttcatgttaagattcagattttacctcgatttccattatcacgcttttaaaaataataagtggtgtgttctatgtgaaaactttctatatataattttctttgatattatatccatttgtcaagtttataataattaaaacttaactaattatgtgctaatagctttttctttttgcgtgcgccatcttcatcttgttttaaaatttaaacatcaatttaaaacaaaatatatgatgtgtcaatgagaaacatgcactgactggctatttttatagggaaaatttaaaccatgccacacaaattttgcaaaatttgtgatatgccattctaacccacatgtcattctaattccagaaaacagttttaagactaaatttttcatagtttcgtgtgtaatatgtttttctaacagctataaaaccaatgtcacatgaaaatactttgaattataaatccaatggtatataattctatgcactaaatatatttgtttgctatcttaattacagctcaaatgttccaaccttgacttcctaaaatcaaatacggttataaaaataaacggaaagcagaaaaatacaactatcatgtaagtcaaacatgttttctatttatatgataaaaatatttaagccaacattaaaaccgatttgttttataaatcaggctacatttaaatcggttttgcttgtaagatggtatgaatgtccggttttatatttaatgatgtttttttgaccggtgttgagagtaaggtaaacttcaaaatccctcttagtgctttttttttgtctttagggagtacttaaaaaggaaaatgttaggagacaaaatcccagcacccattatctaggtagcacggtgcccttctccattgttccacccccttacttgcatgcatggctagagaagggtgtacgccaccgccgcctagtcggccggtgagccgcctatcatcaatgcctcctttcctcccttcgtatcctcttgccggcatgcaagttccattgccatcgtgcttgagagaggggagactgaacccgccaactggatctactgttgctgctctccttcattgccgcactggtggatccactgattcttgagactcagttgcttgtgtgaccagtgaatccacgacggatccatcaaagccaagcatagagctattgccttctacaccccaattcaaagaagaggagagaaagagtgggagagaggagaagaaaggggtgggagagctccaatgccaccgtcgctatcaaaaccaatttggcccaggggtggtatcaagcacggctctatgagtgtccctattgctatccatagggatgagaactgccatgaccgttcgacgatgatggcaaagcaatgggaggtaaagtagagaggctcaggaatatcggtcattgccagaatgtcgatgatggaaggcaagatgaaaatgcttggcaacgatggttatagagacatgggctcatgctagtattgcatgatacaatgtggtactagagcattggttttcaaagatatcatatggtatccatttagtattattctgtttaaaacgggatcccgcacaatagtagccccttcaaataaacgaggaagttttattcggtttaaagcaaggctaataatacagctgacctgctggctataaggttctttatagccttctctcagcctacccatataatagttagctcttcacaattaatacaggtcccacttgtctctctcacaaagtttcttggttcttgtgtccaagccagctgttagtttacagcccgcttctcctctctctcctctcttatttcctacaattcagcatttagccggcttatagcttactattatacttgctcttatggtctgacactatatacagctttatttttatttattttttaaaaaaaggagtattaccgttcgtgtccggactccgaacaatacatgttcaaaccgggaaaatccatgccaattgccaataactttcagacaggcggattagcagaaaggtggagagaagtacactagctcgtttacgcgaaatatccagtcatttttttcaagtatagaagatacttgattgcgatggtataaactaaagtagtgtaccgatttagatgcaataccactatcctacttgatcacctgttcaccatcataatcaaatcatcgatattgtctgtctgttacagttaaaaaccgatgacagactcaggcgctcagccaggacaacttttttttaaggggaaattttaagacgccaggacaccctggaactactccgataaagtagcagcacaggacaattcgttgggtgcatgcatatcatcactaggcccatggactcgcgatagtgatatcacgcagtatagtatagcgaaaacacgcgacttcatggactggctgaccgttgtcaaagacaggtccaagatagatgataccataatttgtctgtagtttggtcatagctcggtcttcaatttgagatgtcagatgtcccaggaattcacgaagatagttactagctgatagcgtaaattcgccgacatatacgtacgcgcaaaattgaaaaacagaagttcgagggtgatcagtctgtttcaagcaacatgttggcacctgacaagcgattccaaatcaccggcgagaagtcagagttgatgaaaggggcagtagcccaggccccggacaagctccttgtcaccccttgattttctttttcctcccccattgactgttttgccttaagcaagatgatctcttcagtagttcagtggcgctttcggatgtggctaatcaacacataaaatttcaccgtcaatctctatttggttagtttgattcaacttctaaaaactccatgattagattttcttcagaagtggtaatagtaattaataagtaaaatattctatggatgattgcgtcagtccaaaaacatactcatttgtgagtggaattagtgagagcacgactgggaaataatgcttttatcagaaagagtagccattttttcgtatagttgtacgaatccaattgaaatcaaactgctgttacaactttatttattacttattagaaaaaaaacattgtgttacaattgtccatcgctattaacacgggattttttttaagtctcgagactaaaagagaataatcgttttatctctgctttaaaaactctcgttttctagttgaggacgatcttcgcatgaatttcactggattaaaaggttcgagaaaacattatgttaatatgtttaaaacaatcatggatggtttcaaggtaactttggaaggatcaaaacttacataatgttagatttgataagatttgttcatgtatacataattaagtgacatccatgttagtaaaaacatgctaagtctttactactgtaaaaatagagtcgatagtctttagggtttgttagaaccatgccaccctaattttgcaaaatttgagatatgccacccgtatctcaatgacatgtaggacccacataagttaatgacatgtgggtcagggtggcatatcacaaattttacaaaatttgtgtggcatggtttaaattttcccaagtcttgatgtcccatcatcccagcacgcgtgtagcatgtccatgtgctccttctcaaatcgcatgtacaccaatcagggtttgcaaaactgccggtaaccacgcttattgcagagtacagtaaaaggaaaatcgcagtaacctctgtaaattcaaataaatttaaaaaataatttgaaattttgataaattttacacggtttcgtacggcttaccgctgaggcgtggatgtgacatcctggcccagggcttaataggattaatagaatactcatatcaacaagttgcaacttcttttccggaatccaatctccaaagaactctgaggttcttctcgggtgcacatgagtgaggacaaagtgaaaagacttgtattggtctgtgagggcggtctatgatctataaaagctgccagatataagcgggtccggcctcggagaggcgggacgttacacgtggcaaccctggccccagtggttttagaaacctgacagcaaccctctcctctaggaaaaaaacagactagatcatgtgctttatcctgaattcatcctcatgtctcatatccgctcttataatcctcatgtcccatatccgcttttacaggcatagctcattgcaacatacaaacatgttataataaaaacgtgctttatccttaattcatcctcatgtcccatatccgatcttataggcatagcccattgcaacatacaaacatgttataataaaaacatgctttatcctgaattcatcctcatgtcccatatccgcttttataggcatagcccattgtaacatacaaacatgttgtaataaaagccttcacaggtgagaaaacattgctatgtaaactaagtaagtctttatttatctaattgtataagttaaaaagggaaaaaaacaatgacttaaaaaatactagttacatgctcgtaagctgccataggatcacatgataattttttgagggatttttttttggaaagggaacaattttttcgagtgaagttttgttttttttgaaaggagatagatcggttttttaaagggaggaacgaggaaggaggacggcgaaattaagatatggtactaatatcgttcaagaagaatccaaggcaaaaggatatttgcccttgtgagttcagttatttgtgggtctatattaaaaacaactttagtggttgtttaaatctcaaataccacacctatgctgcgttcgggagag

SEQ ID NO: 57896 - DNA, 9638 bp, Oryza sativa
atataccttagtcaatctcatgtttttaaggctttcagcaataatgtttggtgggcacttgaaaatgtcttatccatccatccctttaagaaaaccatagaaactgtgcaatcatacttgcatgatgtgtgaaaccctctgtttcccgggggagggggggggttaaaaaggatttcctgaaactgtgcaagaactgcacataaacatggcatagcttgatcaacttgatgaggactgtgtcaaagctgctaaaaaatgaatggtgaaagagatatatatcaataaatatgtagctagtggtgaaaagcaatgcaggcccgttttctgccggggagagagaaagagagagagagagagtgattgtcaggtagcttgttgattgagctgcatctgaattccggcatatacgcatgcatgaaacgcagcagagatgttcttcttgctgtctcgcttggacttaaccgcttgggctcacctgctcctgcatcatctgcatctgcatacgcaattatgcatgcatatatatgtttgcttagctaccatgcatgcatgcagtttgtttcagactctttcagttattaatcctgcagatgttcagagaaatgccatcagcggctccttggcccacatccttttcaacgtttaactggggttttgcctcgtagactgtgctatataatctttgtctatgcgatgtaaatactgttagctactccctccgccccaaaatataacaatttagaaccggatggcatatatcctagtccaacgaatctggataagaggctatctagatagattgatatattttgggatggagtagtactcactatagctagcttcaggttttacattaccttgctttgaaaacagccactgcatgcatatggacgggagcgtatcctatgcacacaggccctcgcgtgtacacaccgtgtacaccaactaaaaattatcacaaaaaattttaggaaaattcatacatgtactttcaatagtattacatctacgtgcaaagtcgcatcttcaaattcattctacatagagaataacaaaaaagataaaattttgataaaattgcaaccttaaaactgtcagattttttgtttttttttgttatggctaaaatataataaatttgacattaagattttaaccctaggtgtaatacaattgaaagtatgtgtatgattttttctagattttttggtgacattttttagttggtgtgcacgtgtgtacacgtgagggcctgtgtgcataggatatgttgcccatatggacattcatctaatgaagttcagaactttgtgaattgatgagtgatgacaacttttcaactattcggactagcttgatacgaaagttatatactcctatataacagctcttaaaagttttataaacatgtactcctactactatacaggtgatccatgcatgtttttttttttcggggaaaaaaggatcttcattactcagtcacggagtcctcgcgaacaagccgtgaaataaggtgatccatgcatgttgtattgggatttgggaatactcgtgaactaaattcataacagtaggactaattaactcagttatatattatgggtcatttaggtttgtcctaagacaaaatctttaaatttaaccaaaactataaaaaaaatgtagcatattttctaacataaaacaaatatactactccctccgtttcagattagaagactttctaacgatgcccatatccatatatatgttaatgaatctagacacacacacacacacacacacacacatatatatatatatatatatatatatatatatatatatataccgtcaggttataagactttctagtattatccacatttatataaatgttaatgaatatatatattacatggtaaatttaaggactaactaatatgtgtgttatatgtgttattatatattttatgaatttagtctaactaaaaaaactaatttagaataaatttaaaacgtcttataatacaaaactgactgtacttgtctaacaatgggggtcattttgtttgatgaaatatcctctgcatttctcagccttatatacctctacaatgagctagtggccaactcttgcgtactgggccaaatgctaaaggaaaaagtatagtttgactccctcaactatcgcccgagtatgattcatgtcccctagccacaaaaccgggtatatggactcctccaactattaaaaccggtgtacacaatatcactcggtggtttgggaagtggttttggctgacatggcgcctacgtgacggttttgaccaagtctttgttctacgtggtgcttacgtggcattagaataaaaacaaaaataaaaaaaatatgtgggatctatatgtcattcgcacaaaaaaagtattttgggacccacatgccatcctccttctccttcccttcttcctccccctctctctcccttatctctctctcccccttgggcctttctcttggccggagtgcgggggagacggcaatggggagcggcggaggcggttgggagcggggacggatcaaggaccgtcagtacctgctcgtcccggagggcaccgaccacccaccgcatgccgcgctgtcctccccctccccatcgccgccgcacgtcttccaccgtatccgcgtcgccgcgtgcgcgctgcgcgtcctccgcaacctccagcccgcggcggccaccatctggagcaagcttggcgatggcgaggggccgcgggtgttgctctactacacgtcgcttcgcgtcgtctgcgggacctacgaggactgtcgtgccgtgcgcgccatcctgtgggggctccgcgctgccgtcgacgagcgagacctccccatggacccgaccttcctcccggagcttgccgcgctcctcccccaacgccgccacatgaccctcccctaagtgttcgtcaatggccgccacctcgccgctcccgaccgccgccgccgccgctccccgctgccaccgctcccctccgcctcgtccccatcggccaccgctaccgccgccgctcctgagtcctgagagagagagagagagagagagagagataagggagggagagagagggggagaaagaaggggagggaggatgacatgtgggttccactttttgtgtgaatgacatatgggtcccacattttttttttgttttttataatctatagtggcacgtaagcgccacgtaggacaaagacccggtcaaaaccaccgagggatattgtttgcaccggttttgatagttggaggagtcgatatacccggttttgtggttggaggtcatgaatcatacttggacgatagttgagggactcaaagtatactttctccaatgctaaatgatggaggaaatgggccaagttctgtgaggcccatgcttgtagtcttgtttagccagaggataagggcttgaaaggccaaaaactaagaagggcctttttgtatgtatctgctgtgaaattggacctgaatccacgtctaatttcgacctatacactcttgcgtggaccagtgtttttagtttaattttccaacatggcacccataatttaataaaccaaattgactacgaataatctgcccgtttaaatgtttccttaattccctcaaaaacaaataaagaaaattcaaaggaatattacactactactccagttgaaaatttctttttagagtgggagcaagagtccttcgaacgtttgattgaaaaataggaggaggccaatgtaaaagtttcatttatagcaggggccattatactatttgagtaatactctactatagtgacttatgtactttaatgcaatcctctcacttgctataaaattatatatcgcactaatttctaaagcttaacatacagagatgtcatatcattacttactaacaattattacatttaaacatcatgttatattatctataatttaataatttattaaattttagagatttaaaatataagcatgttaaatcatcccacataattcacataatatttcaatatatctctccatcatttttttaatatcctataaatctatatagttcatcctcactttattccatgttaattttcttttctctcattaagtcatatcatataaattggttttagtcctcaaatgatgaacctatggttcaaattatctctcttctttttttctctctcactaagccatatcatcttagttctttgtagttcttagatgtatggtctaaattatcttccttcttgtgttttcttcataaagccacatcatcttaattttatatttgatccaacgtaggtgctgagtgactgagtccttctaataagagatggaagggagaagaagagggatatgaggaatagtgtgggttgggtgcagtgcgagtgcgggggctgaaggaggaagaaggagatgagtctccctataatctagttcgagatccctatttggagatagggtgtacgtgcgtatgcgtttgaacaacgtttctaaaaattttgaaaaattttggaaaatgaaaagggccagaaaatggtataggaccaatttgccaaaaacgctaatacacgactagtcgcgcgcgtcccttcccgcgtgacgagccacgtggcgcgcgcggaggagttaggttgcgttggttttttttctggttttcttttttttcgttcgtttcgttggttttttttccggttttctttattcgttagtttcttccgttcttctgtttttttgtccggttttctcgtttttctacgttggtttcttccgtctttgttcggttttttctctcccttttcggtttttcagtagcaagtttgtatacacacgtgtacaaagtttgtatacatacatgtatatattttgcacgtatatacagtttgtatatgcacgtgtacaaagtttgtatacgcatatacaaactttatatacgcacgtgtacaaagtttgtatatgtacgtgtataaagtttatatacatgtttatatttttacatatatatatataaagtttgtatactcccgtatacagagtttatatacgtcgtgtataaagtttatatatatgcacgtatacaaagtttgtatacgcatgtatacaaagtttatatacgtataaatgtacatatatggcaacgtatcctatgcacacgggcatatagctgcactcatgcacacgctcgttccgagcccttcgatcaagatcctgcggctaactctccaagcgttgcatttttacaatttaccgcccgcctcctccactaagttttgcaaaacacccctccacaattctcatcttccctcgagcagtccatattaacaaaaaaaaaaaggttaattggatccatgccattacaactttgcgaaattaaaaaaataccactactattcaccatatcagctatatgcaactgaaaatttctaaaattgaaaacatgccactgccgtccctttttccatctcctatctcacgctgtctcgtttcccccgtcagatgtggcgtcatctcacaccatctccctcttctttcttcctgcgagctcggcggccacggcgagcgctcgcgggttgaggaggtcggcgtcggcagcgcgcgggacttgctccaatccccaccgcctctactgacatcgtcgtcctcgtcttcctcctccaccagacgccgcgcaatgccgccggtcgccgccgccgggctggcccccgctgccgcgcgcagctgctcgaagaagaccacctgcatgacgacgcggagcgggaggcgattgttctgcgccgcgtggatgcacgcctccttggacagcttcttcacgtccatcaagcttgagatcttccgatcctcttctccgccttcggcacgttcggatgcaactgacaagtgacagcagattgcaatatgttcatgtcaaaaataatagtttagaaatcatatacaaaatatattagtagtttatacttaacatggtggatgaaaatatacatcaacatgtacaataaagcaaattcaagaaccaaaaaagatgaaaaatgatcactgttttgcatcatggtcattgtcaagcaaatataccttgagaaagacatcaatgtcggtgtacagtccatcatgggttgctcttgctgcatcacgcaaggaggtcggagaggaagacagcgacgcccgcgggggagtagaggagggagcggaggaggtcgcggaggtgcgggagcgtgcggcggacgacgatgaggatgcgggcgctgcgcgtggacaccacgctcgccggcttcgacggcctccgcatccgccgggccaaccatttgttcctcttcttcggcgaggaggtcgacgccagcggccgccaccttcccccgggctcgctcctcgtgctccaccgcggcaggagagcgtcggggagtggaagtcgcgggccgacggccaacgctggccgtaagccacgttcgagctcgccggagatgacgatgacgacgaggacggcgacgaggaggagttcctccccctggagatccgcgacgatgacgaagacgacgacttcatggttgccgacatctccccgcccccgtcgcgccacagctgctacatgcccggccggcgcagcgtggcgccgccgccgtcacacatggcgacgccgccgtgctcgacgatgcgccgggcgagctcagtctcgggagctgccgccgccgccgtcgtcctccacgccgtccgcggcgggagtgctcgggagctgccgctggcgtcgccgccgctgtccttttgcagttggagggagagagaaagggagattgaaacgattaaacgtgggaaggagacggcgtgagagtggggagtggaatctaatccctcgagggatatccctcgtatatctttttttcttttaaattcgatgtaaatagttgtaaaaaattctgaaaaaaattgacaatgtagagtataatgatacctactagttcatcaaaatttaagtttaaatttgatctgcacatcgagaaacaaaaaaaagacaaatttagatataaacagtacgctactatttatacgctgaatttatcttttttatatctcgacgtgtgagttgagtttggacttaagattttgtggagttgtatatatgtgttgtatgaatgttgtcaattttttccagattttttcataaccgtttagataggttttaagcaaacgagggaacatccccttgagggattagaatagtttcccatgagagaggggatggaaaaagggacggcaatggtatggttccaattttagaaatttttagtggcatgcagccgatataacaaatagtagttgtattttttaaatttcgcaaagttacagtcgcatggatccaattaaaaactcaccctatctggatctagcactagcacgccgcatgcgcaacatcggcgagggtttgtgttcggaggcagcggcgacaatgcttcaacggagacaacgacatcaatcaacgaagcgctggcagagacggcgatctcgagcggcggcagaggctgctgctgctttcaccacagcagaggttctgttcaagtttagggggaaaaactaggagctgtcactcatgaacacgatggattgatggctgaatatcttctatgtaatcccatgattcttccaaaacattactagttttgctttggacgcagatttgaaacagtcaggtggtgatgaactcttaaatctcatgtgaataagaagagcagaaattcggactaaaacaacaaatttctccgaagaaaaaagtggtaaatagttaaatgccccccaatttgccacttttacggccgcgcgcggtcagtcgctaatcaactcttcccctaatttatgagatattgaattatatgtaaaataatttatgagatactgaactatatacaatatagttaattgacaaatttaaaaatgacaaatagttaaatgccccctaatttgcccccacccgcacacggccggtgagcgtgagtagcagtagcccaaaaaaacacaagcaagggaaaaggacacgaggccgagggagggagtttggcagttgctcgctcgccaaactgccagatccggatcccgcaccagatgcgcccgacggcgatgctccgatggcccgccgccgcggcggcgctcgcgctcgtcttcctcctcctcatcgccgccgcgccccccgccgcggccttctacctccccggcgtcgcgcccaacgacttccagaaggtccgttcctcctccccctcctcctcctggtaatggctcccgctcctgcgcttgctggatctcggcgatcccctggtgcagatccggctccttgagtcctcgtgctctagccttttcggggttgtccgtacgcgccaaatcgttttggcttttttttttctttttttgaaaaccgaagccagcaaagctggtgttataattttggcgtgatcgtcgtcctgttcttccacacacacacacacacgtaggggatgctgtttcgtacgcgtttctgtggatgttggtggggtttggttgatgagtgatgaatctgtgtgccgcttgtcgccaatgttgagaataaactgtatattttcagtgctgtttgatgtaggggtgtggctgatcagtgctaaaggcgtaccgacatttggttagggatgcctctgtcatgtggttctagttgcatgcctctggaattctggatggacattagcatccttagattagatccattgtttcgcaagcctcagtgctgaggcagaacatgtttctaaccgaaagcgaagcaaagcagtttatctctttgagtggaaaaaacttctgcaatgatcctagcatatgcatttcgtattatccctctgaacattttcagaacaaattatattgttgactatagctgtattctgtaattttttcaagcttgcgcattgagtaaacacgctccaattttcaacatcttctcagcctctctataccgtaccctgtttatcttctctcgtcaattgttgccagttgtgcgtgtatcctcaattttgtcacttacgaatggcatgcatgtccttgcaacacctgcttaatcacccttttacccttaattttttttgctctctatcgttcagtcattagttttaagaatgactgtgctactaggcattttctaggttattacatgtttattctgttctgctacgtagagaagaaaacatcatgaaggtgactgaaagaaaatatttttgagtctgtgaagaaaaaaaatatctagtaatcttaaaaaacatacatttacatttacctgccgtactgacaatatcttaaaaatatctagtcatatgttttggatgtgctctaatggacatatatactacaatgcctgcagaaagatccacttcaagtgaaggtgaacaagctgtcatccacaaagacacaactcccctattcatattactcccttcctttctgcaagccagatacgatagttgacagtgcagaaaatcttggagaagttctacgtggtgatcgcattgagaattctccttatgtggtcagtactggtctctggtttacagattatctgagcgcactcgcatgttaatgtacctaattatcttctattttacttcttgggact

SEQ ID NO: 57897 - DNA, 11341 bp, Oryza sativa
cgcggcgatggccgtgcgcccgtcgacggagcggactgccgtggcggtggtcccggcatcggtcttctcggcagacggccgccctcctcaccgcacgggacagcagcaggccagcagcgccgccctcctcccgcctccgcgccggccgcctctctcatctccgcacgcgtacgcttgcacggtcagggacccggagcacccgtcgctggcgtccccgacggagaactccagcctgtacgaccgcccgggcacggtgctcacctcctgcaccatcgccgtctccatgccggacaccagctcaaccgcgcgggcgccgcccggcaccgcgtcgatgtacttgacggacttggtggtcgacaggatcgtccacggggacagcggcgtgtggtcgtcctcgtccatgggcggcaccagcacgccccaggacgtgttggggaagatgtacgggccctcctcaaagcccccattcttcagcatgttacctggttcagtttgttcgattatttcactgtgagcacatcctaattgtattcaattttgtagagatgcacactgatagcagctttgtggagaggttagcacccggctcaattagttaattacctttcgttctttgaggaggttgcggggtcttaatggcgaacgagtcgatgagggggccgcgagcttcgtcatcagagacaccggggttgtggacgatgaacaacacgacgctgtgcttggccttgaaggcccaggagtaggagtcccagccgctcggacccgttgttgccgaccgtggccagctcctccttggcgagcatagcacgcagcacgacgcccaggtcgtcggcaagcttggcgaggaacgcctagatggagtaaaaaaaaggaagagaaaaaagaaaggggaaagagagatgacgtgtatcatgctgacatgtggggcccacgtgagacccatgctgactcagccgccacgtaagccaaaaccggggtcaaaaccaccgaaagacctcgggtgaccggttttgtatagttaagggaccccgcgtatctgattttgcggttcaaggatgtttttctatcccgatgacaagttgagggaccttcggtgcactttttccctctaccggacattagaggtatgggctttttgcataggatccgataacaacgtgtccaacaccggtccgtctaaaataaacacgagtaacaggattatactaccctctcgatcatattatgtttaccaaacatgatgagtaaccgggtactacttcgtaaccaaaatcaaccctagtaatatttcgtgaggcgaaaatttgatgtaaccaaaagtggtaagataaaagatgtggaggtaatatttattcgaaaccactttggtgtagttgttaaatgtataaattttcagagctaccaaaatttagtagcataatgatagctgaaatatattcgatttatcatgttagggttggtttggacaacaaatcaaacacgctgttaagtttacacgttgtattaggggccgaaatggaccagacatgcacatacagacccgctattatattgttttatttagtacagtatatattttttcaagatatccaggtggttcttctttcatctatactagccacgtaatcatgcttcgtgcaacttttaatcccgtataataacttttgtatacggtatattagttaattgaaggttttagcatgagttattttttttcaaagtatcaattggcctacctaactatatatatatttagttactatataagaaatcactataagtctcctaagtttttctctttgttttctttgccccctctcttttttatcacgtgtctaagaggaaagcaatagaatcctcgaaaattcccatacgtttatccatttgttgtttctgttaggaaatgataggcgaacaaatgataaaaaaataatagatcaatcacagaatacatgagatttaacgtggaaaaccctctcaaagcagtagagacaaaaccacgggcgccagccagcaaaattcttcactatatctgaggtaaggttacattgtcgcacgacggcttacaagaggtatatatatatggtggaaccctaaaagggatgacgatccggcccaagcctcccggcgacaagcctccgctccactacgacagaagctggcctttattaagtgcaaataaatttggatcataactcaacattttccaatgcatgtgtacctttttatccactctttatcccttgactaatatgtcttgatgagatgtggcgtatcctcgtagtaaaaatgttttatgctttcactggataagataggataagatattccatataattttaacctagctactactatactacatatttaagtttaacatgtaaaaatggcactcacttctttttctacgcatgacaatattagtccaattttaaaccaactaacgtcatatattagataacgaaggcagtacattaatattatccgtgagcaattattaattagatcttaaatttgacataagcatgctccgttatgtatgatttattatattttaagctcaatataaaaacatatgaaatcatcgtgccattgtcattttcataatattttaacatatacagtatatgtttattatctttataatatttaacatatatttataattcttaattactccctctgtttcaggttgtaagacgttttgactttgatcaagtcaaacttctttaaatttaaccaagtttgtagaaaaagtggtaacattttcaatcaagataaatttatcatgaaaatatattcaattattaatttgatgaaactaatttagtattataaatattactatatttgtatataacttagttaaacttgaaacggtcttataacctgaaatagatgaaatagatggagtattaatttttctcagatagtcaaatctcaaggaattagcctctcacgcaggtgattcaatgggtaagctcctaattattccactttatatttaaaagatatgctacctttccctgtttgtgcacagctgcatatccacttgcagtggcatctcataaaaggagccttggaccttgctaaagggccacagaaacacatacccaaacggaactaaactaaggtcaagtggatgcaatgtcatatgcaatccattaagcttgccatttgtcatttcgtgtattttaaggctgccgtacaatgacaaggtcggattggcattattgtgaaacacgtaggcccgtatgatctgatggctctcacatgatacactaattaatcttactactgtacttgaattatttgtttttcaaaagcaaagctagcgcatatatccggattatgcagacgaagccatgcattaggatcgcttgaatatggacagagacaaataacactagtcccataaactaatgggagacaaatgcaacgaggcgttgtcacatctacctgaaagcctccatggccgtgatgcatgcaaggacttgtctgtctgccttaggaaagggctttgttaaagactgttgaacctgagtagtaccagtattattattcgtgaaaacagagaagaaaaatggaagcgacgcattgcagccttcgcatggttcatgaaacgcgcgcgaattaaagatgctcgatcgctcgtgacaacacagttcacgaccccgcggcatcaagaagccgcacgcatgcaagcatgcaattatgtactcgtatcgtgttcaaaattctagttgtactcttacttttcttgatttctcaaaaccccgtgccttgattagttctcaaatttttttcctaaaaatgtcacataaaatctttggattcatacatgaagcattaaatatagataaaataaaaaactaattgcacagtttgcatgaaaatcgcgagacgaatcttttgagcataattagtccatgattagtcataagtgctatagtaacccacatgtgctaatgatggattagttaggctcaaaagtttcgtctcgtggttttcagacgagttatgaaattatttttttattcgtgtccgaaaaccccattcaatatccggtcaaacgtccgacgtgacactaaaaattttccttttcacgaactgaacgaggacttagctcttccttccatgatacagggcaccgcgcgtggatgtgaacaggatgccgagataattttttaccatgtcaagtttttttttaaaaaaaataaaattttatacttttaaatttttaatttttaatacaaacattttcaggacttgattttaagatctaatttttttaaccacatcagtcgagccagcgtgaccaacaatactgtcacaccgatctaaataacgtggcagagttatttagcgcgtaggtttgtgtcagggtcatggataccacatacccaatagtaatcgactaagctcggcagggcccatcacataccatgtcttatacggaaacaaacctcgtatatagaaggagttctggataaggaatgacgagtagagttctatatgtaaacgacaaggactactcggatcatatctatatttatctccctagtcttacttggataagaaggattctatgggtataaatacaagcccccctaggaaaagaggggacacacccaccacaatctatgaagcaaatacaagccaatatgctgccagatctcgacatcagagatgagcctagccataccccatctggcacctacaggggccggcaagagggatctagcgccatctcttatctcaccgagtacggattcgaggaggagattaccctgtcgtcgactacgagttggttatctagccgccaagtcgacgacagttagatatgttatcctaattattgtacttgtgtgattcagatgaataaagaacaacaccagcttcggccaacaggatgtagggctattacctgtaagataggggtccgaacctgtataaaattatatgtctccatctcttttacctcaatctcgcatataccctgataccaacgatccccatacatccaaataccctagtcgtgtcgacaatttgctggtgtggtagtgttcttctcctaatgtattaggataaaactatatatgacacccgctgcatgttgtatgataatgttattttgggacgttggggtgattggcttgatggaaaggttcatatttttaaaataaacttgaaagttcatttttgaaattgtgtgtttatttcacactagaattgaaaatttggttgaaattggaacgatgtgatggaaaagttgaaagtttgtgtgtgtagaaaaattttgatgtggtggaaaaattgaaagtttgaaaaaaaaattagaactaaactcagcctaaattaaaaggtaaaaaaaaaatcgatcgtcgatcggctatgcccgctagacgagaggattgctcggcgcctgagccgtgaaggtaggggatattctattgcaccgtgatcttgtgctgcctcctctcctctcgtgctggtccttgcggtaccacatattttggcccgtgcctctgttggatcgctcgcgcgggcgcgacagtctgcggctgccaggagcgcagctttgactagcagataacaacggcgcgggaattgaaggagcaaggccggtgggtgggagtcactgatcaccatgtgcctcttgctccctcttcagatgcctaatcgggagtactccgtaattcaaaactttgaaagctcgagtactaggacagttgttgttgttgttgccctggactgtagattaaaagaaaagtaagagcgccctcatgcgccataaaagatgctgatcgcctgatccaacagaagcccgacacgcacgggcgcacccttttgtggctatctaatcctgatgttaattacttgatggtcataggcatatgatcatcgaattctacagttgttaaaccctgcatacttcttatgggttagtataaagattttgcctccatgcagctgcggcagaattatttttcaggttttgccacctttagacatgggcatcaagttatcaatgatcagtctcggcgacacagtagtgccaggaacgggataatgagcacccatgcttgggtacataattgctcgggatgaaggaaggctgggttaaacggcgagagtaacgatgtaaaaaaaaaacgacgaaccagatcgctgtagctccacgactcgtcgtcatcatccagtctttcgcctccatgcctgcgcgctgcgctgagctgcatgcacgcgattctggccttggtggcctagctacctctgaccctccttggattctgaccctttttcgtgcactcacatgccatgctttccccggtttcccccctccgaaaaaccaaaagcgcccagccaaaagtgccggatggacgcatacgtaaaaatggccgccccgtggatggatggatgcaattttcacttttatgattaccgcgcggatgcgcgaggacacgcgctgcactggcacgggcacatcagcacatggctgtgaacagcggaacccggtcatggctgacgacgggacgaggcggccaggtcacaggccatgctgcgcgcggcggaggaggcaggggcccctctccctcggcccagcatttgcacgcgctccgcgtacgcccggcgtcccgactcccgcgcgtgccgtgcgtttcgccgccacaccacccaccaccagtccaccaggttgacgtgatgttaaaggcgtgagaaagcaacggaggatttcggatttcgatctcacgcgcacggagagaacgagccgcagccgcccgtccgtgccgccggccgtcgtcgagctcggtgagacggtgtgggcatgtggagagaaacacctgtatctccccccgaagcctgaccgagacgtgtcacaagagtggcaaatagttaaattagccaaagtgacaaataaacggatcctgtcatctggttgggagccatcgagaaactttgttttcccgtctggtcactctagctaactgctggaaaagctagcgaacgtgcatggagtcctcgtgcggtcctaagagaaaaaaatcattgtcttgtggtgagattgaatcccatgattcccattcgctgcggcattagtggacgatgtactaccggagtagtatacgtgcaacgagagaatgtttcactgtcagcaaaagcggggaactttgacgcgaataattgcgcctattaatgagagaggatataacaaatgatggatcctggatgatcgagtgcgagaggtaggtgtgttggttgcagcagttatttttactctaagaggaactcttgtacgttgatctaatagctcaggctcccttcaaagaaaattcataaaaatttttatggatttcattcatataggaattttttctatatagccatttgaattaaatgaatgaattctatgaaattccaatggaatgcctctttacatataaattttgcaagaaatttaacatgaggtagaacctcatgttaagtctttatctctcctcaaattcctgtgttttttctacggctcaatcaaatggttatttctatgtttttcctgtgttttgtaatcctctgtttacacttgtattcctatcagaacctatatttttcatattcctttttttttccattcctgttattcaaagggacccctcaaaagttaaattttctggaacagagatagtatagcgagataatattgcaaaaaagtggagatagaaattttgtcaaacaaataatactattagaaagtatggttataaaggagataaatatttttatactgtagacaaataaaacattttttatagcgagataatactgcaaaaaagtggagatagaaattttgtcaaacaaataatactattacaaagtatggttgtaaaggagataaatatttttataccgcagacaaataaaggagataaatatttttacaaagtatggttttggaacaaaaataatacccgagataatatttttattattttcaagcagaaaagtggagatagaaatttcaaaaagacataattgcacttagccttatcgaaccatcgccctcagtccaactggcccgtcaactccttccgatccccatccaaaactctaaccctaggcgatgggtggcacgaccgatggtggcggcgccgctaggagggagtgatgatgaaaccgtgaagttgatagtgccgagggtaattttgtctttttaaattgctctatcatctttttgcccataaatgataaaatattgtctcagggtatcatacatccaagcacacagattttgaagtgtctatcagaggcatcagtagcgatacgattttgcggtttctcttagctaatcacataaaatatagatgttcctatagcaaattttaccatgtttgttgctaaaaccgcatatgcaaaacaagtgttactattgtcaatattagctagagatgtgatcccacttagattattatgtaagcatcctattcatgtatcctcttctcgtgatttttgtactcatattgtaactattaaaaaaacatggttaagtaagaattactttctcgtcccaaaatataaaaacttataatcggatgggacattttttagtagtacagatctgaaccggaaggagtaatcactggaattttgcaatggatacgaacaaaactatcatctctcaacatgatctacccttggaaaagcatccttggcaaagtgacgaggtgcgttcgttctgggggattgggtgagaaagggacatcgttttccacgcgcacgcttcccaaactactaaacggtgcgttttttgcaaaaattttctatggaaaagttgctttaaaaaatcatattaatctatttttaaagtttaaaatagttaatactcaattaattatgcgctaatggcgcacctcgttttgcgtatctttctaattttttttatctcctcctcaaacacagccgaagaggacacacttacagtgggtctagggatagagatacaacgcctgaacaggattgggagaaagagaaagacggattgctcaatggatgaggttggtggttacggatatggtattaagggaagctaaacacccgatggcccatcgccggcagcaattagccatttgaatcgcaatgatagatatcaaccgtaccatgcgatctttccagctagacagatcacatagctcagtgtctgagttgtagttaagtaagatttaaaacctgatattgtgccagattagtccaagtatgccaggacataagtatcacaagaaccattgatcgctcaatggacttttggcattggatgagcttctcgttgttaaggaaaaaagaattaacatcgggtcagttggtcaatctcccatagtcggcgaggccgccgtacagaatggatatcacttggcgttttgcggggcccggcctgcagtgacagcctcgtagcgggccccgtgcgagagggcccatgcataggtgcacgtttggctctggtccacatggatcatgcgcgctgcaggcaaacaaacgtgagtcgcggcgcggaaaaggagcgcgacctcgctgttgaacctgtagtaggcgtacacgtctgacgtggaaagaaactacatttaacttttccgaaaattagttctaaaacgtgtctcgtaaaacggatcccgtcttttcacaaaagcgaaaaaaaaattacacattaatatattagagaaaaaagagtgtttgatacaaacgcaatcagttatactggcttatgttaggggaaggaagaaaagacaaaaaaaaaaaaagaaaaagaaaaggaaggactactacgatggctatagaaatttcgattggcgggatagaacggatcccttcgtaaaattcaatttgaattaccgctatagtcagtagtcacaataataatacgtacaatagatgcatttaaactgattatcaatagtattactctttggatttaggctcttatttggttgactcatgccagataagttttagcaaaatgaataggcaaataaaagaatttataggtaaaaatatttttatctgtgttattagcagcctaaaagtatgtgcttaaaaatagactaaaagacccaaaaaatcaattttaaaattaagttttaagatttaaattttagatgtgattgataaaccaacaaatgatattagcttttgaagatagtacatgtcatcagtggtggatctacaatttaagatataggtggttcaacctaaatttttttctaaacacagtaaatctaacaacactaatatatgcaatgcatgtatagattaatataatataccaaatcaccaaaagtttaccatcatatattaataaatcatataaaattagtaaccaagtaaaattttgatttaaagaagtttaaagcagaaaacctaaaattgttagtgtgggctgggcgtcaacggctgcgcactgcagcaaggaggcaagtctccgtgagtccgtgattccgtcttccagttttacctggttgatcggctcgacgtcggctcctcgcagtagtggcacactatagcacaacagatcagtagtgtgagtgcggcgcagcggcggcggactcgtgtgcggcgtgcgtgggccgccggcggcgcggcgctcgctctgccgtgtgatcagatgagatcgcgttgacgcgtcgtgttcgtgtcgctaggggctagggtgaggaggagagagccacgcggaattctgaattctgatcacgcgtgtggggcctgtgggcggcgggcgctaggaatcgggaaggaatagattcgctattttttttaataaccgctattttctttttttttaatattggagccggtcgctgtatttttgggtggtccagggacaactcggaccaccctctgaatttgccagtgcatgtcatgattttaatatgtttacactactaattaaactgaactggtgttttaaaagctactccctccatctcataatatagcaacctcgtattggatgggacatctcataatacaacgaatctgaacaatcattctatctagattcgttgtactattagatgtcacatccggtactaggttgcaatattatgggacggagggagtatgtgactgtccaaaacgtagttggttttctgactagggctgtgttcttaccttcaagttcccaacccatctccctcgttttccgctcacacgcttttcaaactactaaacggtttttttttacaaaaagtttctatacgaaagtttcttaaaaaaatcaaattaatctatttttttaaaagctaatacttaattaatcctgcaataatacatgcctcgttttgcgtgccggggagga

SEQ ID NO: 57898 - DNA, 73804 bp, Oryza sativa
ctgcgcccccattacaattaaatctttacaataagatgtcacacgattgtagtatgtagtatgttggtaaaataaatatattttaaatgttgaaatttgatgtttaatgtatgagaagcgaatgcttcaactggaattctactctatcgcacattttaagttttgattaaaaacaaatatatttttgcttgttataattatttgtgctgtttgtgagccaatatccatgcaaaatagaccattttaattcacataataatcttataaaagtctatttcataaaaaaataagttttatattgttatgggcctatttggtttgcattgggtgaccttaacttggctcgtacgggtcatcctatttgggattagcatggccataggacgtagatggctgaatggtgctgtctggttacatgtattagtttaactaagataggttgggataatgtttggttggttatatgagatgcaacacttgggagatttcgcatgagtttcgatacctattctatcctctatgtgaagtgtaaggttacatctttcatctcaaaatttatcaaatctaataaacatatcaattgattttagttacattttaaatgtttttaactataaactatacaattaatatgcgtggaaaagatgctaaatgatttatcacacacatttacaatgatatgttatagtttttatataatggcaattatggcagtaaagaaaaaaaaagtcactccgcctctcgttgttcccttgcccctccgttgccgacctcttccctgctcttctcccactctgccgctcgcctcctgctctcctgctcctttcccactccgcagctcgccgttccctgggttagggtttgcactttcgattttggtcaaactttcggtagcaccaaaatttacgaatttcggtacttctggatcgaaattatttgaaactttaacaaactttaactgagtttaaataaattttgattgaatataaaaaaaagagaattttcaaaaattttggatgagagaatgatttgacggtgggtcctagatttcaaactgaaataatataatcacttccccgggtccctaccagggtgtaccttaccgccggtaaccgcgcggttaccgcgggggtacggtaatataaataccgcggtaacctccttaaattcaaataaattttaaaaataatttgaatttttgataaattttgtacggtttttcacggttaccgcggttacatgtattagtttaactacagtaaccgtgcttaccgttgggacgtgataaacccggccccgacggtttgaaaaacctggtccctatcctcttctccatccgtgcagctccccgacaccttgaccccccagctgctagagctcctctatggatctatccccactgtttgtgactggattcatcatcggttgggccgttcgtttgtcacatgggcttcgtagttgggtaagccccgagcaaacctactcggcccgattcacccccgacggcccaccaaactagccgaaccactcgcctagtctcgtgccccggtgttcctcgcccacactcccaacgcataaccaaccctagctctcgcaaagcaccgccaccctcgccgcccccaaccgcttgccggcggagttcgccgccgcgccgcccctcggcggtgctccctaccccgcccgcctgaccgcccgcctgtccgtcgcccctccccgcctcgccatcgccggcgccccacccaccgctactcgcgcgaacgcaccgtctcgactagccgacgccgccttgggatcgcccccgcccacctccagatacgcggcccggccgcggagccgtgcttacgtccgctaccacccggcgccgatctccacgacgccccgctcacgaggtagggttttggagtgggaacgacgacgatcgcgttccccctcgcacgccgcctgatttgagctgccccacgcgttcgttcggtcctttctcaggtactcagatcaaaccctaacccgatgcttcgcttgtccgagaggatctgtgcaagtgtgtaatcctggattgatgtgatgatagattaatggtttccctctgcatgtgtttgttgtgtgtatgattgtaacagatctgttgtgttgcccatatcattgttgatacatctcgtgccgagtccatttcaagttcacttcttgtatgtgttgggtataatgctttggtttgtcatgtggcagtctatgcagtgttattagtgcatcactccgtatgtatggacttcaatggatatagtcagccatgaaagattcccttaatatgttgtttccgctcatctttgtaatgtttttggctaaccttgcaatttggcggaatatagttagcaaggtcttttcagatttaataatatagtctggtactggttctatttactctgtacgtcgttccagctcatattattaacgtagtcgaatatattctgtctccatttcccgccaaaattctagttggaacggtttaattccagctttgataataatgtctgttactactgctacgtcgattccgtcaacttgtcgtttctaccttgattacgtggcataattttatctgaaatgattggcttggaaacttcgcatctaataacatctcttattgacacgtgtgacatgttggttcccattgtatataccatttctgctcagctcagcaacgatgttggccaattttgttaatatgattacctgccatatttgtttggctgtgtctgattgatgcacatgttgtatatggacctgctttaacgtaatagtgcattatggtttagtattactattaaaagggatgttcattagcagtttttatcctctttggtggacgtaatacctgctgcacttgaccaaaaaatatgttgctgacatgtgaactctacttatcacactttatgtggctgttaatcaggcaatggatagtgcttttgtctcttgtcgggttaagattcctaatatttgcttctgtaacttttctgactgaataaatttgtttgattgttcctgcccatgttatatgatttattgattgattggtacaaattttgtgattattctcaaaaaccaattcttgcattgtcactgcatatttgtttcttttcttcattttatacgctatatcatgcatgttagagtgaatgccatgcatgataatttctggttttattgcaaatactatgaaaattgaaaagctcacacctgcttccttttatcacctattggatttgcaggcatcaaaaccctgatttgataacattaagtggaattttgacgatgggtttcgataatgagtgtgttctgaatattcaaactcttcctggtgaatatttctgtcctgtttgtcggacgctcatatgtcccaacgaagctctgcaaactcagtgcacacatctctactgcaaaccctgcttggcttacatagtggcaacaacacaagcctgcccttatgatggctatttggttacagaagctgattccaaggtactgctatcttcttaagggaatgctttgtgcatattcagttcatcaagtatatttggtggtagtgatccctttatttacaacctgatttgcaatatgcagcctctgatggaatcaaataaaccccttgctgagacaattggtaaagttacagtccactgtcagtatcacaagagtggttgtcaatggcatggtaatctgtctgactgcatcacacatggtactacttgtgcctatgggaactctcctgtagtttgtaaccgttgcagtactcagattgtacaccgtcaagtgcaagaacatgctcaactctgtccagtatgtccatctccatcattccttattactccctcgatatgtattagcatcatttccctattcactaatgttttttccctttgcatgttattgcagggtttgcaacctcaggcgcaagcacaacacactgacagtagtatgatgcagtcatcagcaacaggaacccaggcagccgtgcaaggtccttctgcagtggcctcagcagtccctatgacgcctgttacagcagctcctacaacagtaccatccacaactacagccagagctggaacagattctgctatcgcagttgcttcagctggttcaaccactgtaagcaccgtggctgtggctccttcacttccggtggcacctactgctgctagtcaaggtcaagcacttgctcctcaaactccaacagctgagcaataccagcagcagctccagtaccagcagtactaccagcaacattaccctggatataacccctacatgcagcagtatcaacagtatggtcagtaccaacagtacacacaacctcagacgcaaattgcaccccagaatgtggctcaagctcctgcgcaatctgctccatatgctcagcctcaagttctacagcccaatcagccccaacacatggtgccattccaacctcagaatcagccccaccttacacaactccaagcaccagcagctcagtcacagtctcagcagcatccaccattgcagttgaagctcaaactcaaattgtacaagcacaaccacaaagccaagtatttttccaacagcttcaaccccatgcacaacctacaacccatacaccagtccttacacaacttggtagccaaccatttgcaatgcttcttactcaagccccaccatttgaagttcagccccatgttcaacctcatattccacagcaccatcaggttatggctcagcaacaacagccccaactgcagcatttacctcagcagcaacatccaaatgcacagcagcaatcttatccacaaatgcaggcatatcatcagcctcttccaatgtctcatgcacaacctcagaatccttcagttcatgcagtaacaggtcatcaatcattttcacagcctcagccagcacatcagatgcaacaaggtgctccactgcaacgttccctacatgtatctcagcagcaaatgcctagtgctcagcatcatgcacttgcacatactccacagggccaacaaccaactatgatggctcaagggattcagcagacaccacaacatcagcatgttgggcatcatgccctgcggccagaaatatatgctagcattcctccacaggcagcaccacaaggattccctctaaacgcacctgctccctcacaaacaggtcaatcataccaacaaggaatgccctcatcacaacaactgatgcatgcacctcccaatcccaaggccaacaatttatgcaacagcaccctactcatacttctgctggtcggtctatgaattatgttgcaccacaagagcagttccaaaatcaatctggtggtccagttaaaggtttacaggcaggtgtgatgaatcaacaaccaccaatgcgtatggcctctgataatgtaggagcaacatctgaattgcatggtgctggacaatcttttgggcagggctcttcgtctttaaaaaaacctacttcggaatctgagaaatcagaaaatgcaactaatggtactggtaatacagaagtaagtgggaaaaatggaagtgctgaatcagctcttgtaaatcctatttcattggatgggtcagatggttcagacaaggggaaggggaaaggaaaagttgacttttcagcttgggaaagtaattcacatgatccagatgctcggggaggcaaagggactaggtctggtatatcaaatgatcttgtgaaaggtggatcattacagcaggcaccacaacatccttatggacctgattcaatgcttcctcaacatatgcgtcagcctgggcatatgccgtatatgcaggggctgccaaatcaaatgaggccacctaaacattcctttcctgaaaatagtcggcctccaatgcaacaaccatttgaaatggcacctagggtgcctggtccaaaccaaaatcagatgcaaatttcacagtccatcagacctgatggtgctatagttcggccaccgatgggggcaccaatgcctgggctgcatgattcaacagttcctccttttgctcctgaatatgttggtcagcctcatcctcttggtaattctctgtaacaaatctaatatgtatgtatgtgtttgcaagcatatgaccaaacttccatttattcaggaactaaaaagaacaatagtgttggcaatggaccacatggaggctcaagggctttatttgaaggtggattcaattcttcacagaaacattccaagtcatgtgcagcaaatcctggcagaaacaacgttagccacaaagattttgaagataatatgaagcagtttccagtgcctactcaccttgacggtgaaggtcatcaaaggggtcctagaccttttgaaggaggttaggtagacctgatggttttgctgatatattacctggaaggcctccattgacaaatcatcctggtccatttcctataggcttcggagaagattacccaaggaaacccaattcgactgttagttatcctgactttatttcgcctggtgcagaatttggtcatcgtggtattgatggaatacctactcttagaaatgcaggtaaggatcagaatcaccttcatccttttcatcatatttcataaatggcgaaaagtttagtacaccttgatccttttcatcatatttcagtgactaatggattaaaatgaaatttaggtccatttcttcaagggatgacaggcgggcctggaggtttgcataaagatcagctaggctctagtaactttcctgggagtggacaccatgattttgacaactcagagttccctcgtactcgattccatcctggtgatgcttttgtgccaagaaatctgcacggtggtggttggggtggtggccaattgcatggcattgagccttctgactatggctacagaggtcacatgcatgcagatgatccaaatattccaattgattattctcggcatggttttccaaaagaatctgcccactttggttcggtgggttattggtgtttctttctataatatgctttatctcttcccatatgatattgctgttacctgatgttctgtttacccgctgaactcttgtttggtggtcttctctatagggtggacacttgagagatggagatgtcagttggtgccgtatatgcaatattagctgtggtacagtagagaacctgaatatacatgtagagaccagggaacaccatcaacatgcaatggacattgttctgaaaatgaagcaagatgttgcaaaggggagaaagaagtgagtatactagttttaattctaacatacttggttaagcattgcccatctgtggttttaaactctccacttcagttccttcaggaattctggtggtcccaagtcattcaagaaaaaagtacctgggaagggtagctttcgtggaaataggcgttagaactcctgttatcttgttccttggagacaggtgtcggaaggtatgctttggtgctttattatttaccataagtgcaaccatttcttcctaggcttcagttggttacctaattttcttttgccaggttgctggtaatgcttctggaactatctgagaccattgaaattgggtcttgtccatacattttggttaaggtagtgctgcatgtttggaatagaattaccatgttctcctgtccatacatgtttggaactatctgtacttatgttgccgttttaccatgttgacgttttaccatgttgtcatgtggactttacctgcttttgtggagttcgttgctcctatattggatgctcaactcacaactctgaggatgcttatcttggacctgcaatactttaattttgtacacctggatatctgataatgcacaatgcatgactcccatgtttatccgctaggctcagatggattatgggttctgttatactgtataacggccctacagggtcaaaagagataagtttcaccaaaaggatccatagctatttttctcatgcgaatagaaagaaactatacaactagctatgaaaccctgcaatcacaattttttttctatgcaagagactagtggaagtctctcttgggggccacttgcagtgcctgaaatggttaacattgaatcccaggacatacatttgcttttttactctcacaatgttttctgtgaaagaatatttaattaaaccctatgatcctagcccttcatattttgaatgtgtgatgattggcatttcctgcaatccatagttgtgatcaggtataagaaattggtggcaacataaactgttgttaactaactgcctcttccatacgttcatttggtttcagagattaatttcattctacttcgtgaacatttttgttcccaatttatgaataataatttttagtgccaattgggttaaactgagctcattcaaaatttaagattaaatgaccagtactggagacaacctactattttaattttctcatgacctgtttttcattctggagtttatagatatttaaggttctgctgccttgacagcttgaaaggaattacttgtaggagaatatgcgaacttacatttttttttaaccatagcatgtcacataatgttgagttgtcttgtacttaatggtttgactaaataatactgcaatgattgcctatgagggcatcccaactctaaaatgtccaaagggaggtagaaggcagaaaaacaagctatcatttggtaggaacatggatcctagatattagcatgccaacatgtagtaagagtggcatgttagtgtagtgcaattgaaaggggcaaaatttgccctaggacattcccatgggacactccgaaacatgcctttccgtaggaaacttcggttttgtggcaatttgttaaatcatgctattccttttcttttttttcttgttttttttttatctttgagtgaaaatattaaagttcactaaggacactttgaacccatccccaaattgcacgcttgacccggctaaattttcatcccaaattgtggaaatgaaaacatttcaggggattaggcgccgtttggttcaggtattgtacagattattgtcgtggattgtcgatttgattatagggataaattaaatattttaagaaataaatttaataaatagcttaaacaagtggtctaagcaatgcagtagtaggaatttttttagaaaacgtatttttggaaatgtgggcgaaataatccatttcaataatctggtgaataagctgaaaagaaaagagcctaattgaatgaaaaattttagaagtactaaaaaatttctgacgaaaaaaactgaacaaaatttggccgaatttaaacatgttgtgctgattccaaaacaaattgtgtaaatcaaaaacatttcagaggcctgtataatggatcttcccccgcaaaagttttagcaaaatttggctgaattcatacttatttcgtaattaagaaatgtgtgttttttttaggaagcatatcctacctggtggccaaaagaccaaaaatttcggaaatgtcagtttaaattatagaacccgaacttataacttggcatgggggtagaacgccatttccaaaattttgtcatcagttaagccagaaatcttgaaataatgccatcagtgttttagcaaagacacattttttgagtgccttaaattccaccaaactatgatgtcatatagaaaattttgccgaaagtaattacactaacaaactctgtgcaccgctggaatgaaagcacattctaagaaaaggagcaaataataaggtgtaaattggttctgagatggaccattgtgcatgagctatcgatgccaattaaggacttgtaattttttttcattagttcttgcagacagtggttcttggtttgattatcataggtattgccgtattggtgtggcattcaaacccaatgaagaacatttacattctgttgatataatattttcagttttaattttaaatttaacacagttcgatatgacttaatccgattatgtttgatgtgatgatttgtttccttggcaatagccttctcttgtgtttttccccaaagtgatcattaaatcatttgtttcttttgttgttttatttgctaaagcagaaattgacaagtttaggaaaaatccctgagggggctcaactgtcgttcttgcatgctttcctgaaggcggtaaggatagatgcacacttagctttttctatgttgtgatttaacttagccacagatctttggccaaaatatataagctgattatgctaaccctttgtcagtatgttgaactagacctgtagagactaatttcatatgtcctagactgtttccatattggatcttttatgattgatatgacatttagtttctttgtaaataaaaactggttggactagctgatcacatatagaaattgatttagtacaatgttacaaggcctatagatgtcaaggacattttctgacatttcaactgtatggtaacctggagaatcaccattctcttctaatgcaacatgggatcataattagtatccaccatttagttaggggaaccttgaaaatatcctaatgatgcaaaaggtgtagctaacaataccctcaccatggaatatgtcgtggctttgggctggaaaatggttccacgacaattatgactagcatctaaggaagcatgggaaatatactaactcactgaagtaggagtagttgtgaagttaagtgctaggcacaaaaggccaaatttgaataattaagttgcttggtgttgggattgaacctatgtagaatatcttttgaccttcatgtgaattcaactttatcttatttattgggctcaatgaccacacgtttatctgcattgacatgtttgctagtatttttgggatttaagttccttcctgcctagggattaagatgcagctgagatatatttgctcagtagatacgcacatcatgtgtctccattttttgctgtctctacaatatgccaagattctaggcttcaagccactttagttataagttttctaggcttccctgtccctctccgtgcatgcaacactagctgagaaagtggtgattttgattgatacagtggtggttttcaagcaaaatgaactattattagataagttaactgagctctaatttactgtctcttcataacatgaataataggggttttcactagagaggcccaaaaataaacttggctagaagcttctttactatgtaatctgtatcacctccacatgtaatattatttttgcacgtgatgaagctaaaccgcatattcttttcattctgatgggatatgtggttagttgcagcggcacctaaaacatggtctcgcaaagcccttgtggtttaacagtttcatcagttaaatctgtccttagattcgcatgatataaatgaagagtgaaaccatcactgctcactagtctgtcctatcattttttgctgcttttctactgttaaggctcagtttgaatcaaattattgagcggattgttgctgtagattatctgcttgattaaagagataaattaaatattttgataaataaaattaacaaatagcttaaaacaagtgatttaagcaatactgtagaataatgttttttagaaaatatattttatcaaaacttggagcaaataatcagtattgataatatgtaaataatctaaaaagaactaagttagccatgatgttctcaccgtagcaggcagtcatactagcatttattttgctgtgaaggtggccattattactgtcttcttctggcattaccagctgtaattcatgatttgtctttaattcgcactttatatgtttcctttttttttcctatcccatgttttgtgttactgctttggaaagtcttgtagcagctaatgaggcattcatgatggatatgctggaagctaaacaagtagctcaagctccgaccgcatttcaagagctcgagtggcacaggaatgtagacaaaccgtcatactccagcttgctgaatttaattatttcattgtaaaacagtgtagtttcttgcacagtaatgtatcaagcagttgatgactcgatgtatcaacataaatgtaatcatttgttaattttttcctacttaacaaatatcagttggacctgtacattatgctagtataaagaaaaaaaaagaatattatttgtctggtctggtgttgcatttattgccttgacttgatataaagttgtgaactccagcaggccaagcttgtactcttgtactacgtatttccacgtaagacaaaagttctctgttcagtttgtgatattttttggatgtcaccttatgtatagagcaactttgggggaactttggcatggtgctactactgatcgacctatgcttatatcattgtgttgttagcttggttctcgggtgaagaaatagcccaaactaatgtgtactctctaatcacttttcttatttaatttattctgcctgtctgccaaaagaaaaaggtagtaatttctattttccagctaagttttctagtgtgtgtgattatttattttttgttgttgaaagtttaagttaagttctctttcgttggtgatcctgttttctaggaacagagagaccaaatgtcaagccgtcgaggtgcagatggcggcggtcgcagccgtctgccggtgccggagcgggcctcatgggcgacgacgtggctggctgtggctctgttcttggtaattaactatcctcttctctctctcttttttgttcactttgatgttctattggtatctttgggagttcttttttctctcacattcttgatcttttatgttcttacgtcttttatcgatcgactcacgcgtggatcgctgggagtgaatgcatgcatgtgtccgtgcgcgacggacggagtaatgtccagcgcagcgcagcgtgtgatacgccctccgtgcgttgctactattgtaactatccatcactgagctctcgattcttgtcagaagcgctcgaattccttggtctcacgattatagatggccgtaaggctccggcccacggcatgaccatttggcccggcccaagcacaacatggcacgattggtgttgggcccgtgccgacccgactcgatagttgggctgtgcctaggccgatgtcttgcacggtgagccgactcggcatggcacgatcaaagaaaaatagttgagagatccaaaatagacttaattgagccatataaggcacaacccaatgaggagggacgcaaaatagacttattctagccatatatgacagggcctaaagagacgagagaggcagaatatacttattccatgtaaaatcacaatgggctgtcgtgccttcaaaccagcacggcacaaccgcctgggccgttggtgctgcccgtgggcaggcccaacccgatgtgtaggttaggccgtgttggcccgactaacctcggcacgggcctggttatgcctaggtagggcccgaccgggaggcctatttggccatctatagtcatgataaggaaatataacccatgtattacaactcctacttgaagaatgtgtatgggcacagtactaacaacagtgatattgcatttcatttcaaaaaaaaaacaacgatacatgatagtaacagaagtagaagcactgaacagacttctccacatccatttattcatgaatactatactttggctaaattttgtaggagcaacaacaattgcgtctgcttcatggtaatcgatcagtttgtgttctccttgcccatgtagcgacaaggacatatactttgtcgtacagcttgtctggtagttgaaagaaagcaattctccatcttcgcttgaacaacagaacaccaaatgccatccaggtaccagttatgaagccacacccaagtccaagataaaagaaatctatcccatgaccttcttttgttcctccctggtgacgaccttgctttgatgcattatccctcgagcaattgttttggagaggatgcccacaaagtccaatgttgccaatgtacataaatggatttgctgcatacaagctattaagctgtgttcccgatggaattcctcccgtaagattgttgtacgacaagtccaagtaacttaagaacgttagatttgacagagtggctggtatttcccctgagatcttgtttaaccaagctcgttaactgccctatccattttggtagcgtcccagttaactggtttactccgaggtctagttccttcagttgattgggcgagcaattagacgacagattcttaaacatctcagttatgtctccgtataagagagcccagcgaatcttcaggacattcaaactgcatagattgctaaggtccgtggccatgacgcccatgttcttgtcaccatctccattagacgaaagatcaaggaattgtagggatgtcatcatcagtttgtgcggaatttgcccatacaatctatttgaactgaggtcaaggtattgtaggcttgttatgttccaaaaccagctggccgacattggatggtcgaaggagttactggaggcatccagcacctcaaggtttgtgaggttcactggtagcagcagctggtttgcggtagcaagagagcagccagaaagattaaggaccttcagagaagggatcatgttcgaacatgacacgaggccaatccatcactgtcgtaaggttcatgttgttgagactaagatgttgatcaaggtgttccagatgttgtagagcaagtacagaagggcttatctggccaaccaaagctgtgctgctgctgctgccaagtcgaagctcgtgcacgcgtcctgtctggttgctgcaccggacgccacgagtcgaggaggcctgcaggatcgtgcggcaagcagctcgcactcgcactcgcactgttgccaccagcagcggctcgcaacacggacatggcagctgggtgatgcatgctcgaggatgtgcctagctcagttcttccactgcccgtcgcctgttattattatagcgttactacgtgatgtcccacgattagtgcgggatacatggtagatacgatgaaatgatttagattaaaatattatcaaaatgatgataatttagcatgtgtatgtttagttttagaatgaaataaattgtagatataattactactttcttcgtaaataaaaacctaactagatatgacatattttagtacaacaaatttagactgatatatgaccaggttcgtaggactagaatgtgtcacatcaagtactagattaattttttatgggatggagggagtatatgcttgcatgttgatgagcttcgtgtgtttaatttgttgatgtggcatacttgcatgtaagatttaagagtgctattcaatactatgcttatatgttgagctttagatatttagtgggtaatagttttatagaaagaatggattagacaactagtactcttgacagcagcatcacttaattaggctgagttcgcttgcgctagatgggaaccaatctcctacgcacggaaaatggagtggtctattagcacatgattaattaagtataagatattttttttaaaaaataggtcaatatgattttttaagcaactttcgtatagaaactttttgcaaaaaaatatatcgtttagtgctttgaaaagtgtacgcatggaagacgagggaggagagatgggaatttgctgtgccgaacacagcctagtgtgtctcagcgtcaacgggtcgagtcgtcgctcaagcgttcggcgttgaagccgtcagcgcctcagcagtcagtcgtgagcgcgttcaacgattatttcctgtcacgatgtccatgtactgtactggtgccctgatgcctgggcaacttggagtacgtcctgtgcatggaaccggccggatccactaacgtgaactgctcccttacgtgaaattttttacgcaaaaaacacgcgcttcgcgattgcgggggttggacccgtgacccaggcctcacgcgttcctcccttcaccacactcatataaggccagtcacaatgggggtttcactagtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggcctaagactctcgtatttatttacaatattcgtcctcctcattttatcttcatccggtattcaaatgggtatttgagacccaaaatgaattcaaatgaaaaagttattaaccataaagttttatagctttttgagatctacaacattagttttggtcaaatctccatccgaggtcctttgaagaatttgaatttcaaatgtaagaaatttaagcataatttttggagcctaaataatttgaaatgaaaaattagtcaactacaaatttgtagatctttaaaaagaagatctacaaaagataaaagcagctggtgcacccttgagcagcatgatttttgcattctaatacttactccctccgtcccataatataagggattttgagtttttgcttgtaacatttgaccactcgtcttattcaaaattttttaaaattattatttattttatttgtgacttaatttattatctacagtattttaagcacaactttttatttttaatatttgcaaaaaaaaattgaataagacgagtggttaaacgttgtaagcaaaaacttaaaatctcttatatcgtgggacagatggagtataatatatgaaagtattgaacatcccacgttcaacaattccattgtcgtctagtccggttaggatacctggctttcacccaggcgacccgggttcaaatcccggcaatggaactttttctgatttcgttttcttttttcgttgtttgcagcaagataaacacatgtttgcgtcttggggtgttagtgctatagcattgctgcaattcctcatgatcttttctctaatcctaggctgctgatcacgattggaattgttcagttagcttctcttctctttctgggaagcagcagtgctattcgattcagattattttgtgatccaaatttggtccttcaagatggaacggtgtactgtgatgcaaatgctcgttgctcgaacttcactgctatctaggtgtcctatataaaatctggatgctcctaaaccatttgcatttgaaagaatgaacgtaaaacactgtatcatatcatcactcgtactgttagctcctttctcacttcaaaacaaccaaatcctcgaacttcaaaccaatcggagaattgaaacttccaagcgtctagactatgtcaaaaacaatcggagaacacacggaatgcttactcttttgaggttttaataacaccagatgaggaacgcggcagagttccacattcctggtaacttaggcttagaaacaaagaaataaaccatgcgaggtgcatttggggttgctatttggcgcgcgcgcgcacgcgttttcgttttcttttgccatctttttcgcgttttcttttttttttctgccatcttttttgttttttcctttttttttcacgtcccctcccctagcatgttttacctttttttcgcttttttttttctgatttctttaatagttaacacacatgttttcaaaatatattgagttaaaagttttcaaattttaacttaaaagttttccaatctgaagaaagtttcaaatctagagttgtaaattttcaaattttgagttgaaagttttaaaatctgaattgaaatttttcaaatctgagttgaaaatttcaaatctcgagttgaaagttttcaaattttaaattgaaagttttaaaatttgagttgagagatttcaaagattgagttcaaagttttaaattttgactgttcaaatttcaaattttaaagtttaaatcttgagtcgaaagttttcaaatttaatatgaaagttcaaatttcaagttgagtttagagtttcaaattttgagttgaaagttataaattttatgtattgcttttaatttttcaatagaaagttttaaattttaaactttcacgtatagatttcttttcaatctgttagttaaaaaaacaaccgggaaaaaggaaaatcttatctaattactatcattatctaaaactaatacggttagttatactaacttctcccgaaaaaatgtgcgccgccaatccacgctcgccaactagcttttccataaattcttacatgtatgaaaaaaaccaccacaacattgatgggttcacatcgtctgccgttcaggctgacggcaaacattgccgttgccttcatccctgccacacatccttctatcaacagttgcatgcagtggtcccaccattgtgattaattagggactactaattagcagaatcacttatttctcttcaaaaaaaaaaatcagcaaatagaatctcggcggtaaagcgcgcgagaacaaaagtagagcagagggaagctcctgctttttggcgccaagaatatggatcgacaccaaatgtctattcatccagaaacagaagaaccaaaacaacaaaatcctgtattgatggagcagccaaacgatcctacaggctacaggaagtaggaaaagcatgaacaaggaaatccttcatctatgaagcagccaaatgattctgccgtcgcatcgaacgagtaagcgatacaggcaaatttctctttgtttgatctctcctacagtgtcttctacttttatcttatcaagcctaaaatttcgtttgtttttaatctacacctatacacttctccgtggcgttgttcaaatttgatctattttactaacttcttctataacgtgatttatcaaagttcttgttgatattattcagttaaacgaatacaacaaacatctttttttcagagctgcacctagttgggttcctcagattggcatggcattcagtgatacagaggaggcatggaatttttgggtcacgtatggaggtcggatgggctttgatgttagaaagaagtatcacaataaaaatcaagtaacacagaaaactacatcagctagatttgtttgctccaaacaaggttttcgaggcaaggataaaagagataatttgactaagcatcctcgagctgagacgagaattggatgcaacgtccgcatggggcttacactcaatcgagtaaacgaaaagtatgagatatctgatctggaagtcatgcacaatcacatactgcaaacgccagaaacttctcacttaatgccatctcagcgcaaaataactgaagtgcaagcctttgaaattgaaatggcagatgacactagtattcagcccagaatcgctcatgagttggctgcccgacatgttggtgggtcatctaatcttggctacacttgtcttgatcagcaaaattatttgcgaactaaacgtcaaaaggagttgaaatatggtgaggctgggagcttgttgaattattttaagaataaggccatagataatccttcatttcattatgctgtgaaattggatagtgaggaacaaataacaaatatcttttgggcagagatgattatagattatgctcactttggtgatgttgttaccttcgatacaacctttgggacaaataaagaaagctggccatttggtgtatttgttggatttaaccactttagagaaactgtagtttttggtgctgctctcatgtatgatgagacttgtgactcattctgttggctttttgacgcctttttgtcatgccacaatcacaagcatccacaaactatttataccgatcaggatgttgctatgggaaaggctatcacagaggtatttacagaaactcggcatggcttatgcacttttcacataatgcaaaatgcaaacaaacatataaatcgtcagaagactagtgatggctctaatgtccttgctgattttagtgcttgcatgtgtgaacatgaggatgtggaaaaatttgaggaagtctttgctgatatgaggacaaaagttcgcaaagggacatggttggatagtgtttataagttgaaagagaagtgggctgaatgctttatgaagaatgcatacacattaggaatgcgaagcactcaattgagcgagggactgaacagtgatttgaaggagtatttaaattgtgaattaaacattgtacgctttttccaccactttgacagagttgtacaagggaagcgagataaagagatcaaatcagagtatgaatccaggaaaaaattgccacgcatcttaatgagaattcctatgctattgcaaacaagtaagctctacaccccgcagattttttaggcctttcagaaagaatatgaaagatcgatgacagcttatacaaaagtattggatgagggcagggcatatattgttgggataagatctctagatgatgattgtacaattgaagaagagtatatggttgttggaaatcatcaagagagtatggtgtcatgtgattgtcgacagtttgagagggtaggaatactttgcagccatgcattgaagattcttgatgtgatgaatattaagcaattaccagatcattatgttctcaagagatggacacgagaggcgcgtcatggggttgtccatgatatatctggaagacatgtcctagaaaatcctaaactagacgcttcacgttgatataagtttctttcacacaaatttatcagtttggcgtctcaggctgcagattttgaagagtgctttgcgtttgttgataatgctcttgaaacccttggacagcaagtggaacaaatggtagaagtgaatacaaatattcagtcgaatttagagacagagtttgagatacctgaaaatgtctcccaagctattggcctaaagaaaaaagagacccggtgtagcacatcgaagcgaaagaagaattgggttgacaagctacataaaaaaagaaagaaaagcctaaggtatgtatgtatgctaaaaagaaaaaataaatgaaattaaacgttcattagttattctgttgtaaatcacaatttaggtaaccacggtccactgacaggctaagaatgggaatgaagtagcacatcctgagccattagaagaggacatattggagaatagtacaaaagaatctcaccaggattttgaatttttgggtagctatacccagctactggcggtatgctaaccctgacttttgttttttaagatttgataaattccaattttttaacttatatcagtttataaatttgcagggtgattcagatggatatgagttatattctgaaggatttcatcagtagcttcatttcactgctagtttttgaatgaaaaatactctatatgggacatagtagtagtgcggcaatgctgtttttgtcaaatgaatacttaaatattttataagacatgtactattgttcaagtatttggatagcttcttagtacagaagcttgttttgctgtagtattttgctctgttgtactatgctctgcttctgttctgtcagtcgatccatattcttggcgccaaaaagcaagagcttccctctgctctgcttttgttctcgcgcactttaccgccgagattctatttgctgatttttttttggaagagaaataagtgattcttcttattagtagtccctaattaatcacaatggtgggaccactgcatgcaactgttgatagaaggatgtgtggcatggatgaaggcaacggcaatgtttgccgtcagcctgaacggcagacgatgtgaaccctattctgacctggtgttctgtagggctctaatcgcaataattttttgggctaaatatcttgaaatttatttattttccagctagagccccgagtggattgtttcagtgaggaaacataaatgtttgaaccactttaatttggactataaactataatattcagcaataatttatggtccaaagccatataaaaatagggttaatcacacttaattattttgcccacaaaagcaacacggcaaagttgtttttactcccctgccacaaaatgaatcaacttctggccggctacaaacctggacgacaggagatgatcacgaagggagtataacctacatggcggaattactagtataattgcatagataaactactgcatagctaaaatagctaatttgttaactaatcaaatatgtcaatgggcactgggacgatggcgggtgacaacaccataacaaagcttttggaaatgtgccaagtacttagagcatggtccatggaggttggaggccacatgatcgtagtggtctcatgtgggctatatgggctgaaaccaaatataggccacaccttccacaatggaggtcacactaggggtgaaaatggtaatggtaatttctagccgattgacgttcgtttctgactttctaccggccgagccatatgaaaatagtaatagaccaaaacgaaaatgaaaatggtgaaaaatatggaaacgaaaacggaaatggttttgctgttataccgattgtttatgtatttaccgtattcttgtagaaattacagtttcttataatatggtaattaccgtatttctaaatatgctgatatttttagggcatgtctctacttgacccacaatttagagattgattgactcttccattaaatccctaacttgagtgcatggctaaaatggagttaacttataatttatatagtataattgtataagcttgaatttatttatacatataacatacttatgtaaagttaaatatacgtttttatagtttaatgttttcgtatttgttaccggtttccgatctgtaccgacatgtttccgtccatattgttccatttccggttttccgatatcgttttcgtttccgactttaccgttttcgattttgtttccaagaaaaatatggttatggaaatggttgagattgtttttcgatcgtttccgaccgtttttattgtaagccacccccaactgtttttgtattttgattcctgggtacttgtatgtcaacccttgaaatatttattattatcaaatccgatgaaacttttatgttttgggcccctatggccacccaaaaaaaaatattcatgtactttacctcctaatgacccacttgtcaaccactccactaatatttttccatccaccccatcccccatttctctcacgaattcgcctctctcccacactaaacgcgatgcggcatctcttccccatctgagcaccatctcatttttttcttcccctatccgagagttcccagcctctcccctctccccacctatgcttctcccatcttccttttcccggccatcgcgctcgcaagccttcccaccctatcgaccagattgaggtggcgggcctcctttcctccccttttcgtcgggagaccgtgccaaggcggcaggaggacgagctcccaatgacggcgcgaccaacaagctccttgcagcaggcatagatcaggtggcgagctccgggcggatttgcttacagtggcgccctcactctcctctcctgctctggcgtggtcgtcgaggtcaacatcggttgatggtggtggtagctaacgatgacgaggcacactctctctcccactttctctttggatggctgctaactagaccacaattttcctccttttctcctcaaaccactatggctcctgcaggtaactctgacacaaatgtagcccctcccaaacctccaccatggcattcgagccaagttataggctagaaccacaggcttgagactacgcgttgggcatggccttataacaaggctagtttgtttgagcatttagctcatgaagtcatgataggtgttagtttaacgtactagggtcaacaagttcaggttggtggggtcaccaccaacgatatgctgaggaacacatcggtttagtcggacatcgtaatcttacctggtgtcgttggtgtcattaacttcggtgaaacaatagtagatccaccggtggagtacccatagagatattaatacttttgtatagtactagttgagtctgattaggtctgcatgatcctggtggagttggtgtcatattccttatcaattcaggataatatcctcatttgggtaatcctcttattgcgtttagtcccacatcggtgattaatgatgggggagtacgacttaaaaggtgagggcagtcctcacccatcaaactagtcttttgggttgtgtagacgtaggacctaaagttgtggctccggttgggcttgtggtagagtagggccaatgtgacctgggtagccatgattggtgggccgggctgcgcagtaacaagtggtattagagcctagactagtcttttgggttgtgtagaccaaggatctaaagttgaggctccgattgggcatatggtggagcaggcccaatgagacctctcttaaagattgggcatgtgttggagcaggcccaatgtgagactacaatgtagcgttgacacgcagagagatgatggcggagaagccatggactcgtagcggctagaaaatatattgattgggaaggagcgcccataatcaaagccccggagatgtaggcttcgtttgaacttcgttaacaaatattgtgtgttcatgtgccgtcatctggcatgtcttaggtgatcaatgactgaagtgatcgagagagttagctgtcgtttcgctatatcaactaacttttgtaacaccttctagtagaactatatgtattctatatgagtatttggcattttccaccattgtgtgggtatgccatattttatatactgacagtggcccccgagtgctgatcaaacgaggagcaatcacactatgtgttgggacctctgctgggaatagttccgaccaggtagagattggtagtggttggctggcttgcctatcatgatttggttggttcagggtgagattgatagtggttggccgggttgcctatcagccgggttggcatctaacccatcgtatccttaaaaagttattttcacgcgtgcgttgtttgtagtttgaataggattggaaaatacgaaccgttcactggacaatttcagtggacacatggtggagaaatcaggtatagtggactctggaaaacaatcatatcacttgaaaacaaccaaatccgtacatttctatacaatcaaattaaggaaaccttgaagagtcttagaaacaggggacacaattaaaactagctagctagctaatattgttttaatagcatatgcatgtgtgtataagttcttacatgcgtggaaaaaaccattgtaccattgatgaaaatctgtgttgccctagggtacttaagctaattttgctggtcctgaagtcatacacaccatacatgggaatcccttccttttgctgatacacatagctgttggtaattctggtatggatatcaccccactgcctggtcaaatcacctcccaaaaagaagatgcaatttcctccgaatctcgggtcgccgtgatcaaaagagaggatcgccttggagcaagcttctgaggaagacgacctgaccatccaagcttttcacctctaaccactggccaccctccaaatccgcctcaaacaccttgaacttgatttcataatcgtccacatttgctgaagtgcccaacatgggagaaatagtacacctgaacatcaacagagtgccactgcatgaaataacaaggtacttgcatgaaataacacggtactggtgtactatgtcatcgatgctatattgccattgaagatgcgacaatggaggctctgctgcggcgcccctaatcacaagctcagcacgagacaatgtgttgttatctctgatctcatggacaagaagatccccgttgctagtaagggcgtagagcttgccgcggtacaaggcgatgtcctcgtacattctcttgtgatcaccatcatcatcatcatatggaagaactgaccatgatgtgtcaatgcccggcctgaaagagacgatgttgttatcgataaggcgggaggcggcgacgatgaggtccggcgagcacacgatgatcttgtgcaaggtgaacctctcgggccacgtgctgtaacggttgtcaacgacgaaggcgttgatgggccgatcaaagcggcaggggatgtcgatggtcgcgttggagaaggagttcttgaggaagtgacgattatcgcatgccatgatgcaaggcttgaacacgtccatgtgcatcagccacccgtcgttgtgggaagagatgcaccagagcgcgtcgttagacatggggatccggcacgccacgccgtcgtcggcaaggctatggtgggtgcgcgggtgcgtcagggtgagcagcaatgttttaaatagcgggctaaggcatttagcggttagcttctcaaatagttatagcggcagttatagcgggctaaatagaactatagcggctaaattgtacatgagagcaaatagctagaacccttctcaaacagttatagcgggagatagcggcagtttagcgggagatttaaaaacctggtgagcagacatggcagcgctggcggcagcagctggcgctgctggagcgcgccgaggcgccactggctgcagacggcggcgaagctgaggcggtcgtggtggaacggcagcgaggagacgatctggccggcgaggtccgccgggaggtccgaccagcctggcggtggctccagctgcagcggcggcggcgaactgctgcttccgctgaaacagagccccatggtggcacgagaggaagacgcggctaattaacacaagggaaaggagatgaaaaattgaaacctagctttgggcttaatttatcttgatagctagaaaaggtgatcttaattaaagatgaaagacaaatctgtttcgaactcggttgatgaactcggtcaaaagagaataagaaaaactatggatggacccaacttgtcagccagtataggatggacagtgctgacgcgtcagcgaccgtgtggtgtaccatgtcggattttggaatattaattgtcagtggtgcatttaggagtataaagttgtatctttttaagtttattgacccagatgaaatctatgtactttaaggatggcctatgtaatttactttaaaaaatattattagatgtttgagtctaaaacattttcatttaaaaaaaacaaatgtgcatcaccactacaactagtaagcttagatatatgagattttttactgtccagcaggtttgagcggtaccaaatgctagccgtcagatggaccagatccaacggttgaaattgatcggtaccaccaggtaccgctttagtcacttaggtggtaccgcaccggtggaagggtaaggtggtcttttcgcatagaaaattttgggaagtcgattagagcagcgtctttcctcccccagatggctagatgcgtgctgttgtcgccaccgctgtgtgaccttggtcgccgtcgccgccgtggtgtcatccccatctgcagatgagacagaccaagactagaacacctggggtcgtcgtcaatggagcagcccagcactcactctctgggtgatatgccccaaagcgggaggtggagggccgtgcccatgttggcgatggcgaggtcaagctccgtcgaggtggtttccagcttgcaccgcggaggactcctcggcgacggccgccgtctcgtgccatcttccgaagcacagggattgcgcagagatttgcaaatggcaacataatcttcaggaataccatcttagtactgtacctttgtatatgtatttgtatatctgttaatctactaccattagtaagagactctgaatcaatcctcactgtgcattcatcaaattgtcactgtgtgttctccgtccaggcggggtctggcttgtcccactaccacggccggacgacggagcggaagagcgcccctgcatgtctagaagtagttgttgccatacgcgacacagccggcgtgctgcagcgcgtcgacaccggcgggaagcctgcgttggtacttgtgcaaccacgcaggtggaactgatggctcagcactacgcacgccgtgaacaggccggcgaaacaggtgtgccgcgacagcatcgacgggagggaatgaatcggcggcggccgcccgtggaatattttgcggtgggcaggagaagcgttggggggattgtggcgcctgcgagaggatgggtggcatggagtccaggatgattcccatcgtgcccttggaaattggacggttagattcaatctggtaccaccaggtactagtaccttgaggtacaatttgctggaccagagcaaatctctagatgtatatattggctcctttcacttcaagtcaaccaaatccttacacaatcttgtaaacaatcaaagagcctctcccagcgccagcagagtcttatggaagacaaaccaagccagctaatttttactaatatatagcatgtgagtataaatccttacatgcctggaaaaaaccagcatacctttgaatgcttatattcccttcctaggtaaatcaaactagtcgcgttggtgctcaagtcatacactccatacataggaatgccttcgttttccttatacataccgctagtaatactggcctgttgtatgtgatgtcaccgccaggtgatatcctctcccaaaaagaagatgcaattccctgcgaatctcgggtcgccattacccggcgagcgaggaatggccttggagcaagctttgctgaggaagatgatctggccatccaagctgttcacctccaaccactgaccaccctccaaaaatcagcttcaaacaccttgaatttgattgtagttccacccatggaagaactaccgtcaggcgaatatttagttgtgcacctaatcatcagcagcttgccactgcatgaaataacaaggtagcgactctcatcggagctgaaattttgtatccgttccagaagcgtcaatggatggtgatgcactgccctgatcgcatgctcagcacgagatagtactgcatttgcactgacagtgtcaatgtcgtcgtcgttgatgatcccatggacaagaagctcctccttgctagtgagagcgtagagcttgcctcgatacaacgatatgtcctcgtattttctcctcatccacggataatcatcatcgtcgtcatcatcatcatcaccaccggtcgtcgacataacttcatcaccggaaataaccgaccatgaatgatcaattcccggccggaaagcggcgatgcaggtagagtggacgacggcggcgacgacgaggcccggcgagcacacgatgatcttaggcaacgtgtactcggcggggttaatgctatgactgccgtcgttgtcgcccaagaagtagtcgaggctcctgatgcgctgatcgaagcagcgaggtatgtcaatggcggcgcgggagagaggattcctgatcctgtctcggcggccgaagcattggtactccaggagccagccatcatcgtaggaggagaagtaggggatcgcgcggctcgaattcgcgccggggacggggcggagctcgccgtcggggaggctctggtagacgcaggggctacgcaggatgagcagccacggcggcggcggcggcagcgggtgttgccggagcgcgccgaggcgccactggccggcgaggtccgtcgggaggtccgaccagcatggcggtggcggtggccgaggatgcggcggcgacggaaggatggcgacgtccgtcggaaggtccgacgagcctggcggtggtggctgcggccgaggatgcggcggcgatggcggcggactgctacgtgtgtcgatgccgaaacagagacccatggctccacgactgtgggcggcaaacacaaactaaactgattgcaaatttgcccctaataataaagtgtaaagatgaaaaacaaatctgtatcgaacaatcgatgaatccagtttcaaaatcggatattgttaggatgggatgcatggattgccaggagagaacactatctgtctgtataacgtgttacgatccaactcgagtcttaatacggttctatctttggaattctgctaaactaaaactattaaccatgattttggaaaaattttaaatcaactcgactcttataatatagtattatctatgggtatcagaattttggaaatttcgaacctaaattgtaaaccatgattctcactcatcaatcaacacatgtacagtaggatcatctgatggaattactgcagcaagtaatactggaagcactgacaaattgcctgcagttcaattattaccttgacattctagctagatgatgatctcctccatgattaattagttgtaattaccttggaaagaaccacgtcgcactggatcggcgactgatgtgcggtccacccggtgaaattgtcttgcttctcagatcataaacgccacaggttgaatctgctggccattcgtgccgacgctctgcaccatagtcggcgaagtatattttacctgcttccacataacctccatagctcgacgcacgaactgccatggagcagcttgtactaacgaagatcgcctcatcacccaagctctcgatatgaacatcagtccatttgattgcttcgacatgacgaggtagtgtaatctcttgcatctcacggcggcgtaggtgccatccaataagaagctctcgaacaagccgacctgaatgatctgtgtcgcgagatcggaaaccatgggttgtttggtctttctgtgggtggtgatttcatgggcgaagaggtcgcctctcccggcgacggtgtagaccttgccgtcgtggaaggccatgtcgtggtagcccttgccttcccacgggccggccgaccacgacggcgaggttcccggccggcagcacgccaccacgtcgtcggcgttgtcgtgactgtagctgatcctcgcgacgacgaggccgccgccgccgcagacgatcaccttgcggatgtagaagtaggcggtgggggatcccggcgggtgttggcggcggaggcgggccgggtcgccgcagtggcagtggcccgggaggcgcacgacctcgccggtgagagggttcttgaggtagtggcggcggcgagggccgtgccccggccgcctgaagaggagccagccggcggcggtggagccggcgcagatcgtgtgccggttgaggcggctgaagcggcgtcgctcgccgccggggaagctctggagggtaccgtcgtggaagttgagccacgggagagccgggggcagcggaggcggcgccgtcgtcgccgcgtggcaccattggcggcagacggagccgaagcggacgcggtcggcgtgggagggcagacggaggaggaccacgccggctaggtccgtcgggaggtcgaaccagagcggctgccggcttgccggcggccgttggcgtggctttgcttagtccaacgcccatgacgcactagctacctgcccgtatgtatgtaggacgtcacgtccgcacatatatttgggagtttgagacagggtgcggtacgtgtgaataacggttcaaaatttcggactgacatttcgaatctatgttaagatttcggctgtttttttaattttttttcaagcttttatgaatttggcaaaaaaaagttcaaatttgatcaatttttgttaaaaaatttaaattatttcagaccgaacttgtcgaaattttgaaagtttggatcatatcggtacccgatagaaatagtgtaaatgattatttcgtacgaaaatttctatatatataagttgctttaaaatattaaataatttattttttaatttaaaataattaaaacttaattaatcatgcattagacataaacggttttttccttaacaaaactcccgtcgattcaggtttgaaatttcgggcactgttcacttgcatgaaactatgtagtccaggcaaactatgtagtccaaaatatatatatttatttattaacttgcgaattcagtaaagtttattctaatacggtgtaaatctgctcaattttaatttttaattacgaattttacgaattaaacactaattaacttaataccgagaattttatactcaagttagaacaacagggaacatggtgttgcacttgcacttacttcctgttctaccccttaagagcaagtttagtatagcccactactagctctaatttatatatagccaatctaatagccaattcatacaatagttgtttactatactattaatatatggtcccacctgtcatacacacattgcgtcttggagtctgcgttgcagctggctacagatctgtagcccgctgctcttctctctcatattttatctcaataaaatatatttacagcgggctaatagcctgctactgtatctgctctaatggcaaccacagtgtttatttagcaacttggtattaagtagtaagatggattccggtgtgaaacaataatagttattagcatgtttcacaatgtttaatacctgaagtgataagtaaagtggggtccacatggaatgcttccctccatcacatataaaactcaaccctacctacgaatctaaacatacacatatccaggtttatagctagtatttctctttttttttacagagtagtatgtgagaagattattatacatacacgagtaaataatatattttaataacttattgttagtagtaagcatactatccggttataactactaccacataccacaattgtatatactctctccgtcccataaaaaacaaatctatgatcggatgtgagtatgtacgtatcatagtatagtactatgatgtgtcacatctgttttttatggaacggagggagtagcttattacccgctttttctttgcattgtggttgctctaacgaatttagcaacaagtgtaagggtttaactgcaaaaatgtaaaaccaaccccctccccttcccttcctataaccaccccaccgcccccgcctcacctcgccggaatcgcggcctcgttcactctcgcctccacccgcgccgccccccaccctccgatgccggagcgccgccacatcgccggagatccgccgtcctggtgatccccggagcacacccgcccacccaccatggaccgcctcctgctctttcgcccccggaaaccggcctcctcctcctccgtcgccgcggtggcggacggcgacctcctcgagcgcgacgtcctctggcccgcctcctctgccccaggcctcctcgccgcgctccccgacgacgaggggagcaagaagaagaagcgcgcgggccccgccgccgtacggtccgcctcccgacctgtcccggagaccgccccgttgaccccgacggcgggcgcggcgaggtcggcgcccgtgaggataccctcggaggccgcggcggcggcggggaggagggggaggtgggcggcggcgcagtcatccgtcggcggcgaggacggggacgccgccatggtcgtcccgccgcacgaggtcgtcgcgcggcgcgccgcggcgcacagctcggtgctggagggcgccgggaggacgctcaagggccgcgacctccgccgcgtccgcaacgccgtcctgcgccgcaccggattcctcgactgagagggcggaggccagtcgtctcgtcgctctcgggataaaaccaaaaaagttttgaccctttcttcctttgattttgttcccctcagttgtgtgtttccggctatctttgatttcttccccttcgttagaatgggatggaaagaattgaggcgagtttgcgaggtgtacaacccggcgcaataacaaagttattccatcagttatagatggaaattttggtccttacatctgttcaattcagtatttgcttgatttctgttcaattcagtatttgcttgatttatgtttgcttacttttgagtaggtgaaaatttagttatcggtagcttggtgccatggatggaaaatttagttgttggtgagttcagctcacatgctcaaatacttatgtttagctactaataatcacccaaaacggaggctcgtaaggcgcaaattgaagttcttagcaccagagatggcaattgtttggaaaactttggaactgctgaatttggggtaattataagtaggatactgagaatttagttgcctccatgtttgttcataggcattgtgttgttaatcagacgtgccatgttaagtgttacttcctccgtttcatattataagactttctagcattgctcacattcatatatatgttaatgaatctagacatatatgtgtgcctagattcattaacatctatatgaatgtgggcaatgctagaaagtcttataacttgaaatggaggtagtatgttctagctaatggtgtggaatttcatctcgatactgcaatctactatatagttttggctgcattgcagttcggtgtggtggaaccattcagatttgagtgtttgaagtatctatgtgattatctcatatttcctggttctgtccaagagagtataagaatggtaaaagtttttaagaagagatgccaggcgccagctgccatattgtttctggttttcgttttagctgaaactgaggataagttactaattctgaacattgccaatagagaaacctaacagtggtgtttaagatgaacattgtgtttgcttttgttatttttattggcaaatgattgtatcaatgtatagattgtaggcaagttgctcgtaggtcaaacagatctagttgatgtaggaactaggaagaaatgtttatctaggtagttggtaccaagaaaaacacattcatcttaaaagcatagatgttgattccttggaagtcctttacaccattttttggtggtccttcaaattcactacacatctcaatagttatgctttgctgtagatctggaaccactgcacggcgttctagtattttcatggaatcatctgctcttatgtcttgtccaggaccagatataaaggagctgtttgcctattttgaattgcacccactctcatttctttctgtgcagctgattgccttgtcacccctctgttcaggtataaggaccaccaccattccaccgcggtgtagctaatctgctaatgatacctcaagtacacaagttccttggattatccccatcaagaaacagctaatatgtctttgccatcttaacttgtgggataaagttgtttggttcagtcacttcaaaatatgatgccatacaattcagaaagctaatcaaagaaagagtgaataaatatggtccatatagaaactctgaagttaattgaagaaaacagttgatgaatacggccatccacctagctgagaccaaattatatacaaggacattattaatttcaaatttctgaattaatatgataaaaaaatactaaactaagactcccaagatgaataaaacttatatttatcaattcttaatttcagaattatcaaatcatgaacaaactaaaattgaaagtccaagctgagtaaaaattgtacttactaatttgactttctaaaccattaaatcaagcaaattactcagtaactgtcgatatatatttgtaataaagttttatacaagtatttggtatgcaaatgtaatataaatagcccgtgggaatacacatgttaacgatgacctgccagtctgtcactaatgtggcacattatgcatagttttatgtttatggaggcagtagtacaatcatcaaataattgaatcttgaatgcttgatttgtgttgtttcatcactactaagagattgcaagaacatgactagtcgagtagccatttgaacaagagaacatgactgagagattgtgataattgacaccatgaccatcttttgtgaattggcacattttgtctagtgctctagtgatctgtcagattaagagcaatgaagttctcttgttcaaatggctgttctacatatactgtcgtcatggatgcgccccaatgctgcatttatcttttgtatggtttttcttttgtcttttaatgaagtacaatcaacttcagatttacacatccactctcaagttccgtactacatgaagaattttgttcagaagggcaactgaccattaatatggattttggagctttattttacttcaatgtaggttccatccttaagttgtttatagaattgatactgaccttttttgtgttgtctggatgctaaaagtaacactatctttacattaaatcgtttgatatccctttcaggatcaggtccactttcttgcttttatttgattccttcaaattattgggatgtcaatttatttgtcctgagggctgtacattatgagattcaactgctctgaacatgccatatttctttcattatgtactcctgctgaccataaattatttagtgagcatgtgtgatgtctagctcatacttgattgtacccaactcatgttttcagtataaaataaatagcatatgctgccaaatggtgtattcattgaccatctctagatgaccagctgcttactttatttcattgttttggcttcaacatgtattgatccgattgcaataagtgatatagtctgcaatgggcatgcaatatgttgcttcataaccatactgatgtcctattgtagttctggtgagacaaatatacgacgtgtgtacaaattatactcatggtaacccagtctcagcgaagttttgtttatcatcaatgatgtatgtatgtatatatagccacatgatgttcagaagaactactacttgttaatgtaatcacattgatgatgatcagacaatgataatggtagttatgcagcatggatctaaatatagtctggagtgaaagcatcctgaaagaaaatattctgagcacctatctgagatcactgtgctcttgttggccagataagatatactttctgtggtcatgtgatctatgtgtttgtccatacaactgttctgtttctttgtgacattgctggtgcctggtggcatggctttttgctgtggtccagtctccaggctataatagtatgttctgttatgatccagttcacaactttatgatgatgctgcacccctgcaaggaaaacagttttgttgcagtttgccaatgaatatgctgtggtgattcctcctcaactacttcactgggagatgtaacaataaaccctagtactcctgagatgccaagcatccaatgctcacaaggcaataatgcatgcagtacaagagcaagtgaatttacaccagagctgatgcatttcatgtttgaatgccatccatagatcctataaaattgttgtttgaatggagctgaggtccaaagtatgaggttttcttggcaattgctaggtcttctggaaaccagtcatcttttgctttaatcctgggaatttactgaaatttggcttggctactgttacgagtgccttgaaaaaagaagagagaatcccagatggcttgattagattttcaacgtttgaattcacacttcacaaaccctttcctcctcggaagcctgaaaatatgttgaattctagtacacattccactgctaatagtacttgtatgcacggtgcttatgtgatgcgtggtggctgtatgtgtttactgatctgaaaacgtcctgaattcgctgcgtggactatctcaaactttgaagtcagtccttggttgagcaacccacacgtgtacaacaattggacctgactctgaatttctgaaaactttgaatttcaacagccatttccaaggtactagtagcactaggagtacctttttgtggctgcagcctgcatggatcgtaggtgtagaccagaacagcatcaatcacgtagaaaaagcatcattaactatggttaattcggtagcctaaattgcacaccggttttacatggctacagttggtgccctgcttttcttcctgtctagaaatgagatcagatcagacttgttgttagtcagaaagtgtgatctgtcaaaatggcctaaccatctatcagcatggagtctgctccagctcctttgttgaactatatgtgcattagccatagtggagatggaatcatggaattggagtgaacttgtatggactcatgaatcaaacaaaacttggaccatggttgaatggtcagttagaagctgcttgctagaatacagagccatgccatacaactaaatagaagtttcttgctaggctctcttctgtcagatccccaaattcaacagaatgtagaattccagtctccgaaattcccatccacattccaaaaaccggatgaagaaaaaggtaattaaagaagctggattcattggaccggtatgtttggcatccttcaacaattgtgctgatcaccaaattaactaaccatacgttgaaatggtattcagtcgaaggcgacagagcatagcatcacggcgacgtgtgcttggagcagagacgcgttgcatgaatcatcgcagagcgaagacaatgttacttctgttaaaaaactgtgccacctcgctcgcagctctggactgaaggtgtacgcgttcttgacacagacccagtcgcaagcagtagctacgtagacaggaaagactgttctagatttggactgaattgcttgcacttaattgtagtgatatagggtgtgtttagttcctgaaaaaagttgaaagtttgaaaaagttggaagtttgaaaaaaaagttggaagtttatgtgtgtagaaaagtttttgatgtgatataatgtgatggaaagttgggaatatggggaaactaaacacggccataattgatttaacagatttggacttaattgcttgcacttaattgtagtgataaatgatttaacaaaaagataaatacatcgtcagtccttaaatttggaccgcgacatcacgacaaattggttatctaaattaaatttagtttaatgtatcacccaagatctaaaaacccatttaacaaatctccgacgctggtgtagttatctagagtgacaaatgtttttcatttagccccgttgttttagatttatccttttattttgaacgactcgcactagatagtgcaaagttctattaatagagtaggaaaaagatttgtcctcaacccaacttctctctatactctatcgatcttctcctctttcagaacaaggagagaaagcggcagcaacatgaagtgcggtgagcatagggtggtgcaaaatgcgggaagggagggaggaggcaaagttcggtgagggtagtgtagcgtctttttgtcatcaccaccaaggatattcgctaagcgcctcattaccttcaagtcacatgaggtccatcactcatcctcatagtgaccatagcaactcaccgaacttgcgggatcatcctctccctatcgcatcgtctgtctctgctctgagacctctgcctatcgataattgccccccccccccccccccgtgaccgccatctcttcgcctttggggaatgacggggaataggggtggtagtcggatcgggggtgtactgtagggagagggctaaacgtaaaatgtttgccaccatggatagcctggtcgttgcacaaaactagcccaattatacatgtgaatacattaaatcaagattacatattatagttctagatgagcaatttacaatattatggatctaagtgatacccaatctaaatttaaagaccgaccatgtattttatatatgtttagagagcctgctcaaatgaatataatctgtacatccttttatatctgcaaaccaaggaaaacaatgtcctcaaggacgagaggacgtgttgggttgacttgacctagtcattcagccttccactaaaacgatatatatagtcgatctacgttgggatagtctacttatttatacggaatgggttaaatataaatatcatatattagaaacctaataaatattttctccgattcaaaatataatgcatccttattatcgatatacagtggatccatcctgggatgatctactttttcatatggaatgagttaaatatcatatactataaacctaataaatgttttctctatttcaaaatttaaggcatcctttcaaattatcaaaatcaatatttgaaaattttaaataatgactggactaaaagtatgagtatctaaggccatgcatgtagctagaaatcacgtttctctatttaaaaatattttcatataatattaatttcgtaattgttgataatatattatgaaagacactaaagataaagtaaagataaagtataatgtttgagaatgtgtaaaaggctaatacgtcttttagcatgcaggaagtagtacactgtacactgtacagaaacagctggtctcacgtagaaggtctttagagaaatcatatcgttaaaaacgtgatgcaaacaatccacggcaataatccaaacgatcagctccattgaacaggtcattaaagaatctctcattcaattctcttggcagtactcggtgcttggtgcttactgctaatatatataattagcaattgctctggtgcagtgtatgaattgaaaagagtgaaaacttcatcatcttttccattgcatggtcatggcaactgccgagcaattctttgtgacagcatgtagcttatataggtgatctcagctgaaggactgcaaacttacaataatgctagctgaaaaacactcgcagttaccatcagggaatgccaatcatatgcctttaactccttattaactattctctccgtttcatactacaagatatttgattttttttcaagtttataataaaatttagcaacatttatataatatatcaaattagttttcctaaatctaatattgaatatattttagtagtatatttttgtgtaatgaaaaaatgttactctgtcttagatttgattaagtttaaagaagtttgagtagaagaaaagttaaatagtgaaacgaagcgagtgatattgagcttatttgattaatttagataagtgtacacatacccggtcattacagccctagtgtgtgtgtttgaggagaagggaattgaggagattgggaagatacgcaaaacgagatgagccattagctcataattaattgagtattaactattttaaattttaaaaatggattaatatgattttttaaagcaactttcctatagaaattttttacaaaaaacacatcgtttagtagtttgaaaagcgtgcgcgtggaaaacgagactcaaatctcccctagctccccagaacgaacagagccttaaagcaacacggaagtaattaactcctccgatccataggcttgtcatatactcgtgtcagttcagttcagttcataggagtagaccttgacctggacttcgatcaattccttgactacttcagtcaacgcgagtagtttgttgctttatcaattcatcatcgtctttttgcgatcctttttttcagaacttctttttacgatctagtcagcttattaattgactggttaattactttaagcatcgccatcaacgataccttcatcgatatcattatcttactacattcatgtctacagtcaaaagacgtttacacacgtactatgctttagggggtaaaaatagaatgggtatttcctaaccgcctacttgacccgaggcttgcgggagtaatatatgggaggaaaaaaaaagagatcccaatactatccgaatttattaggaaaaaatgggttaggatatgggaagacatgtattcacccgtatgtcccatgttacaaaatatgtacgaaaacttattataaatccacctaaaaatatgataaaagattggctaatcactattttacgtgctcacatgtactattgtgtatttttttttgatgtatctcttttagtactttaattatcttattatatttaatatctatgaattagagagataaattaatatcggttatcaaatctgatttgaatgaaataatatgggataagtgatatttatatggcactatctgtatccggttccgaatttaaaagaaaatacatataaaattatcataatccgaccgtaaccgcccattttcacctctactatagcgccccgcatgtacatacaaattgacggcacaaattaaaccgatcaaattaattaacttgtacaacgacacgaatgtgctagcttttgcaatcgtgttaattctagctttcgtgctaatatagggctattttggtttgatcctaccaaattgttgccgttttaatagtattttggctagttttttatttgtaccaaaacatgctagtaacacatataacactactatagaaatgatcttcacatgtgaccaaaacttgttttcgcagaccaaaacttgttttcgcaggtgaccacccacctggagccaagtgtttgcgaaaattgacatttttctatgcggacgcaacaaccgcatacgaaaatgcatattcacatatggcgtcctaagaaggccgcatgcatgtaaagatccgatttttacatgcgaataagtaaggacgcctcactacaacgattttctaaaaatttaaaaaaaataaatccaaaacccttgatcgggcaccgccttggcagcctgtgagtccatcgccgtcgggtgccgccactaccaaggcccctccgctagctccgtgaaggacagagccatcgtcgtcattgtcgatgcagtccgccgcccaccgtcgtcgagaccctaccgcaaacaaggccgacagcgacagatccatgagggagagggccgccgctgtagaaaccgcatgggggggtaggaagtgagtagtggagagagaaatttgatattttaaggcgtggtgaactggttgcaggtccacttgcgaaaataggtttatttttgcatgtggttatttaagagcccccaacaaaaattgatttttacacatgggcttcttaagtggccttatgcgataatacgcctattattatagatgtgtttcttaaggagccgtatgcgataatgcgttttcacatgcgaccctgaactaccccccccgagcaatttttgcataagcgaccaattacggcctgcaatgcacaagggccctcatctagaaaaatcgttactactaaaattttggtattgcctatatgttagcatggtagcataccaaagtccataactctctagctaattaatctacttcactaactttgactatcaataactttaaaaatatttagtttaaaggaactataacaagatatatatatttgtctttcaaagcactataataaaagtaaacattcatttatttattatatatattataatagaaaaataaggtcaaagatatatttggtaggccatgttattgtctaaaatgtcaattaaaatgaaactggagggagtactagtactgtaaccaccctccctctccctctgtgcgcaagtccacacgtcaaccatggccgtacgtattgtccatgcatatgtaaacttctccgaaaccaattcattcatttcacgcgaactcgagccccacacatatatatacacatcccaagatcacaaatcgagtgtaattaaatttgtgatttgtgaaccttcttcaattctacctagctagcaatctattgagaggtgaattgaagtgcatgcatacaagaatatatagatggtgatgagcggcggcggcggcggcgcgaggattgtcagtgatccggcggcgacgccggggttccgattctacccgacggaggaggagctgatcggcttctacctccgccaccgcctcgccggcacgagggccgacgacgtcgcccgcgtcatccccgtcgtcgacgtctacggctaccatccttcccagctcgccgccatggccggggtggcgaccgcgggggacagggagcagtggttcttcttctgcccgagggcggagcgggagctccacggcggcaggccggcgcggaccacgccgtcgggctactggaaggccacgggctcgccgtccttcgtcttctcctcctccgccgccgccgccgccagggtcatcggcgtcaagcgcaccatggtcttctaccagggccgcgccccctccggcaccaagaccaggtggaagatgaacgagtacaaggccgtcgccgccgccgccgccgacgacgaccacaacgccgctggcgtggccgtgcagctgccaccaatggcgccgccgccgtcgtcctccgcgtgcgtgcggctgaggaacgagctgagcgtgtgccgggtgtacgtcagcaccggcacgtccgatccttcgaccgccgccccctcgacgcgcccccggtgatcagccaccatcaacctcagctccagcaacaacaacgtcagctgccatcgtcggcagcggcggcggcgacgaacggcaacctcatcgccctcgccggcgggtacgagtgctcacacgacagctccggtggctcgtcggaagatgccgccatcgactggagctcgctgattaccgccgccaccgattccgctaccgccgccgttgatttcagcttcaacgacgacatcgatttcagccctgccgctgttggcccatgggcgccacagctttgattgattgattatttgtgcacactgcataataactgaattactagtaattagtagtagtaagtttgatcagtgcttgctaattgccatagtgttctatgttcaggtcaactcgattgatttattacctcccaaactctcaattctgcttgtctttaatttttcttgaataaattctgaactatggcctgttcttttcttacgaagatttcttacgaagatgaagattctacctcgctttccgttagcacgtttttcaaactgttaaacaatgtatttttgtgtaaaaactttttatatgaaagttatttcaaaatatcaaatatatccattttttaagttcgtaataattaaaactcaattaattatacgctaatagttttcttattttgtgtgcccgtatttaaaccgaatatttatgtgtgttagcaatagcatgatgaatggcaaacagaaggctttattaaaaagtcataaggaaaaaccaggaaagaaaagaaaaatagagtgcaaatataaataataaaagttccaacagaaaaaacacaagcatacaaaaatttaagaaaggttagaaaaaaaatgaaattctaaagtggagaaatataatgcatcggatgagaaaaactcgaaaaggaaaaatcagaaaaactataagagaaggaatctaggatattggtgacaatcgtacgttacaaaagacaggtaataaacaaaaaaaatatggggtaaacatttttatctatattcctagaggtttaattaaaaaaacaaagttatgcaatgagtaaaaggcccagcattaactatgaaattatgcttcaaaatccaaattatttttggttgtaactgatgagctaataagcagtcaacagacgatgaaagacttatggtgaaccacttatttcgtgctgaagtacagtgatagccaccttaaatgtaaactccaaaatagatatcatcacataccacatcataaagaaaggtcatgataactgcttgggatggtagctttgaagttgagccaatttatatgagcatacgtaagtcgccttctattttaatggttacaatctactcaacacttgtattgcgtaactaaaaacatatgtactgcataactaagatgatgcctcttttttctctttatcctcaatttttctctttaggtaaactaggaagaaagcccgcgcagatgcgatgcgtatcttgttaattgttttataaaaaataataaaaaaaattatatatcatcatttctacttaaatgatacttcctctatctacttttgatagtcatatttccaaatctgaaaaaattatttttgataggcatatttcaatccaataacctagtatcatattaatgactttctcggatttaatgcgtgactctccattcttctacacatgattggatacatgggcattgagaaatataaatattaatgagtcgcttgtttacgaggaatgactagtaacatgtttaaatggatgataagtagaatcacttatccttggtctatgtgccaaaatgaaatatgattatcaaaagtagatggagagagtattaaatgataagaatgtttctcatatttaaataaaaacattttgatcgagtgacatataaattattttatcgtcaccatgacttattatgttttaaaagttgagcatctattaataaataaaactgcatatgtaccaattaaataggcctaatacatcattaatacactaaaatatcctctacttaaatttcataactcacttatttctaaatccatatataaatattgtgaaaataccactacttctatctattaatgggatacctaagttaaacatgaatgctactctactgggtagagccgatcatagctgccaagattttctttctccgttgccttcaaatataggtcccacatcgatatagttgtactcctcaagaccagcttggagcacaattttaattcctaattcattaagtattgcatcgataagtacgaagttgagcactattagcgatggtggatcacactggggctagattaacttagccatatgttgcatgctatatatacttaccgcaccgtagcaaactctgttatcgatgcttggtgccctttaggaaaggacaaatggaagatggagttgatcaagatagtttttctattgtttttagtagatttgtggtatagtgtagacacactttttttatgatgttaatcattactacctaaatttttatgatataaatagaatactctgttataaaaatgagcaaagttaatcattcggtgatacttaaagaatgtacatgtttttccaaacatatttacaataactaatccgttggagtacacttatagtcacgtcagtggagtttatgacatatatccatcaattatacctgacatattgaaatttcatacgtataagaaaatataatatgagtagtttattatgcatgttactttattgctcatttgtttaagaaaatatttggcaaagaaaatatatatgaccataaatctcatgatggattatagcaagtccattggctggaaatgttgttgataacttttttttcatatctatataccatgtatactgcccacttctgaaaaactttgagaatgttaatctcaaacaaattacaattaaatctcggatgtacttgaaaaacacaactaaattgtgttgttatgtagatttaaattagtattttatatttgtaaactgatatttcacaccctaaaatatgatgtgatttttttgaaaaattgccgtacaactaactattatatgtcggccccatatgtcgtgatatatttaggacaacaatataacttttatagtttatttaaaaaatacagcggaatcataaattggatatataatttttttaaaaaataatagatggtttaataacattgatcggatattttatatttttattatccattttaatttaactacatatttatatttgtgaataatatttttatttttatactgtaaaaaataaaatagatgaccgtcgattttcttgcagcagaaggtaatctttgttttcaatcgtacgtgcgtactcaacttttgttttcagtcactagaaaaaatgcccgtgcgttgcaacggggtaaaaacgttatctttatcctatacattttactcccttggttttggaccgaatgcttccttggttttggatccaacgctcattccttcctttccagcttcagtcctagccctgtccgctacctccctctactcggcctacctctcttcggctcagcccaccagtgaacctgtaggcctagctcgaacaatcccgtgcctgtaccataacggagccgatcctcccattaaatccggtccaatctttctcgatctccaaaatttaatccggtcgagcttgcatagtccagtgtccgtacgatgatggagccgatcctttccatcaaatccggtcgaatctttcttgatctccaaattgttgagggattttgatctactcgatcccaatcttcctttttaatcaaaatccccaaaattgtcaagggaaaatgacaaatccggtcgaatctttcttgatctccaaaattgttgagggattttgatccactcgatctccctcttcctttttaatcaaaatccccaaaattgttaagggaaaatgatgagagagtagtcgggaatcttcttgatctccaaaatttaatccagtcgagctttcttgatctccaaaattgttgagggatttgatccactcgatctccctcttcctttttaatcaaaatccccaaaattgttaaggaaaaatgatgagagagtagtcgggaatcttcttgatctccaaaatttaatccgttcgagctcgcatagtctcgtgtctgtatgatgatggagccgatcctctccatcaaatctggttgaatcttttttatctccaaaatttagagggattttgatcccctcgatcttctttttctatttttttatcgaaatccctaaaattgttgagagaaaaataataagagagtagtggggaatcagtttttgcaatcaattggagaagaaaatacacatgggaaagcaaatcaacgtgaccgcggtgcagggttcggcacacgagaaaaactaccgcggcgcaaggttcggcacacgagaaaaactgcaaaaaaaaaagcgacaaaagaaagaaaaacggcgaaaagaaaataaaacggaaaaaaacgaaaaagaagggaaacggaaaaaaaaggaggaaacggaaacggaaaaaaaaggaacggacagcgaaaagaaaataaaacggaaaaaataaaaaaaagaagaagaagaaagaaacagacgaaatttaaccggaaaccttatgaattttttaattaggtatatatatagatatagatatgtatgtacatacctacggagaacagcagtcgtgtttacatgagggggaagttattattttttaataataaatctaatctaatggtgtaaaataacgggtccacaaatttaagtgaaaatcaacggtgagattagaatgggtccaccaatttaagtgaaaatcaacggtgagattagatagtcccatgtggtggcttaagagcgtatataggagtgccacatgacgtctttagaatatttgtagaaaggttaatttgtagaaaggttaatggacttttattatataataggtagactgtgccctcgctcggaacgatgccaccaatttccttagcaccgtgagacgttcctaccaaagtccaaaacaacaagctaggtacatcaagcgtgcaagtggcaccatcccctcctatcttctttcatccaatagctactaacatcttaggcaatgtttggctaatgggaaatggaaatgatttcccacccaccaaaaaaaacatctttaaatcctaaccattcattctccctctttcatttaatcctaacccttcattcatttcccaatcccaattccactctctatttcccattatccaaatacactcttagttgaagaccgacaatagcatagttggctcactcctagtaatgagaacaaccaactgcgacagtggcggagtcagggatgtcacgaagcccaaacgagtagtggcgttttctggtaatcgactaatattttcgaatatcataagatatctacagtggagacgtcagcgatggagcccgtgcagccacccgacctgcccggaatctagctcggtctttaatcgcaagtactattgtgtaaagatcagagttgcgaggcaccatcatgtttctacttagtattggatagtaagtagaagctattttcacctttgttgtaggcacggttttcataattaactgtgcgtatcaaatccatatttaacagtttctttggaaaggtactttaaaaggggtacgtgtgccgttaagccttcaaccattagatcaaacatgttttggcgtgagttagggtctgggcggcacccaggcgactgggttgcggcagccttctcctcccatgaaaggaggatctggatggaggttctctccgatctgctcagaaagtctgcggaggtcacgtctgcgatctgtaattgggttggtgatcaggttaatcgtgctggttctggttggatctggccgaatgcttttcgacatcgggcaggatggaggcctatcatgggacaatggaatcctaatccgaggaggagggcggatatgaagtttggtagaattacgcctgttgtcaaattctggtacggcaagttctacaggggtcacaccaaagatatcattgatgtggatctgttttggcgatcaaccgtgaaagaaaaggactcggagctgctggggtataaattcaggtacaaggaagggataaaatcaaaaatatctctcgggtcacagatatctagtgcaggtttcaatctagggttcggtcatctagcccttgtgcttaaggtcatggcggctgccgagggtgggggtgatcaagggactatcaatgcgatagttgcccacccgaagccttccggtgcgtcgtcgttgcccccagggagcaggttggaatctgaactccaagctgtactagttctgaatcaaagcgtggatgggatacatgatcaggcaacaggttcaagagtgctgccatcgtctggaaatcatgatggtgggttggcaagtaataacctgagcagtcaaggccctacagttttcactgaaggagaggttgtcgatgaggaggaggatgcagttgaaattgaaatcgaagagaacgaagttcagaaggccggtcaatggacgatcctagcgaggttctactcgctcaagtttcctaatcagtcggctctgtttgaggatatgagaagagcatggcgtttgcgggcggagatgagttacaagtccctaaaggataacctcttcattgtgtcttttaatgcagaaggggattataatttcgtgctgcaaggagatccatggttgcacagaggagatgctttattggtggcggagtttaatggcttgttaaacccttccatggtgaacttggatacagtccctatttgggtcaggatctatgaccttcccctagttatgatgaacagagcaagaggtgaactctatggcagtaagatgggcaaagttcgcgaagtggatgtccaggaggatggatgcaataagcatgatttcttccgtatacgggtggatctcccagtcaatcgccccctaagaagaatgctagctattaagataaaggtgcaaggcaaagaggagactcgcagatttcaccttcgatatgaaagagtcccacacttttgtttcttctgtgggtttatcggacactcagataaagaatgcgaaaagagactgacaaatgagaatgagcctttagtattttctgctgaactccgttgttcgcccttaaaaccctttgagagaaaagtgggtaaagtaaaagcagttcattctcaaggtgttcagagaaaattgtctttcaggggcccaggaagtgtgagttcttcgtcagcgggtattagacaggatgctaagagatatgaagatcaacccacaagggtggatgcttttgatggttttgatattagagaaggaaaaggtgaagactcaatagatagtcaacttgctgaccagacaaatatgctgcacgtctcggaggtgtcaagccttggacagaagaagggcaaggatttggttagtaaggaaaccagctcaataccttcaatggagatgatcccagcaattagagacctgaatgtacagcaagtttcctttggagatggctctactgaagaatttggaagcccaacaaagaggaaagctttgccgacaacaaagagctcaggcattgtccagcaggctgttttggagtatggccagagaggagcagaggaaacggcaagctcaacacgggcaatgaagaggctcaagaagggagtggaggcaaacactggcgtggaagacatggaagcaaccagcctaggggctgctggtaaactggcgggacctatgagagggtctcgccaggagaaatgagttgcctgcctggaactgccgtgggatggggaaccctgcgtcagttcgagatctgtgtgccttatcaaaggaggcgagttcccgactggtttttctatgtgaaactagacaaagtgtggagaagatgagtcgcttaagagggagactgggtcttaggggttttactggtgttagcagtgaaggtatgagtggtggtcttgccttgtattgggatgagtctgtttcagtcgatgtcaaagatattaataaaagatatattgatgcgtatgtgcaattgtccccagaggaaccacagtggcatgttacttttgtgtatggtgaaccccgtgttgagaatagacatcgaatgtggtcgttgctgagaacaatccaccaatcttcgtccttgccctgggccgtcattggtgattttaatgaaactatgtggcagtttgaacacttctcaagaaccccacggggtgaaccccaaatgcaggatttccgtgatgtcctgcaagattgtgaattacatgatctgggatttaaaggtgtaccacacacttatgataataagagggagggatggaggaatgttaaagttaggcttgatcgagtagtggcagatgataaatggagagatatatactctaccgctcaggttgtgcatcttgtctccccatgttctgatcactgcccaattttgctgaacctggtagtgaaagatccccaccaacttcgtcagaaatgcctccattatgagattgtgtgggagagggaaccggaagctacccaggtaattgaggaagcctgggtagttgcgggagaaaaggctgatctcggagacatcaacaaagccctggcaaaggtcatgacagcgctgcgatcttggagcagagccaaagtgaaaaatgtaggaagagaactggagaaggctcggaaaaaattggcggaacttatagaatcaaacgccgacagaacggtaattcgcaatgcgacagaccatatgaacgagctgttgtacagagaggaaatgctgtggctgcagcggtccagagttaattggctaaaggatgaggatcgaaatacgaaattttttcatagccgggcagtatggagagcaaagaagaataaaatctccaaactacgggatgcaaatgaaactgttcacagttcgacaatgaagttggagagcatggcaactgaatattttcaggatgtgtacactgctgatccaaatcttaatcctgaaaccgttactcgtcttatccaggaaaaggttacggatatcatgaatgagaagctttgtgaggattttacggaggatgaaatttctcaggcaattttccaaattgggcccctgaaatcacctggtccagatggctttccagccaggttctatcagcgcaactggggcacaattaaagctgatataatcggtgcagttcgccgtttcttccaaactggactgatgcctgaaggggtcaatgatacggccattgttcttatccctaagaaggaacaaccagtagatttgcgagactttcggccgataagcttatgtaatgttgtctacaaagtggtatccaaatgcctggttaacagattgagaccgatcctagatgatcttgtttctgtggaacaaagtgcctttgtgcagggaagaatgataactgacaacgctctcttagcctttgaatgtttccatgctatgcaaaagaacaagaaggcaaaccacgcagcttgtgcatataaactagatctatcaaaagcctacgacagggtggattggcgtttcttggagatggcaatgaataagttgggttttgctcgccgatgggttaactggattatgaagtgtgttacctcggtgagatacatggtaaaattcaatggaaccctacttcaatcattcgctccaactagaggtttaaggcaaggagatcctctcttgcccttcctatttttgttcgtggcagatggactgtcattgctgctgaaggaaaaggtggcccagaattctttgaccccttttaaagtctgcagagctgcccctggaatttcccacttactctttgctgatgataccctcttattctttaaagcacaccaaagagaggcggaagtggtaaaagaagtgctctcatcctatgccatgggcactggacaattaattaacccagccaaatgttctatcctcatgggaggagcctcgaccccggctgtcagtgaggctatatcagaaattttacaagtggaaagagacaggtttgaagatagatatctgggatttcctaccccggagggacggatgcacaaaggacgttttcagagtctgcaagctaagatttggaaaagagtgatccaatggggtgagaaccatctctccacgggtggaaaagaagtgttgatcaaggctgtgattcaagccatcccagtatatgtgatggggatttttaaattacctgaatctgttattgatgatctaacgaaactaacaaagaacttttggtgggattccatgaacggccagagaaaaacgcattggaaagcctgggattcgttaacgaaaccaaaaagcttgggtggccttggtttcagagactatcggcttttcaaccaggcacttctggcccggcaagcatggaggttgataacatacccagatagcctgtgtgctagagttcttaaagcaaaatatttcccccatggttccctgattgacacttcctttgggagtaactcgtccccagcatggagaagcattgagtatggcctagatttgttaaaaaagggcattatttggagagtgggtaatggaaattcaattcggatctggcgggattcatggctgccaagagatcactcaagaagaccaatcactgggaaagcaaactgcagactaaagtgggtgtctgacctaattacagaagatggatcctgggatgtgccgaaaatccatcagtatttccataatttggatgcagaggttatactgaacatctgcatttcttcaagatcggaggaagacttcattgcctggcaccctgataagaacggtatgttctcagttcgaagcgcttacagattggcagctcagttagtgaatatagaagaaagttctagctctgggacaaataatattaacaaagcatgggagatgatttggaaatgcaaggttcctcaaaaggtcaaaatctttgcttggagggtggcctccaactgcctggcgaccatggtaaataaaaagaagagaaaattggaacaatctgatatgtgccaaatctgcgacagggaaaatgaagatgatgctcatgctctctgcaggtgcattcaagctagccagctttggtcatgtatgcataaatcgggaagtgtttcagtagatataaaggcctctgttttaggaaggttttggctgtttgattgccttgaaaaaattccagaatatgaacaggccatgttcttgatgactctgtggcgcaactggtacgtgaggaatgagctaatacatggcaagtcagccccgccgacggagacgtcacagagatttatacagagctatgtcgatttactgttccagatccgacaagctcctcaggctgacctagtaaaaggaaagcatgtggtgaggactgtacctctgaaaggagggcctaaatatcgagtgcttaacaatcaccaaccatgctgggagagaccaaaagatggctggatgaaattaaatgtggatggatcctttgacgctagctccggtaaggggggtcttggaatgatcctcaggaatagcgctggtgatatcatcttcacttcttgcaaaccccttgaaagatgcaacaacccgctagaatcagagctgcgtgcctgtgttgaagggcttaagctggcgatccattggactttgcttccgattcaggtggaaacagattgtgcctcagtggtccagcttctgcagggtatcggtagagatttttctgttctagccaacatcattcatgaagcgaggcatctgctggtgggtgaaagggtgatttctattaagaaaatatgtcgtagccagaattgcattagccatcatcttgcaaatacggctagagctgattttcttgctggattttggttgggagagagttgtaatcttatctcacatttattaagcgagaactttatgagtgagtaatatatttctttccccccgcaaaaaaaaaaaaggggtacgtgttgatgtgcatgtgtgtgtctggactctctctataacttgtacaaacttgaactatactgtttgcccgttatattattttgtcggccgattgtacaggccggtttttatatggcccaagtccaaagcctgccttttggctgcgtgaccacactcatgtgatgatgtgataagtctgctagcactagcagacgccttcacggaccaacacaaaagttacgacccaaaaacaaactctccgaccgaacgcaacagcgcactgcatgccaaccgaccgaccgaccgagcccgggccgcggggtgggccaggtggccatccttccagacgcttccgccccccatcccacccactgacgcgtgggccccacacccacgtgggggccgccgaggagggccatcggtcgccgctttgaccggggaggacaccgtcacccactgacgccgtggggcccacacgtcagtagccccgtactagtacgttttttgcatgctttgtccgggatgcgcggcgcgaggcgtggctccacgtgtcctcctcctcctcccccacagcctacgtgtgcctgctccggtgatgtcctgtgtcgcgggtacgtggcggccggcgaccgggcgcgccctcgatatatcaggccgcgccccccctcgccgccgcactcgcctgcccccacggcgagcagccagatgccaagatcctccccgcggctactcctcccatgtcggacgaccacagcggcggcggaggcgagcagcggcaatgccggcgagggttcgcggtggacgtggtggagctcggtgcggccctggctctggccgacatggccggcgccgccgtcaaaccggccatgcagctgcagctgcagccgaccgccgctcaggaggaggacgaggagatggcgaccacgaggctgagccttcagctcggcaacaacgtcggcagcatcatccagtcctcctcctgctccagcagcggttccagcgccggcctccccgcgccaccgccgccgccgccgccggccaccgcctacggcaccaagcccctccacatgctcaccgaggtaactgaaactgaagccaatgacatcgctcgcctatcaaactgaaactgaaactgaaactgaagctggtgaaatcgcctagctgcaaatctatcctgctttaattaatttctcctacaaatttgcaggaggagaaggaggcgaagcggctgcggcgagtgctcgccaaccgggaatccgcacgccaaaccatactccgccgtcaggtgatccgatctgctcataaatagttggaaattgcacaaactgtactccaaattgctgcgactgttgggtgtcaatataatcagtgtttctcctggactatcaatttcaggctattagagatgaactggcaagaaaggtcgcagatctgtcaacacagaatgagagcatgaagaaggtgagcgaattagacctgacaagatcaacagttgtatcttttatgtagcttaagctggcaattaacagtaatgatgttgtgtttgggggtgcaggagagggagacagtgatgcaggagtacctctcactgaaggagacaaacaagcagctcaaagaacaggcacagcatcatctttcgctttccttgttctaattaatctcttagtagtataatcttcttctttttttgttctcttttactacaaaattattattactcctaccattctgaggccaaagagagcccaagagaatctactctactctactctaccatgttccaaatccaaacctccagttactttaatccctaatcccttttctcttttacttgtactacaaattaagctaagtaccattctgagttaaggccaaattaaagagaatctactagcatgttcctccatttgccacatgactgcactttactgctgctactggtcctagtagtggtcaaatcaatttggccattgctgtacggctgtagctagctgctggcgaattgggaactgaaaatgtttttattggatgctctggcacttgtgtagtgctgtgtatgtgccacactgacatctgtaatggatataaccattttttcttcctgtgttttgtggtacactgctccactatctggcaccttgtgcatgtccagattcttttagttgtcgatgcgatgatgcaaaaagctcgcttgaaattatttgtttaatcattgtcatgtgggatccaatggtccatccttgttccgcatgggtgttctagccagttcagtttcatttatgcgtggggaaaaaaagaaaataaaaaattctatgtgtgctgggtaatgaagcatgtatgtggcaagcagcaatagaatacatacctactctactcttatgtgatgtttgtgttagaataggggttgaatatacgagttgggattgaagttggaataggtataatatccctctaaaatagagacggggcaccacaatcacggcgactacaatgagtgttggaataggtataatatatagttagagagttgaatcctgtgataggcttgctctttcttaaatggagaggaaaatagagacggggcaccacaatcacggtgactacaatgagtgttggaataggtataatatattgttggaataggtataatatatagttagagagttgaatccgcttgctctctcttaaatggagagggggcaccataatcatggggactagtgtagacccctcttcttaaatagagggggcaccataatcatgctaactagtgtagacacgcagaggcgactataatgtagtgtagacataagaaaaatgatggcagtgaagtcatggatcgtagtggttaggacttatcttgattgggaaggagcgttcataatcggagctagaaagattatgtttacttcgctaataaatatcgtgtgattctacgtcgtcatctagtgtgtatgtagtgacactctaatgcttgaagggatcgaggaggttagtcgttgaggaggttagtcgtcgttcttttatatcgacgaacgtttataacattcgtctgtgtaaactattttgaaggtctaagaacgccaattagtcgagatcagccttttgatgataatggttggttaaaacgcaacattcccgagttcttcgcggatttgaattcatccctgcggatgcgttgcaaaatttgggaaattcatgcgttagcagtataaacaaacactgctgtaatgagacaagaaccaaacctgcaaggctgcaacaacgccaacagcaactgtgccttccagctttgtcagccactctccgccggagctgagatcatcgaggtgcagctcaagctgggccaccatgtaggggaaaaagcggtattgaaattttaccgacatagcgatacatgttcacgtaaaattaatataataataataagagaaattttatggggtttgcatttcaaaggtatagattccacggttctcagtcatatgtactatgctaaaggtatttaagtattgatataggtactatgctaaaggagaaccataggtactatgctaaaggtatttaagtattgatataggtacttaaggtatttaagtattgatatagatacttaggtattaagagtaaaacatataattttgctagtagagtgaaaagggtagaatttgtcccccaaattataataggtaccgtgtagataggaccgtacgcattaacataacatggtatcagcgttatgtgtttttatttatgccatttttctcttttgcgtggtttcttgtagatttacgttgtgttcgagttaagtcgtttatcggcactaagatcaatcaaatattgtctcatgttcaaacgctcgaccatgccaaaaccttcttcgaccgtgtctctcgtggctgcacctcttcaaactctagaagaacaatgtaggagatattgtttgtcccttatgaagggaatctgtgaactacataaataactaatcaactgtgtaaataaacaaaggataacttacgaatacgcttgtctagccgtcgatcggccgatcctgtctcctcttcaaccctcaaccatattgacgcttctccctctgtctcccttcggtgaacaggtttaaaccttagaacacgcacgaagcaaaagggaaagaagaaagaagacgcgagtgttacgttctaatcagtcactaaatcaacgaagtaatctaatttacttttttttcctacaatgataccgagatctacgatgatataccgatcaatggtttcgaagtaatctaatttactttttttttctacaatgataccgagatctacgatgatatactgatcaatggttggaggtattcaattcactaaaaaatactcatgttttactagttaattactcaattgtcattagttaattactcaattgtcatcatgttacaataattttattttctaccttatccttctcttgatcaacaatacatattattccacctccaagtacctctaaatacctcacaaacaccgtgaaagatctcaataagaatatatatctttatcgatcgttgctggttgtaaaatttagttttttttctaatttctatcagcgtttttataaaattagtaaaaaggaatttattaaaatttaatttttttaaatttctatgagcgtttttatataaaattaataaaaattgatactgttttcaacttccgaccgtcttcgtctccgtggccagtgagcacggccatggccgccgcggcattggcattagtacgttgctagcacatgaggcaaccgcaagccatcagtattaagttgcatatatcgaccagtttaacttaaaagcaaagcttaaactgatgagaaaaggtggataatccactttatattccaataggtatacactgtccagcgataacgtcgccgtcaattaaattgtgccaccggttacaaacatgaaaagcttctcgtagaccttgttaaatcccaagagaaatattaaaactgtgccaccggttacaaacatgacaaacttctcgtagaccttgttccgtaaatcccaagagagagattaaagggcattgaggaaaataattctacattaccataaaaataaaattaattttctctgtttcattcaatctaagggggagagattaacggactgtcctcagcaagaagttaccgacaacagtaaaggccaagccagagcaggaggaaggagacgatgagaaagctgggccgtgtacttaattgggcctcaaccaggccaggcccattttaaccgcgtctctcgtgggcccacattaactgccctgacaacacagcccacacgtggccgtgggccccgacagcccagtccgacgtgtcaccggatagtttccagaaacgtcttcctcctcctcctctctctctcctccccactccgcgcaggcagctgctttgctctgtgctcccttctcgggcctcggtttgctcagatccaccgcgtcgcgccgtcgatccgacgccgatgcggccgccggcgccggcgacgacggcaggcgcgggggggaaggtgacgccgaacctggcgatggacgcggaggggacgcggctgctcaacctcaccgtgctgcagcgcctcgaccccgccgtcgaggacatcctcatcaccgccgcccacgtcacgctctacgacttcaacatcgagctcaaccagtgggtgggtgaagccatgcgccgatctgctcgcctccctccgctggtgtccccgtccatatgatccgatctgacgccgtgtttttttttctctcttccttgtctcccttttgggtctatgtgtgcagagccggaaggacgtcgagggatcgctgttcgtggtgaagaggtgaggtgggggtgctttgggcttcgggaatggtggtttagggtttggatcggggtttttgcgtgtgtgctgattgagatctaacactttctggaacgcgttggatcgcgtgtaggaacaagcagccgaggttccagttcatcgtcatgaacaggcgtaacaccggtatgtagttgatgagtttttttttcctgttgcccgtatttcgtagcacgcttgttgtttagaactttggatattggactgattgagctgatctgtagtaccactatgacctgtgatctctgatctgtagttctgacacatatccagatattagcaggctagttcttcttaggattttaatttactataggcttttggaaagaataatctgaaattctgcacccaaatggcatatatacgtaaatcagctatgatcaaggtatatctacatctatgagtagcagagcattttatgattttgtagaaggtgtttttttttataaccacagtatttaacacagttacgcagatatcagctcaatacatcatagtctagacaatgaactgcaacattcaatattaattaatttgatttgtatgctttttaatgaatttgatttgtatgctggattcctcatgaaaagatctgtttctgttgttgtagcctgtaacagataatccaagatctgggctgtgtatatccccttgcagatatagaggccggatttctatccattttctaaaaaaacagataatctaagatctgtttttcttgtcgtaactcgtaacagataatctcgtggaggatctattgagtgactttgaatttgaacttcagcctccgtatttgttataccgaaatgctgcacaagaagtaaacggtatttggttttataaccaacaagactgtgatgctgttgcaggtgtttttggaaggtaaggccttttctctaatatctcacctgcgtgacatgtttcaatctgactgggtcatttagattgggcaaacaagaaatggacagggacagatgagaaccatctaagaatcgtgctccttgctatctccatttatgccatgaactaatttcgctagttactcttttgtgtaaaagacatttgtttttttacttttgttgtttagtatattcaccaaatcgtaaattagtagttgcaaatgtgatcctttttctgattctaaattatattatgtctaagtacatacactttgactgaaactgtggttgaattgatctgtttgggttcaggatattgaatgcttacgccaaagtgcctccaaagcccaaagtaccttccacaaaaaggttcccatcttttgagttgaactacacttgcattctaagctttacatttagctatatattggaattatactgatttctgttggtgtactgcagtgagtttgaggaattggaagctgttcctacatccgctgctatagatggcccccttgaaccttcttcgtcgtccactgttctagtttctaatgcccctgatgaatcattgactgattatttcagtgtatgttctctcctttaaactccctgctattgcattctaccttttattttttttcatgttcatcaaataatatacaatagcttgcctcagatcctagtaaatctttatttgcatcttgattgctacatttgtactagtatattgcttcttaccagtcacacatgtatatatgtttgtactgtcagtcttgtcacaatattgagttctgttctgaacaaatctgcagggcgctgttaatgttgggaatgtatcaattacaccaatggttggaagaactcatcagcctatcgagtctgttgcatcctcacacgtaccattgatcatcccatctgctgctcctacacatcaaatgggtgttccttcaggggctgcgtcagctccaccactgcccgtcattgacactaacgttcattctagccactcaacaaatcttgtaactccagccttttttgcacctccctcatcgtcttctgcatcattggtggcaccagcttcatcctttatgcccacagcatcaccttttcatccaacttctgccgatgctcaccgtccagcatatggacatggtacaccccttcttcaaccccttccgccgccaacaccacctgcatcacttacccctgtacacaacgatgagcctgttatttcgagggataaagttaaagatgctctcctgaggcttgttcaggtatgtttcacattgacaaacacatggttgaataacctttttctttatatatttttaactcttttatctcatgcccaacagaacgacgaattcatcaatttgctctatcaggagttacagaatgcacatgcgtagactgcttactcagcctttatggagtgtctggccttgacgagagttcacctgttctttcgtagttttgtgtgctttagttctcaaaactttatgtacagctttggcttctttttatatcggatgtccgcgaagagattgtgcagctttgtcttgatgcattattgatgtagagtttttatagcaatggctggtagtatttcttccaaatggttgtacttgtatagtatttttgtttcctgttggaaactcgaaatcggaagctggactatgtgtggcaacgttaaaatactgtccattttgtgtgatatactgcacagttgccatttagatatttgatatcacacatttttttagatcaaacttatttttacacattgatcagttctaaagatcaaatatatgtggccagagcgagtatgagtagctattgcctattggtggatatacgtaccgtggcaaacccgtggcactttgctccctcgtcgaatcatcgtcatccatcgattgttccagctgttactcttatgccattgctctacttctattctgcacaagcttgtttcatcagaaagctatttcttctgtttcacaatttaagtcattttaatatttttcatatttatattgatgttaataaatcaaaatagatatatatgtctagatttattaacatcaatataaacataaaaaatgctagaatgacttacattgttaaacggagggagtagctacaagaacgtagtagtatgcacatgctcgtttgttatcccccatcctgttggctgcgaggcaggtcacacccgctcgtagtaaaatttaattgcttcattcgttttatattataagactttttagcatggctcatatttatatatatgttaataaatctagacatatatgtatgtctagatgaatgtgaacaatgttaggaagttttataacttgaaacggaggtggtacatatttaaacatttatgttcttgattttgttttgcaactcaaaacaatttgaattccaatatgtacacactacgttgtcaccgaaacctacgccacgtcagagtgcgccgcgcgccggaggggacgccggccggccgcagcgcacggcacggtcaccggagcgtcagcgtcgagaggaccccgacgaacgccgccgcggcgacgccggagcagaagaagtcgacggcgccgtctcgcctcgccttcttcaccttcctcgccgccctccccctcgcgaacgcctcgtaccgccgccacgccgccgcctccgcaccgcggccgtgcctcgcgccctccatgaccgccgccaccgcggccagcacgcaccgcccgctgacgccgccgccatcgccgtcctccgcgcgcaggctcacctcccgaacgtgcccgtgccggtcgtcgcatgtcacccccgcgtcgagcgcaacgacgccaccgccgagcaccccggtgaaccgcgccacggtctccccggcgagccactcccggtccacggacaccgaacgccggctcgaggcgttgacggcgcggccggtggcggggtcgatgagtatccagcttagcgtcagctcggccggcgtgatcggcgccggcgccgagaagccctcctggacgagcgcgtcgacgcggaacggcgagcccaagaaccactccgacgaggcgtccgtctccacgacgcgcgacatgaggcagacttcgccgtggtgcaggtcgacggcggagacgagccgggccgggaggagggaggccgacgacggcaccaagccgcgggcctccgccgggagcgggaacgcgtcggcgaagagcgcccggtaccctcctccgccggtgacgccgccgcattcgtctaggccgtcgacgtcacgcagcgacggccacgtcgcgaggcagaggccgcgccacgtctccgcgtcggcggcgagctcgcggaaggcggagcacgcgcagccgagcgcggccagggaggcgccgtcgtcgagccggcgtagcacgagggagagcacgtcgcccggaatgtcctcgatggccgtcgtcgtcgtcgcgcccgccacggcgccgtcgagcgacaccgccgccgcggaacaaacgctcgccatggtcatcaggtcaagaagatgcatgccactgtcgtggatgtgcttggttggaagcaaccatgtctcgtctataaatacatggagctcgatcgaggtgggtgaagggagcgcgtgcggggatgagatcgatcgatcactccagatggaaggaaagcgaaggtcaactcgtgtctcgtccatggagaagaagaagaaggagacgacggacacggcgcggcggcggcggcagtaggggttttgcgttggcgggaagcgaaggagagaattattgcatggtaacacaccgttcgtttcaaaataaattcatttttcaccgatccgcacatactccctccaaatttataataattgattttttaaacaaggttgagatcaaacggtcataactttaaccaccaataacttcaaaaaaatttagtttaaacgaactataacaatatataaacatttgtctttaaaagtattataataaaagtaaccatacatttatttattgtatatattataatagaaaaataaggataaagatataatttgtagaccgtgttattgtccaaaacgtcagttaaaataaaactggagggagtagttggttatgtgtcgtgaaaaccagccattctagtttatgttttataatcggcatgtgtgctcatatttggtggtaagtgatgtacttctcaatagcgaaaagtctacgataatttcatcaatctcaaaatatacttgcccatttttcaaatatactcataattatagagtgtgcgtgggtttttatataggtaagtgtatgtgtgttgttagcgtatgtatttgagtctgtttagttggggaaatgaaaatttttgggtgtcacatcggacgtttgaccggatgtcggaaggggttttcggacacgaatgagaaaactaattttataactcgcttggaaaccgcgagacgaatcttttgagcccaattaatccgtcattagcatatgtgggttactgtaacacttatggctaatcatggactaattaggtttaaaagattcgtctcgcgattttttccttaactgtgcaattagtttttatttttatctatatttaatgatccatgtatgtattaaaagattcgatgtgacgttttttaaaaaaaaattatgaactaaacggggtcttatattaaaaaacaaaaaggagcaaatggaaaagatcctcaattgaaaggactcgtgggcgtggcacatcctagatgtttcagtcgtgccgtgtatcattcctgaaaaccgagaatgctttgatttagacaaatcatgtagtagtagatagagatgattagatggtggatgccgatcgatattttcatggtcccggccgtctccattaattaatggcggccagtagtttgggctaagaacttgggtttctgttggcagatgaacgtacgtaggtaccgcgtgcgaacacagttcgccgccgcgcacacggtttgcttctgctggagggcttgtttgatttcgagaaaaccccaaaaaaaaagatatctaagaattaattaattcatatgaggtgttatttgtagtacagaaaatcaattttttctctctttttttaagttgcggagaaaaaacatatggaatttttcattcactcaaatatattgaaaaattgctataaattaaaatgtgcatgtatttccgtttctctaaattttctattcttatggttaaaaattcctttaaatcgaactagaaaggtaatgtgagtgaaattttattatgaatatttatgtgcagggttttttattgaaatatttttattatattctaaactaaaattaaacttattttgtattctttgaacgctggtattttcttataattactctttcaacatataaattataaaataaaattatttgagatcatgtggttttgaattgctaagaacatattgtgtcgaaactatggaggtggccccttatctcgaaaaaaaggaggttgttgctatcagaaaatttagggaattttaacttgctagattgataccttacaacccaaaacaaatcaaataatatatttttttgtttgattgtattttaaaattttatatttttcattctaatagtcctcataaatatatttgaatttttatattaagtatgtgttttaaatccaacaacaaagtatcaaggtcaatttgtataggtaagtagccctcatatgtatgttaagagaaattaattcaattggtagaaagttgttagatgcctaacgtgatataagtaatagatggagatccatttgtgtttttcccatatagataattttaatattaattgtctaggagataaaaaaaacagatagaaaagaatggcgcacgtgtacttacgggcagggagggagggaggtttgggatgttttttctaaatgattaatacaacaacctaaattaatatgtcagatgtttatgtcgaaaccgatggttggatgctttgttttcttatcagaatttttaggattttctttgatttaagagaacaacgtaacatcttaagagcgtttacaagatgtgtaatggacttttaataccacatgctgtaaaggaggagggagagggtttggggtgttcttttttttttaaaaaaaatagatctaatgacctaaaataatgtttcattcgattgaaaataatgtgtccatcgatttatgtctaatcctatggttggatgttgtttcccaaaatttctaagaattttctataatttaagaatttcatataccagcttagagtttttcttattagaaaaactaacaaatcgatagtctaatgctttgttatttttaatattttctagtattttatttaatttaatagcatcgtatagcatcttaaaagtgtttgtagcatgtttagaatgacagatcaggagctgctagacctagtgggtggagatatgtggtattttaatgcaaaaataatattaattttaatttctcatgaagaaagcttgttggtatgtacttgacagggaggttgtggatgtgtgtgttttaaaagaaaaaaacgatctaaccttcgaaaatgaaataatagattcaccaatttaattgaaaatcgatgtgcgaattagagtatcacttgacaatttaggagcgtttgtaaggtgtaacttgccggcttagaaatatttataggctgtttcatggacttttagtatataatagtattttttctaaaatttctaagattttctttaatttaagaatgtcatatagtagcttagaggtgtttataaaatgttgaatggattttaccaccgcacggattttttattaaaaaatatataacaacctaaatgcatcaatttaagtagaaactggtggtcgatgctttgtatttttttctagtactttctccaatttaatagcaccacgtagtgatttagaagtgttcatatgatttttaaagtgacgaagggagagatgctagacctagtagttggtctatttgtgattttctttttgaattgtaaaagtaatttttattttagtcttcttaaaatagaaaataaggaaggaaaagatggatttacatatagtaagtacgttcgtcagtataatctaaaactattacgtacttttgtacgttggtttggatgttggctccggatgtttttttttataaaatagatctaaccatctaaaacaatgggtccactaatttaagtaaaaatagatggttgggtttctcttatttattaggtgtcatttggcgacttttgagtgtttatagggtgccacttgatggtttggaatcgtttataggaagtttgatggacttttagtttaatactccctccgtattgtgggacggaggagtatatataatatataatagatagataatagataatagaaatagatagacagatagataatacagtagatagttttttttcttgctatgaatagtactaccgaagctttatttccttttcaatctcaagtacgtacttatgtttgtatatgtacttatgtttgtatatgtacttatgtttttttaacagttagtatatatacatctaatttaatggtctataatgacgatccaccaatttaaatgaaaatcaatgctgagattatacagtaccacgtagcggcctaacaacatttgttggagcgccacatggtgatttatgagtgtttgtaagatcacaaattaaatatatcatttattttttttaaaagatgaacaattaaagatgattgatttgatatttgatatttatattgtagatctagttttaacaccgcatgtgtatatttatgaagtaatatatttcatctttatactgtagaccgtcgatttttcaatggccctaagtatttatgtttatgttttattttggctttatctttatagtaagtacgtgcatatttttttttcttccggcaaacattatgtacatgagaaagatattatattatataaaacaacatgtccattaatttaaaaatcaataacacataaataaattaatggatccatcaagtgaaaaccgacattaaaattagttcaactgcatgtatatatttgtgggataatatattttatctttatattgtagatatttgcttgttgacagtactatacatgtatgttttattttggttgtcgtatctcgtatgtacgtccatacgttctgttccttcggcaggcaaacagtacggaggagaaagatattatatatacatagatataatctattagcataaaataatgagtatgtatatatctaatctaacggtataaaataatggttccatcaatttaaatgaaaattaacagtgagattagactatgccacatgacgatctaggattgtagaattgccacgttacagtttgggagcgtttgtagaaagtttaatggacttttagtatataatagataagcttgtcagcactgcgcctctgctctgtacatacgcagcagaaatattagcgtgtggtatttccgttcccgtgaataactcacacgtgtggtgtgttttatatctccttaattcaactccaccacgtgctaatcacgtccgtgctgtttaataagtacggctagctagctgcctgcttgctaggccatgccggcaagcaatgacaattttgggttaacgatctataacctaactaatatggtcagttccagaccgttcaaaaaaaaaaggtcagttccaagcttatcaaattcatttccattacttcttaaaaaaatcatttccgttagtattggcctgaatggccagtgctactgctattttaacatctaaaacaatatgcagctagcgatgtgtactgttcgatcttgtccaaataccaatcaattcggatctttccggttaatttcctactgatattttatcgaatctgtataccactcgttcatccattgaatttgtcttactcgattattaagttatgctcagctataaactcatttatctatgttatattttttgcattcttttaatataacaatgacatgtgagattttggtgaaatattgtacagtgatatacattctgtttttaagggcatatttgatagggatccagcttcaactcaatatctccatcccgcttggaattagaacctagccaagcagtacattctgtttttaagggcatatttggtagggatctagcttcaactcaatatctccatcccgcttgaaattagaacctggccaagcagtttcaacttcacctcaaaagagagtggattgggctaaattgatttttgaaaaatgaattagagagttaacggctttgttcttctagagttattttgaaagtttgagctagctctactaaacaatccctaaagctttggatggtacaccgatatcgttcggtaccaaaacattctactacatgtttccagagaccgtcagattggaattgacaagcttgtccgtccgcaagaagagaaacatgctaagccaggttgaaataaatgaaatggcacatgatgcatgacctgatgcttcacttgcttgtagggtttaattgaatattacatggcataaagctaaccaatagcttgaaaaaaaaatccaagcaatactatttctaaatcatatttttagatcaaatatttggaaaaaaaggttttgaagaaatcatattttctaatgtatgtcacgaataatctactcgataatccatataatctggttttagctaattcaaacaggactttgtgatgctttccctgtgtaagatcgatcgagatgtttatcgatctgtgatgctcttcccttcattgatttgttcaacaaaaaaaaaagatttagtggactaattacaggattgcacctttcattcacagataggactacctccatcccaaagaaacctaaaatgagatctaatacattctaatactacaaatttgaaggttgaaacagagaaaataatactaaacaacctaaattcctagaatgccttcttttttttttggacggagtattattcattcaagacgatccgttcctgggccgttgcctcgtacgtggcggcgacgttgggcctgggctgtctgatgaatgcggagtaggcaacggggccggcctatcaccaaggaccgaacttttttcgtttttagattttttttaatatttacagaaataatctatggaccaaaaaaattgcagaaatagcccctgccgccctaatggtgggcggcaagctgacgtggcagacggtgggtcgaccgcgccgtctgccgccgtcggccaaaattgcgattaggcccttgccgcccgtacagagggcggcaaggggctaattgcaattttggccgcccataaagagcttgcggccgtacttttttcatctggg

SEQ ID NO: 57899 - DNA, 19192 bp, Oryza sativa
aggtgataacattcagattgaataagttcttattgacagtacaattgttatgaacacggcacaagtaacttgtaatttaattctcctttggaaaacagatgatgattgagaaagagagctgggccgtactattttgcactatcagatgattttcagaagactgagcaaagaggtcgtatctctggtagactactcgtcagagacaggtagtaatgacatttcttttccagttttttacaacagtagtaactaaaaaagtttgattcagtccagatgtaatttagatcgagatacatctattactaatgaatttatcatgtgttatataggtatttacatgatgcagatctttatggtacatcagcttatgtaggcttagctctaccaggagatgttggatcctggcaaagagagtgcaaggtaatgcattctatatacacacttattcttttagaacaagctggaatacatgttagactatgaagtatattatcgatcacatattccaacactgtagggataccaattctggtgtagggcacatgatggtggaagctttagcataagaaacattgtagctggagactacaacctttatgcatgggttccaggatttataggggactacaaactggatgctaagctaaccatatcttcaggtcagtatctacctgacatttattcctcttgcagcttccaatgagatatcctgatatgttcagcactcctgttcaggggatgacatttatctgggtgaccttgtgtatgaaccaccaagagacggtcccacgatgtgggagatcggaatacctgatcgatccgcctctgaattctttgttccagaccctaatcccaactatgtgaataggttgtatatcaaccatcctgacaggtgatgcagactggctaccaacagacttctcaaacatgtactaatcaagtgatcatcatttcttatcatatagtgttctgattgttcgttacagatttaggcagtatggactttgggaaagatatgcagagctgtatccagacggtgatctggtatacacaattggccagagcgactataccaaccgatggttctttgctcaagtaaacaggtgatgttttcatctcatttgaatacaactgattgcgcagagttacatgatgtgcttctaacatctgtgtccactgcagaagaactgatcagagcacctaccagccaaccacatggcaaataaagttcaatcttgacagtgtcagtcctaacagcacatacaaattcagagtggctcttgcatcatccgcaaatgccgagttgcaggttatttcagaaaaaaaaacacaaaaatactcagattggccaatgtccattcctatttcattatttgttatcatcattcaagaagttgatactaaatacacaaaatgcttgtattttcaggttcgtttcaacaatcaggacagaactgctcctcacttcacaactggattgattgggaaagacaacacgattgcgaggcacgggatccatgcgctgtactggctgttcaacatcgatgtgagtggagcttggcttgttcaagggatgaacaccatctacctgaagcagcccaggaaccagagtccatttcagggactgatgtatgactacctaagaatggaaggtccttctggcagctaaggccagtctttagctagttaaccagcctcacatgtatcgctagtaatagctgtactatgcctaggtatgcagtatgattttaaagtttaatcttattttaccaaaaaaaaatcctgggttttgtctaacccggatttagcttatctgatttaggttagctggtaaaaatgtaagctgccgaaatttctcagagcatcagaattttgaaaacgataagatataatctaaattggtgatatgtattggaaaaagaaatatcatttcctcttttaactgtagtgtaacgattagaaataatctaaattggtgctatgcttttgtttttcagaattatccgtatagcttgaccgttttccgtttccgacggataatagccttactatatccatattcgtctctgatactatctgaagttatccataaatcaacacagtctatttccacgcaagtgtctggacagtccgaaactatatgaaccaatttcatcactacctgtggatatatattataactaagcttttttttggatatatattataactaagctttttttttctttctctaaattagttccgaaagattgacctggcgatagtagacctttttgtgcgttgtagcacgtagcatttccacttattgagaagatatcattttgtacataaattattcaagtcatatgaacacgagcgagtgcatataatacaaaaagaaatgttttgagtacggatcgttatccttttagggtttcacattcatatatacttcttgtaagttgtcgttcggcgttgtaacctcaccccgatacagtgaagatattaatttgctggctggcacctatggttttttctctcctgctttgggaaggtttttcacgttaaatctcgtgtcttctgtgattgatctattgttctttatcttttatttgcctattgtttcctaacgcaacacacatatattttgctagtttaattaaaataataaacgttttaacacaattacatatgcattgtggttaaaagtagaaattatgtagtcctcgtacagcataaagaatagaactaactaacgaggactagttaaagagaaaatgtaacaataactattaagttagtgctgaaaaaactactccctccgttgcagattacaagactttctagcatttctcatatttatatagaagttaatgaatctagacacacatatatctagatttattaacatctatatgtatgtgagcaattttagaaagtattacattgtgaaatggaggaagtattaagttaagtataatcagtggcatataagaaatttgtctatttttttactagaaaatggctagccctattctattgaaccagatacgtgtggaaagcataaatttgattagtacgacgtccaccggcccatctatgctgcagtcctttacataatgggcttctataatagcccatgtcccactataaaccaaccaatggcccaactacttaattgggccttccacaatcaacaggagcagcccgctgtagagagggcagagctaaactgtacaaaattgcgtgcatgttttttaagataagaaaaactttattgaactcaatcaattaatatcagtgataaaaccatattgaaaacattctcggcatttgcataacttgaatacacaaccaaaattttcacgcacatagtatcacatagcaatacactcttgtgtgtgactatatgtgtgcagtgtgcgtgtgtgttcacgtgccacattatatttctatcatttgagccattaattgttgtaagattttcacaaatgttatgttcagacccagccaaaattgcagtatatatctggcaccaatttgatatgcgttatcaagatcactaattcagtgtgacaattgtcaccacttaccaaaatacggagtagtaaatgtacaaattaaatcccagccagattcaattaaattttgtagccacatcacatacaaattgaacatcaaattggatttggttcggccttaattcggtgttatttttgatggcttgcgtggctagcttcatccatcatctctctagaacgagaagaagctacactgcatgcatgcatgactgatcagtcattgacaattaacatgcattatcaccagttgatccacctaaattaaataatcaaaacaccacattaatccaccattaacttgatcatctcatcgatcgatcgattgattagctagttccatgcttgcatgatgcatcgatgaaccctaataatctggtggttaattaatataataattaattaattacttcatctcttggtccagtgagccggccatgcccatcccggcggcgccgccgtgccgcagttgaagccccggcgcgccgccgctcacgccgaggaagtccctcgtgctcagcttgccgtcgtccacgccggggaagccgccgccgacgaacaccgttccggcgccggtgccgcccccggtcgccgagagcgtgttcatcatcagctcccggagctggctctcgttctccgccgtctgagaagcagtgctcctcgacgagctctccccggacatgatgaacccggctgctccggcgggcttaccgttcagagcgccgccgccgccgccgcttccgagacctctgagtagcgagttcacgctgccggcgccgccgctgctcgtcgtcgcgcccatctgtgcggccttctggagaagcgccgtcgccgacatctgcggcggcgggacggtctggtcggacgagctgtacaaggacgagaagccgccgccgccgcccatcatgttcccggagaagatgctccccgagtcggcgttgttaccgctgttgccgtgctcgccgctgccggcgcgggcgccgttcccggcggcgacgccgttgaactgatccgggaagacgagtcgtccctcctggtggtggtggtggtggccgccgttcccgccggagaagtagctcaggttaaggaggccgccgccattgctcccctgctgctccggcagctgcattaggccgtggaacgccggcttgccgtggagcagcgaggtgtgggcctgtccgtcgtcgccgccgccgccgaggtagaacggcgaggaggacgacgacgtcggctgcgcggcgcggaacgcaggggagccggccgcggcggacgacgtggccatgaggtggtcgaactgcgcggcggcgttggcggcggtggtgatggcggaggagtggtcctggaacggttggagctggtgggaggcggccatgccggtgaggccgccgatggccatgccggcgccggcggcggcgtacagggcggcgcccatgggtggcataatcctgccgctctcctgcgccagcgcgtcgcagaaggcgcggtgggtgatgaagctgtccctcctgcatgtggtacaaagttttttttttcacggtgatcaatatgatgtgccacttaattattaatctttataagcaagatatatactccctctgttcttaaatatttgatgtcgttaatatttttaaacatatttgattgttcgtcttatttaaaaacttttgtaaaatacgtagaactatatatatacataaaagtatattcaacaatgaatcaaatgataggaaaaaaataataattacttaaattttttgaataagacgaactgttaaatatgtttaaaaaagtcaacggcgtcaaacatttagggacggagggagtatacaatttactcctagctagagataataatgatactgatcatgatgctatacacaatgaagttgggaagaaatacactacttgattggttttaaattaattacttgccgttctatctttatcctcggtctcaaacatccatatatttgaccatcaatttttaaacagttgtatagtttagcatcagtgtgatttatgcatgttttcagatttaccttgaaaaatatcttcataatataccttgaaaagtacagtttttctagaaaccaatggccaaattaagataaacatatttgacttaggagatcaagctaaaacaataagtaatttgaagggtagcaggttggtatatgtgcattcacatgttcacctcaaattcactttcttcttttattcacttgtcatttaattcactcatcttgtatatagttgtttcgttgtgcagccagcacaacatttatcttttaattaattaagttgatgtgaaaacagaaaatgtgaacattatgatttgttttacagatcaatatatacgttcaacttgtcactccagttatctttttttttttaaattcaataataccatcggttatgagaaaaaaacagttcgccaaattaataaatgaagaaatgtctaaaagagcaattaatcaaactagaatatcaagatccattgcaatgctaaattgagcatatagctttcgagacatatatcatactgctgtttaatagcacacgaagttttcccccaatttaagcactatctaacttatacacaaaattacataaacatatatatggtaccatcaaatatcctttgctaacatatatagcaacaaaaaaattgttgaaaattatatatctatttactaattaaaaaccatactaatgtgcatgcatgtcaacatggaatttatttgtggacagaaaaaacattggcttaatttcactagtagtacatgcatgcttgattgtctttgtaccaatatatccaaatatatgcggcagattgtgcaaactgcgactgtagcccatgatcaaaaagccagaaatgggaaggcaaaacaaagggaaagaaagaatgtcaatgcaacaatacccaaattaagatgcatggtgtaactgtactgtaccctctctccaaaacattcatacacaattgcaagcaaggttccaattttcagatggggatgcaagagcatatctgcatatgtgtgtgtgtgtgtgtatacacatgaaatggttactaattacacatgcatgtatgagcagatcgatcaggtcgccgagtggcatcatcaaatgtcgatcgatccgaatgcaacaacaagtggttcaggctgaatagtaaggccaataggactaaaactttaagtctctatcacatcggatgtttgaaaattaattataaatattaaacgtagactattaataaaactcatccataatcttggactaattcgcgagatgaatctattgagcctaattaatctatgattagactatgtgatgctacagtaaacattatctaattatggattaattaggcttaaaaaatttgtcttgcaaattagctttcatttatgtaattagttttgtaggtagtatatatttaatactctaaattagtgtctaaatacagagactaaaattaagtccctagatataaacaccacctaagctaacgcagctgctcgtgctagtagctagcacagtcgccatgaaaagaatagagctgtcgtctctgtagtctgtatgcatggctccatgcatcgatcgcatgcaatgcaatgcaagagagagtagtactgatgcatcccatccgtcacaagagaacaagccatgaccatggccatggtccttgcttacattgctgtagtacgagtatacagagagtactagtactacagttgcagctagcaagggctcttgtcatcacgtgaacacgtagggacgatgagagagagacagagagagaaggatacttgtatcaagatggtgcggattccgagtcgaaaaagatgactggcttttgtttttctttctgaaccttttcaagaggaggaggaagaagatgaccatggcggcatgatctgcagtggcctctctcagctggcctgcctgcctgcctttgtgtccccctccggacaagagcagttcacgtgtgaccagctaagctactaatcctatatactctctctcatggaatgatcaatgggaaaagttaatttgttgtaagaggagagtaagcaaagggaatcaaaatcaaatttccaaacaagaaagactcgagagacacaaccgtacaaggccagtcacactgttactacctactgttcttcactgcagcatgcgcgagtggtgacaaccctaaccctaacacgtagtagtactcacccgggccggccggcgacctagctagctagctagagccatctgcttcaatcaaatcaccatcatctccatctatcctagtatctaccaaagctattcatctcgtgcctttcagtgcccggacctcctcctcatgagtgtgttcatcatgactcaatcatatgatgaacaaaatatataaaagtacatgaaaaggaatcatcccaaatccaaacaattctctaggttgccacatcttgcaaactaatggaatatctaataattcaagacatactacacctccatctcaaaatatatacggtaacttctagctatacatctgacacaagacgcataaccagaagttgctgttgagaccacagagggacatcacaaacaaaaaaaaaacaaagaatttaagagatattatctccgttctcaaatatgaaactttttaattatacatctggcacagtcatgcacatataccagatgcatagccagaagttgctactgggacatacggaagggagtatgattcgcaatagaaagacgaagatgacgacttatattttgagacggagggagtagtacataaagagtacctggagaagagggtgccgcagtcgcagcggtactcgcgggtgccgcaggtcttggagtgagccttccagtcggactggacggcgtagcgcttgttgcacttgtcgcacttccacttcttctcgccgtgcttgcgggagtagtgcttcttgatgccggtgaggtcgccgagggctcgcgacgggtcgtggtggacgcaggacggctccgggcacaggtacacccgccgccgcgtctccttggggttcttctgcttcagcttccatggcaggttgtgccctcgccggtgcagctgcaggttctgctccctctggaaccccttgttgcacacctcgcacacgaacctgttcgtcgccagcagcgtgtgcggcgacagcgccaccacctccgcatcaggatctacgtacattatcaattcatcattgaattaattgatcatctgcgaaattcattcagaggaattatattaaatgagatacttgcttggattcccgggctgattcctcttcttcttgggcggcggcgtggccgcgaccggagcagccgcgttgttctgcaggggaggctgctgctgctgctgctgcatctgcggctcgccgagaccgaagtagtgtgcagacgaggcggctgccatctctatctctgatgatagttaatcagctcaaaccactgatagactaattgtcttgttctgttaaattgtggctgaagaagaagataggcatggaattaatccaatccaattaagtcacactcttcgatagtagtatgtgtatcttggacgctagctagtctaccagctgacttccaatcctcttcgatttgcacgacctgaaaattaatcaagacaaaattaagcagagatccaagaggtaattacatgcgtggatgaagctagctagcatggaagatggtggatggatctgtactgtgtgcagccataggacagacaaactgactgacctgcagctgatcgatcagatcctctctaataacaaagcaacaaattaaatcaaaaagggggaaggaaacgaaaacgagaggggaatttaatcaaggaattaataagagaggaattaattcacaagctaattaatccaaagttccaaaaaaaaaaacatgcaatcgtacgttgcacatactcacaagcaaggcagctagaaactagctagcttgaaaaaaggagactggtcaataacatgagataaggcatggagaccgaggtagaagaagaacagcaacacatgcaggagaaaaaaccaaaaaaaataaatcacatgtcatcgatctgagatggagatcgagaaccgaacaaacaagttaaagaaaacaagctaggctccttgttgaaaaaaggaagaggagaaaactctaattaaggcgatggagatagaaatatatagagagctagcaaacacgaaccggggttataataaattcgaaaagccaaaaacgagactgcagctatctcctcgtcttcttgctgctgggctagctagctgctgcaatctatactagctagtacacgtacgctccaaattctccaagttttgtttggagctagctatagcacatgatgacgacgacgacgacgtaactggtataacaagctagcttaggagcatatgctactatatggcgcctgtggctggagaagaagagaggaagaagacgagagagcgagcgagcgagaggagaggagggagatcgatatggtgtggatcgagtaatcgatcgactcgagttgggtggttggttatgagcgagcgagctagctagctctcctccggcgccggcacaagggtggggcccacgtggcgccctctatgggcccaccatgacatagacagatgctctcgtcccttccactccaccccgacctctccatcctatactagctcatgttccctggtatatatggatctatcatctatctatatctccaattcccaatcagatgtacatgtacacgtgaccgtgtacgtttagggaagcttttagtagcggcaatttcttttaaatcttgagctctcttaaatagtttaattagattctcactccaatactagggattctctgtagttatagaattcagaaaattaactactaaatagaagtaaaagattaaaaacacagtttgcttcgtattctcactagccaaggctactcattagtttcttcctagaatctcaatctctccaaacgtggcctaatatcttgagatttctcgctcaatctatatatgtgtgtgtgtgtcgctttcggaggggtaaaacgcttttcaatctattgtattattaaaacatcattaaaaagcgacattaagtgaacgatggggactataaattctcacattaatcaaagaaaagaaaaaatagagttaaaaagagttcaaattatagttcccagcggtaaagagaattagcaatagccagcggtcggggcgtagaagtaaggtgacgatgtttattaggacttctaaaattataacaagggaaggacgagacaatgaactctaaaatagtacgatttcccaagacaacgagatattttttaatacattttaaaattatgtgtaattcttttataattttatgcgggtgctaggactgctagcctcataattgtacggggcgcggactactccaattactggcttaaaaaaacgattgatcaatcaaatttgaagcgctagctgttgtgagtggggagcctttttggctggatgttttgcttgcctgattaattatacttgcagtggctgctgtcaggggcatgtgtgacgtgataacaaacactgaatccgctgtagagcggctcatcaatcatcaggccctgaatgttgcggcacagagcatgcatctacagctagctaggtacatatatccacgaccaagttccatgtgatcattgctcatcacatatgtaaacgggataaagatatatatatccatttatctaaacataatatatactatatgtaattggcttagttaaataaaaaaaatgttatctaaaatttaaagtccaaaaacaattatatcaggcggcggttgtgcatagaggtacatacatgaacatatggcacgcgtgtagattttttttcttcggcgcatgcatatagcgaaactaagtgaaaaattaaatacgaaaagcatatattaatattatatgctcctcatgcaaattgagaaaaaatatctttgtgctaaaagattagttttggcatgcatatatatctccaagagtttcatgacattctttgtcacatgtactttgcttgtcaagtgcttggcagcaggctatggctgtgttcgctgctggcggttcccatgcggaaaacggaacagtctattagcgcgtgattaattaagtattagctatttttataaaaaaaatagattaatatgattttttaaacaactttcgtatagaaactttttgaaaaaaacgcactgtttatggcaatttgaaaagcatgcacgtggaatacgatggagaggggttaggaaccctaggttctgaacagaccctatataacacaataaaatactacgctgttgaatagtaattcctctacgaggcatgcataattgcatgtgatgtgtattcgagatcaaaagtacaggacaaaaacaaacatatagaaaaatcaggaacagatacatacttgtgtgtatatgcagatgtgctcacatgtgatatataattagctgatcatttcatctccccagaaattccaaagtagcaaagtttaatttagtggattacgatgtataggaaacagcaactatccacagagaggaattacacaatggcgactaaaggacaaagccgtgtattgtcaacagcacgaagaaaaacaaaattcttgtcacgaggctgactgtaaagtacagcatatatactacctgtaaataatccctctcaattaaattcaaaaataacacatgtgcatgagcaagatattaggtcgacgattcagcatcgggtataaaagggcatccaaaaccttaaaataatcaaattcaagctgttccaagaaaattcaaaatctctacacctgatatccaaaaacctcccatatgcctcaaatattaattattgaatcaattagacatatataaatcaaatgttacgatagacgacacgagtttgatgttgacggctagctactagataaacttgatagcagaagaaaacacaacatgccatgttgccatccatatgaaccaatcatatatctcttgttttctcaatcctcattctggtttattagttttacatagtagacaaataaagagtaaattgtgccggtatatctgtgatggtattttgaaactcgtcgacagataaaactaatgatatgggggggggaattctatagtgttattcttgttttgattttccatgcatgcatcatcctgatcactactccaataatgtcaatactaccaataataatgtgttaatttcctccatatcttatatgctatctacttctcatcagtactaccactactagaacaacgatttttgcaggtagccaaaacgaaacagcagttggacgtggtggtggtggtcatcattgcagggaggattgatgccgccgtcgccatcgagaagccggctttccatggacgccgcttctaccaccacctccagcgccaacattgtcaccaagaccaccacgaggaagatgacaacaaacagcgcgaggagggtgcgcccttgccaccatgatgaggaggaggccaagacgagtcgttgccagatccgccgcctccgcctccctcatcgccggatccaccaccctcgtcggagaaccgtgtgccacggccgggggagcaccgccgctgctcccttcccttccaacactaccgagccccgccgttgctgccgttcgggtgaggaaagaggagctcaagagaggaaaagggagggagttggggacttagaaaaaactggtgtttcagttttcttttgcgtctatttaaatgccacaaccaaatttcaccggatggcttaagaggcccacctgcaaaaataagggtattattgcaggcagcccttttaagccatctgcctgcaaaaatgggaataggatattcccaggcggtcggccattggactcctctccacacaacgtacaactacacaggtgggcaatcgtagtcgaaaataagatctgcctgtgaaaatctatgtgtttcattgtagaaattcgtttttctagtagtatgccatccatcatcagccgcaaggagagagatgaagcaatgagcaatggatgatcttcttccaatgctagctatctactgtggctatgaacaagaaggcggacatatggaaacaaacctagctataaataaaacagagagaaaaatttagatgcctactaaatttgggcataaattaaataaaaaatcatttacactatttgaatggaaaatatgaataggctcacatttttcccaatacttttgtagaggaagctagcaggtcctagtccttgaacactgaaatacaatatatatgtaatgacaaatttaattagtttatcataaataaaagaaaatgttattagggaatagggatggaactctgctaattaagggttgttcgagttcaggctgctccttaagatcaccacggtgcggttttatggattggtgaagcatggtaaaagaagattcaaaaagcttacttttctacattttttttgaaaataaaacctttcttttgttttgttgtttctcagttaagatttttggaaactaacgatttttgtaagttttgtctatgtatagtatatctatttatggtagaaggtctgggatctctatctattatattgagacagagagagggagagaacaaacaagtgcagtgcatttgcaccggacctgcatgcagctttagtggttggcaattgccattcgaaatgaattaagaattggaataggaatatttttgttggctaccttgtgaaatgttaggtaggcttgcgtccacgcttgattcgatcacattcgatcaaccaatgtttatatatactttgatgaaccattaaaaataaataaaaataaactagtggcagctgctaattaactaattaagctgttaggttgttttagctcacagcaatctgctaacctatatatatccatcgaaatcgagttactgtgagagaggctgaaatcgagttactagccggacatgatttgtagtatctgacaattctggccgtatacggtcgttgcctagtttgacgtgttgacactgacttgttgcgtgctcacgatttgatttgattcagaattgaacggattagtcctaattataaattctagtcaatggctgccggcctagcgcatgcacatctccacttgtttaatttcagcctagctctcgcttgttccgcttcctccatcttgcgcaggagcagatcgagatcaacctcttttctactcgttctccgtgattttacctacttgcttggtgccatatatagcctggtttctctagtatctcctctattctctagcttctccccgagctcatgacataatcggatcgaggcaagtcaccttttcgtggaagttcataaaagacgcaaatattgtggaaggaactaatatcaaaaattagaaggggtgagacttcgtacccaagtcatctagcccaacagaagacccctgggcgtttcgcggaagttcatgtctctatgaacacaacttccaatccttggtacttaattttacaaccaaaatcaagaggattaatttgaagcgatgtagctctaataccatattgataactactcaagaacgcactcgaatcgtgcaacagacatgatgaatttcagttgtagctatgggcaaatcaatccggatcaagctagagcaccgccatcgctaggttcagatacaagctgagtctgtcatttctttccccttatataagcttagagcatgaccgatgtttaatccattataagatcctatggatagacacccagtgagggtagcacccttcaaaaattcttgcaatgtatagaactagtaaatgtcttataggtaggacgcgctataaatggcaataggttcatggtggatgtaaaggcctctgagaggcgggcccatatattctctcttctctatagccagatattatgattgttgactggttctatattaaaaatggtaggaaaaagtttcacaatatgtaggttagacttattcttctctctctctctctcccatagaacccctccaaatatcacattgtggatgctcttatacattacctactatttatatatttttttctcatcagataggtcgtgatctatccataattgtgtattattacacgacccatgtcgacccataatactttaaattattgtgtttttccctcctgccgcgtcttagctcctctcctgccctgtcttcagctcgatcagcaacatcttctttctttgatacaacgtctccctcagacccagcatctccctatggtggctaacacatacgtagactctgcaatcattggatgcagtactccaattttgccagccaattgcccactgcacgtacagtagcacatgtgtacattcttcttctttccaaattgaattgaccattataatactccccccatccacagaagttatacatattacttttgtcaccaagaccgaggagagattaaatcatctaggagtcaccaagaccaaggagagattaaatcatcttgcatattacaaaatcaaggagtgaatgtaaacatgccaccaatgagtatttagatgactcattgaattctaatcaaacatttaatttatcacttcatttaagtcttggatgcataaaaactacaaataggaacaacttatttggaaaagctcaaatgtgaaatatctaacttttgtggatggaggaagtagtaatatagcacatgcaaaatagtttgagatttgtgggttgctaaatttcagtcacatctttaaaaatctcgctcaaaatttcccaccgtgtgatttatgtcaagatttgtgccctgacgtcttccccaatgacgtcgggctagtagctagtgtcgtctccggcagcgcgagcttctagagacatggaatgacaattgaccgagggtacattgctggcgttcatcttaggaggatgagtgaggaagaggagaggacggggcttgatgatgaggtagagcattgatgggcgatcaagaagaagagaagataagattagaggattggagcattgtaggtgcacgaatcttagtacaatatgagtcactgaaaaacaactgaaattttatgatatttttggtaaaaaatattcgataatagtacatgggtagccgatagatggaaactgaaaacatacatgcagctgatatataatacaacctccatctcaaaaaagatcaacttctagcaataaattaagataagtataatattattttgggacgaagggtttgtaagggaatcccaaatgcatgaaggtgtggggcgtggcggtatccaagggagggaggaggtccatgctgcatgcatgtagtgtgaactgtgaagctagtatgcagcacgtaccctagcttgtttgctttcctgcaggacacagtcatctgacagtcatatactgtagtattaggctattcctaacccaaagcactgtacatagtttccataaactccacatcatcaagaaactagtactagacactactctttcaatgcaaacaccactatctatacttaaatttaatgctacttatctcacatgatgtcttagatgttgtgtagaaactatgtctcatgcaagacatggtttccttctatttctttatttatttacttgtgacatcattttttatcttagatggcagcctatttaatactatggacatcatcttaaccattgagttaggaatggccttagcttggcgccacctgcagggacactgcatctgcatggtcggttcatgttacagcgtacaggcctcaacctctctccgctatatacactctcctagctggctaacatgtgtgtctgcatgcactgaatttttgtaaattcgtatgctagtacatggacaagaatgcagagaaaagaaacagatactagctcgatgaatgaattaattggctgtgctaagttttgagtactctctctatcccaaaatataaacatttttaactatggatctggacaactatgtatctagattcataactaaaagttattgtactatattttaggacggaggtagtaactagctagtctttacataaacgacagcataggccagattagttgtgatgcttggcctctcggaattactcctacacatataactcatgaaattaatagtgctgatgcatttatcttgaactcattttcacattcaactatatattatacgtactctgttcgttccatgttactactatgtttcatattataaatcgttttaattttttgagccaaactttattaggtttgactaaatttataaaaaaaaatatagcaatatttttaatacaaaacaaaaaaattatcaaaatatatttaatgttagacgtaatgaaactaacttggtgttataagtgttgctatactttttttataaacttggtcaaacttttaagaagtttgacacttcaaaaagtcaaagcaacttataatatgaaacggaaaagtgtaagttactttagatttgttctaagttaaacatattattgaaaaagtagcaatatcagggaggagacaggcccataacaattagagcttaaattaggtctaagctagtctccttaatcccttataaatcatttcaaaatttcattcaaagtctaaagatttgataaattatgttggtttagccttaggtttaattaattagtaaattcctgactcggctcctggttccaccctccatccctaaattaagtgaagctacttttagtatagtaatttgttctaaattgaagttatagtaatttgttcacctatcatctcatctcaaccaatattaaccattttgtgtgtttagtttctacacctacgactttctctcagtcaatttacaaacatctcccaaatattttcaaccactctcttcgtttcaggctataagatgttttgactttggtcaaagtcaaactgcttcaagtttgactaattttataaaaaactatagtaatatgtacattaccaaattagttttattaaattaataattaaatatattttgataataaatttatcttgggtcaaaaatattattgttttttctataaacttggtctaacttgaagcagtttgattgtgaccaaagttaaaacattttataacctaaaacggagtgagtactttcttaatttgtgtgaagctgttcagggatgtttatattttgggatgaaagcaatacattttttttgtacaaacttgaaataagagcaggtacaatagcaggctataagtcagttataaacatattttaaagagataaaggaagagagagaagagtagctggcgacagatttgtagccagctgcagcacgggctccaagacgcaatgtgtgtatgacaggtggtaccgggtattaatagtatagcaagcaactattgtatgaattggctattacattggttatagatgatttagagctggcagtgggttataccattaaactcgctctaaggggagtactagtgtgcatcaggcactgtggcagctacaggctacagctagggcgcgcgtgcatctgatagatatgatgcatgcacacatcaatgcacgggcgcgcg

SEQ ID NO: 57900 - DNA, 104634 bp, Oryza sativa
gtcatctattaaaaaacggaggtagtattaccgaactatttggtccgttccttaaaaaaaacctcttaaaattcataaacacatactggccataaattttcatatagtagtattattttccaacatacgtataacatctacacgtgtataaattcaacatgtctatatcctatgtgtacagaaaataaaacattaaatagcgaaattagaacaccaaagaagtagtagcaagaatctcattattaaaaatcttcaaataaattcaaccaactataggtttaattgaaaattaaaaaaaataagagaaactacaagtacatagcaagtaacaccaagaatttcatatgattttgaaaaatatatagacaaatattaatatacatggtaatacacacatggctataaatttacaggcgtgctaatcagcacgctaattttctagttttacatcgaatccgattttcatccttgaacaccaaaaccagatacaactgatccccgaattatcaaaaccggtgtaaacaaggtccctcggtggttttgaaggcggttttggctgacgtggcgcctacgtggctagtttgactaggtctctgtcccacatgtcagccacacaaaaaaaaatctaaaaaaggtgtggcccacatgtcagctaaaaaaataaatatggtaggccccacatgtcatctccctctccccactcggctctccctcttcttcctcgtcacgccgcagcatgccgccgccgtgcatgccggcggagcggcagctgcggcaggccgtgggcgaaggggcccacgaggagcggaggggcggacggagcgaaggagtggcagggcgcggcgcggagcgcctcctgcctcctcccgttcctctgggggctcgccaacctcccgccgctccgagtctccagcagcgcgcccgtcacgccgccgctctcgtcgccgacggcatcgcaaccgcccaagttcaggaagccggactgagacgttgaccccttccggcaccccttcttccaagggcaaagctacacaagctgatgggggtgcacatgaaccccctgtatttctatttttagtgcttgatgtcatgtttttgctacatgtgcacccccctcatctcagttacgtgcaccccccaacgaccggccaaagcgtggcggaatgagcgcacgagcctactggtctgttattttgttttttcggttttactgatcatgtctatcgccaatactacatgcttatattgattggatagaggcaagggcatgcatataacttgctcatcttatttcttcaatttgtctgatttcttcacatcaaaccttaaagtttaaatatagaattcaattttagttattattttaatgtttctagatagtaatttaggatttaaataattatactgttttactaggatttaggaaaatggagtagtattgcagatcgatcctaagtactaatatttcaattagaagagttatggcactagcttcttgacttttaaattttacacacaccaatatatagtactcccacttaactagtgtatgtgtgttagtttgaagcataagagagacagaaatcctttgtttacgcatgctccctaaactgctaccaatgtgtttttctattaaaaaatctataaaatattgctttaaaattcatattaatcaattttcattttgaaataattaatactcagttaattactcacctcgttttacgtatcttctcaatctcttttttcatatcctctcaaacacaccctaatattattcaatggttcaatgtatcttgcaatgttgagtatcatttttatcgttcccccttcactttacattttaatgtaagaatttctaatcatatcttcatcatacacttagccatcatctagtatgatgtttaacaattgatagtttatcattatcttgtatagcatggcttcaaaatttcgtgtgctactgcatatacggttgaggtggtgcaccttcctccaatttgttctagcttagccactaccttcttcgcagtctccgcgccggcaagcccgacccgaggccgccgccttgagcacccggacacgataccggagtgcgacaagtctgacgtctcgacggtggactccggccggtggttcagcttccagatggccaccatggcgctgacgtcccgcacctacaacctcatcaactcggcctggtggattgggaaatttcagggtgaagtcttcgatgcgagtccttcccgtgcacgcaagaaagggcgctgtgctgtgaggagatcctcagctttgagcatccatggggttcctcaaccttgtgggcaactcctttgggtgctcggcttccggcgagcggctcgtctcggcggccagggacgacgacctgcaggaggcgcgcgcgctgctcgagtacaacccgcggctcgcctggtactccactttcggcggccgcaactcgccgctgcactacgccgccgcgcagggtcaccatgaggtgatgccatttgtctgccaaactaagctgaagtatccgtgtttctgtatagatgggtaaaagaactgcaatactgcattcacattttctgttgcttggatgttcagattgtttctctattcctcgaatccgacgtcgagatcaaccttaggaattacagggcccaggtaaaccaagatttctggtacatttagttgtttaagtttcacttgcgaaattcgacgaggggagggtgacgccatgggagggcgagaggaggcggcgtggactggggcgaaggacggcggccgcacaggaggacatgtggggagagggagatgacttgtggggccggatgtaggtagcgacgtcggtgtcggagtggccgtcgaacacggctaagaggctgagctcgttgccgtcctctaggcggtgaaactcggcggcgacctcctcctctggccacctccgccgcccgcaccctgccacagccgctgccgctccgcccgcccctccgctcctcgtgggcccctttgcacgcggcctgccgcagccgccggtatgcttcggccgccgtcgtcgtcgtcggcatgctgcggcgtgatgatcaagaagagggagagccgagtggggagagggagatgacatgtggggcccacgggccccaccatattttttttatagctaacatgtgggccccatcatttttagattttttttttatgtggctgacatgtgggcccatgatttttattatttttccgagatataactggcacgtcatcgccacgtcaatgtcacgtgggacggagacctagtgaaaccatccacgtaggcgccacgtcagctaaaaccgcctagggacctcatttgcaccggttttgacagtttgaggaccggttgtatctggttttggggttcaaggatgaaaatcggattcgttgtaaaattaagagacctcagatgaacttattacttttatatatgggcctaatggttgtgttttgggctctacttgggccttcaggttgtgacaaagaaaaggaagtttaattttactccttttatagaggccggatttagttcgtaattcttaaccgtaaaatcgggtatatatatcgacctgtctaactattaaaacatgttcaaatagactcctggactgtttttagggtgcttttttttttaaaaaaaaaaggaattcccttgccacttttatgtgggctctatgtttgttcttaattcctcatataactaggctgctaagttagacgcatgagccaaaaccgtctttaaaacagctaaggttttttttttcacgattttaatagttgaaggtaacagagttttgagggatatgtgttaatccggaaatatttgagggagttaacggaaaagtagcttgggctttcgtgttggacctctgctttggcgcggctgcttgctgtgcgtatgtgactccgagtgtgacacgatgctctgtgccaaacctgaaaccctgtgtgcgtgccgccggtaccggcgcttactgcacttgattgtgttgcaacttgcaatgatggttttcagatgcgacgacatgaaatcatatgggtgcagtaggtcgttgataaccagcaaaaccaggtttctctcttggcataatccgcaggacagacatgcatatggaggagagacctcgatcgacatatgtggcgcgtgtaaagtcatccatctgcgagttaattgcccacctgcacatgtggatcgttagttcgttggaagaaaaacaaggccacatcacatgcaacagaaaaagaaacacgcacgcacgctggttcttgctgcaatcggcatgtgattctctgtttcctcggtcgaatccgtacgcacaatttgggtgcgttctcggttgatcgatggccagagacatcatgcatgcatcgacgtatagtgtcaattactccattgattcacacggagtacgcaacagctagaggcactagctaaggccaggaagattacgctggccccacacgtgcaaccggtgcagaccgtttgcttccttatcgcctacgcgtccctaccgagcgcgagaaaattgtgattttgctatcgcaaaagaatggtttcgctggaatactatcccttcaaagtgattcattaaaatactattctaaatcaaggggtgttcactgaaatactattttagatctttttggttgctagaaatgattttactctattttaagttttgttctgaccaaaatactcttgtgtccttgtctctattatgttgtgaacagttgtgaaccatggtgcatgtgaactactattatgttgtgaaccattgttatgtgaggtattttgtgaaccacatgctattcaatattatgtctacatgctgtccaaaattgttctattttgtttttacaattttttcatgcccaaattttatgggttaagctagcttcaccattatatctttataacttggagtgagaaaaatcttaatctgtatgcgcgcttgtggctaaactggactacacaccatttttattgtacaaatgtgaaaacaaaatatattgctctagcaaagcatgtgtcaaaattaaccagagaggtgctgtttgacttttaaaccagtgcactagagcttactagagcttttgtattagtgttaatgatcaattagtatatacatatcacgcagcggagtgtgagccgtacataggtttcacaaatatatagcaatatattttgctctagcaaagcatgtgtcaacctgccattatcctgggcgaaaggaggacatagaggcgagggtattttggtccgaagaaaaactaaaagagagtaaaaatattagtactaacaaaaagatccaaaataacatttcagtgaacacctcttagtttaggatagcattttaatgaatcactttgaagggatagtattccaataaaaccattcttttacgatagcaaaatcacaattttctccccgagctcagcaagttgcagcggcaaccactggtgagtggagtggcgctatggctcagtggatagtcgctgatgatgatgctggtgcatgtacactttctgctttcattgtggcagcaactagcagccaaccacgccgccatagatagggaatagtggaatgtacctttcctggagaaaaataggctgaaattgggaagaagtttggagaaaattggtagtttgaaaaaaaagttgggagtttatgtgtgtaggaaagttttggatgtgatgtgatggaaagttgggtgttgagggaactttggtgtgaactaaacatgcctatagtacagtaattcaggaaattgtactccctccgtctcataaaatagtacagcaattcagtaaattatactacctctgtcctatacatatgtccagatttatcatattagaatatgtcacatcgggttctatatttgtgttttttatggaaggaaggagtatgtacactgcaatacatttaaaccctgtttaaagcgtttaaagcaagaaaactaaaacacacaagaataaaaaggtgcaagaaagcaaaatgcatattagctactcctagtagatgggaagcatcagtgcatctatgtgttgcctgtcggtggaagcaaagcgcgcgagccagccgccacggatgcgaatgggagcgcgccccttctggctttcgtgtgcgcgcgtagcattcactcgcagcggccaaagcaccatcatcctcgtcgcgtgcgtcatggtacgtgccgcggtgcgccgtttggttggcgaacgtacgcaagcagattcagcacgacgtagtacgagtaatggaatgtcacggtccgtgacaacatatcgatcctctcgatcgatctgaacggccggccgtcgccatgattattgatcgtgtactccgcccgccgtggtcaccaccgctacctccttcacctaaatccgatcgatcgattgcccccctcatcaccctgggcttagctagctacctagcgttattattgacattattgtgggcaatagaagggaataaaaagtcagtagctgctattagcactatatcctcctgcctatgacagtgtctcgttttcaaaggcaccccaaccccaaatcctgccctcaagtgatgaacgctttctgagtaaacaagatctgcaaagtgtgggcttcatccaataaagtactactagtagtatactagtattacatcgaagtgtgttgactgatacagtaacattaagataacacatatgcagtactgctacttttctcttgcaaactgtactgggtttcacctaatccaggatcactcggactataatactttgtctgttgaaaagcgatcgctagtatctaggattaggaattacgagtagggctgcacttcagtgtgcagttcctccaatcgcatgatgcatccagcatgtaacctacggccatagatgctccagcctccagctgcagtagcaccattgctagcattgttttgctcccggcaactagctggagtgcttttcttctcttcaccacctctacactactcccatcacatggcatcacatgaggtaggccaaatgctttcgggacctttttcacatcacgtagacagaggaatagctagcgatgttgtgggggcatttctttctggggttcaagatgaaaagctgaacaccgtcacagtttcttttgcacatgcatatgcaaatcgccaacgtacccaccaccttcttgatggagctaatttgattcgcggtgtacggtgtacgtcgcgcatgcgtgctcattcgtgcgcagcaaacacacgtttgactacccatggcacaaataggggtgaagtccaatttaccatctcgaaaccaccggagtgtagaaaataacaatccggtttttaagtgatggttttacaaatttgacatccaaatcgttcgtttttttactcatatggttttttcttgaaatgtcttatatatgtggtaactgttctttacatctcttgctagttgctagttgctagttgcctagctagatgtgccgcggtgaaaagtaaacatacaaaattctagtattgaatcgggttttggaatatcccatctctaatcatccaattgtctacatcgacctcaaatgatattgagggcatgtttggatcaagggataaattttagtccctatggatgtttagacactaattagaagtattaaacgtagacaaatgacaaaacttattccataatcctggactaattcgcgagacaaatctattgagcctaattaatctatgattatcctatgtgatgttacagtaaacatgtgctaattatagattaattaggcttaaaaaatttgtctcgcgaattagctctcatttatgcaattagttttattattagactacatttaatacctctaattaatgtccaaacaaccgatatgacatggactaaaatttagtccctaaatccaaacgccacctgagtccatcccatcctatgaccgctcgaactcccaccaccaccgttgcatcgtgccttctatagttatatgggggtcttaacgtcattaccaccccaatgtccgttgctaccgtggccacgtcccaccattgctcccgccgttggttggtttacttggttaccgcgaagtttatcgtggtttaaaactgatccacgcataataaccgcgtgataatcgtacggttttgcaaaccccagctgtcacaaataattttattttgaaacaacacgcacaaaatagtacggcgtttcgtaatgatagagtagaaaaaaattacaaaactatagccctagaaggctatagtcaggaaaaaaaagacaaccacaccacacgtcttcaaccagaaaatcgctagtaaagaagcaggaacatgacatcctaaagaaaaacgaacctctaaacgacgccttcaggaagggtatgacaccaaggatgccaccgtcgcccgtcctagggtttaggatgtggttttcacatagaggaatccataggggggcaaagagagatcactcaacaatgcctcaaggggaaaactgtgcccgcaaacgtcgtcgttgctggcccgaagaggctaggctttcactgtaatcttcctgcacccccgtgccaccaccaatcgcacaccttcgacgcgcagccaccgtgccggtgcctcttcgccagctgcccatgaagtaggagcttggcattcggcacgctccaaatccatccacagatatgttggaaagggatatggtgtgagggaagaatggatcccctctcccacacactagcttgccaacgtggtcatcttgtggtggcaaggcgctgccacaagaggactaacgtctggactaggacctgttgtaggcctgcaatgcccacctcatggtgccactgtcattgccgcctcggtcggactgcccgtgtcaccgtaggcagctcgttcgcatcgctaccgccttgtcctattaccttgtgccgccgccgaaactccggccaatgcgccgtacaccgtgccagctgagtctgccattggccgcagccccgcgcctcgctgccctccacgtcgtcgccgcatcggcctcctactgccgccgggcacaccaagcaccacgtcacatcagcctcggtcggccacggcttccttccatcgccgactgtgtcgagtcagcctcccgcaggacgtcccacataatggacacgctgactttctactccgtgtgctgtcatccattaccgaccgtccactgccgcagctgccaccacccctcccatgtgttgccactgccccgctgtcgtagctgccgacgtcagcctcctgcttccgccgatgtcatcgtcctgtagccgtcggcctcctgcgtcggcccctaggcatcatccgtcgcgcgtagccgctcctgagtcacttctcgtcgccaaccacaccagggacgcctcttcccgttgcccgtcgtgctgcgctggctgctcgaccccgacaagatccaagcggggacgccagatctggccatgggggcaccggatcaggtcagggcagtgccggatccaccgccaccatactagagttcggtggcggcttcccaagccctcgccagaaatgaagcatcgtctggttttggccgcaccgccctgttttccaagtgaactctagcagcagctagaagaagaggagggtgggagtggcggcagtgggcggcaagggttttgccctaagccgcccgtgtgtgggtgatgcggagctctgtattctattccaaattaataagttttgtagaatgattaagatagaatgtagaatatatggacgaaatttataaaataaggttggaggatgccagggtggagacatatgggggatattttgtaacacaagtatgcacaaacatttattaacgataaatataatttgtaagtaaaatttttatatatgtgtttctcgacttaaaagctaatgctaaaaataaaacacaatacaaaacatcaaaataaactttaaaaacatgttttaacattttatttagctgtagcggataagttgaagagcaaaaattgggctgtacgagtgataggttagatatgcttcaacaaccgttggatagttcgctagctacgcgtgctcactgacaaagagctaccccaagttagagtgtagtggcaaccactactagaaaaagtattttcacaggcggacaaaagtaatttttgcaagcagagggttggaccgcttgtagcacaacgatggtaaaaaatcaacgattttcgcagtcggggcaacagcccgcctgcaaaaatccataaaatgcacaaaaaaaatcacggcggcggctcgccgacgccgccacgcacctcgccgccgccgccctcctttggccggatctgggaggggaggggaggggagccgcaccccgcgccgtcgtcgtcgctgccgccaccccacgccgtagtcaccgccgccagcctcccccctccctcctccagccggatctaggaggggggaggggagtcgccgccgccccgacccatcgtcgtcgccgccggcagcctcccccctccctcctccggccggatctgggaggggggaggggagccgccgccgccggcctccccctccctcctccggccagatctggagggagaggaaggggagccgccgccgccgccgccccgcgccgtagtcgccgccactgccagacgccgcgccgccccggacgccgcgccgctgccgaacgccgctgccgcgctggccggcctcccccttcctcctccgccagatctgggaggggagccgcgccgccagccggacgccgcgccgccccgcccagtgaggagaggtgaggggaggggagggagggaggggagccgcgccgccagccgtacgctgtgccgccagccggacgccgcgccatcgtgccgccttccaagccaccccgcgccgtagagccgccgtcgctcccccttcggcggccggggagaggaggagaggtgaggggaggggagaggaggaggcgtgaggggaggggaggggagaggccgtgaggtatggggaggggagaggccggccatgggtgaggaggggagggtgaggtgtggagacttagaaaaaatcaacccctacccaagtctatttatatttaagtctattttcgcaggcgccgcttaagtggtccacctgcgaaaatagattttcgtaggcggaccgaccatttcaccccgatttatatttttgtaagcggttatttggttttaagagtcatatccgcctgtgaaaataaagcccctatgtcgggaaaaataatttttctagtagcgaacaactcagatatgggcgaggaattttgattgagtaccatcaaatcatcattgaaaatcagggggtgtgatagcaatatcttactgattactgctagctggggaccatgctagcacggcatgagaccatacggacaaaataatagtcgaaataaaaacgatgttggacagttggaatccatcttccaaacgtacgtcattgctaattctgacggtgcataataagggtcgtcgtcgttgcaatagtgtcgttttcccggtaaaaacgacccatatggatgcgagtaaacaaaagggcgaaacattgcatgtgcggccgtgcacaccgcagctcacgactttcttccactctttcctggttcgtgtttcacgccctcccaaactggatttgctgtggcaaagagacatactagtagtgcccccccccccccccccccaacgttaacgtttctccaacactggggggtgacgtggttccgacttccattgcttctattagcaagtctataatactatagttaaccataacatatatataataggttaaccatggcagaatccaaaaaacttttttttatcaagaagctcccgtgtcgttctcacgtgggcggctcaggggcgaaaccctagccgccccggcgtcgccaccttcctcaccccctctggctgcctagtcaccaccgaaaaccgtgcagccaaccgggaaggcggcagcggggaaaacgagccggcggtggagctcctcagtgtgggaggcggagcggcgcaagtcgggcgggaggcggcggccggagtggtcggcgggacggatttgcccccctccacccacggccaaatcgagagtgggtgattccgacggcggcacaacccggtgaggctgaggcatggggtgacgcaacggttgtggccagtggaggaggaggccaaacgtcggcagggaaggggcaactgcgacaacggtggcgaacgccggcacggcgcgtgcgaggaggcgcggccggcggtggcggagtccggagcggcacgaggagacacggccgctggccggtgacagtgaaggccaacgtggtgcgaggaggcgtgatcggcagcgtcagcggcaggcatggccaaatgccatcacaacgcaacgagggtgatgtcatgcggagactggccggtggtgcgcgcgggtgcaacggtgcccacacgccaacggaggttagatggcggtagagcaatggtgtgtcaagtgtggataggcaggtggcgggcggccggtgaaaacatagctcagctttggccaggccggcaattaatggtggtgtttcgagtgtcactccccgtcttaagggcgttgtcgtgccgtctcatcccctctagtgcggctgcagggtgaaaacccagtctgggttctctttgagaactcaacggacggtggtggcggtgctttcatcgcttctctccctagagacgtcgtctaggcagctcccttgccgaaacctcccaaacaactagtgcaagctagctctatattcatgtcctattgtgtcggtgtcctagcaagagcctagggggagagcggcaccgcggtgcagcagtgtcctctgcgtcagagttggcacattgaagggcctagggggagagcggtttcattcttctctctcaccctctcttcctcaatcccaaagatgtagatagagtggtttttttttaagggttgggttttggacgatcttggttgtggctcctttgttgacctagccacggccggtcacgcttaacagcggtcgatctagtggtagcattctcccgggtttgtgcgttggtgctgttggtgcgtgagtggtgatatactttttttcgtttttcctggtaatttcttcatactctatcgatacgaaccttgtattatttggtgcgagtcgttaaaaaagattaatcataaggttgctctattttttctctcatttctctttatctcatgtaaatttaatgtaagtattttgaagtaattgtataactagctctcacatgagagctaatactcctcttttttttaactttttttcacataagtttatagttagcttacagagttatagcccactattattctagatcctgatgctactttacaagcagtgtttatagttgctatttatttttataaattgtactgggatatagaattgaacgaaactaccatgttttcatagtgtcgttggaatgatacgataatactactagcagttaaaacctttttttaaaaaaaataatcatgttttattgcggggaaaaactaaattaccttagcccaaaactataattgatattcctatcattatcttcaaaaaatcgatattcctatttattactactaaggaactagtactctctaaagtaaaagagatagagtgagagaatcgtaatatgggtcatcttctgttgttaaaggtttactttggatttgccctaaatcaattattttacttttaatcgagtaattcttgcactattacagtttagattagcctaaacaacttgcacggtccaaactaaaatagcaaaatcacccggtctaaaaataaaaaagatcagtttagggtggtcgtccaaagtaaaaattttgacaataaaaatggcttaaagtgcaattcacttaaaaaatataactataattgatattcctatcattatcttcaaaaaatcgatattcctatttattactactaaggaactagtactctctaaagtaaaagagatagagatagagtgagagaatcgtaatatgggtcatcttctgttgttaaaggtttactttggatttgccctaaatcaattattttacttttaatcgagtaattcttgcactattacagtttagattagcctaaacaacttgcacggtccaaactaaaatagcaaactcacccggtctaaaaataaaaaagatcagtttagggtggtcgtccaaagtaaaaattttgacaataaaaatggcttaaagtgcaattcacttaaaaaaatatttaatatttggaacaagattgggtaaagctttcaaaattttgattttatattaaaatatccatacatacgatttttgaaactaaatgctactgatggttaaagtataaagagtttatcgaatcttatgctaagcactcaaaatttacgaccgaaggaagtactccctccatactcgtaaagaaagtcgtttagaacagcgacacgatcttcaaaacctaactttattcatgatttatattcccaagatttgatttaaatattgtccgagtattttccaggatggcaggacccgtcgagagagatgcaaccgaccttgcacaactgcacgtatatggccgcatcgcattacggagcgcagacagtaaaaaaaaggtcaaattagtatgaccactgcgcgtatacgggttacgagcgtatgaccactgtagctacagggacccaccagtctatgctactatagtactacctggcgttgcatgcgtcctttgcggtgttgactttaccggttgcattggtttccgtttaggcaagccgattcgtcatcgacggagcctcagatatgcgtcatcgatacttggagcccgcgcgggccgacgggatttacaatttttcgttgaggatttcgtgagcgacatgtccgagccgcggcatctacagaagtccacagccgtgtgcctaattgccaatggactacggagtactatatatttacgcgactagtagctggggtagcgacggaagtaagagcatcttcaacagtctctccatctcactcttcaagctaaattttagctattatagtctaaaaatatgctccaacagtctttccaattggatggctaagtcatccggctggccaaaacccctcctccactagcctaatttggccagccagaaaatcactggcctcccacccccctcctttggcccggatggcgcaggcggccaagacctcgacgccgccgccgatgcagcgccgtgcaccaccgctagcaccggcttccgtgcgccgcctgcatctccaggatggtgcggcggagctcctcgaccacgagcgctgggccgccgccgccggcgaggagggggccgtggcggggttgttggggagccggcggcggagagcacgacagcgagtgtcttgaacccatgccagagcgccaccatcgttgtcgaggtcgctagccgctgtcaccttcgtctgcaccatcgccagttgtccccgtggttgccgttgccgtcgtctggatctggcggcggccgacctccgttgcctccgtccccaccggcgcgatgtggattcgggcggcgcagcatagattcgggaggaggatccgccgtccccaccggatttgggcggcgcggcgtggattcgcgcggcctccgccgccttgctattcgccgccgccaccatccccatccactacggtaaccgtcgtcgtttccattcgccactgttgaggaagaggaggaggggggagaaaatctagaggaagaggggaagaaagaggaaggagggataatagaggctgacatatgggtttcaatgtcataggctcgaaatagggagtttagatggtgaggctgttggagtgaacaatgagtttgactgaccaaatcaattggctagctggctatatgggtatttggagagtctattttgggtagtctattggagatgctctaagtgagtaaaaaaaatataagcgagttataaaagttgccacatcatatgaaggagagatgagaagagagagaaagaaacgaactaaagattagtagccagttgtagcatggactccaagatatatatgaattagatattaattatgcagtgcatatctacaactaactattgtataagtgtgctattaggttggttacaaatgatgtttcaatttttagagctatggttggctatattattaaacttgctctaaatgaggcgagagacgacagtggggagaaaggaccgaggatatatgtgcaatcgtgcatggcgtgcggtccttgggttgagatgacgaattggttatttccgttccagcggccatggatcaggagattccggagacgaaattagtgacgttatatcaaacgtttcacacaccaaactcttcaaatagaaataatggcatcttaatacattctggagcggatatttctcctacatggtaatccatacaacaaaaggtatttttaaaatctatggcatccacctagcagtacatatcacctctttcatgggcttgaccttagcggacaacaccggcaaggcatggctcaaccaccaccactctatcttcggtcgaggtgataatgagaagtaggagacaccagcggacgataggttatggcttgggatatatatctggagtggacgagccaaagagaagacaaactcctcaagctgtgcaacagagacaaaacctgcggaggtacgacagctgagaccatggagctgagcagcaactcatggtgctcaccatccatggttgcctctacatcttctcgtgacggagcttggagaacgggaaagccttgagcttagcgtctattcgtcaccatctcgaggtccacgtcagtccacccccacctcgagctgcacgtctatgaatctcttccaccctaccaagctcgagaaaacgatggctgtctgagctatggtgttcgccactgtgttgatagctccagcaatggccggcgtagagagaagagattaggagagcagagtttgagcttcgtcgccggctatcgcctcaagtgccctctgtgaggggagcatgagcgttaagaagggaggataggggagggcattgttgagagatatgacatgtgggcctatgagtttttattttattcttttatcattggattgacacatttgatgccacgtgtactagcttaggtgaatctggccaaacaatatttaggcaatgtttttcttacacctttcccaacctctgctccctcattttttgcgcatacgctttccgaatcgctaaacgagtacgttttctgtaaaaagagttatacaaaaagttatttaaaaaaacatattagtttatttttaaaaaaaagctaatacttaattaatcatgtacttaagtcatttcgttttgtgtgcgcgagggattagttccaacttcataagaagaacacaaccttagggatgcagcgagtgtctatttttttaaaaaaattagagaggataattcactgtcgaaaacttgagatggtagctcagactttttattatggcaattaaaaaagaaacagtaccatattgtagtcgccacgtagataaagcggtaccatctgcacatgaaagccctagcaggctagcacctaaccaattcctctctggaattcttctggttgtgccgatggatcggccaccccaccgaccgacgcccgcacacgcacagacgcctcgtccgtccgtctctcgtctcacctcgtcctccccaccgcattcaaaactcggctccacttcaccacttcaccagtggcagggcacgtaaatacctcggaaccacggtgtcgttatccccgcgtcgcgctccgccatttaaaccccgcgtcccccacctgtcccttttcctccgcgtccatttccatcacgctccactcgcctcgctgcagcaacctccttcgctcgagagagagagagagagagagagagagaggcacagatttttgggttcgtttttgaagtcctcgatccagccggcggaggggcgccggcggggagcggaggccgccgccgctcgatccggtgagccacattcggttcctgagctctctctctttctcagtgtcgtggtttccgcccgggggggggggggggtgcttgcttcggctcgaagcgtgaggggtcgggcgagcgggcgctgtcgcctctggatcttgcccctgtcgcttcggtgcacgcgaatcgtggggggctgggcctggacctgaatctcttggtgtgctgtggattttttttttatttcgattttgatagttcggatttggggtttggatccgggagttgccgtggttctgatttctgaacttccgatcagctcgaaacgggacggtccagtcaatgaggagagtgcttgggttttgacaagccgaggtgaaagatctgaagtgattggcactaaaattctgtttagactaccgtttggttttctgtttctctgatctgtgcgcggaccgcaaaaattggtggatgcataagttccgagtagctgctgagcattgtggattttggttatgctctgcccatgatgtttgataatcgaatctgagtcaagaattttgggggcattattatctgtgttttttggcattagccttttcttctttgggactccgttttgtttttgagggtgagtgacgttcgtaccgttgtttgcagggttttgaagtggacgaggaactgcttttatggtgggaagttgtagtctaggaagtgattgatatttgagcaattagtccgttgtcagggttgtaacttgtaagcaacatggagggggcggttgctagcaatgtggagcttgattctgcagtcttccaagtatcctcagcccagaacaggtgattcttgctaagatattttttggctatagctgtttaatgttcctatctgtttctccaagaattgggctcaacaaatttacatacgatgcattttattcctctcctctataatggactttccgttttcctttctgcgttaggtttgaaatgggaattttgtacatgatgtgctgatgattgctcaagtcttttgtgattcacaatttcctttaatgaaaatatgaacctcaccctgcagctctctcaaatatttttttctacagatacgaggcaattgcttgcagtaaagggaatacagaattgattgcatctggtccttttgatcaattagtcctgcacttggaagatgctaggaagttccaatcgtgttcaacagctggcacttttaagctgtcgttgtctgggaatgcaaaaggatcttcctggttcacaaaatccaccatagcacggtatctgcaatcaacatttttctagtttttatgtttctccttgcagagaccatgacataattggatcccccttacaggttcctgaataccataaattcaccagatgcctcaaaatctgcaaatggaattttacatgaaatctcacaactggaggaaactagaaagtttcatcaatctctctattctaaggtatcacaactcttcccgtaaaatacccatagtttttagtcacgacgacctgaacatttcaacgtagatgccattataatgagcatttatcttttgtaggaacaacgaaatcctatgggtggtgctttatccggtacattgaaagaaatatttggtcatccattgctctgctctgtcttacttgaatgtccttacaacctttaaatgcacatgtgcacctagactcaacatactacaatctatgctagattgcatttaccattttagtaccagtttggcttgatcgttcagacttttactagcaatggtagtattcctagttgagattatcttttgctgacccttagagtagattaattgttctctagttgagattatcaatgattattttgcttgtagttaacagcaatagttgtcagcaaaaaaatctgagaataatccatccttctataagattctgttaatttgttgtcggtacatttgcaatctaaagtaaccatgtatgcctcaaggtcctcaacaagtactcaaaagtgttaatttattgtagtatgttgataaagcataccttcctttaggaagtctcttaacaagggcagaggattttctgttagaagctatttgtttgagtaggggaattttagttgaattctctaattattgtatcaagcttcaatggcccttaaaattttatgctcactttattgcaatatttaatcatctttgcaggaggtgtctttggtaccattggcgtagaacaacaggtgaactgcttttcatttctgcaagatctgaaccagctttatggttttgtattattttaagtcttacatttcattcttaaaatacctttcagggaaatgttggcccaaactcatctgaagcaacaaagtaaacctttttcttctttttttttttgctactttatcttgcccttcttttagctgacgatctatatgattactatgctaggaatgaattgcttcgagctctggatttgaggttgactgtactgaaagaggagatctttgcgttgttgaatagagcagtcgtttccaatatgtcaactagagatgtatctgatttatcctcatttgttcagcacttcggtgcatcagagttcaggtatggtccatgagcattgtgcatgcagggttcaaggccactgttttttctactaaaaataagtgtaaatgccaaaaagtgttacttagtaggtcaaataactatcctatattcatcgataagtccacttatttataattctgtcattatttggaagaaaactgacctacctgatcacttggaaataacgtgcttttttaagactgtatgttacatcctcatcactgaaattatgtattgtttcttttaattcatgtatcaagaattaactgctgtttttcttgtttgttagctggttgatgcggtgcctactgttgatcccagactgccaaccctctgaggtctcccaacagcagtctttccctgccgagaaagatgacaagggagaaaatgcacttcatactcgtaatatcagctctcataccattatccagaggcctattaccaacaatgtttccccagcaaagcttgctcaaattgagcgtgaaagctcaactgaaagtgatgattcttctgagtccagtgctgaagatgaggctgtcgttgaaagaagccggccactcatgaggtctgcttcacctaggagatctgcttctccaatgcgaagggttcaaattggtagatcaggatctcgtaggtcaacagcgattgccatcaagagtctcagctatttcccccctagtcaaagaattcctttggataaagatgatgaaagtggcagttgcaatggtgaaactgaccagccttcaaggaaatctgacaataatgtaagaaggatgagtgtgcaggatgcaataaatctcttcgaaagcaagcagaaggatcagaatccggattcgcaaaataagaaagctggcttgtttgctacaaagtcagtactaagaaggtggagtgcaggaatgggtgattccttgaacaataattcagaagaaaaaaccatagattccacatcccaaagtaaatccaacaatacaggatccgattcagagaaggatggagctgaaacacaggctgagccaggttcagcttcagcttctaacactgttgttacgccttctgttgaaggttttcacactaatatgcaaggtgttgcaatgccagaaacagagacagcggtttcatcccatactgaaatttctgctgagcagacaaagtcagggcaagaggaaaacagtgatcgggcaatggcctctgctgagtggaaccgccagaaggaagctgagcttaatcagatgttaatgaaaatgatgcaagtcatgcctggaaagttttcgagtgctaatgtcaccactactggcatcacttccacaaatgagaagaaaggtggactgcaaggtcagcataaagagaagcgagactcgaaagttcgaaccgataaaggtggaaggcggccagcaaaggaggcaagcactaggcccttgaaggaaacagttgggcagaagaagcagcaattacccccaaaactggcactgcagctgagaaacgcaattctccagttccacaaagggcacggagaaattcatcacctccggtcctaccaaaagaattgaccccaaaagcgcctgccagaaagagctcacccaaaccatcacctgcacctgtgacccgcagttcatggtcaggtggatctttgactaaagcaactactgcacagaaaactaaaagctctcctgggacagtttcagcaccgacagcaactagtcggagaaggactccagtagcaccctcatcttctcaaccaacttcaaaggtggaaagaagtgctcaaccggtgaagaacaaaaaggaaacagttgctgcttcaaagccagcaattaagggaattgaagaaaagaagactaaaacagcaacaaagacaagcaggctagctaaaagtacacctatttcagatgaaaaatcaagtgcagcaactaggccaaacttgtataacaaggttgcaaagaagagcagtgttgtaccgctagaatcaaaaccatcaaagaaagctactgggattagtcaaagtgctggtactgatgctgtgaagagtaagatgccacaacttgatgactcttccaatgacattggaaatattacccaagctgaagataaggagcactctgctgtgacaacccagccaaaaactactaaggtattggaggctgatcttgctcaaccagcacatgatgttgatgaaaatttagaaatttcgctcgataatgacttaaatattgaaaaaacagaaaattcggccccaagtttagctacaacagaaatggactccagtgaacaggttgaacctcacactgaggttcaaccacctcctgaagaggacatgggcatctcatcagctgcctgggtagaggtagagcatgaagaagttactgatgtgggtgaaaatgtagtgcctgaggatgtcacctcaccatcaattgagcccttgccatcttcaagccctagaatccgtcactcattgtcacaaatgctgcaagcagatagcaatgagccggaaattattgagtggggaaatgctgaaaacccacctgcaatagtttttcataaagattctccaaagggattaaagaggcttctaaagtttgcgcgtaaaaataaaggacacagcaacagtaatggttgggcgagcccatctgttgtttctgaaggagaagatgaacttgaagaaccacgaggtggtaatgaaggtgtaaattcgagcaggagaacatttgatggccccaagactaacagcatcttatcaggtacattttctaccatgagagggcattttttctgcagccagtatagctataggagaaatctgaatatagagtacaagctttagtttttgagctgctctgatttcaccatttaacagcgcatgatgacagtaggtagaaatgcatttccaattcccacatgtttatacacacttaagtgaagtaactgaggtcacaacattattgtttcacaagagtaccaagcaccttttttaaaagaacttgtctgcagcgaagatttatgggatgcttctgaaatggaagagcagattatctttcatgcttgctcacattgtgtttatatttatttcctttctatttcaactatgcttattcttccccagctcaatcaaccaccggcagcttcaactcaacgaattcagacaggttacgggataggcctggagctgccccatcaactaaatgttagttcttgcaaacatagtatcgtcatcacttgcattatgattataataaactgcagccatctctaatacatctttgctaccttgtacttccagcgtcaaggtcgttcttctccctatcaaacttccggagcagcagatcaaacgagtcgaagctcagatagcatgccatgttctccaggagatacatggataattggatagtcgatcccttccagtttggaggtcaactgatgtaaaaaaaaagagatggtttgagattgattgattgttcggacggagccagcttgttgtgtttggttctgggttttctgcaatttgatatagtctctgcgtctaatgtcatactcaacctctcacctttcttgtacatcttttcactttttaacagttgctggaactgcaagcttatttggatccggtcgatgttagggaaactggtgctaatgtaaagtgcatagcgtgagcctgaggtgctcacagccgattgcgatgcccgaacttgatctgacgtcgtgtaactgttcaatgagcctgtgtgcaaatgcaatgttgcaacgacaccagcttttagggggaaaatatagcgtggaaatctgaaaaccactttgggataacaaaaactagacgtataagatttgttctttgcataagatcacatggatagaatagtcgtttactagctatttgtaggacatcatcgcctcaccagctgttaaacataaacatagggtgtgtttagatccaggataaaaagttgtggcttgtcatatcggatgtatgtatatttaaagtattaaacataaactaataacaaaacgcatttaaaatattaaacatagactaataataaaacacatttaaagtattaaacataaactaataactaaacaaattacagatttcaactgtgagatgaatttattaagcttaattaattcatcattagtaaatgttttattgtagcactacattgttagatcatagagcaattaggcttaaaaaaatcgtctcgtaatttacacgtaacctgtgtaattagtttttttttcctatatttaatactctatgcatgtatccaacattcaatgtgacaagttgaaaaattttaccggggcccatagaccatcatcaaagactttgcccagtactaaagtgcaagtcctgagaggaacagattgtcaaaaaatacagcatagtagcagcgtttatttaccacacgcatagcatttatttgctgccaggaatcatcctgctacgcaacgcaaccaccagcaaaactggaaagcgaattcattggtttgtctgcagcccttccagaaacggagaagctgtgcatctttctccaagtctcaaaacacgtgggaactacagagagaaacaatctcgtcgtggcgaagaggagcagatatcagtatatcaccagtcactactattcactagtactccgtagtcaaattagtcatcatttgtcgacaacttcgatcagcgtaggctcatagtgatctggggcctcgaagccatgaagattcatgactgttgccgcaacgttggcaaggccggcactggggagatctgaccgaaatcttacccctggttgaagcccagggcctccaatggcgatgggaacctgcagatggtttcagaaagtgaggtcctaaacagcaactgcatcctaatattgttaacacggtgtattgcaaagcaaagcagatctggaagtgagcctactggattcaaagtgtgtgaggtgaggggctggacatttccatccttgtcgcgaagcggtttgccagatttatctcttttcaccatgtcctccgcattgccatggtctgcggtgaccacgaaaatgccacctacttgttctatcgcatcgagaacaatctgaataagagaattccggtccaccatgagtattttcaaacagtgaaaatcatgcatacaagactgaatggtgaattggtggcctatcaattgttaaaagactgaaaagagagagagcactgcagacatgatcaccttaacagcttcatcagctgccttgcacccaacgatagtagcttcaatgtcgcctgtgtgaccaaccatatctccatttgcgatgtttacccttacctaacaaatgaccaaaataacattaggcctattaagtggattagctgctagtaacaattatcacgccctatctatctgaagtctacccgatgcatggcctatgagctctttgttcgttcttctgaaggaatttatttgttaaatacctgatcaaatttgcgactcaggatggcatcccttgtcttcttcgcaatttccacggccttcatttttggctgttcattgaaggggataccaatgtcacttggaatttcttcgtatttttccaggtttgggtggaagtagccagaccggtttccattccagaaaaaagtgacgtgaccaaatttgactgtctcactgaaaattagaatgacaagatatgaagctgcatgctcaagtaccaacactcagagcaaacactttcgacaagataatgaacagtattgtacctgcaagcatatgtgcgtatgccattgcgcgctaagtattcgccagacgttctctctatctctgggggagcaacaagaaaatggctcggaagttttagctcaccgtcgtactgaagcataccggcatagcgaatcttggggaacctgacacgatcaaatttgtcaaaactctcgtattctagtgcctttgcaagcatgaccatccggtctgctctgaaattaaatgtcacaacagcatccccatccattatagggccaatcggtcttcctctttcgtcaactataacaaatggcggtaaatactggtcattggcctttggatcctccctgagcttcttcacagcttcaagggcgttttgaaacttatgtggcgcttcaccgagaacctgtgcatcccaaccacgcttcacaacttgccagtcattctgcagaaccagtgaaaatttcaatcatatttttggcgcagagaaaattgtgccatgacattacaaaaggcaagtattgagcagctagcttcggacaacctcttatgttaagaaatgcagctagcatatgcaacataagtggtaagatataatgagttcccggagtagtaactgaactctgaattcaaatgcttgacacatactccctccgttatcatattataagttgttttgacttttttaaagtcaaatctcttgaaatttgaccaagcttatagaaaaatatagtaatatttatagcactaaattagttattttagatccaacatttttttgtgtaaactattagatccaacattgaatatattttgatagtttctttattttatgttaaaaatattgttatatttctctataaatttggttaaagttaaagaagtttgatttataaaatagtcaaaacgatttataatatgaaacggagaaaatacctcataacggtccatcgtgacatacatcctgccaccaccagatgcaattcttgcatccacacccttatcccgtaatttagcaaggtcattctcaatcaattccacaaacttgacactgctaccgtccaacacatcacggccatctgtaagtatatgaacccgtatccttttcgctccatgctcactggctccttttagaagcagctgcaagagcccaccaaaagaacattaacaagagaaactgagatagttgtactactactcaactacaactgatcgacggatgaagtttgaaatttaattatatcaacctgcagctgatcaatccttgaatgtactcctccatcgctgagcaagccaatgaggtgcaaagtaccgttctcgaaggactgttggatgtacttaaaaccttccccctcgtatatctttccagaggctagcgccatatctaccagttttgcactgcgcattgtcagcaactgatcagtaacttggcatttgagatgtgcatgcaacactcatccatgctaccgtagtttttggaacaatcaggttaaggtgattaaagctggtcatactcacgcatgatagtactcctctgttctaaaatataagactccttgtgattcggaaattcaacattgaaaattttgacattagattcatatttcaaatatttccatctgatattaatttcatagttattgataacaaattatgaaagaaatcaatggtcaaaatatacatatttttacataaacggtcaaagtataatattggagaccctgtaaaagtctaatacatcttatattttaaaacagagagacttgtccaggaagaagagtagtgagataaaattattcataataaaagagttaagattcagcattcaacagctaggtccctgtgcaactgggctgcattactacatactgtcactggagggtgtgaatgtgcacctagagaattagagacattaaccatcttaaatgaacaagccttacttcagaagatatttacagcaggttgaaaagtaaattacgttctacttcatccgtctttcatttttcatctatcgcacatatatcaataaaaaaacaaaaataaactataatactcttactttatcaaatctcaatgcaattattttctacttcatctactcctaatatatttatcccctaattttataaactccgtgatcgctaaataatgaacttattattttagtacaaacggaaagcacgaaaaatgaaattattataggatagagggagtatctagttagcctgaacaacccaacatgcatttttctggtgtatatactactccctccgttccaaatataaggtattttttatggatgcatggaacatatcctaatactatgaatctgaacggactctactatctagattcataatattagaatatgttctatttatctaaaatcgcttatattttagcatcgagggagtaatatgcagagtaacagaattgcaggtacatgcagaaaaccagaaatcaagcagagattgctgctatgctactatactagtacagtaaagggcccctttgaatcgcaggattgaaaaaaaacgtaggaataggaaaaacgtaggattttgatagaaatgtaagtggaaaacagaggattgcaaaacgcaggaaaaacacaggaatgaccgtttgattgaaccgcaggaaaaacgcaggaattggatgagagagatagactcaaaggaaagttaccaaaagattgaagctcttgctaaattttctccaaaatctctataagattgtccattccataggaatttcaaaggattggatatgattcaatcctttgtttcaaagggcttcataggaaattctatatttcctatagaattaaaatcctctaaaatttttatatgtttttcctccaattcaaaggggccctaaaactagtattacccctgggcatatatctggcctgctccaagcgcgttgtggccaacctcactgttgcccatgtcgtcgtccgtaggcagccccaccgccgtcccgtgagccttgatcaccctccacctctccggaccaccctgcacgcgccagaaaacacacacacaagtctcgctctcagctgatcatcatgggaagcatcaaacaaacgtcttgttagcgttgttactaccttcttgagggcgtcgagggttggggtgtcggcgacgtggatgcagttgaaggtatccggcgccgcctcgccccagccgtccagcaccaccacgcccaccaccttccccttctccagcctccggtgagccgccagctcccaccgcctcgtctccgccatcgagaagaaaaaaaaaacgttgttcgtctgcctcgacgttgttcctcttctctggtggcgtcccgccgcgagccaagctgaagttaggaagaggaggatgtctggcttctttttatgctgcaactggaagtgtccgggcgcgacgaggcagctggagagatgtccaagtgttaagaggcacttctcgttgtttagttctttcttgtgagcttacgtgacagtgtgacgcggacacatgtcgtgtgaccccgataatcatccatgtatacgttcgtgaacctgcctctataaattttcatcttaagaaagaaagaatcccgccgattggaggcctataatccgtcctatcgggctgagttttcacaacacgaggccgcgtcatgtgcgagagaggcccaaagggcataaagaacccgggccgacgaacccgctgatctgccgacacaaagtgagtcgttcgccgagatggcccacccgtttccatcaagagagccgggccgacacaccgcgccggtcgtagtcgtataggttgtttagttggcatactcacattatcaaaacttgctatactttatttagctaacatgtctaacatgtggccaacaaaattaaagccacactttagccatagtagagtaaacttgccacacttttatgtgccaatgatatgtgggacccacatcacggtgaaggaatcttatcaaaagtgtggcaccaaacaaacgaatgtctaactaagttaaactttggctaatttgagttgtggcatgatgaggcaaattttggtagtgcggggctgcgggcgcacacggagctctcggcgagccgcgcggggagcgccgccaccgaccgctcgggttgccggattcccagccgacaccgacacggctgatctgatcaatcaatctgtggctcgcggatctctcatgaaaccgagggtggcgttccaaaaacaggtggaatcacgacggtgccgtctctccatcctgtttgccaagttccgtgccagccatctgcgttttctgccatgccaccctgacgccacactgcagaactccacatgcaaactgtgtattgggggggggggggggggggtggtctgcgacttgtgtgcatatcgagtgtagtcccggtgtgtgccgctttccgtagttcccacggtatatcgagtgtagtctgcaggcgcactcgccactatagaatatcatcggcatttcgttttctgctctttgcacgttctttacccttccctcgctaacatcaaaagttggacgagccgctttgcgtgctgggcttccaaaagcaacgctcaaactgaacgtgatataaaaaccaactcttcctcctctgacaaagttacgatcataccggtggtctttaaactacatgacgggctgaactaccgtagaactgacaaaggccgtgtttagttccacagctatttttttaaaagtatatgaacacacatttaaaatattaaacgtaaactaataataaaataaattacagattcttataaattgcgagatgaatttattaagcctaattaatccgtcattagcaaatggttactgtagcaccacattatcaaatcataatgtaattaggctcaaaagatacatctcgtaatttacatgtgaactgtgtaattatttttttcatttatatttaatgctctatataggtgtctaaatatttaatgtgacagatttttttaaagtttaaaggagactaaacacaatcaaaagtgacgagagcatgggggtgttccttttttttttataccctccctgtctcgtctcgttggatgttgctggataagccggcctgtagtaacagtcgtgtatctagggaaggatggcttctctcgtcgtctctttccgttcattttccagagcctgacactgccgattctcgcttagaataaacgacctggcacctggcacagtgccatgagttattttcctacaaccggcccaatccaatgaatccatggtctcggtttactcaggcctctagtatgatattagtatctgccatcccatttacgtgtcagcaccgggcaaattagccgatagattaacaagacaactagtagcatgtatcatgagtaagcacgcgctgcggagttgttaatagcagcgcatctcggacttaacagcttaattacggtgagttcacatgcggagcacacgtacaccaagaatggccatcccaggcggccgtttgctgatgataatgtctccccgtcgtatgctgctaataaagtgatcacctaccaccgtacacttcctgacacatgggggagttagttcgtcctttctttgagaggagcagatgaaggagtagctgtttattggccttgttagggggtgtttgggagcccctctcacaaaacaataagtcttattgtgagagcctctctctcccaaacattcccttatttccataactttgattttcaagtctcatgttaaataattatattgcctacttttggtgacatcgttgagtagattgtgcacatgattgtcactattttttcaacaatatatttttaggactatagaaactatacaatgctatggatgcatgttgcaaaacaaatctaacgatatgaattttaacattcaaacttcaaagagagtgatatccctatcagaaaatagagtgatatctcgcaaaaaaaggggagaaaaacagagcaatataggcatgtttactttgatgtcatttttaaccttaccgaattttggtaaagttactaaataagtggctacatttagtttgctgttaaattgtcgaaatttggtaagttttttttggcatcaaaagtgaacagaccctaagtttaccatttagtactattggttaatgtagtgttttcgtcgagccggaaatcccgaagcggttgtggttgccggcctgccgctgctgtccgggccttcggcgtcgtcgaaacggcggggcgcacgtcggttttcgccgtggtgaacgggggaatggggtggggatacgcacgcgggtttgcttggtcccgttcacgcggcgcggtatgggtgtagccgtgtagggggtcagcggtttcgcgtcttttgtatcgtcccctcctcgtcgcgccgagccgaaatcatcagagacaacggctacggtgggatgctgccgcggatcggaggagaaaggcagaaaagctgtggtacgaagggcgcaggtttccgcagaccgcaggcgaaatgaccggtagcatttggagtccactcctaccgaggcgacatggctggctcgtgacatgtttgctccgttggcatggtgtatattccggtttttcattgcttgggatgtttttctttggatgggtggcttatgtttatggcaagtactgtacgcagtactatgaacagtaaactgttttaattaagggccagcttggagctaataaatccataaaatgattaggaaacacggtgccaaaatggggaagaaaacaaatatggttttcaactattaatacatggtgcacagcaatataatcttatactccctccgtttcaaaatgtttaacatcgttgactttttagcacatgtttaaccgttcgtcttattaaaaaaatttgtgaaatatgtaaaactatatgtgtacatgaaagtatgtttaacaatgaatcaaatgatatgaaaagaataattaattacttaaattttttgaataagacgaataagacgaatggtcaaacacgtactaaaaagtcaatggtgtcaaacattttgaaacggagggagtataacctaatgatataaggaaagagatcgactttttaaagacatgtgactttgagtcactaacatatggattcaatttgctatagatttacaaaaatattaattactcaaaattacgtgatgaaatggtggaggatcggtcttaatgctggaaaccattcaagttccatggaattccttagaaatataggaattcctaaccccgcataagtatttctatgccgcattttttcctttgtttaaatgataaattaaataaaaaattgtggccatgtgcaagcactaaatggatacaaacaatctgttcaggttctaaacctttcttgcacaatccgacttccgtcgggaccggcggtagctaatgaagaaagcgacgcaaaacgaaacagaaagcctactccaatcgttgctccgtttcttgtctttctttggatataatctccggtgttaggtccacacacaacaaataaaaaagagcaatgaagccttcaatttgaaggatgtgtgcccaataaggtttgtcctactatatcaatatatatcatccatgcaccattcctattgattcttaacacacgattgggcgcgaaaatgggaatgccaatattatttaaaagcaccgacaaacctaaacttgaaaaaggcctatgaaaaaaacagagatggggaaataacgcaagagggttctttccttgacaagtatgtgggctatatattgtaagtgtactttagaaccttctattcacttcgcatcgatgcatgttgcttggcccttgtttagtttctaattttttcttcaaacttttaactttttcatcacattaaaattttcctacacacataaacttttaaattttttctttaaacttctaattctagtcaaacttttaattttgatatggaactaaacacacccttagtaagggaaaggcatggaattgtctgcagtagttagatctaggggagaggggctaaagtttaggtagagaggcctctctccaaacacccccctagctgaagcatttaaaggtgctactaaatcagtactcctgcatgttctagggctgtttggttggtggcctcagtttgccacaccagatcttaggcgtgccacaatttttcaggctagtgtttggttgcgtgccgcagttgagtcaagccacactttactagcacattggcccacgcgtcatactctcatttgctagccaaagtttgccatagttgtggccaacaaattgttggccacactttgtgtggcttaccacacttatagcaaatcgagctatggtaaagttagcctctattcaaatagccccctagacttgtagtgagtctagccagaatttgttttctctcttcaacagaaaagagagtaaagttagaaaatgaacaggaaagcgggagatccatcatcatcatcatcattcatcacctttccatattttcctgaccactctttcagttttcaggcattcgtgtagccaggaaaaagtagccataaggtcaagattagtgtaatacggagtagtagtattactactagcagggagtaaatattatttcggtagaaaaatgcacatgcgcgtcattgtcattaaatttaaatgagttggtgatactatctactggtagtaatcggaagcggttgatcttttgtggatatgccgttgtgtggtgtgtttgttgtcactttgcacgccctacatttagaatgggaccaaacaaggtttttatcgaggggatcaaataagttagaccaatttaaaaactactccgtaacatgcatcatctggtgatatatcacatttaaagtcaaatatcatcacatttttttaaatataatttgtattttatatttttatttgatcaattcgttttgctttagttattttttctacgtaatgtttttttcttagagataattctgcttgctactttttataattttgcgagtaaatatataattctaaaattatatcattatgaaagcatcccaacaaaatctagacagcttcagatatagtgatcaaactttacaaaggttgacaaaaacatattatagagaatcaagtaaacaaaatgtgtttattaataataagtgttaattggatccatgccatgataaatttatcaatttggtaaaataacattactattcgtgaaacatactaggtgtcactcaatttttctaaaattcaaattgtgccatcaccaccaagttttatatcactttctccccaaccacattccatctggatctgagactaagtaggaatgagcttggcaactaaatggggtgctgattgaagctaacgatgaccttccccagccaagtaaaagttcaacaaatttctgttgctgaaagagaatcaaagttttcctacaaagagttgccatttgttcttctgtcgtaggtggggttgatcacatccactgtgggcttcagctcgctgctcgtcaggtgatggcggtggctgagactgcgcgagaactatgcaaggcggtggctacccttgatgccgacctcatacgccactaggactcgctctctctgtttgcgtgccgtccttgccgtgtcgtacctcttcgtcatcgacctttcttgctctgggggcttaggcgctgctggccttgttgcgcttgtcttacaccgaaatgtgttgggtaagaagacaacaaacttgatggctgtggcacgattcaaattttagaaaatttaagtggcatttagcaggtatcacaaagagtgatggtattttttaaaaaaggaattgataaatttgtaatgacacagatacaataaatcctaataaaaaataattatttgacatatattgagttgtgttaatcttcgattatgaatagtaccgaaatttcattctttatgaccaatgatgatttggttatcgtttcttttattattttgctggcagtaaagatatctatatgtattagcacaatagtatgatcataaaccatgaatcatacctagacattattttaggtacatggaaaatagaaaaataaacaagtatatatatagcatttcctagagaggttactatgctcacaaacgcaaaattaatagagacatcgagcacgagcatactccaggttgttgggggaaaacctccaaaagttcaaaaccacatgcatccacatcgttcgccgcagaagatcccttgtccccgccgctgatctcataatatgcgaaccagttggccggagttaaactaaacagcaaagcaaatcgaaataaatcaaatctccaaagtgaaaaacatacatatctccagagagagagagagagggagggggggggggggggggggttattctctttggcgtatatcacatcgcaccgcaacacacttgttttatgccaaagcaaaaatcctctcccatcttccatctctctttccctaggacgcgcagcgctgtttattcctctccgctccccttgcttctcgcgcacactaaccaatccgagcatctcgcctcgccccgccccgccccgatcgatcgactcgagcgccaccccacgccgccgcccccgcgccattggccccagccgccgggaggcattcgtctgcgctgccccgcggcggtggcggtgacggtggaggtggaggcggtgtggcatgatcgatagaggagtcgggagaggcggcggaggaggagggggaggaagaggcggtggagatcgctaggagtggtggtggtggtgggaggaggaggcgatgaaggcgacgcccccgccggcgaagaggcggaggggcccgcggctggcggtgctggcgctcgtcttctgctcgctgctcgtgccgatcgccttcctcttcaaccgcttccctgccggtgagttctccgcggccgacacgttcgcccccacccctcgcgacgcgacgcggctcgagcccccccggattcgggggaatgcgggtgccgccgcggcctcccccccgatcggatcggcgccgttcccggcggatctgttccgggggctcgctggttccttccttgtcgtttagtgtgcgggatattgggttgttttggtggtattcctgttctcttattggggattgtgttttttgggggtcagttttctgattggtttggatgtttctgatgcagtgtatgtgacggatgagcgcccccaacaggtaacttgttgtttctagaaatgtgcatattgaactagtttttgatagtcttgtgtggatgttttcttacgaaaatgctgtttgtttgggacaatatgtgtcactcattgctattttggtgatttgtgtttggtacaggagattgatttgccttcattcggacgcatggggttggaaaggagcggtggagtaaccgtagtgaagccggaagatggcagtggtgctaacgcagagacaaaggttagtgattttctgtgatctttttgttacgtagtgatagtgattaatccgtacggcattgtgccttgtgctagcttggtggattttgacatagtcatgcaatgtaaaactctgacatgatcatgttgacgaaggttagtagcttggcctttgtattgcattttcacctctatggagaaggacaaaacatgaataaccattaaactaataacattagcattttatttttcataggctggacatgtcgttgtatccctcattcctcctaacgtggtttagattcttggttggttactgggttttaataaaaactacctggtttaggtgcatttgcattcaaatgtatttttgttcttttaaaatttgtatggcatggtagataaaacaactggccataacacaactgagtttacgactggagagcatatcaagacagaccatgtcaaattgaacttatccagtgaaacgggttttttgtcagcttttggagaatttggcgaactagtcataatgccgtagactgcactgcttctatactatttctcttggactgagtatgacaactgagatatggcatgctaacacgatttgagccacaaaatccaactgctacgaactacccccgacatagccaatgagcaaagcaatattgcatatcaatagtacctccctctattctagtctctttgttcatgattatgaactgcgaaggatctggaagatctatgcctgcagaaatatagaattagtaattaatttgcttcttttgttcttaataaatactgcattccataacagctccatatgtattgtaaaatcccttattcctcacacccttttctcttcctttttcaggatacacctgagatgattcacaggggcggtataaactcacatcaccatagtgataatgtcccttccaaagttagtgctaacccaaaaggtattggttataagattagaaatattataaattagactcagttgtatatatgtcaaaactattaaaaaaatacaggaagtgccatttgggcaatttaatgtacaactttgaagaaaagaagcatagattgtttttcaattttgtaggaaaatgtttatttggataatattaaaaaacaatgcagttatacatcattttggggctattgaggatgaagaccagttactattcaatatcccaacacctgcagtttactagttttaatatttacattcatgtatagtgtggcaagatggtgacttctattcataaatggtgttttgtgtgctcaagctgtgtatgagtagtccatctattctattctattttttttgttcccttagtaaactcatattttatttgactgtcttattgactcaataattggcacctgtctgcagtcccccctccaccaaaaattgaaccactgaagccaaaggcaaagtcagtaccagttccagttcaacgtacagaagtatggctcttggctagttgcagttacatctatgaccttaggctaggttgtaatttggttgtcgtttttaatgagaaatgtgctgatacattttgtttgaataaacatttactggtttcaggttattagtggcaataacatgaaacctgccaaagttcaaaatgcggacgatgtggaaaaggctaaggcttgtcagcttgaatttgggagttactgcctctggtccatagagcacaaagaagttatgaaagacaccattgtgaaaagactaaaagatcagctatttgtagctcgctcgtactacccaagcattgccaaactaaaaggaaaggaggcactgactcgtgggttgaagcaaaatattcaagaacatgagagggttctcagtgagtccattgttgatgctgatctaccatcgttgtaagtacctagcatgcatattgtgattgcccccttcaatgctttcagggtccatcttttgagttaaaactgtgaaaactaaaacatcctcttttgtgtgggggtggtaactagatcatctatgtactgcatagattcttctgcaagcaaaagaattgaaaatccatgtcttttatatcttaatccagcactcatgtgtcaaaattttcttttaacatttctatgttttctgagttgtaaatgttgaacttgcaccttggtagcttgacagaaatttcagtctggttctcttagtaattaacacttaaattgtgctttcagtatcaaaagcaagatagagaagatggaccaaacaataggaagagctaaagcatgcactgttgattgtagcaacgtcgacagaaagcttcgccaaatacttcatatgacagaggatgaagctcattttcatatgaagcagagtgcatatctgtacaatcttggtgttcacacgatgcccaaaagtcatcattgccttaacatgaggttgacggtagaatattttaagtccgctccattggattcagatgactctgctgtgcataagtttaatgttccagaccataggcactatgtcatattatctaaaaatgtacttgcagcttctgttgtcatcaactcaactgttagtaattctgaggtatgcaaccaaattttaacacattcaagttggtagaatctgctctacacttgccatttctgattttctttttgtgattttgcaggagaccgaaaatgtagtatttcatatattaactgacgctcaaaatttctatgccatgaagcactggtttggaaggaactcctacagggagtcagctgttcatgtcataaactatgagcatattattttggagaatttgcccgagttcagctcccagcaattatatttacccgaagaatttcgtgttttcatcagtaatcttgaacgacctagtgagaaaaccagaatggaatatttatcagtgttcagtcactcacatttcttcatcccagaaatattaaaagatttaaagaaggtgattgtgttggatgatgatgtggttgttcaacgtgatctctctttcttgtggaatattgatatgggagataaggtcaatggtgctgtcaagttttgtggtctgagaatgggacaactaagaaaccttctgggtaaagcaacatatgatccgcagtcgtgtgcttggatgtctggggtgaatgtgattgatttggagaaatggagggagcataatgtcacagagaattaccttcaactactgaaaaaggtcagtcctctgtttaaaattcaaaaacataatagtgtgcttagtaattctgttccatggggccacaaatttgctaattatatgggatcatgacttgctatggtcgttgaaatgaactgctcaaacttttctctgagaatgtattgttagcttatttagtaatcttattttgttacagttccaacacaatgatgatgaagcttcagtgcgagctgcagctttgccaataagcttgcttgcctttgaacatcttatatatcctctcgatgaaagattgactatatctgggcttggatatgactatgccatcaaagaggaacttgtccggaattctgtatcattgcattataacggtaatatgaagccttggcttgagttaggtataccggactacaggaagtactggaagaggtttcttacacgagatgaacgattcatggatgagtgcaatgtaagtccataatgcacttaaacctgggaaacaaaatatctgacggtagattgctacgtctgctgctgtattatatacctagaggggacgagcacttccattgaggaaaaatggggccaggaaagcagttattagccatcaattttgacagagtagatccagcaccatctgttcattgaattagtgagcttgatggatggtttttctacagttagagaaattagtcttaagctgaaggataatgcagtagacaatgatgatgagtgttagtgaggcttcaggtaaagggagcatcactctcaccttctagagtacgggacagaacgatcgatcggtggtgggctgtggcacctttattcaaattggtaccttgcgcctcatcgatgcaggttaattcttttctttgttgaatttttttgacccccttgttttgtcctgtcaataagggcatacacaggctaaattcaaattctttgttcttagttgcacattgattgttcatcatttttgtgtcggtggaaagtatattttgttgtcagaaaaccatcagttacacaacgagattgacagctgtttggatatcttttgagtgctcaagtccaattctcattctccagtaaattttccaatcttgtattcctttgtattgcattgaaatgggtgtgttatcttgcaaccatcaccgtttcaagttcagctctagaagagagtcatccataaaatcttatctcatcctaatttcaacaaccaatctaattttcggctcaccgaactcgtttgatctacaatatcataaatgtagccgaataaatacgcctgattcagcctctgtagtctgcactgcagttaccactattgtcaaaagcaataccagtgctaccgcggaatcaggcatattcgacagcccactcggactcggccactgcctccgcccacgctggacttacatgccaaaacttttcaccccgaaactaaacagggccttatgttcacgacatgccgcgagttcacggtcattttttttccttttctttgttttcttgagatgacaggaggtccggagctcacaatcttcactggttacttgaggggataagtgcaactactataagcttctacacacttgcctctaaatgtcatgtaagctcatatgatgagctggatgagagatatgaaagaagagagaatgagccatctctcatgtaagaggtaatctctatacaaactataagagagatgataacaaagagaccaatgaattgataggaaacagataaaataaaattaatactccatccgtttcagaatataaacatttttagagttagacattattattaagaaaatagatacaattaaatagggaagggttgtgattggatgagaagtgaaggtatgtaggaacattgaatggtggggagttgtgattggttgaaaagagaatgttggtgtagaagttgttatatttgggacaaattctagagactagaaattgttatattttaggacggagggagtatgatgtggggcaagtgtgctagaggtaatttgttgtatctatattgcctcttaattaatgagttgatgatgtgtactaaattaagggtgactatcacctccactataaaacttgccctaaagaacaccaggatcagggtgcctcgaacactaggagggaatgctatcactatgcagcagcgcgggactccgcggtagcggatggccatggaaccagcaataatcgttgtcaactgtcaggttctttttcacctacttcgagcaccaccgctgcatcttctcatgatgccactgttaccgttctagaccagtggtttagcccctctgctaccaacgttgtttacgccgttcaattcttgttcgcgcgtattggcaacattagtgcacgcatttgttttgagttgttcctagggttggtaaagccggtatgatgtctaatccttcacggtttgacaatttcggttattcgacgtcatcttccacgactgtctcgattaagttaccgttttcgtcttcagtgcgtccctatgaaccttagtccagggtgtcgttccatgtgcccacaaccactcgttggcaccccttgtgccctgtgacttggctaaattgtccatggtaccccgatttcgattacatcatctaaaggctactctaatcacgaccctttttgaaattagctctgtcgcagtccacatttcagctacaccgctatcattgttaagtcatcctactgatgtcttctctagcctaaacgttcgcgatgctttcgcttgaattgtgaagggaaattttaagtatatagtagttgaaagaaacgctaggaagagaattcatttgtggattccattactgctatatatacccgcccctgatcaatatccatcatgctcatgcaacgtacgcaccaccccctccggccctccccatccgagggcatcctcatcaatggccgtgctgactgctgtgactcgaaccactggccgtggacacatcaacgagcgccatggcgggtgggtgccattgcacgctcgttggggccgtgccgacagccgacacatgcacggagatctcacgccttgttggaagcagctgaatcatacagccggctaggctattgcagttttagtttggattcctcgaggagaaatcaccataagactatttgacttgaaagcttcaaacaggtttagttcaaccttaccaccattggttcatgtacttccaaaaaaaaaaaaaaaccattggttcacattcaagagataccagtaactcgggacatttcagtacctagctcaatatcttctgagctgcaaggaggaagagggagttccgtagccttttacaactgactccctgaaataaaaattgtacccaggaagatggctagatctcaaattctccttatttcatagtaccggagataaatttgagttattgctactgaattataatacaagcggacaccaaacagttccccttctctattaggcttttttatgttccttttaaatagttcagctcaatagacttggatcagcactagaatttcagccaatatagatggaaccatttttcttttaccaagtacatgggcagaacagctataatctgaatgcactctacattcagatgagttaactgtcaagattcatgcactctacgacgcttctcttgggggagctccgatccatcagttgcaattactggggaatcaggggactcggttgctgcagttttcaggttggcacctacattggtagaatttttagggtggttgtctcctattctgtttgggtccaaggcagcctcactgtccttgtctacagaattgcttggctcagatggagttgctgtatctccagacgatggatcctgcacactctgtgtgctggatttacattgcttttcaaacatcttctgcagatatttcccttgttcttcaattcgaagctgcaatttcctctgaatctgcaatagagcaatcaaatgtgcttcaggtcatgggaatttaatttgaagtatatgagcatgtcctacccctatattattaagaccagtgcaattgtagcatgccacattcctgcagtcacaattttgttcattgccacaaactagtgtcgaaaggaacatttctgagtctcatatttgtatccccaaaagggtagcaattgttgcatgcctcttttagtttattaaggtgccatttgcccatttggcatgagcctatttcaaccaaatttagagtcagtgcacatgcttttgaattagtacctcgagttgttcatgaaggcgcttctgaacttccatctgaaggcgcagtgcttcagtaagatccatgctcctacataagcaaaacaacataatgcaagggtatctagtactggtgactgggaagaacatggtgcacttactgatccaacagaaaaatgaacatgaaataccaccattccctcaataatgcataatggtaactcctaaacataatttgaagtaaaatggatatatcttctattgtgctatatgagcaaactgtagatttgaaccatactagtaggcgaatccctactcttattttgaaaccatgctagcaagtgaatcacaaatatatatgtgcgaccaactttttctcaaggcaattatttactttagtcggtaatgcaatctgccatccagtcatgcctacgctcttgatctgaactttgatgcatgttgatttgtaaaccacacagtaccctacttattagttagcgccatgtgaagtgtaccaaaagtacaatgaaacaggagaagagacgatggaataataatatccactcacgctttcaggtccaaagacaactcatcggtagttttcccttcttgtgttttacctgcatgatgagttaagaaaaggtcagagttgtcttaacaactcacataaactagaatatggttgcatgcgtgctattttgcaacaagggatcttacactaagtatttaatatttcatcatgaaaatatgcttttacaaataaattcacagcccttgccattatcatgaaaattgtacttaagttattgccatgaagttctaaaaaaaaagttattgccatgaaaaatgagttcccgtatgtaagaatatgtataaataaaatgcaagtcagagaggaacccaattgatataaaccttctgataggtctggcttgtagcgagctgtgcggtacttctgcagtaaaaataagtgcagataaagaaagtcaaaactgaagtctcctttcagcaaatatgacatttagaaagattaaaaaaagaacctgcagatgactcttaacatgatagattgtcaaaccatcaactttcataagcttgagcacaccttttggagtagcttctgaaggttttttttttttaaaaaaaaaaaactattagactatgccagaataggattcgtatatataagagaaaaccacttgagtggtatttacgacacggaggacatactttcactaccaccaagcttatttacagcatggacaaaagattcatgcaattccggggtccatctcatccgttgtttacttgcagaggcattgctgttgttgggaggaggacttgtgacaggacaaatatcgccactatgggatgaagttgactgattgaaagcaggctgtgatgcagcagaattggaaggttgggccatggactgtaacaaaagagatccataaatatttagcattctgaccagggtagaaacataaggagcgctatctatagcatcagggacaaaaaaaatgcgttaaaggtaagatgcagtatacattgcttagaatttccaggagcagcctatgtcaagaacatgaacaattcgttacaggatttttaacacattgaatcaaatatttaatctaccaacagccacaatctcttcaagccaaggaacaagtaatcattgctcttgtacaggtaatcactttaacaaatgacatctcacacaagtttcgagcattcaataaatgaatagataaactaacaaaatgcccttgtgtaataagggaaaaaaataccgccatggttacagaagtatgttgctggaaaggcaaaatttctctaaaattaatcacgatcatataaattagtaaccgggttagagtgtaggcagatggtaccactattaccagtaggatgatgtcaaaatactctcaatagattatagtgttagaaactttcgtcaacatgttaaaataaataggtgtatttctaaacttccagaacacaagaaagggatacaactttactctttatggtattgcagttacatacctttgactgagaatcagtagctgttgcatctagaatatctttccagtcatcattcattatatctgcccaccattcattttgtttagcagcatcagatgtaacagtagaggagccgctctgggtgtgattatcagggacagttatagtatccatgtaatctggcgcgccacaggcaggagctgggaaaaaggttggcacagtgtgtcccccatgggtattattattacataaatactggagcatttcagcattcgacgactgagaaataaagggagcagccataaaatgcccctcatggctagacacagaatcaattgggttagcagcatatcctaacattgctgaatatgatgatctgacaacactggctcttgggtgcgaaatagaagattgagttgcactctggtgcaaaggcatagaatcatttggcagttgccctggcatcagaatattctgggtattatgggatcttgggatatctttcaaagatttcggtagaataggcaaggaggatgacatctctccagaaatacttgttttgcaactgcctcagatcaaacttccctcactgcaattctgcaaatagtgcataagatttgcttctttcccataaaatagtttgaatgcctttctacagatcaaactcgcccaaaatgttagtccatcactctgtacatgattaagaaatgaagagttaaaggggtgagcttattttgaggtcatggaaataatagtataattgtaaggaacatatatagactgtaaataatatttcacacatttaagcatgctggaactaatcatgaataagcagcagtgttgctagtgtcaagcagatgacacaagcagaaaacaaaaacggctaagccatgaaatgtacatctaggtgtaaaccttttgtacactgatgcacaacaacaaattttacacccccaatattttgaccactccaatggtagattacattgcataaacctcatttattagcattacaaaccggatactttcggaaaagttaaaatgtaatacctgcgatgcaggttcgacttctagctacattgcaaaaatgccgcaaattccagttccaaggtattattcagttaacatttttcttgaagctataaagtgatatttttcctgcatagcaaacccacatgcagaactctgtggaacagggcgccataatgatggcctgaatagtggtggcacaactggccccaaccatcttttcctactatcaagcaaataactctttacctaagacttttttgccacacacacacatgaaatgtgtacttctctatcacgcctgcaccgattaactcacagtacggcaaccaatggttaagcactagaatatcctgtttctagggcggaagcaaaccatcacagcactacaccactccacagtactacctaataattctgccgtgaagctcccccggttcgtaccctcacagaatcaaccccccataattccctgtaccaacaccatcatgtccgctcacgagcatgcggtacagcagctcccccccaccaaactcccacgccctacatgtcgcgatcaaaaccctaaaccaaaaaccccctacccccagcttctccccggcgggcacgcgctcgtccgctcctgttccataggctccaaccggggccgatcgatggagacggcgtggactgagactagattggatgggaggagaggaggcgtacctggggctgcggcggcgcgatcggcgcggcggggagcggcttggcttttcggaggcgacgagggaagtggggaggaggggggggggggaatctgattggggcgatcgcttttttttttcccctcggtgtcgcgacgatgaggtgagggtgaggagggagagagagagaggatgcgggaatggaggagagattgatcgagatttcgtttcgttgaggggaggggagggatggggagggggggagagagaacctggtgcgcggcccggtgaggcgcacgcgcgccgcggactccaccatgggaggcttttcttgttcggccgtgtgtgcggccaacttggacggctgggatggtggtccatggggactggggaggggagagagtggcaacgtgtgcgccagaactttgaagaaagaaaagcggaataatgatgcaaattgcgaccaacggattaaaaacatggctgaagaaacttaaacaccccctacttattattaggttaagaacactttaacaactacccaatataaatatattttagagtaaattatattgttagtacacaaacttgttaggtgggtgtaatttagtatataaacttgtaaaatactcgttccagtacacgaacttatctagctagttcgtgcgaacgaggaccaaaataacttggcaatattaattttacgaagttgatattgattaggatgtgacgtgcatacgtgtagtgagtatgcataagacatgtaatatttataaatttagtctctatttcatccttcatcattgaaatgatgaatttcatatgtttttaacccttatatcagtgctcgttttttaatatttttctactatcactaaatcctattctatattttattgaatatgatgtctaatggtaactttctctcatgtatgtgtttacatagtatcctaatcagcccctaaatcaataagattagtcatatagtgtcctttttaacttccaccgcacgcaccatacaagtttgtgcactaaaacaagcattttataagtttgtccactagattgcacccacctgataagttcgtgtaccgacaatgcaaagagtaaattgcatcggcggtacacgaacttgttaggtgggtgcaatctagtacatgaacttgtaaaatgcggtacacgaacttatcttgcgcgtgcgaactaaggtcaaaaggatattacatgactaattttgttgatttaggtgctgatcaggatactacgtaaacatatagataagaaggttgctacttagacatacacctgttcaataaaaagatagaatgagatatagtgattatagagaaagagataaaataccgagcaatgatacattggttagaaacatacggaatttaagataaagtagagaacatatttataaatatagcatgttttatgcatactcactatacgtatgcacgccacatcttaatcaacattagctaggtaaaattaaccttgccaagccattttggacctagttcgcacggattagataagttcatgtaccgaaacaaacattttacaagttcatgtactaaattgcacacatctaacaagtttgtgtaccaccaatgcaatttactccattttatacatattgaatgggtcaccaactactcctagctatcagtacaagtagaatggtttgctaatttctagagagatggatgtgcaaggtgccactgttggaaaacagagtaagatatatgaatgctcaattaccaatcctataagtgaactacaatctattatactataatcttgcgtaattcgagacatagttttaggttcttgcaaatatgctatatgttgcagattagcctttactttccaccggctttttttgacatcttttggggaaatgtatcaagcgaaagtatccaattgttgtagtcatcaaagaggtactctttcctctttgatgcattgataatgtacatttgcttttcccaattcgtcattttaacattgtacaccaataggtaggaagaaggatctatgatccaaaattttgaaagctaatggtacgaacgacagtcactataccattgtaacatcgtgtgtgttctctttaataaaattgattcatttttaatggaaaggatgaatgtgtttgcacatggaggatacaaatgatagtaattgctgcgtgatttaccacatgatcaggagaaaccataattcaggtcatgttgaccagggaaatcaattcccgttcggaaatgaaaatttaataaaatcagggtgaatttgttcaaaggtttgaacatgattccgaatttagggtaaattactatctgaatgaaatttgaccctaagcctctcctgatcagccatggtgttggacggttatgtgtccatcggagtggtgggagtgacgaggaggctggagatgcctggaatgatggaacgaacccttaaagcctagtatttttctgattctgacatcttttttgttgggaaattttgataaaagcactatgactttgtggttttagctgtagggcaccgcactagtgacttttggagggaaaacacccccaaaagttagatgtttactgatgaacaccgcacgtattaaagtaataattttcagttaaaaatgagagagaaatcgtgtgaaatgtcagaaatgcccttgggcacacatgtcagctctcctatctctctctatcccctccttcacttctttctctatcccacatgtcagcgatgtcggcgcgcaggtgaggtccggcggcagcggtgacgggagggcgatggctccggccgctgacaacgcccctccctcctcactccgcgtgggcgacggctccggccaatggcgcgcccggacagcgatgccgatcgccgacggtgcccctccctcttcactctgcgcgctgcagccgtcgtcgtcgtccagccgcgccgcctctcctccacacgttgttgccaccgccgaacctcgcctgctgtctggccaacaccacttgccggcgccggcgctcctccgcacgccgctggtcgcgtccgctctgccctcaccctcgccctcgcctgtccaccgttgttgctaacatgtgggatagagagagaagagattagagggagaagtgtaggagaggatagagagagaagagagataggagagtgggcccaaggacatttctaacatttcacacgatttctcctccttttcaactggaaattattactttaatgcgtgcggtgtctatcaacaaatattcaacttttgatagtgttttcctccaaaagtcacttcgtgcgatgttctatagttaaaaccgcgaaatcacggtgtgctgtagcaaaatttgctcttttttttttctgatgacctactctcatgtcatctctctctgtgaaaaaactagaattgattgcccttttgatctttcgccactttggtagcatccaatatccattgatacagctaatctaatacaagtaagtagtaacagccagcagggaccagaggagaatatgttctttcgtggtgcttctaacaatatattagaaaaatcaccatacaaaatcactcttaaagagtgtaaatgtaccaatcacataacataaaatttcttcgcatctctacatattcgataatccacttgctgaagaggaagaaaaagatcgaccaaaacagaatcccaatccggttatcttctacttcggttcgatcttggattggaaggaataccctccgctgtagtcgaacgagtcggtgctcatgtccttgtccttcttcgggagaggatcgttgtaaggatggcgtggggcacccttggtgacgtcgaactccgtcgcggacgtcgacgccgacgtggaggcgctgctcagcccctcgctctgcagcatcatctcgatctccttgacgacgtcgctcatcgacggccgcgcgccggccacctcctcgacgcaccggagcgccagctggacgaacttgctgaatgcggccaggtggttggtgttcatgatcctggcgtctatcatgtccttgatcccgcagaactcggcgtcgccggcgtcgaacgcccgcttcacctcccggacgatgtacttccctttctcgatcggctgcttggcgatgatcagctcgagcatcaccaccccgaagctgtacacgtcgctcttctcggtcagctgctgggacatgtagtactcgggatccaggtagccctgcaagtatggaagaaggagaacaacaaatcagacgagccgacggcgaagggtgcagcatatcggtcggcgtggtgcgcgcgtttaccagtgttcctttgacttgggtgctgacgtggcccctctcggtgtcggacactagcttggagaggccgaagtcggcgaccttggccgtgaggtgctcgtccatgaggatgttgctggacttgacgtccctgtggatgatgggcgggtcggcgagctcgtggaggtaggccagcccacgcgccgcgccgagcgctacccgcagccgcttcttccagtcaaggtgcagcccgctcttccctgcaaagaaaaaaatccaacaagttcagggcgcgtgccgtgcaagaacgcgcggcgcgtcaggaacgcacggacaaatgtggtttgtggttttaccggagaggctgtcgcggagggtgccggcggacatgaactcgtagacgagcatctgctcgccctgctcgaagcagaatccgacgaggccgacgaggttcttgtggtggacgcgggagagcagctcgatctccgtcttgaactcgtgcccgccctgcatcgacccctgctgcgccctcttgatggcgatgaacgtccccgtcggcagcatccccctgtacaccttgccgtaccctccgtacccgagctcgttcgcctccgcgaagttgttggtgctccgcttcagctcctcgtacgagaaccacctcgcccccttcagccgcggcgccccgcccctctcctcgctccgtttccacgacgcgaacggcccgcccagctcctccctcgccttctgcgcgcgccgccgctgcacgagcgcgtacaccgccgcgcccacgagcgccaccaccagcacgccgcatccggccgcgatcccgatgatggcacccttgctcctcgacgacgaccgctcctctgcacaccaacaggtcagtttgaatggtaacgagctgaacaatgtctgaatcaaattgatccatgggagtcatggactgacctgggaaggggtagggcgaggcgatgaagtagtaagggccaaactccttgggcggcttgaaggtctggttgctgaggtcgaagccgatgcgcatgacctcggagcggttgaagtaggcggagccggaggggaaaagcttgacctggacctgcatgtaggcgtcggcgttgaagaaggggtcctggaggaagacggagcccggggtgaggtccagcttggtccacagccggctctccagctcctggaacgccgtgccgttggtcacgtccccgaagaacggcgccctgaagtacatcaccccctggtacgggtacgcgcacgcgcagctctgcgggctcatgctctcccccaccgcgttgcacgtccccgagaagcacttgacaaggctcgtcgagtacggcgccgccgcggcgcgctgcgtcacgttgcagtactgcgtgttcggcagccggtcgcacaccgggttcccggccagcctgatcgatgtacagggagttaggcaaggagaggcagcagcgaaggccacggcatcattcggagatggttggttcaatggactcacgaaagggtgccgttgtagctggcggtgaccgtgacggaggagagctggttgtccttgaggctgacgatgctcagctcgctgctgatgtacttgcccatgtcgagggtgccgttgaacgcgttgccgtcgaggatcctgcagcgaatggtgagcgtcacaagttgttgaggccattttgtcaggcggattactgcacagtgaggctggtttgttcagtgagcttacacttgctgcaactgtgggccgctgaacagcctcatcggcaccgtgccgtaaagcctcccggattgtatgatccttgatgaacagcatcacagagatgatcaggtcaggttttttggttatgccacatgtgagagcatgttctgaagctggaggcactggagaaggagaacacttacagagctgagagctgtggcagcctccaaaaccattgtgggctaggagaagggtcgaacgtgttgttgctcagatccctgtggtaaaattggaggagatttcaagtcaaacatgattgatggtatgtttaagttagaagaagaaattttgtggaggagtgccagtatcttacacataattgagttgggtcatctgagatagatcaggcaatgggccggtaagctggttgttggctaaattgctgaaatatgacaatagcttgtttagtgtgaatattccatctcacatatacaggtgcactggaactgtcaatggtatctatgcaattcttgaacaacttacagctcatttactttagtgaggttattcagattctctggaactggccctgagagcgaattcctatcaagccggctgttcaaacaacaaacagagcagatgaatgttttatgtaatccgacataacaaaaactgtttacgtagtttcatgtgaagcttttgtttgtggatggacacttacacaacttcaagtgtagtaacaagcccaagagagtctgggatattaccagtgaatttgtttccatcaaaaagcctgcatcaaaactcctaacgtgttagttcacctttttagctgaattgccaactgaatcaaagaagcaggaggtcaggaacttacaaatggatcagtgtcatctcaggactgaagagggcatctgggattggaccggacaattggttcttgttgaagtggctgcagagagaaccagaaacatatggtcagtgctacatttcatttagtatggcctcttgaggaataggaatgaacaaacttcttaggacctacaagtgtttggttttgaaaagcttgtctaaacccattccaccatttgtcgagattggtaagggacctgacaattgattgtcggcgatgtcgaaccaatagaggttggaaagattgcccatagaagctggtatttttccagagaactgatttgagttcaatgccctgaaagacagattatgtcagtcttcttctccagacactaagttgcagaagtctcccaattgtatgtctactaattcaccagtgagtaattctcacatgtaagacaattttggcagactccctagctcatccgggatgttgccatggaaactgcaaccggccagaatcctacaaaataggcagcacatgagcatactaacttcttagatggcagaaacctgaaagagaaatactttcagaacttacaaggtggtaagctgcttcaagtttccgatgtttggagtgagcacgccgccaagatccttattaaatgacatgtccctgcatacatgcagttctctcatgattcaccgttgcaggtcggaacaacatgaggtttcagaaaaaaagatcaatcttgaacagtgtgctctgctgctacatacagggattgaagctcggtcagttgccctatgtcagcagctagaactcccttgatgcccatggtagaaattttactgaaacagtcgggtagcagtgggtaaacgtaaaccttgtagttggaaacatgcagagttatagaacagagcagtagagcacttacatggagatcactctgttgttgctgcataccactccatcccatggcgaatcgctgcatgggtcgtcagactgcccccacgttggcggcgcgttctgccactgatccatcaacgcgcggagaacagatgctacaaccaaatccacggttcatttcattcttcaagatatcacacaataagatcataaatacagagcagcacgagcttcataaacaaggttatcccactccttcaagattggacaatcatggagacacgcctctggtgttcccttccaatcatcgaagaatatacagaacatttgttctttccctcctcaaaatcaataaatccaatcgttcaagactgagaaaacaaaacgatcttaacactagctgattaaatggttgggtcatatggtactcactgtcctggctatccgtcacggcatggcttgctcggacgcacaccgagagcagcagcacgacgccgagaaccacccgtctcatcctcgcacagcctccgggcaccggtgccgccatgcatgcagacgacacgatgagctgcgtgcgagctgctgctgctaccagaggtgcggttttaggtcgccccggccactcaggaaaaggctatagctgtagctatagctcgggagagagagacagagacaaagaacgcgcaaggcaactaccagcaccacaaccgcatcagcatgatgcgcctcatgatgggatgtgcattcaagaagccaacatgacatgataagcttggaggttagagatacacacagtggaacagagtgtggtgtgtgtgtgagagagaaagacgacgacgacgacttggcttgaaagcaatgcaagctcctggcccggccgcctgggtggtgtcgtggtgagctcgcgcgcgcggtgtccgcggaagccaccgcgcgaggggtcaaaaaaaggaggaagaagacgctcgcgcgggcgccctcgtctcatcaacatatccctcgttccacggcaagtcctcactcagattccctgtaccgtggcagcgacgtacgtagacgtggtgctagtgctagccagattgagatcatctgacgtaaagttagaggacgtggttactgatacatgatcctatcggatccatatattagtgatcatgtcacggagaaattcacgtcggagaagctgcttccatgctaattttggtggtggactggtggttcccggtgtctaaagaaaaaaaagagaggaagaaatggtttgttccatagagggttcttaaaggtgatgatggggagcttagtgatgatgaggggtgtgatctaaggtacgtcgacgggtggacaatttggtggggattaaacaaaattatgtccatgatcaagtgctgggactttggcatgcactgggagaaaaaagtgtggacagattgacagaaggaatgttgttaggatgttttgtaggcttagggtgagtttgggagggggattgggaagatacgcaaaacgaggtgagccattagtacatgattaattgagtattaactattttaaattttaaaaattgattaatatgattttttaaagcaacttttctatagaaaatttttgtaaaaaatacatcgtttagtagtttgggaagcgtgcgcgtttaatacgatgtccttttctcacccaatcctccagaactcatcacaacgaacgcatccttagtttcagggagaagtgaagaaccgattgttgcaggcaatacatgttcgatgatgctgatttgatgcaagaaaactactatcccttccatttcataacatagtaattcgtaattttttttaagtcaaatatttctaggtttgataaaatttatagaaaaatatagtaacattttcaacacacgctacatttaataaaactaatttagtgtggtagattttgctagattttctataaacttagtcaaaactagaaaagtttgactagaaaaaaaatcccaaaagtgagttatgatataaaacagaactacgatatagagatacacagagacgtcagtgtcagcatggtgtcacggcctaactaggaacaataagcaagactttgtcaaatggacttcactgatgttggtccgtgtgacaacagtgaaatgagtgagactgtgagagtgatgcctgctgcaagggaaaaggacagccagttatacataaaaacagagctttgatctgatatgcttttttttcccatcagaatatatactcagttggaaacgagacgattaacgatggcttgctacatggttttgaaaacatatgcttttttttttttgaacattgaaaacatatgctctctcttgttttttaccctcggtgctgtgaaaattcagaagtgaagctcttctttttaccggctggttcatgcgttttagttcatgatggtggttgatgatgatggctggctggtcctgaatcacgttagcgggataattgtttcgaagcagattaatttcatatcatgattgggctacttttacagcaattttacattgtaaaattataatttatgaaaaatacatcaagcaacatggtttcaagtcttctggaatatgctccacgcagttgccaacctgcggtgagagctgccaagtagaaccccatcacgaggtctttacacggcaaactcgtgcctttggctgcgatgataccggtgttgaagacaacattaaagatctactagtagaattagctagaaaaaaaactaaacgaaattaggtcacaatcacgagtgtgactgtcctgtctaggaactttttgcccaaaggtgggaggaaacgcatcgaacaagttatgcaacaggttccatgaaagaaacctcgacatcaagaagtgcacatagatgttaccttgccatattttacagaacgacaaatgattcataaatgtctctccaaataagatcgagtaatatatatgactcgtgggaacttttgtcataggttgatgaatttcaagtagtggatagaaaatgttgtaaggaacaaagtactgacaaatgattaatcaatatagtgacttaatcaaatctatattgcacgtatattagtatacaccgaataagtggtatggtttctcaaatcccatgggaagagaaaacccaagaaaacttcaaaaaaagttgtttgcatgtacacataagccacagaaaattaatagacaaatgacggtctttatttaatgaaattggcaacgaacttgtaccggttcttcaaaaagaaagaaagaaattacctcagagaaattttttttccaaaatatctatagagttgctattccatatacattttaaaggaaaatgtaggattcgacaattaaacttgaagagtgaccaattaatcgagatagtggctgattaatccttcgagactacctaatgctcttcacatacactacacgtgaatcttgatggctttacctcaaaccgaaccctttttttgtacaacttcactaataaaagggtagataaatgaaaagagattaatatggaaataaacacaaagatatgatgcataatcccacacattcccacccttggcaggcccttaattagagaaaacattaaggtagttgtagtggagttattagttagtaataatccactgcatctatgtactccctccggtttcattttaattgatgctttggacaatgacacgctttataagatataactttgaccttatttttctattataatatatacaataaataaatgcatgtttacttttattatagtgttttgaaagacaaatttatatatgtttttctagtttctttaaactaaatatttttaaagttattgatggttaaggtaataaaagtttaccctcaaccttgttcaaaacgtcaattaatatagaaccagagggagtagcttggtgcgctcaataaatagcaactagcacctaccataatctcaagtggagcataaagctccatgtatcatgccacaggggaatggactgggctagtgctacttcacaccacgggatcctacatattttcctttttttttccgcagtgaataaaaacaccattgctatctttacaaaagtttgccttttgtttatgtctgtgatgggttttttgactacgaggtgctgtattgatgtgaacaagctctcatggaatgaattcattgcacctatgttcgggtctacattttcgtttcagttcgcagaacgaaagagagttgaattcaatattgatgctcatgttcttcatctcattgaagtcgaatttaatgtgggatggatatgtaggaaaaatcttacagtcaacacaaagaaagtatagaccgatatacatgtaaaggctaaataatgtggaaattaggatttttttttcctgattaagatatagattctacatcagtttttgttaacacgattttcaagcaactaaacagtatgttttgtgtaaaaacttcctacacagaagttaatctaaaatatcaaataaatatatttttaaaatttgtaataattaaaactgaattattactccatcctttccattttaagcgcagccataagtttatgtgtccaatattaatcattcgttttatttgaattttatttttgaaaaaaaataaaaaatataagtcacgcataaagtacaattcatgttttatcatctaataacaatagaaatactaatcataaaaaaatttcaaatataacggactatcaagattggacacgaaaactcataactgcgcttataattggacagagatagtagtacatattaacatgattttcaagctactaaatggtactttttatgtgaaaactttctacatttgatctaaaatataaaataaatctattttttaattttttataatgatctattttattattaaaacagctttgaaaagagtcatcacgttcgctgtgggggctagaaatttccatattaatcggataaaaaggaaaaaaagaaaagaagagtccaagtagaaatacaatttaaaaatagctgaaattcgaaattaaaaataagcaatattgaaagaagtttccatataaaaacccaatatgagattaatcaaaattcaaaataaaaataaaataaaatccaaaattagaaaagagaaggataatccaagtaggaatacaatttaaaaatagctgaaattagaaattaaaaataaagaatattaaaagaagagtccatataagaatccaatacgagattaattaaaattcggaataaaaataaaataaaatccaaaattagaaaaataaaataaaataaaagaagagagctcaagtaggaatacaatttaaaattagctaaaattcggaattaaaaataagcaatattgaaagaagagtccatataagaacccaatacgagattaattagaattcagaataaaaaataaaataatatctaaaattagaaaaattaaaagagagttcaaataggaatacaattttgaaacaattgtaattgaaaatgaaaaattgaagtattaacagaacacaatacgataataattgaaattcgaaaaaaataaaatttgaaattagaaaaagaaaaataatatttcaattagaaatgcaatttataaatgactaaaatttgtgataaaaataatgactattgaaagaaaagacgatctaaaacacatgacgagataaattaagtaacatgcctcggttgatatgataaataaaaactgttagtaaaacaccaaatagaatcctaatgacgattaaaaggagggacgacagtcatgccgtgaaggaaacaagcaaggcggttgccgggacttctagaaagtaaaaaaaataaaccccattgataatcatattcaatttttaaaatctcaatgacaataaaaaatagaagcagcgggtgggggtgtataggagtatagttgcggagccaccgaaggttgacggaacttctagaaaataaaaaatgaatcccaaaaacagttatgtttgatttttagaatcacaatgataataaagagtaggtggcggacgggccgtagaatagcatagtagcatcgtttgaaggtacttctaaaaattataaaaaataaaacccaacaagacaataaactctaaaaactacaaggtccaatttttaaaggttcggaactttaaaaaataaaaaaaaacaatgataatcatgttcgattttaaaatctcaatgacaataaagaagggaggcagcgggcgagccgtagaggagtacaatagcaaaaccgctgacggtttggccggtcttctagaaaataaaaatgaatccaaacgataattatgttcgatttttaaaattttaatgacaataaagagaagagacagtggatgggccatagaggagtataacggcaacgtttgacgggacatctagaaattataaaaagaaacccaatgtgacaataaactctaaaaactataaaatccaatttttaaaggttccaagaagaatgaatagaaatattggtagatcgagcaagcaaataaagaagtagatgacataaggggtagcaactggtgtgacttttaaaaactatataattagaaacacgaggatgataaggtttgatctttcaaaatcttaagacaatgagatagctatttaataaattttaagtaaaatcatacttaaaaaatatatgattttgtttgggtactagccgcgtaattgcgcgggccatccagctagttaaaacttaattaatcatgtgctaatgattttctcgttttgcatcccttaatcccatcttcctcatcggctgcgaacaccaaatgctttctgttaaaaaaaacacgaaacttatgttcttcaaaaacaggctagttcaatgagccatggtaccaaatatccctaagttaaaagaaaatccctaggatattttttaaacaactagcaacggtcagtaactgacgtatcataaaatttgtgttaaccgtatatctcgactactataaatacatataaaagaacagtttcgtttgtccatcctccttacacattgtttgttcgaggaaaagaaaagaagaacgaatgagcaatgggcaatggtcgtctattgcctagcacagtgaagttgtactaagaagagggtggcacttgccatatccatgttagcatgataaggatgggcttgggtatgttgaagtttggtggagtccctgggctgcctaagaaaaatacccactcgcaccaagtcttctttttgggcatggaataaattctttatctcatcaactcatgctactattgaatcccatccctcaaccgtaaaatcaggtataacccgtcccctaactttcaaaaccatagcaaatcgactccccatatggttccagaggtggtttcgtcctacacaccacttatgtggcaggttcacttggtgtttatctcacgtgacgttgacatgatgcttacgtagcactaaaataaaaacaaacctaaatgggatccacatgtcagtgagtaaaagaataaaaataaatttcgggcccacgtgtcgccaccctttctcctccctctttaccatttctctcgcaggtgatggcagagaccggtggtggatggcggcaacagcgagatggagcacgacggagggcgaggactatggcgtttggctgccgggccgctgagttcgacggctaggtcagcaagagcagtctgctcgccctcgctagtagatgagctctccgttgcaggcggtgcgcgagcgcggcagcgttgatctcggcgaaggggacgagctgtaggggcacacgacaaccatggcgcgcacaaccccagcggtgacggaggcaagggagaatccgggcgaggtttgcggtaggtggagcacacctggtcagggaggacgcggcggtggtggggctttagggcggcggggctcttggtgggagtgaggggacgaggcccatatgcgtctccctgtggaagttgatggccttttccaggctccggcactgctcctgtatggctacaaggtcatcgccgctggcgtccgtctacacctccattgctgttgtgcggcgaggaggtcacaagggcggtcgaggaaggagatgaggttggtacggggcgctagagcaaggcaacgaggcccatctgcatctcccgatggaaaccaatggcctcctccaagcctggcgctgctccctcatggcggcgacgttcgcctgcgcctccattgctgttgcggcggagagatcgggggacgtcaggggcggggcgcggagaggggcggcggcgttgctcccatgcgctgaaatccacctgagatgtcgtgagactgactgggagagatgagagagaggagaataactgacatctagggcccatttaggtttgttttttattttagtgcgatgtaagtgtcacgtcgatgtcacatggatgaagaccaagtcaaccgtgccacataggacgaaaccgtctggggagtcaatttgctacagttttggaaattgggggacgggttgtacccggttttacagttgagggatgcgattcaaccaaggggcatgagttgagggacgcgaaatagacttatccccttgcaatagccatccattttttccagcccaattcattcagcatcctctcgtgcataggccttctcttttttgttagggaaccgtccagtttcatccttatcgacacgacctaacgcttggtcaaccaacacgaaaatattggacgacaagccgacggcccacacggaatcctatctcgtggacggacattaatcctagcaggcagccttggtccgaggccggacacgtgaagccaaccatgacaaaccctcacgcgctcctgttaactccggtggacccttgccacgccaccagtccaaagcatttcgccgctggggaccccccgtcgcgacgcgccgtttcctggctggcacacgctcaccatttcggcgcaatatccagctgcatgcacgcatttcccccgggcgccccggcacacagccacacgccgcctacgagcagcacgagatcgatgcgtatgcgttttcctgcgggcatgcacaccgcggacacggcgaaaccggctcatcgatccgttgatgcgttcacgtcgagacagctggatcatcggcgtccggtccgtcgtcgcgtgtcgtgtggcaatgaaggtggccatgctttgtacgtagcgtggcccccgttgcacttgcacccaaggaccaagctggaaatttttccggaaaccgtggcttcagaatttgtagaaattgtgtctctccatttcagtcttgtacacggagttgcttgtagaaggtcggtcgggttacacgcagagagataataggtaatgtattgaacatactttcgtgccagtaagagttaaggacggtacgtagagagtagtgaactgttatgtttgagctacaaaaggaaatctagagcttttgctccagcaaaaaggagcccatacatacatgatcgtcaagagatgacttgtcttggttagcttgagcctgaaggttaattgcttcactgttcagcataccagttgcatgctaccagctagtgcccacaaagtagaatctagaaagcgctaagctttcggactctcaacaactaacaaagtcgcatcggcttacacccgtaccttgccttgtaagagaatccttatattgctaatcctcctgctccatctcgatccacataacgatccactgttaattcgtccttcgacatatggaagggtctgtgcgttgtccctgtcgcctttattagctgcgtgcaattcctttccagcacagtaagtgacctaatcaattgtagttaaatccagatgcttccagattatgcacttaactgagatcaatccgagaggccagtttgatgcgggttgatgagcgaggtgtcctgcaggtgctttggtgaagcacacctgctccatgactccatcccctcaaatgttaaactcacatgcatgtactatacagttttttaaaacagcgtttttcagaactcccaggtcatgtttaaaactgaaaaaaactatttctaaataaacatactacggagaataaaaataatctgaagataatctatcctagtacgagagtaacagtcgtatactaaagtaaagtaaactctgtacaaaacagtggttgataaacacagtgactgactacgaatattaaactctgtacaaaacagctgaaactaaagatccgcacggcacaactgaaactgcccttcctaaacccagacgaccaaagatcaaaacaaaaacaaacaaaaatccacatataagattgtctcgtaggcgtccatcgctatccccacccaacaccacactacaacggcaacagtagtagtagtacctgattatccatccctaacaaatcccacttccccacacacgccaaaagcctctcctctcctttcctcctcctccagtcctcctcactgtccgtcccaagaaccactcggtgcagccgccgccgccgccgcagccagtgccattgcaagaatcgcgagggggtattgaggttgggcggcgagatgagcatgtacgggagggacccgtggggcgggccgctggagatatgccacgactcggcgacggacgacgaccggagccggaacctggacctggacaggggggcgctgtcgcggacgctggacgagacgcagcagagctggctgctggccgggccgggggaccagggccggaagaagaagaagtacgtcgacctcggctgcctcgtcgtcagccgcaagctcttcgtgtggacggtcggggtgctcctcgccgccgccgtcttcgccgggctcgtcgccggcatcgccaaggccatccccaggcaccaccgcccgccgccgccgccggacgacttcaccgtcgcgctgcgcaaggcgctcatgttcttcaatgcccagaaatgtgagtgtgcttccctccctgccgcctcgcgcgtcggagtatcagatcatttttttcctttttttgtgagttctcagttgtgctggattagaaatggtgggttttttttggcgatctgggcgatttatgttcgggagcttttaggatttgattattgtgcgtttgagctttgccaagttctgaagattcgatttttttttcatgcttctcttggtagaataggaaagaccggattttcccgttgtttctcccggtgatcttgtggacaggaagtttcaagtctttagcttggtttccggtttcttccgagagttacgatggcttgagagttgagacgccggcttcagagatgggatttttattttattagcttggatttatttttccggtgcttgaaatgggaataactaggcaccaaaccggtctgtccatcagatccatccgtaaagattacaggagtttatctagaagaataatatgtccaacttaaagatcacattttgatggtacttcccatttgtgtatttgctgcagctggaaagcttccgaagaacaacaatgtgcattggcgtggtaactcgtgcatgaaggacggactctcggatccggcagtcgggcgcagcctcgtcggagggtactacgacgccggcgacgccgtcaagttcaactttccagctgccttctccatgaccctcctcagctggagcgtcatcgagtacagtgctaaatacgaggcagttggggaacttggccatatccgtgataccatcaagtggggggccgattacttcttgaagaccttcaactcaacggcggataccattgatcgtgtcgttatgcaggtaaaacaaagatgcaaacatggatatgtgcagagggattgtagttcttgccatcagagccattgctaattcgagattttatggtgggtgcaggtggggagcggtgcaacatcacccggttcgactcaaccgaacgatcactattgttggatgagaccagaggacattgactaccctcgcccagtagttgagtgccatgcttgttcagatcttgcggctgagatggctgcatcattggcagcagcatcaattgtgttcaaggacaataaggcgtactcgcagaagctggtacatggtgctaccaccctcttcaagtttgcaaggcaaaaccgtggaagatatagtgcaggtggttccgatgctgcaaaattctataactcaaccagctactgggatgagtttgtatggggtggttcatggatgtatctcgcaaccggcaattcatcgtacctgcagttggcaacacaccccaagcttgcaaagcatgctggtgcttactggggtggtccagactacggtgtattcagctgggacaataagcttactggtgcacaggtaattgcatttgttctcttctgtttaagtaatgatatagacattccccaggttgacccattggcatttaatttggtacttggttgatgcttgacatgaatattccgtatctaacatgctgatcattataatataggactatctgttgaatcaccaattttgtatataatatgtgaggtggtttagttgcagtagctatcttgtgtggagtcaacttgttatgtggtatatcaagacctgaaatgtagagcattagtaacaattatagagaaagaggtacacaacttgtatgatatattaaggtttggaacaccgtcagtgttgtcctgtctcccttttttgttctttggaatttcctaaaaatgtgacccatgataacaattgttttcagcatgcaacctgcatttgggctcatcttttaaataaccagttctggtaggtttcaactatgtgtgtcaaaagaattggtcacacttctctctagtttaacccgttgaatcatagaacctggtaacttttgtgtatatgctatttcttaaccttcaagagctaaaattctttgctactccctccttccctaaatgtttgacgccgttgatttttttaaacatgtttgaccattcgtcttatttaaaaacttttgtgaaatatgtaaaactatatgtatacacaaaaatatatttaacaatgaatcaaatgatataaaaagaattaataattacttaatttttttaaataagacgaacggtcaaatatgtttaaaaaagtcaacgacatcaaacatttagggatggagggagtacatagcagtagctagtaaaaaaaatccagatgaacaaataaacggatttaacatatcaattggtacttattttatggtctgtcattacaggttcttttgagccggttaaggctcttcttaagtcctggttatccatatgaagagatcctcaggacattccacaatcaaacaagcattattatgtgctcttatcttccaattttcaagtctttcaacaggacaaaaggtttgaccttgaactcactgaatcacacagtcacacattggtttgtgaacagttagttacttaggccctgtttagttctccaaaaacttttcgcaaaaacatcacatcgaatctttagacacatgtatggagcattaaatatagataaaaagaaaaactaattgcacagtttgcatgtaaatcgcaagacgaatcgtttgaccctaattagttcatgattagccataagtgccacagtaacctacatgtgctaatgacggcttaattaggctcaaaagattcgtctcgtggtttccaggcgagttatgaaattatttttttcattcgtgtccgaaaagcacttccgacatccggtcaaacgtccgatgtgacacccaaaaattttcatttcaccaactaaacaggccctattattattgtatttcaggtggtttgatccagttgaatcacgggaggccacaacctcttcagtatgtggtgaacgctgcattccttgcttctttgtacggtgactatcttgaggctgcagatacccctggctggtattgtgggccccatttctacccaattgaaactctgcgcaattttgcaagaactcaagtaggtttgcagagtttaaaatgttggaatcttgtaattccagcagtttttaactcctgatactaattcactacttatttcagatcgaatacatcttaggaaaaaatcctttgaagatgagctatgtggttggttacggaaaccgttaccctaaacgtgttcatcatcggggtgcctcgatcccaaagaatggtgtccactacggttgcaaaggaggttggaagtggagagaaaccaagaaaccaaaccctaacatcatcgtcggagcgatggtagctggccctgatcgccacgacggcttcaaggatgttcgcaagaattacaactacacggaagcaactctagctggcaatgccggtctagttgcagcattagtagcattgtcaggtgaaggccatggcgtggataagaacactatgttttctgccgtgccgccgatgttcccttcgcccccaccgcctccggcaccatggaaaccatgattggctgccactatctgattctgattcattttgtatacggcttatttagattagtgtttttctcccttgttctggaaatgctgggggaaacctaacagaaaagaaggcgtcaggtttttatctttgtttctcccattgttgtatacttgtataatccccatgttatgtaacactattgctgttctggtatgaacctagtaattaatactatctttcctcgtggatttgtgggagttagatttttaagactctgctttcttgaatcagtctatgaaacggcaacgctcatattaacattcacgtcctaacccattcgatttgtactctactgagatgaaactgagtaccacacttgggccaaaggtcatgaataatgatgattcttgcaacccattttcattaggaaaaagtccaccttcactccctaaactaatgaccaaatttgattcgtatccttgaatcgcaataccagatatatcgaccccccaaagccccaactattaaaaccggtgtaatttgactcccttacgtttttagagggttgtttcgctggcgtggcgcatacgtggcggtattgacctggtcttcgtccaacgtggcattgatatggtatgctattataatacatggacccatttatcattcaaaaaaattatgggccactgacatgtgggcccacatgtcatcctctctccttcccttcttcctcttccctctctcccttgttcggctgtgtgcactgtgtgcagggagtgggtgctggagcggcagcagcgacgacgacgtcgtcacataggcgctccgtctcgaggcagcgcccgccctcccgccatcattattgcagaaatgcagagccaattttactactaattccacaatacgaattcaagcacaagtagaaatgcagagaccgcaatggttctactcctagatagcactcgtcgccgccggagctcagaccttggttgcctctaccgcccccgtcacccgaggggcaaggacagggggagcgggaggcgtcgtggcattggccttcaccacgcgccaccatacccagacgacaacgagaccggtgatgagcaagcgcggccaagacgatcacggcggcggcgatgaccattgcccaagcattcgtcgcgtgagtgacacccctacgccgacctctaatcttccaacacttataatccatcgtgatcgtggtgggggttgtcagaggctgtaaggccaatgaggttcactgccaccgctcgtcgccattgaggagacaaagaagaaagcctcacacagcggtaggagtacttagtagttcgtagtctctcatggagggtttgcaattttgcccttgggtttggttatccgtggatacccggtccgataggtatggctctacgtatgatttttttatgtaccatttaatttttaggaaaacatgagcgaaaaataaagaactagaagttgaaaatcgtactaccgaacacacccttaatatatttttgtttagcttctctctataatccataaaccaaaaccatatgagccatcaaaacacattactcttatccagtggcggatccagtataggggcggcggggtctcgagcccccactactggggtgaagactatgagagacgccacgaagaccccactaaattttttttaccatatgtagatgggaggggggactgtaactctatctagtttattcagacccactgctcttatcttctaaattcatatcgatttaatagcacgtacccttcctatactagcagtagcagtttaatttttttgtgacacgtgatacaagataagtcattagcatatcaattatcataaacttaaaataaatttatttaatttttcaagaaacatttcaggctcattcggaacacaggattttaaaaacgcaggaacataaaaaatgcactattgcagtgtcctaacacctcaaatcctatggattaggaaaaaacccccaaaaaatagccattttaataagcacatgaaaagtacgggaataagaaaagagatagacacaaaggacttttttccctaagaaattaaagctcatgttagaattcccctagaacttctaggttttgagccaatccaaaggaaatccgtaggatttttatagctattcctataacccaaatgtccatatagaaattattttcacatgattgaatttctctaaaattccttaaaaagaatcctttgttccaaaaaaacctttatataaaaaacttttacataaatgcatagtttagcaatttgaaaactatattattgaaaataagataattatagtttgaagttgatgtaaagaacgcacctaagtgtaatattttttatttgggaatggaatgagcacaaacaaaacaaaaggagtgcttgtctgatcgtatcaagcctgattattagaccggatacggttgccattgatttatttcctccgtcacaaaatatttttatgttccaagcaattattatatcaaagttgataaaatagaaacaaatatattgtgaccagataaagcgtgggataattacattagtattcgaaaagagtaaacggtattttagtgattttactttttattactccctccgtctcataatataagagattttgagtttttgcttgcactgtttgaccactcgttttattaaaaataattgtgcaaatataaaagacggaaagttgtgcttaaaggacttttgataataaaatatgtcacaaaaaataaataataatttcaaacatttttaaataaaacgagtgatcaaacagtgtaaacaaaaacacaaaatcccttgtattaggatccgtcccaaaaaaggcaaaccgtgggtttccgtgccaacgtttgactgtccatcttatatgaaaattttttataattagtattttcattgttgttagatgataaaatatgattaatattttatatatgacttatatttttaattttttttataatttttttaaataagacggatggtaaaagattgaacaactttttttttttttttacggagggagtacgtggggagagataagaaatgaacaacggatggagtatgcgcgaccggagcgcatcgatgcgcgcatgaacgcaagccttcctgcgcactacactgcgcatacgcaacgcgcagtcgcggagcagagaaaccgcgcggtctcccacgcgcgatttgaatcccgcatcgggacccgcggcctgcctacagaccaaaacaagctagcggccacacaaggcagaacaaatcgattgacagtagagggaagcagggttggtgacttgtgggtgtgcgcctgggcggattttaattgcaccgctccgatttcttttggatttgacgaccgatcggccccgccggtggcgccccagcatactactactactactaccactaccccgcgggcctaatccagcccaaccgagttcgctgctagtatacttttggataatggccattcgaacttggtcggcgccagcaaggggtgtcttctgttgtcgccgcatatgggtccggcaaaaaacttcgctttttctgtggcgagttcaaattgcgggtaaatggattgaactccgaatacggaagaaaataataccatagaacaaaatagtagtagtactactgcagactgtagattttgatttggaggaaaaacacagtaattttgaaggatttcaatcctataagaaaaaattcacatcaataccattgaatcaaagaattaaatcatatccaatcttttgaaatttctatggaattggacgatctcgtagagatttaggaggaaacttagcaagaacttaaagtcttggaaaatttcctttgagtctctctcttccaattcatgtgtattttcctacggctcagtcaaacaactatttcttgtttttcatgtgttttttaatcttctattttaccctacaatttatgttagaatcctgtgttttttctattcttttattttttttcattccagcgattcaaagagaccctgaaggcccaacccagaccatccaaaaatgtttgcagtgaattccctcggtggtcgttgcaagttctagagctgtcaaaaatgttcgaggctcgtaaactgcttgagctccaaacgagttgagcctgagcctctcctaaaactcgcgagctttgttaagtcgagctcgagcttccatcgagtttattatttgtttcctcttctattaatatgattaactagatattaattattttttaagatatcatcctcaaaatatatattcttttacttaaaaattaagcttgatagtcgaactcgagcttgatcgaactcgaaccaagctgtttgaaagatcaaatattttataagctcggttcgaggttgtatcgagcttatagcttaggcgagagctcgctcgagatcagctcgttcacagccctacttgcaactacttctcgcggctcgctcggcgcaagactgcgggccacgcagctgccaggttccagccttggctggcgactcgtcggggtgtggccgtgtgggctgtgtggcaagtgaccatatgtgtgtatccaccgcgcgcgcgcgaggcgcagccgtagacaacagcatgctcgtcgggcactcgggcggctgtgcacgcacgaccgtgtgcacgcagagaaggttcgccgcagttcgctcggcgcgacaaggccgaggaggcagatcggcggacgatccaatcctgatctttaacccacatgaaaactgggcgagccgccgtagcagtactgatccacactaggacaagatggtgtgcacatggcgcggcacatgcgacccgctgcgcacgcccagtcagcccagaggccacgggccaagttgggagtcttggggagagacagcaccatgataccgtatcacaccctgcttatcctcggccctaccacgctttgcccacacctgtgcgcagcagcagcagcagcagcagccgtggcccgtggccggcgtgcatatgcggcagcgctatctgcaatgcaagtttgcatcttggactgcactgccccggctaggaaacaaaacccagcagggctttgcccctgtgggcccaggttcgggaccgggagcgggttgacagactgatgtgtgggtccgacgggcttgtgccgggccccgtgtcctgtttgccccagactagcaaaggatcattaggatattaattagcttaggcacaacagcacaagctaatgcaaacgacgtaactagaggagtagtagtacgtgttagtgagatcctagtatatagattagcggcggagatgtgggccgtgggcctgggctccaagatctggtcttttgctttatttaggtttgactgcaacgctgtccaaaagaatactgccccactactgcattgagggagaaatttcatcgagccccttgagttttgcacttttgctactcctggtagagtacccagtacctttgcccgtgaccgagaggctctctgtttatttattccttctcggaattcgagctctgctttccaatgtcgtgtcttgccaattgtttgttcattgggtaaagatttgcctgtgcatgttcagggtccagcaaactttacaggcttttttgttgccagtctacagtgtaaagcattgaaaaaagacttgtggctggactctcgctttttaaaagtcctctttgcgaaaattttcggcgagtacaaaagtttcataagctgtttcccaatacgtcctggctccagattaggaacgatgtataggaagtaaataatattttgatatcaatatgtgtataaaagaaaggattataaaatataggaaaaatatatatataaagtttaaataggccataggtaaaacattgcaatctgatgagaatgataaactcaaagaaaaaatttcataaagattgaagctattgctaactttcatttgaaatatacatagtacattaaaaaccactccttacaaattctatagtaatagaaaaaatgctcgtgcgttgcaatgagtgaagattattttaatcttattattgttatatggtttagttaagctgaaattcactttgttaaatttgcttgcatatatatttgttagaaaatcatgagctgcaattaggagtccgaccgtctcaaattagcatgcgagtttttagaagaaatttcttatatgattcattctgtatttccaaaaacgaacgaatttaaaaaccgactcaaatacggatttatatttccaaaagcgcacgaatttaaaaaccgatccatacccagatgacatagtaaagtaccgacaaaaatatcttcaatatatatatatatatatataaagtagttaggagtcggtattttttatgtataagttttttctcttttttctccaccggagagtcggaattaagtcagacatattttttaacgatataagtttttatttttggttttttctctctctcttttttccacatgaggagtggtacttttttttcttttattttatggtagaagttgtttttctctttttttttctcgcctttttttccactagacgatggaaacgcctcttatttttaaagtagtagtagatttagaaaactccaatgcattatttcaaaggataaataagaacttttctacacattgtgtacactcataaactctagccaaatgtatcgagaaaaatcagaataattttactcgaacttggaaaaaaatgaaacaaacatgactggcaggatgaagagaattcctcctacgtaacatcccacctaacgtagtcaatgaatgtaaatgatcatatcctctgactttacattagaggatctcaatccacatatcctaactcatatctgaaagatatatgcactagagttgcccttgtaaggggggattggaagatctataatcctaagagtgtggtgattgttttggtgattaataataacccattgttggaactaactatttccatgagttggtgagattaggttaagttccggcatcgagtaagatgggcatcttaccttgatgaggagcaagtgaatacagtgatgatgcggggtatgaagtggctatctatggcaaaacggtgaagggaaaacaaggctcggctacaatggaccatgcgggggtgaagggcaagcaagaggctagcgccgacgaaccaaatccggtggtgaagggcgagtgaaagctttgtcattatggaccgtgcgaggccatttgaagctatgagtaatccgtatcaattataagaagaccgcaagatagaatgccgaaaatcaagaggaagctgttctccgatgaacatcaagtcaaaagccaaagtaggcattgatcaaggcaaaggtataattgatttgggactaatgtgcttaactagttgtagataagaatagtcccaatggagaaatggcgttgacgttggcacccctgaaggcgaagcaagaagatggcaagaaggcattccttgcatttgagtataggaataccatactattaagagggatgcaacattgatatgtttgtttatgtctcggtgataaaagtgacctatgcaagtgctaccttgagagaaaccaaagccttaacctaacatatgagtggttttagagcttgtttctagttgggttgggtagccctctcaaaaagctttccatagagcccaagtttaccgaaaactgactctggagcaaggagttatgaccgtttttgtgaagtgctgtcagggtagctcggaagttccgggccctgggccaggaagttccgacccgatatctctgttcgggcgaggagggtgccaggaagttctaggtctcggggcaggaagttccgggtcctgttatgtgagtaacggctagttttttgggggcttgggtttttaatccccttcaccctcttctttgttggctgctaattttgggcaagaatagacctatccaaaaccaaatagcccctccgaaacctcctaccttagtggtagatctttgtgagtgagatttggcaagagatttgagagattgagaggtggcaaggttgggattgcatctatattgctctctctagttctacttggacaaggggacatctatgtgtataaatataagacccccctagggagagggaacaacaacatatcaatatagatcaatacaaaccaacatgcgccaagacaagccgccgaatattgacatcagagataagcctagacaaacccaatatggttctgcggaagccagcaggagggatctagcgctatctttgatctcgccgagtgcggattcgaggaagaagactaccctgtcatcgactatgtattggttatccatgccgctaagtcgacgacagctagataggttatcccaattattgtactggtgtgattatagtgaataagagcaataccggcttcggccaataggagtagggctattacctgtcagataaggggcccgaacctatataaaaatccttgtctccatctcttttacctcaatctcgcatataccctggtaccaatgatccctataccatccaaatattgtagtcgtgatctcaagcgttgacaaaattcaatgcatccccccctctccctctacattatcttttccactagtaatttcctccaaacttcatgtatttctatctatagtgttcctctattttgaaatcatgtactgcatagcatgcaacaatctattattacatttttcttattcttgtatttaagcaacgtgtggtagagactcttgtaaaacaactctactctaaagaatatatggaaattttcaaaatgatttgaatcctccaatgtttgtatgaaaatcatctgttcaaaatttgtatgaaacagaagggggttttccaatcctacaaaaatctcagcagcaattctaccatccaaatgactaaaattccactttgaaacaatggattgagaatatggaatgaaatttcctttagagattttgaaggaaaataatcatgaggtttcacctcaagtttttcctataactttaaattcctatgtatcaaccaaacgatagttttaggaccttgtttttagaaaaaaatttaatgagaacgtcattctattttacaatcattcatttagggccccctttgattcaaagtaaagttagaggaattttggaggatttcattgctatggatttttttttcataaatggccctttgaatcaaaggaatggacaaaattgaatgctataaaattcctatggaatgcttcatgccatgcaattttcgaggaaatctaacatgaggtagaacctcatggaaacgttcctttgagtttttatctctcttataatttctgagtttttcttgagatccaatcaaacgattattccggtgttttttctgtgtttgacaatcctttgttttccacttacattcctgtcaaaatcatacgttttctcaatcctgcgattcaaagtggcctaaaattttcggagctcacaaaatgaggcaagggttgtgagcgtcctaggactaaggaatattttcctatagtacagtaaagttctttgccttgttcaaattcaggaactagggcctctttgaattggagaaaaaaatacagaagaagcaaaggaattggaatcctttagaaaaggttaatgttcattcctttggttcttaagaatgagcaaaagaaaaacacatgaaactcgcatttcctaatgattctgaaggcactactatagaaagtgtcataggtgtcagttaagaagcctctatacgtgtggattttctagccagcaccacagagacggcatagatgaccccgagtcattggtgtcatttccacaactaacacctttgaggcactcgctaagcgaaaaaagattggctcgatgcatcggctcgaatcgaggttctcccattgccccaaatccaaattcaaatccccgaatcaaaattagatcgctaccaagattgattgacatcacaaaatcatgaacatatatagaatcaacaaaagaaaaaacatccaaatcagcaaaacccgtcggtatgcacttgacgacattgagataaggccgacgccaccacggatatggtgtagggcaacgacgcccccggggggggggagcagatccggaggccctcaaggttgggcccgttggatctgtcatcggtgccaccaccctcgccgtcgctgatgaatccactggctggggagaggccggccgttacctgctagggaaaggtgccagcgaagagggagagctggaatgagaggaaacggtgctcgcaagagaaaagaaagagggaggcgtgggcgagagagagaacaggctaagggataaggacgggagagagagggtggctaaaaaaatttctcgtcctgatggtggctcggctcagtttttctaatagatgttggttgttttagaaccgactcctatactacatgtgttggtttttatctagaaccgacacctataatataagtatatatgctattttttttaaaaaaaccaacacctatactatgtgtgtcggtttttatctagatttttgcctgatagaagtgataaatggaaaataggtgttagttttaataaaccgtcacttagagccgtaacctataaggtattttgtagtagtgagggaaacatagggcatttaacatcgactataagctcatgtttttttttctagctcacgtaagatcgaggcaaatctagggcctgtttgggatagttttacattctgagaaacagccaggggcggatccaacgtgggtgcaggggggactcaaaacccatggatacctcaggagcacccccttcgattttttcaccataaatgataaactaaaggtctttaaatagctagaggttgaagaaactgtgtaattgagcctccccaattttttgttcctggatccgcccctggaaacagcgagaggggatttagcttgtgagagtatgaagaatttgggaaaattagcttttgggtgtgtttagttccacggccaaaattagaagtttgactaaaattgaaagtttgaagaaaaaagttggaagtttgtgtgtaggaaagttttgatgtgatggaaaagttggaagtttgaagaaaaagttgggaactaaacaaagactttgtcttctagtttatttgctgaattcaacaactacttgttctcaaaacctaaggccttgttcggttactagggatttaatccccaaggggaatcaatccagggagggattgagtgaatccctctcatgtcactcaatccctgttggggatgaatccctccctacccactaatccccctctcaaatccatgtgttcggtttggtcaagatcaacaatagcaggattggtgctttcctgcttcaacgctgctattgagttgatgttcagcttggcagtttatatgcatcaacttcagagcatcaaatggaggaagcatcaaacatagcaacggaatttgataatatcttatcgtacaaacaaaatatactcagtggagtaattactgtaatctccaatgaacatcaaatgtcacttttgcttttcgtcgaaacatagcattatctaatataagttagaatatcgatcagtcctagcttctacagtctatgcttgacggagcgtggggctcctcaccgggagaccgcgcaggcccccctttgccggttcggccggggaccctaggtgagactctaagctcccaatctgtatgtggaaggttcgcgagaccggaagcacagaagacgccggcgatgtatacaggttcgggccgcttagaagcgtaataccctactcctgtgttttggtggattcgtgtgtgaaggagctacaaagtatgagccagcctctcccttgttctgggttcctaatctggaaaagtccagtccaaaaaaaaaaacctcccttctctcagtgggcaaggtcctccttttatatcttaaggggataccacatgcaccatccccccctctctgtggggacttaccctaccttttcataaatggacggagatttgcatggttgccgttcgagtcaccttctgatgggacggcccgcacctacctccactttcgccgggagcaggcgcgacgcggaatcatggctgtctgctgacgacatgacctgtgtcagactggtcacaaatcggtcattcttgtccaccacgcgtcagcttagcaatctgcacgttggtccttcttcacacaacattttgcctgtaatggttaggatgaagcctggcatatatctgaccaggactaacgtgccatctctgggaggtaacacgctagctccagctggggacgagtgcctagaagccctcgtcctgacgggatggggcgaggcgtgcgtcagatcgcctgtcgccacctaacccgcgatctgaccggtctgtgactggtcacagaccggataaatgagtgcactgcaccgcgttacatgcggcgtgacacgctcagccaaaccgcaataaatgtggttaggtgagccccactgtgcccacctaacccatacacgcggagcgaaaacccacgaggggtcggggcgcctcggccctcggggccgaggcgggtgcggctcgaccccctcggggggactaagaggagggcgaacacatcaccctcgggcccgacgtcccccgagggtgccaggccacgtgggcgattgtgtctgcctcaaacctctagtcatgatactcccgatcccatgtcaccgacaatgcttaataaatattttagacatagtgaaagaagtgcagtgcagatgcataattaatccttcagcgcccctgcaacaaaaagatccttacagccttccagttccataatttacaccatcatcaacatcttctccaactgtcatcacaggagaattacgaaaaattatgtaagaccataatagagctgattgaggatatgtatatggtaatttaaaattccagcaattgacaactacttgtgggtaaccccaaagaaaggtagattataacaactaaaaattaagcattatctaatatagttttgtatggaagaccatacaaactacttgcaattttctgaagtttaaccatgttcagaacaatgatccagaaattaagcaacattctcctattcccccatgcatccatatggtgacattggtatacacaaataccattaactttaatctacagtacttcgaggaacttatgcaagcattgccttttgccatgccacacaaacaaaaaaatgattttttttcttctaaaaatagcatataagctagttgtaaatgatcatcttcatcatgcatgattaatattcataataacactttagacagaaacaaattgatagaggaattattatattcacatcacaaaaattaatatcttgtcaactttcagcattcttaaacatgttgcacatgacatgaagtataatcttatgaaaacatgttgaactgaactaatgcaacattccatttcttgttgtacatacataaaataaaaccagtgaacattataatgcacaaagtttcagactcaagtgtataacaaatatatggtgaatgtagaaaaggatgaccacctcaaccttcttctagtttctctctctagaaattagaacgtgtggaagtacaattcagccttgaaaacactaaacacttgcttgctagctactggtaatagagtgtgactctgaaatctgaacttactttgtagacagatccaaaaccaccttttccaagcaaactttcacttgagaaattattagttgcatcttttatgtcatagaaatcatacagtttaaagcccaagttgccctcttctaacctccagagagttattacattctgcattgccatggacagccttcgcagctccgatcttactcaccacgagtaagaactcatcgggaaatgcagcaatcaagaactcaccatgcccaaatcaagaactaatgatatggtttaggacgtgcggcagcggcggtggcgaatcaagaactcatccccacccaaccaagaaaaaaagctcattccccatctgatcaagaactcactaatcctcacccaaatcaagaactcactagatcgagcagaatacgaggaggaggacgacgaatcgcgatgacgacgggaaagggagaaaagaagaaaaccctaaccctagctttggaagaggaggggagaggggaaaatgctgcgtgctcaccggagagaagatggcggccggaggagagcgccgtgccgtcgccatcgccgtcgcctccgcgtcgcgccgcccccgccgttgcgccacctcgaatcgcctccgcgtcgtgctgccgctgcgcgtgttgcgcgtcgcctcccgctcccgtcatgaggaatttttccacgccacacgagaagctgattttttcccgggcctgggtgagggggaaaggccgggataggccggggtaaaacccagactgggcttaaccgaacacacaatttcagatgggccgggattgtttcctcgccggggtgatccacggggattgggccccgatcccagccggaaacggcccaaccgaacaaggcctaaatgaaaaactaagactatttgggggttttcgattctgaaagcagctacagctttcacaagcttcccagacagcaatagtagctcttggtcacttgtctattcaattagggtgggttatatggatataagtagataagtaacccaatttattcaataatcatttatcattacaaaatttatgtgtttttcaatcatctatgttgcacgtatgctcgtattttattcctttgttttttcctattttttaatatttttttcaatcaaacgttttaagaaggggcccatagtttaatttcggagaaaaatcctgtaaaatttgaccatctataagactataatataaacgaggcagcaaagcgaagcactgtgtgatagtactgcagttcctagtgctaccgctaccccattatctaattacccgtcattggtgattgacattcaatagcattgtgcgttttgttatcagaaaagaaaagataaagcaaatagtagtaaaagtaaaaaaaaaaaaaaaaaaagagtacagacaacagactgtacagtgccatgcatgtggtagtataagcaatcgctatggtttgctaggacgtaaagtcaccatgacatggtcactgacaggtgggcccgagagcggtggggcccacatatcagccaccatgctagctgtgtggtaatagtatagtacccatgtataaaatcttggggacgcactgcaaagggccacatgggcatggcgagccgtgagacccacacaggtactggctttttcaaaccggggaaagctacacgtacgctgtaccaacagccgtaaagccaagcagaagcttttgctgtgcgtgcgagaaacatgtatacggacgacggaaacaccggtcaactcctgtgcgcatatgcaaggcaaacgcagcatcacacagacagcttcacgctagtacctttcccagtacagagtggataagcaaaatggattaattgggtagaatggtttatgagtcaaggaggtgagaaagagaaattgctagtgcctagtggtagagcattgttgacccctagaagctagaaccggctcataaaatcggatactcccttttccctgttagatcctctattttcaaagataccatatctttatcattgatatataagtccaaggtttatcgggtccacatatcagtatatcagtgacaaagccaaatgcttttgaaggtggaggagcttgatccaaattgtatggtccggttttggatattcaaaggaaaactttatggtatgagaaacattttatctctttatttctttgccttttacatttccaaaccctaattaatattctaccttcgtctctatagcaattgaagacactctaggtgccctgccgattctagagcaagcctaggtgcacctaccctaacggggttcctcctgagcgggggttcgtaggtcttcaagacgattatgtgagaacaggtactctggtttccaaaacagggtaatccgtaatcggttttctcaagaagcgttacgagttgatctaattgcaatccacacgttgtagtgctttggtgttttgtctatctcaatgtcaacaagcatcacaatgcccatttaccttcttggttacaggcaaagaaaatatgattacatggcatgtactcgatcttctctgaagattcagacccgatatctcaatcttcataatttcggtcaataagatttcttgaaccgacaattggttaaccgatatgacggtgtatccagtcttagctaacttgaccgaacactcccgcgtaggcagactctagtgtaggggatggcaattttacccgtgggtgcgggcattcgctggtaccacacccgatgggtatgggcatgtgtacccaaatatttctattcatacatgatttttttttaaagtgtcaatactaactaaaacatactagctgtgtaagtgcaacaaagtcatatatcactctagcttagtcatttgtctttttttttcttggtgatgaaataatttgtaattgtagaatttatggattttggtccgtatttaatactttgtgattatacttattgagtaaacatagatgtctaattgtgatagtttagatatatatgtatcaattgatatatcacatcatgttgttgaaaaatccatggatacccgatacatgacgggtattgacatggattttattttacgatgaaagcattgggcatgggtgggcgagaactttgtcgtcttgggttgggtatattcttactccacccgaaccaaacttgatctattgccatccctacttagggcccctttcattcgcaggataggaaaaacataggaattgaagtagtatgattcttcaatcccgtgggaataaaaaacataggaaaaaatgaaatgtgccctttgatagtgctataggaaaaaacacaggatttcttttccaaagaggtcagacctctttctttttttcctgtgaaaatgaactaaagggatgcaatccttaggaatgttttctttcatttcctatgaatcaaaggcctccataagaaataatccataggattgtgaatcctaaaagatcctataccaatcctttgaataaaggagcccttaatgggaacttgagtctgctggactctcctgtgacctgtcgtagcgaaggtggacttaagtttggccgtaataatcggtttgctcaggtacctgaggaacacgaccgaaataacgaaaaatagatcggatactttggtctggctcctgtttttttttccttggttctttctgcacaccccaaaagacatgcctatctttgatccaagtcagcttgctttcaagatttcaccaaacctcagcatgatgaagaataactgtagttctctgcagctcagtaaagagtagggacttcagacaaaaaaaaaagaaaggtatagcgttcaattttgcagaaagaaactttcattgcctaaaattttgcacaaaaaaacatttattttcgaaaattatcaccaaactatatattcatcgtaaaatttattattcccccgtccacaacaaatataaatattcttagcactgctattcttgtactagtaacaaaaagctcttcttgagttctgagctcattccaacaaaatggatacaaataaagcataatattaagaaccaaagtactactccattgtagtaatactctctccatcccatctcattttaaatacagtcgtgagtcatgagtttccatgtttaacatttgatcgtctgtcttatttaaaaaaattttaaaaaattttaaaaataaatgtattattcatgttttatcatctaatatcaataaaaatactaattatataaaaatttaaataagacggacagtaaaatattgtacacagaatcccatgtctttacttaaaatgagaaggacactacagcagaaacaggatgtagagacggttttcttctcttgtagagacggttttgcccgtctctaggtgtactagagacggccctgtgtagagacggttttcttctcttgtagagacggttttgcccgtctctaggtgtactagagacggccctgtgaaccgtctctgaggcgttgccattgctcccgtctcaataaacaagagacggttttgctagccatgtctactaggtagagacggtccatagagacggaaaaaccgtctctacatatattttccatattttgtagaaatatcataataaatacactagacacggcttcggaccgtctctacatataaatttcttagatacagaaacaaacctcctcaattctggcatccacaattttatttggagaacatcagactgcatcacactttagcattataaataaaaaaacagggagggacttgtcgaaaaatcacacatttcactcactgaatggtaatttacatcttacatgaaaaggtgaacttctggaaaaaaaatgtacaatttcagttacaatatcataaacaaatacataacttggacttctccatctaattgaagtatactctctattgctccagattgattgaactgttatttcgttaatcatcatcttcatgcacccgttaatcatcatcttcacacaagaacctgctatacaatgtaactttacaatgtgaaaaaaaaataaatagtgaaagtggactagagtagagattgtgaaggaagctattgataaaatattctgtcaacaaaataatgacaagacttaccgcgcaaaacaacacgggatggactatgaatcatgtgaataatagatcaagttaactccatggtttatctgaacatctgaaactgaaagtagatcactcgatcagagtttgtgagagaatctatgaaaaaaaaattatgtcatacaagaagcaccatggatgcaaaggaatatgcctttcaatcatcaagtatatcacggagtttccaggttcagcttgtagtgaagtctacaaaagaaatcgtcttttgatctgctaaggaaaagcaaaagaatagtgaaacatgattaataatgtcctgcattggatatacagtgaaacaaaatatatattgacaacaagtgcagagttgatatcatttctcatgataaggcaacatgtaagttagcaatcatatatgcataatattttattgggaattaatcaacctcaccttgctagtagtaacatggaggtgcttcagcagtaactgaagttcctgagaattgataatcgcatatgtgtcaaatagcagcaaaagccatccctctagctagtctgctaacagaaaccctgcattaaggtaggaagcatatgaaagcaatcaaagtcaatatatatatgtgtatatctgttgtgccctttttgaacttaagaaattaagggattcagttcattttcccgaaactagatttacattgaatgcagtaatgttgacaaccttgaacaacatacctaacttttcaggaaagaaagatcattaagaacaatggcctctaaccacagtcccaatgaatgcaaattaaaactaccaaagcacaccaaaccagatgttcatcacgaatcgtcctaaaccaatgtatacctatgtggattctcaatagaaagggagaacaatgaaattaccttttctttgatgaagctgtgcaactcgatctgattcctcacggtaggtcaatccgtcgtgctagcactttcaatcagccaatcaggggatcatactctgaatcagccaaaaatcagagtctcatccctccacaaatctgctccccacgtgttcatctacctagcgactcgcaagatctgaaccgcgccgtggtggctgcaatggagtggcagcgcagtggcgataggcagcaacggccagaaaggagaagcgagagtgtaggaccggagcggcggtggtcagcggtggcgcgcgatggtggtggaggaggcacaccggcgatctggagcgggcgcgcggcggcgtgcgactccgtcgagggtttcgatagaccaacgattgtaccgagcagttccaaaaataaatagtgattatccgattaattaataattttaaaggatattatgatggtgggtgcagttaagtggggaggtagccacggtttatctctccgtctcttttatccgactctaggtgaggggggatttctcgcacgtacgttgggatagtttagtagcaacggtttgatgacccgtagtattttagtcgtctctagttgcctgttttgctgtagtgggaatagcatctattcacagtaatgtcgtaatgtcgtactataacaatcacaggttgagtttaacaaccacatgttgagtttaagcaaaacagtggggggtaagtgggagacactgatctgttatctcaccataatcacctgatgtaaccgcacggccaagtaggaccttgcggccagtaaaaagcttcagagaccactgcaatggccatgtgcccttcgtcagtttctgggctacccctgtcctgctgtccacatatgacactcttacagcttgcaggtagtactgttgctaaacatgtgaacgtgtggcaggcacttgcctccaggattaaccacagaatcagtataatatacgagtagttgttatacatggaagaactgggtaacaacatcaattgtctgatggcagtagtaaacaaaataactgctaactgccacatagtactatattctctagtataattaggcgcaccactaaattatttatatatatatagagtagtattatatatagtagtatatcacaatacttcatatgctgccactttttcttccataagggctaatggcatcttcttcttctcgtgttgtttaatggagctatccactaaaaggtgagagaagcttaaaaacgaaaagaaaggggagctaaacatcctaaaaactacgctgacactccactccttttttcccctatattccgataacactttctttgcttcatgtattcctgcacagaaataaacaccaaaagaaagaacgcaaaaatggcagcataattagatgggtagaagcctaataattgggaaacgtagtgggaataaagcagtgcttactatgatttctggagagggtttcagccacttccattgtggactactttacatcccgatcgccccgtgctcggacagcctgctcattgcatttgatcgaatcattccaatcgcaagtgatcacgaaatgaccagtacaatcaagtagtaatcaactgctcaaagtagtggcatggccaaacctgggcatggggaagaagcaggtccttggcgaaggtatgtccaatgtgggaggccggagagggttggcgctgccgaccgcactgccaccaatattgcagctactaccggtggtgaaatctccctcgctaccaatggcagtggcagcggttgcggtaaagaatgcggtcgacttggtagaggaagcaaacgggctgtctggcaagttgtgctcaccactgctcaaaatacatgcacaaacaatggtgaagcaaactttcagccacggaataattgcagatttgtaggcttgttgttcatgagttaatgacattagtctgagaatcatgagcaagcagaatgccaataatggtaaaaatctacctttggtcactatcggcattgcgggtaacctcaccggcagaatccgccttattaccaccattgacaactttcccctccgatggagagccgcagctcgccatcagttgcccagctgacaatgtacagtggatattggcaagttaagagaacttgattgattgacgtctaaagaacgagttcgatcaatgctatctatgcttactagagctaggcggtgactcgacgattgtggtggcaccgggttggccggaggtgaaggcattggtgatcggagtgggcagagacattgttgtcgtctccgccgcatggacagcggcagaagacttgaggtcgagcagctggaggccaatgaggcggcggctatggagatcaatagcctgctgcagctccgccgcctgttgctgctcctcgagcttccgccgcagcattagctcgttcgcgctgttggagtgctgcagcatccttgcacctgacgaacaccaaaccaacatccatcaaaacttacagctctagcaagcaacattgaacatcaggcaaacagggcgtccaaatggtaggagcaggtaaaggttgaatctttttataccgagctggtgaaaatcaaaggggtccctggcgtctaaccccgtgggcgacatgcagcagaaatcgccttgctgctgcttcctgaggagcgacgaacaacaaattcacatgcatgcaggttggtggctagcagtcgtgacaagcaacgtagtagtatactactactactaatttggagcgcttaacataatcgcgcatgcatttcttcattcaagccgcgtttcgaacgtacctgtacttgtcggggaccttgcccttctccttgtagggcttgacgagcacgcgggcgtcgcagatgaagtgcgggttgcccttggccaagatcagcttcaccgtctccgggtaaacgaaggtgacgaacccgaacatgcgcttctgctggtacgggatgcgcacgtcgtgcaccggcccgtagatgctgcagcgcggcgcgttgccaagaacagcaatgcaaaaatgccaatcagatcgcgtcctaccgagcccgccatgaaagaaggaagaagcatcattgcaacatcgcattatatacctgaagtagttggagacgtcctcctcgcggaacgtgctgtcggccgggaaggtgaggtaaatctggcgcgacccggggttcatcatgctggcgaaatcgacgcggtccaggcgcggccgccccatgaacttgtgcgcctcgtcgccgccggcgagcatcagcgcggccgcggcggctcttcacacgcgcaagcaagaaacgttttggaactttgaaatgccttctggcttggagaacgcatggaggttgcgaaggcggtagtacctttggttgtcgttgtgctgctgctgctgctgcaggaggaggctgaggcacttgctggtggcggatggcgaggcagggagagagcctgtgggggtgaacgggaaggcggcggggccgaggcgctggctcttggagcggaggaggaaatcctggcactgctgctgttcggcggtggttgcgtccatggcggcgtcgtcggagaggccgccatggacgaacctgcaggtgctgccgttcttgcagaacccgcgcgcgtagtacaggcaaggtttccacccgaagccgtcgccgccgaggcagagctcgttcaccgacgcgctgcggcggtgcccagggccgccgttggcccaggcgaggccgtaggggagcatcccgccgctctcgccggggccggggctccggcactccgctccgtcgaacgcctggagagcatgcccggggttcacgcccccggctccgtcgtgcaggaacgcgagctgctcctgcagctcgaagtcgtccaggagcgcgtccccaccccgaggaaagaagggcggggcgttcgccgcggcgcctcccccgccgttcaaggggctcattagctcctccccagcgccgaccatctcatccgcggcgccgccattgcccatgctgttactcctcgagaacggctgcgcctgcgcccacgacgacggcgacggcgcggggcagcggccggagttctgcctcgacagcaggaacggcgagtgggctgccggcacggtgggcgacgacgacgccgcctgaggcggcggcaggagggcgagctccttgcgcgcctgcgccatgacgctgtggagcagcgcctcggggccgaaggcgaggcgtatcatctccttgtcgccgtggtcctggatgagcaggaggcccatgatcttggcggcgtggtcagggtccagcgcctggatccgggagaacaccaccttggtcgcctcgtatgcatccatggcggcgcccaaagcttctcttctcctactcctaccttctcagtcacagcctcacaggcgcctttgcctcttggtcttcagttcacccttttaccacactactactagtatctgtgttggactattggtgctgtgtttacacttattacggccttaaatatacaggagctagcgaagcaagctcgatgctagtggtagatagagcaagatcgaggaggcagtacactagctagtgcttcttggcgtggtccggttgctctcggtagcctccgcttcccggagctgcggccactgagccactgagcagctccatttcccaaaggattgagagtgagtagtcgcgagctcgctgcgcgcccctttcttgagcacactggcctgagcatggctttcttgggccgggagtggactggtggagtgggcggtgcgcaaattttctgagggttttggggtgatgtgcacatacgaccagtttcgtttgagatggcccacttgtttcgaaacgtactccataattgtaaaaggaaatacaggaatattccctctgtactcataaaatcgttttgcacagcgacgtggtctccaaaacataattttgacttttggtttctataaaaatatttattgaaaaatgatatatgtatattaatataatttttacattttcaaattcaagaactcgagagttattcatgatatatatttctaaggtttgacttaaacattgttctaaacgacttctaatacgagtatggagggagtactcgtactaaaaagcatatattaaggtttttttaaaggaaggtcttcttcgatttatagaaaaatcggaggattttaattttattagaaaaattcctattaaggtcttcaaaataaatgactgaaacatgttgttccctttggaatgcgcatttttaaagaatttattgaaaagtgagcctaaccattctcttagaaaatttcttcaagtctatctcattttatttctatgtttttttttctacagtctaatcaaactatcatttctatgtgatttgtcaggttttgaaactcattgttttgctcttgtagtagcggttaaaatcctatatttttcctctttttttcaatagccctaaacgaacatcattctctttagaatacacaggattttaaaacataagaaaaattgaggtaatgtctttggacgattccaagcaaatcaaagcacatgactggaagttactcgaggaaaacaaaggaagtagagaggggatgaaagagtggattagacttctcaaaggggaaactcctatgttttaattattttccttttagaatccaggtgcataaataatactaccattttataggatctcaccaatcatgtcacatgctccttaaaaacttgagattgagaaaataaaggaatagaaatgcccatttgattatatcgcagtaaaaacacagaaatttaagagcgatgaaactcagaggaaattttcggttagtacatgattaattaagtatttgctataaaaacacaaaaaagattaatataaattttaaagcattttttctatggaaaattttggtataaaacacacaatttaacaacttgggaagtatgcacgtaaaaaatgtgagagtaaaagttgggaacctgtacttccgcgatggggctcctctaaagtacgttagagcatgtacaacaggtcaacagcatattttaagcagataaaagatgggagataagagcaacgagctacatatttgtagccagcttcagcacagactgcaagatacatgtgtgtatgacaggtgcgaccatacattaattttgtagtacatgtttataggtaactattatatgaattggctattaaattgattatagataattttgagctaataattggctatactattaaacttgctcttagatggatgtgcctctcttacttgtggatccataggagtggaccccacctgtcaaggattcacgttactttctctaacctcgcttcaaaggagctgcttcatgtatttatgggtgtgttccgacttgaaatgaggctcgtatttgtgactaattattatttcaatgataactgacaattatcgacaacgatgtgtccaaaatgacttcgttaattttaaaatatgccaactcgtcttttagaagtgcttttttttaagaaaatggattaaaatccagtctctatatccacaatgaatatacacaacccaattcagaagtgctattggaaataaaaagtgtgtatatgtgtttgaactgtgttttagaaaaattatcgtaacaaattaaatattaactatattatactaaatagtaacaaattaaatatcaagtatatatattatagtaaaagtataatcaaatatcgtttttgagggtttgttcggcatccccttttcccaacacatctctctcgtttttcacacgcacgcttttcaaactattaaacggtgcgtttttttcaaaaacttttgtatgtttctatacaaaagttgcttaaaaaatcaaattaatttattttttaaaagaaattagctaacacttaattaatcacgtgctaatagaccgctctgtttttttgcactctgttccggttgggaacatccgctagcgcgcacagcccgagtaaagcctggagcattcacaggtaagatgtactactcacgttgtactagcagttattttcagttgacttgttccacctacggaaagattgcgcattaatgaacaagcaagtgagcgctgctccggaagagaatgagaaagaagccaacagtcgcaaatattttagagtgcactacaaaatactcgaacgtagtacatatttttatatatatttcaaccattaatatgtccttacatttcaccatgtcatatttaaaccatttccatccaaagtttttattttcacttgcgcgaaggagaccgggagactccctctctttcaaaatgatcatcttataacatttttgaggttatttctaaataatcatcatatttattttatggtcattcattaaggctctgtttagttcctccaaaagagcaaaagttttgctgtttttgagcactttttgccaaaatggatcaaaacctagtagcaaaagttggcaatttagcatttatcatttaggagtctagagtagcaaattttgccaaaaagtacgttgggagccgtgctctctctatctttactagtaaaatggcaaaactttaccatgtatctaaacaccaactaacaaaacttcaatgccaaatcttttgccaccaaaacttttgccaaaaaaaattgccacaacaaattgatctaaacaggccctaagtctattcgttatttgtgcattaaatggacattgatgcatgtattcatgcacacaagtatttataaccaacatgcaataccttgatttactatttgctagaaaatggtggggatggtgcatgcatcaggtttgttgtgggagtaaatatactacgagaaagttattagagcaggtacaataatagactataagccagctataaacacatatcgagaagataaaagaagatagagataagcagtgggctatagatttgtagccagctacaacacaaactccaagacgcaacgttagtatgacaggtgggaccagatattaatagtttaatatatatttatagataactattgtacgaatttgctactaaattgactataaatgatttgaagctagtaattggctatactattaaacttgctcttagcttttcttaccaatacacccccacatgtctcttaaattgacatcaattaacatacaacaccgattgttgtctctcgcacatgcatcaagggcaatttacaccaacagtattgcttgcatgcaccaaaattgcatttggttgaatagtacaatattgaacaatgcatacaaatgataatttagtagtgcacagaaaaacgaaaaagtcacacataggaagtaccgaatatgccaatcatttctgaataacattgaaaaaattatatgattatcatttgtgaatggaaggagtagattctagcttggttttgttagcactcttttcaaaccgctaaacggtacattttgtgaaaaaaaattttatatagattttctctaaaatatcaaataaatttattttcaagtttataataattatttttatagaacttaattaatcatgtgctaatggtttctcattttacttgcttgtacttaatctttatccgccattacgtcgaacggggccttagggaacctttgtatcgtacgattaagaaaagagaggaataaaaattataggattttcaccagaatataagtgcgaaacacacgaatgattatttgaatagaccatagaaaaaatgcagggattgaatgagagagatagacccatagaaaattttcaaaaaggttggtgctaacttttctccaaaatctatatgcatgagtcaatccttaaagcaggtacaatagcaggctataagccagctataaacatattttaaagagataaaggaagagagagaagagcagcgggctacaggtctgtagccagctgcagcacggactccaagatgtaatgtgtgtatgacatgtgggaccaagtattaatagtatagtaagcaactattatatgaattagttattacattggctatagatgatttggagctagtagtgggctatactattaaacttgctcttaataatttcataggatttgaagaactgcaatcctttgtttcaaaagatcaaatatgaaaaattcctatataatttaaatcctagaaaattcctctaaggaactcctctataattcctttgcttcaaaggaaacctaattatattatggggacaaggaaacatgagtagaatttcttatattaaagagcagaggtagtaacaacgctcttgactatttgtcaaccactatttacggtttcgtagaaaaatggatgaggcattaaaactattgtatagataaaaaaacgtttatacttagtgcagtatattgttagcagtttcaaaactaaggctgaaaaatagaatataacaaaaagaactaaattaaagcatacgagagtgtttaaaagtaaggtttagtataattcgaattgtaaacaagcccgcgcgacgagagtgtttgcaagttagctggaaaaaaaaacatttgcactgcgattattatcggctgtgatatcgctggcgttcaatgaggtctccaatacagttctagcttcgatcataagcttagataattattcccctgtatgcactgtgattgtaagtgttgtgtcaagtgtgggtatgcatgtccttgaagatcaatcacgtaagacaagaagtgatctcgcttcaaggggccacgacgatttgagtaagcctacttcctatatatatatatctgccatcactatcagcagatagtgtcttcctgttttcttttggaggtggaggattcatcctgcaatgctgatataatatactcccatcgcctttaaaaaatgtatttttaactgtaaacctgtactccctcggtcctaaagtgtatgcagatttatatctagaattgaattctttttaggatggagaaagtacttccctccggttcgaacgattttggtagctagacgattttggcagctaggcatgaaaacggtcgaaaaacatctcaactattttcataaccataattttcttaaaaccagaatcaaaatggtgaagttgaaaataaaaagtatcgaaaattggagatggactatgcacggaaatatatcggtaacaatcgtaaaccgatcataaatatcaaaaagacattaaggctcatttggagtgaaggaatttcaaaggaagtttgaaggatttcaatctttaggattttttttcctattaaaccgaatggcattcatagaatttaatccttaggaatccaaatcctttaaattttcttcaaaacgaataggtccttagcctcattcagtttggaggaaataagaagggaaaatgtagcaacatgattcttgtaggaactatcactattcatccattcggttcgtacgatttgagcaaaggaaaatgataggaaaatttcctttgactatgattcctgaagaatttgctattagagctcttttatctatttccaagcgtaggatgaggcaaagcactcattggtctatgtttttgctctccagttgtatagattaaagcattcaaatcttggccatgttaatttaatactaagcattttgttttttttctatcatccatttaaaggatcaattctataccttttctattctctattttacacatacattcctatacaatttgtatgtttcgttttcctatttctatggttagaaatccgaaactcctgatgggcgattgatcgccaggggcgatcggatctggtctccccctctcctccacgtggttttcttttttggcaccgcattatttttctattttagtaaatttattcaagtaaagtttgtacacctcaagtttacacatctaaagtttagagacccaaagtttacaagtcaaaagtttatatatccgattcaaatttgaatttgaattcaaatatttttttatatatagtatttatatacatctaaagtttatacacttaaagtttatagacccaaagtttataagtcaaaagtttatatacccgattcaaatttgaatttgaattcaaatattttttatatatagcatttctatacatctaaagtttatacacctaaagtttatagaccgaaagtttataaatcaaaagtttacatacccgattcaaatttgaatttgaatttaaatattagtttatagacctaaagtttataagtcaaaagtttacatacccatttcaaatttgaatttgaattcaaatattttttatatatagtatttctatacataaatttttccaactttgtttttttgttttttttaagtttatagtgtagtatgaagagaaaaagaggaggaagaagggaggagaaggtgtgtacaggcccgcccattagccacacccttagaaatcatgtaaaccgaacaatctcttagctcctttgctcctttggaataaaggaatatgattgaaaatatggatttgctttctatgcccctatcccaaatgaaaacaaacatgacctcctacatcatgttttcattttcctttgagaagtcctacgaacttctccctttctctctagtttctctcttccacaaaattatttccatcatgtttcctacaaagccattcagatgagtaaagtctaaaattcctatattttgaaaccatgcgggaatatgaagtgtgtgatattctattcctgcattttcgaaatcctgtgttccaaggagccctgaaatgtaaaagtcaaacatttagctttacataactatatgattatataacgaaataagttcaggttgtactatataaattacaaattgtatccctagctttcaactaagcactcaacttaggatttggttgattagttgaagggcttctaaactatggtcaaataaagaaatggataggtttagaaataccataaatccataatgtaaaaaggtaattttagtaagaatacggtataaattcagaaacgatgagtataactatgaaatagtttatgtttccatttccttttttttaccgttccattttcattttcattttcttgttggtaaccattttgatatgttcggtaaaaataaaaaacgagcatcagacactcggaaattcccgtgactgttttcaccccattgacggctatcttggaatacatttcaactttatttaacttttgccggtttagataaacgtggtatacaagaaaaatcttactcctacaaacaatcgagaaaattgtttcgttcgtttagttccaactttaatcaaccaatttgatgcgagaaatggagcaaagtgagttaagatttagtaatgactagcactgctcacagtaaattttaaatattaaacttaatctagaaccaatttaggggtataattctcattgcatcagtcacacatcttcggcataatgcttgtggcaatcagattattctcacgagacgttaaacgcaagagttaagccagccaaatttaaatttcagaattaatttagatgattttccatcattttggtcactcgcccttggtttttagactgtgaagagtaagcctcgtaatcagatttttagactgtgcacagacagaattttaattttaaaacttaaattttgaattgattttgagaatttatttaccgtaatatattttcaacattggcggttaaataaaaaataataatatttactcatgaattattttttgtcacttcatttttcatggcttattagggtataagtagaaggcctcctttaattccttcgtataggaatttttcataaatatccattccaaacaagtaattggaaatgaatcttatgtaatctccgaaattcaatagaaagtttctttgagtctttccctctcatcaaattatgtgtttttctgtggtctaaataaatggttattcttttttttcaattttctattttacacgtccatcccaatcaaaatcatgtgtttcttctattattaagttttttaacctactttccaaggagcctaggtgagttcgtttgagcaacttcaaacgacaacttcatcatgttccattagtacacttcccaaaatgcaaagggatatgttctatggaaaaaattatacatgaaagtttattaaaaaaatcatattaatatattttaaagtttataataattaacacttgattaattatatactaatggtttatcttattttacatgccgccaatttaccgagattcctaatgggcgatcgatcgccccgagcaatcagccctcctccacgtggttttctttttttgcaccgcattactttcctattttagtaaatttatgcatctaattttgtacacctcaagtttacacatctaaagtttagagacccaaagtttataagtcaaaagtttatatatccgattcaaatttgaatttgaattcaaatattttttatatatagtattttctatacatctaaagtttatacacctcaagtttataagtcaaaagtttatatacccaattcagatttgaatttgaattcaaatattttttatatatagtattttctatacattaaagtttatacacctcaaatttatagacccaaagtttataagtcaaaaaattatatacccgattcaaatttgaatttgaattcaaactatttttatatatagtatttctatacataaacttttttctaactttgtttttttattttttttaaaatttatggtgttgtaggaagagaagaaggggaggaggaagggggg

SEQ ID NO: 57901 - DNA, 65502 bp, Oryza sativa
ataggttcctccaatccgtaaatgctgatatttttcatcttccagaataatatttcattattcaattaccgtatcctgatgcacatttcacttgttcacccagctccagaactttggcagcagtcagttaactccagtcgttattgaacttcctttgtctgtactagttttctgaaaattggccgtttcatgttgcactcaaatccaaaagtatgtttttttggttgacgatctgcactagctatggtcaagttttatgactttatctctttattcgagtgtttgattgacaaaatgtgtgaaatgttacagatctaagatctaactagacatccagtgaccgtatttcctgcatttcttgctttgcagaaggtgaacaaacagatttgctgctcaaattcagagcacttggcagttcgcacaagtgaaagaggttgttgctggttcaggtaatcaggtcccagttttgggccgtatatgagcccctgacaagttgtcgacatcgatgagagatctttccatttcagttcttcaagcactctacccgcttgggaaacatcagtctggttcagtttgctgtcaaaactacccatatcaaaatttagtaatgccaaactttgatattattaaatttcagttttgtatgtatttggtttgtgccctcaccaaattttcaagtgtttttatgagaggaaacttctgaaaattctgaagctgggtagagtggcattagtatgaatatgtttagccagcatttggtaatatcgaaatttagaatggatgaaagcggtaacaactaacaaaccgaacaagcccatggtcccaactcccaaaccttcatgagtgaagaaagggaatagtaatttgtaaaaaatgtattgactgctggtgaggatatcttgttctgaatgcctgacaccaattgcacgcctatgcttacctgcactgaaatgcgacatgacaaggcgttcttgatgaagcacaggatgagaaacacaagaatgcaggacagctgatggcatgctgtccagcgcaaactgtcagtacgcacccagataatggtattttcgtaacatcaataaaccagaaaaaaattcaagctatctgcaaaacatagttgaaaataattttaaaaaatggattttcatccttaaagagacattcacttgtttcttgtaattgtatgccacctaaatagtcataaaaaatttaaaacatttaacaacatagattaatatgaaaatatatcactccacaaatatgtaaggtcaaatttagttacaagttgcaataagagaacaataaactattaactaaaatagttaatgtacattcgcagttatatttattataacttataaaagttaaatttaaacttgcatgtttgtggaatgatatatttcatattaatctattttatcaattttttaaaaaatatttaggtgaaatgtaaaaaagagggaatatctactcagagaataaaaacactttcaaaaaaagagtatgaaattatgcgcgtggacaacattatgaaaggaataaagttaagtaggaaacctgaatgcaaacgtggttgcgtggcattggcagcagctcctctcagtccttaccaaccagagcatcatcacctctacatctccattttcacagtactggagatatgttctcaacaacctaaaagtaactttcgctctattgatggaacttaagggggtatttagatctagcggcgtaaagtttggcgtaaagttttgacgtgtcacatcgggtattatatagggtgttgcatagggtattcggacactaataaaaaaaactaattacagaatccgtaggtaaacagcgagacgaatttattaagcctaattaatccgtcattagcaaatatttactgtagtactacactgtcaaatcatgtagtaattaggtttaaaagatttgtcttgcaaattagtcataatctgtgcaattagttattttttttagtctatatttaatactttatgcaggtgttcaaacgttcgatgtgacagggtgcaaaatttcggggtgggatctaaacatagcctaaaaacagaacattcacaacatcaaattacatctgcagagagatcgctcgctacatggattgtcgtgcgaaaagctagaccaaacggagtgtcggtacaccacgacagtgcacgaatggtgggaagcgacaacaaacatggagaatgtgccaaaacgcatgtgctcctaggagatttggaaggaaagaaacgagaaaatctttcaatacaatgagctctcatctatagttttattggcaaaaattaaagagaagtcaaaacataggcgctagtaagagccagtgtctatttgttttgctgtttaaggataacccttttacaactttttcatgtcaacacctgtacagaaatttacttcaattctattcaattgaaattagcaacttgccgattcactaaaaaaaaacatttacaggatataagcaaatatctcaatctagatacaaccatgtagaggcaacagtttatgttgcttacagccacagatcacaggctcaagcaaagaatctcaattaaataaagaagcaaataaagtgaccaaaatgggtccatgcaatgatgggtacagactaccaatggagtaaacaacagccaatattgcatctgctttgcacagccacagggacctggaactctggaagatagctgctgctgctgcttcttctcctccattgccatctatcacctcacctgagctgaaatcaagaactggatctaggagaaggtcatggttccaaggatactcatcgttctcctggttgtgctgcttggattggcattccaggcaattctccggccaccacctcaaaaattgtgtggctcacccggtggacctcctgtgacatctccaagaatcaagctcagagatggaagatatcttgcttacagagaagatggagttcagaaagacaaggccaagttcaagatcatcagtgtccatgcgtttgattccaccaaggacttccccttgcaggtttctaaggtaaatgcaaacatcacgaacagttagatttgagaaaaaaaagtcatctttttttgtccatgttttcttttagatttttcatgcttttctgaattgattgcttagtttgtctgtcgaaattcaggaactggtgcatgaactgggaatctacattgttggtttcgacagagcagggtatggggaaagtgatccgaatcctaagagggatgtgaagagtgaggctttggatattgaggagcttgctgaccagctcgagcttggacacaagttctatgtgttgggagtgtccatgggaggatactcaatttggggatgccttcagtacataccaaacaggtaaagactgaaactgcaataagtaataatgctaaaatggtagtagtgctctcggtcaaaaaccatatgtggcttgacattttctcggttaaacttttgaaactataactatcattaaaaattttgatactactacttaatttagaaatataaaaatgacatgtgtggattaaaatttctttcataaatcttatactactaattactctctccgtcccaaaaaataagtacttttggaccttgacatagtctccaagatgctactttgatcaataatatagatattttaaataaaaagagttgtatattataatattttgtttaataataaatctagtaacatcaattttacattattgaacttttttattattttgctattaatagtcaaattaaaaatatttgatttgtcactatgctaaaaatgtttatattttgggacggagggagtagattttataaactcgtcctaacaaaaaagtgtgatcaacgtcgcaccgtacagacccaaaaaaactgatattcgcaactcttcactatatatactgtgtacctatgtgcaggcttgcaggagctgccatggttgtgccaattatcaactactggtggccttcattcccagctgagctatccaggcaagccttcaagaggctcatcgtgccagagcagaggacactctggattgcacacaacatgccatctttgctctaccagtggatgacccaaaagtggctcccttcttctgcggcagccatgcgccaccctgaaatattcagcaagcatgatttggaggttcttcagaagatgatggcaatgcctctcattgaggtaaaatcagattgtttaacccttatgaaccaccacttatgcgtttttaagaatggttttgaatgaattttgcattattatagtagatttcaaaaaatcgcttgatttacactaatgtggtccagtttgggtacatgaaaaaaaaaatcaagaagagaaaataaactgaaaagtggaacatgttatatgcaaattaacctaaaataatactatcgcaaaccataaataccactatcggtttagatttgtttttttaaagagcaattgtttggaatgttgacatatatatatcactgattgcttcttgatttttcagaataaatctaggcagcaaggcatttatgaatcaacacatcgtgatttgcttgttgcttttggaaagtgggagtttgatccaatgaatattaccaatccatttcctcaaaatgagggttctgtacacatctggcaaggttatgaagacaggttggtgctggttgagctgcaacggtacattgcccagaggcttccttggatccagtatcatgaattccctgaaggaggacacatgttcatgctggtagatggatggactgacaaaatcatcagagcgctcttggttggagaacagctctgaagtctcatcaaatcattctgtgcttgttagcttatcatcgatagccaaaagttaaaatttcaaacttattaattctagagttgattttacattttctatatgatactcgctctgtttcattttcatcttaacttttttcttattcaaacttttttaagtttgatcaaatttataaaaaaaattaacaatatttacaacatcaaattaatttcattaaatgaaacattgaatatattttgataaatatgtttattttgaattaaaattgttgctgcatttttatataaatttggtcaaacttaaaaggtttgagaaaaagagtcaaagcgacttataatatgaaacggagggagtagtgtattttgtagaattggtttttaagtcgtaaataagttttacctataaattatttttactactttatttatttttttttatagatcgtcagccatcgctcaaacgattcgacactcgagggtaaaatttacttaaaaaaatgtacacaaagggtaacattacacgcatttatatagtcaactatattttgcagttttagtaaaacttggagtaatccaaactggagctagtggccaattcagccacggctgaggatactccacatcgatcgcagtgtcattcgtataatcataaactccaacgtcccgacgaagatgtttacggtgaaccaagtacccgtagtcatcgtcgaaatatatgtgatttggcatcaagtgtggataatccttcactggcaagcacatcgagtaactagtgccaataaacaatgcattgttacctatgtcatcgacgtcatcaagatcttgcttcttgtagtcaaccttgtacaccccgatttcagttgttcgtacgtccttatgctcgctaccttcatcttcttccgtgactcgcaagacctgcaggatgtcaccttccgtggtacgtacaatgtagagggtgcccaattcacccatggtcggcttgagaatcagtctatgggtgaaggaggaagaagcactgacgacatcaatggcgtggatggcgccgtgaacggtctgggcgtagaacacgccgtcgtggtagatgcaatcttcgaaccactcacactcattgttccccatcttgatccatgtccacttcttgtcgccggatctcgcgaaggagagctgaagatatgggtgatggatgagcatcaccgtgtagtcgtcgccgcgcgatgggtcggaggagatgacggctttgagatacaagaactccctgaacgtctccggcgggtgcgtcaccgtgtgcatgtcatcgtcgttgctccggtgactgttgccgccgccgtcgtagtagaccaacttgtagttgttgaggttcccggcgtcgtcgtagagtggccttacgtgttcgatggtggcgacgggtgggaggtcgagctgctcgcctgtggccgggttgaggaggtggagctcggagcggtggtcggcggtgacgagccagccgtgggatgacccgacgatgtggcgctccgcgatgggcgggtccgggagggggaccgtgtaggacgtcgtcttgtcggcgaggctgtagagcacggcggcgcgcgggccggcggcggcggtggtgtagaggaggcagggcgtctgcgcgcgggagtagaggccgaggcggcgtatgtcgcgggcggtggcgcgccagagcttgcagacggcggcggagcggaacaggtcggggaactcgagctcgaggaggacgaggccgagcacgtcggccggaagctccgaccagtcggcggccgccggagtgtccatggaaacagatcgattaagcgtcgatgaaggcgtacgtacgtgccgcgtgccgccagatcatccgctaaaataaagcagcgcaactgatcgacgcggatcagatcggagtagaaaccgaacaggtttcagaaatctctatctctatctcttccctatctctactctctatctctatctcctctccactacctaaaaaattagagaaatttccgtgtctgtgtgctaaaaaaaaatgcgaaaaactttttctgtccgattgaaaaagaaagtgcaaaaaaggatttccgttttccgttaaaaaaaggaaagaaagatttctgtaccgaaaaaacaagcgctaaaaaaaggcgaaaaatgtgcgaaaaaaatatttccgtccgatttaaaaaaaatactgtcgtccgtggccaagaaaaagcaagcgcgaattttttctgtccgattaaaaaaaagtgtgaaaaaagggtttccatctcttaaaaaaaggaaaaaaatatttctatccgatatttttagattcttaaaaatagtacgtataaaccgatcctcaagaaaaaggttaatggaaaaaaaaagttctcgtgcaacgtttaaaaaaatgtctgattccataaataccgtcaaagtagatttggaaatttaaaagcgaattcaattttcccctttcgaattactttttttatgcattcaaattatcatatattaaaatccaccttaagatgtcgaagtttatataaaccgcacgagaaaaaaaaagccctataaaaacgctctgaacaaattgttagagtaaaacacctttataaaaaaagataataaaaccatctgacccaatgcgaggaaaaaaccatcttttctgagaaatctgtataattacacgtgaaaaacatcactatttataaaacaacagctttgaaataaccatgtgactcaaagcgagaaaaacaccaccatttattttaaaaaaagctagaaaaacaccaccgtttattaaaaaaaaaaactggttcggcactgtgcaatgcaaaaatgtccgaatttagaaaaaatgcatctgattcgtttcatgattcgtagcatttgtatcgtccatagtctaccatgttctggcatctggaactaagacaagtcttgcttgtgccttttttttttctgagcacaagatcaaattgatggacgtttaggtctgatagaatccatcgattttttccatctccaacacggcttttgtttcctcatctattctcctataaattatcatactactatagctactattctttataacatattatatgaaaataatattaaaaggtaaatatgttataaattgatatttagagaagagtgcacggtggctttttttttagacttgaccatgcgaggcagtgtaggattttgattcatcatattttttattgcaagaataggattgaaagagtattttagattatggccatgtttagttccatgccaaaattgaaagttcaaaaaaattggaacgatatgatggaaaagttgaaaaactgtgtgtaagaaaattcgatgtgacagaaaagttgaaggcttgaataaaaaagttgaaatctaaacaagccctatatgcatgttgtcacatgaataatccaacttttttgggcaaagcaaagcattagtaagattgccatcgtcgaggttgggccatttatggaagatgttctatttttccttatgatatgtcttagctacaacaatcaatacaaacattattattcacatggttatttatgaaaaacatatattatcattggaatttttcacccgttgcaacgcacgggcagttttgccagtactacttaaaaaaaagatatgttttcttcgatcgtcaaaaaaaaatagctagaaaaataaaaaaaaagtccgacccctagatcctattccctctccactcctctcgttttcaatagataccgtgatatcccatatatcttggtgaaaagaattgatgtgccggattgaacatccgtttgcaaaaacgaaatctacaggtcgagagcattccatttttatatgattttaatttttgggtttgtacttttgtatttgattccatataatttttatatttacatttgagtccctataatcttgcaataagatacttgagatcgttttagttaaaaaaataataaaagggtgagaaaagacagaaaggtgcataaaaagaaaaagaaaagccgcataaaaaaaagaaaaacaacaacaacaaacgtagatccgaacggaaaagaaaaatctgattcctataaaaggaaaaaaaagtggtggaaaaaaaagctagatccgattcctttaaaaagggaaaaaaagttttattcctataaaggcgaaaataaataaaaacatctaaaaaattcgtccgattccctaagaaagtggcgaaaaaatgcttcgtaaaaaataaaaagctggttcgtataaaataaaaaatgcacgcgagaaaaaaaaagaaaaaggcgaaacaaagtccgatttctaaccggtatatatctattctctatctctaatctaatctaactatttaaaaatagaaaatgcatgagaaaataaaaatggttcaaaaaacgtgtgagaaaaagtcagaaaaaagcgcaagaaaaaacacgctaataaggttttccatcttcctaaaaaaaattaaaaaatgggtgagaaaacttatttccattgtcggtaaaaatttttttaaaaaaaacatgcgaggaaaaagctgtcagaaaaaccgcgccatttttaaaaaaatggtttgaaaaaaccgtgcaagaaaaaaaaacaccatctattaaaaaacaaatcactctgaaagtactgtccaaaaaacgctaaattgatggacgcttgagtcggataggatccatcgatttttgccatctactacacggcttttatttcgccatatattctcctgtattggaaaaaagtaaaaaagaacattcgaaaaaaagcaaaaaatacgcgcgagaaaataattgtcagaaaaaacaggcaaaaaaacacacgagaaaagaaaagcaaaaaagggagaaaaatatggttttcatcgtcagtgaaaaaagaaaaaaaaacatgctagaaaaaaactgttagaaagaaatgcgccatttctggaaaatgattagagaaaatcgcgcaagaaaaaaaaaccatttataaagaaacaagtcgctcattaaaatacaaacattgtcattgacatgattatgcatgaaaaaagtatattatcattagaatttttttcactcgttgcaacgcacgagcatttttctagtctgtttaaaattaagataattttatcgtccttaagtaagtacctagagataccatatttagtgtaaaatttggtacatttaggtatcaagtaccttaagtatcaaaaaatttattgtaaaacaggaactgtaaatttcctcttaaaactatacttcagatatattctgctgatcagatgtttgtccgtgactgacatgtgaggccccggtcaacgtgtcactacgtgattggcctgcacattgtccagttcttttgtggtcgacgtgactaatataataatatattcggattaattttttaatagcgttagatgtgtttggcagtaatccgctaggggcatgcgaattagctaagggagttgatggagaaaattaacgtgcgaatttaattttttaattctaattatttcttttttgctgggtacattgctagagagaaataagagggtattcatgagagaattcatatcttctaagatatttgatgtgtgacttttgaggtggaaaattatattataagtcatgatgaacggtacggtgaggatgtatttatctttcacttaaaacacagttctcactcaattaccacccctccctagggatagattggtgggagttggatcgattaattccccatcccaatcttttctaagggtctctttgaatcataagaataaaaaaacagaggaatagaaaaaacataggattctgacatgaatgtaagtgtaaaacagaggattgcaaaacacaggaaaaatatagtaataaccgtttgattggaccacaggaaaaacacaggaatttgaggagagataaagactcaaaggatttcttctatgaggttctacctctcgttaaaattcctacaaaacttgtatgggaagagacattccataggaatttcataggattttatagggtttattccttttattcaaagggctttgtaggaaaaattcctataggaataaaatcctatgaatttcctttgaatcaaagggggcctaaattcataaatcctccgattaaagtgagattaaaatgctcagatttcttacactcccattccatctctcaaactcctctcaactataagccgtaacgccacgaaaataattagagaaaagaaaaggagcaaaatgaaaagagcaaagctagctagcagcccagtagctagccggcccagcagcaaaaggcagcccacagcagcatagcagcgcagtgcaagcagcagcagaagagcgagcagagcagcagcagcgctggtactgtagcaaaaataatcccacctcaccaattcaactcgagggagaccttttctccaacgaaagttggataaaattttagatactcgtggaacgcttttcaaactgctaaacggagaatttcgtgtgaaaactttctatataaaagttgttctagaatatcagattaatctattttttaagtttgtaataattaaaaatcaattaatcacacgttattaccacctcgttttacgtgaaacacttaatctttatattcatcttcatcttctggagattcaaacaccacctagataggagaagagcccccggtgagtgtaacagcatctccaacagcctctccaaatcgaactctccaaacacccataagccaactctccgtctgatttagctagtcaaactagatactcactccaacagactctctattaatcctctccaaaataaaatcggactcacatgtcaacatctatcccctcttcttcatctttctctcccccttcttctttctctttccttcttttcccccttccttccttcccgtcgaggcggtcgacgcatggtgcggtggtgcggcgacgcggggaggtgggaggcggcgacggcgacaacggtttaggggcgcagcagcggagctcggggaggggatggcgatggcggcggcggctcgcgacgacgacctcgacgacgaccctgacgacaacctcgacgatgacctcgtgaggagtacagttgctgcgggccaccgttggcgaggcgttttggctggccaaatctagccagccaaccagcgattttggccagctggatggctgccagtctgttggacctcctttttatggttgaatggccaaaatttggcttggagagtctgatggagtggttgttggagatgttctaactccgattctggaattttttattaaagtgaggacgaaaaagtagtgagttgtagtgttaggtgtggtcaaactggatgagatggatccaatactgtttttgggccttgggcgtcacaaaagccgtttaagtttttttttattaggtgtctctccttttatcccgtatatatacttttgtaagctacatggaaaacattttcattgttatttacctatgtttttaactaactccttgtcagggttatggataccacatacctattagtagttgactaaatctcggcaggactcaccacataccatgtcttatgcggaaacaaccttcggatatagtaggagttccacataaggaaggatgaatagagttctacatggaaacgacaaggactactcgggttgtatccatattggttttcctagttctacttggacaaggtgatacttatgggtataaatacaagaccccctaggagaagaggggatacggaacaacagaagccacaacatacaagccaacatatgccaagacaaaacgccggatatcgacttcagagataggcatggctagtcccctacggtacctacggataccgtcaggagagatatagcgatgtctcttatctcgccgaatgcggattcgaagaggaaagctaccctgttgtcgactacgagtcaaaccttcagaccgtcatgtcgataacagttagataggctaccccaaatattgtaatggtgtgattatgatgaataagagcaacgaccggcttcggccaacgggatgtagggttattacctgacaattcagaggcctgaacctgtataaaaatccctgtctccatctcttttacctcaatctcgtatataccctggtaccaacgatccccatactatgcaaataccggaatcgcgacatcaaacgtcaacactcctcaatagtgatcatttccagtcgactctcatggtattttttgtaagtgttattcacataaatatttgtacctacatatctattatattattaaaatagttttgaaagaaggcacttcgtttcttgtggaggctaaaaaatcccacattaatcaaagaaaaagaaaataaaagtccaagtagacgtacaattaaaaaatatctgaaatactaaaaataagcaatattgaaagaagagtccatataagaacccaatacaagataattaaaattcggaattaaaaataaaataaattctgaaattagaaaaaataaaaagagttcatgtaggaatataatttagaaataactgaaatttggaactaaaaataactaatatctgataagagtccttatacaactgaatacgagataattaagttcggaataaaaaaaactaaatttcaaaaatagaaaaatgattataaaagtttaagtaggaatacaatttataaatataaaatattataataaaaatatggaattttcaaaaaaaaaaagataacctagaactcaacgatgacaaataacaataaagagagagaggacaagtaataggccctaaaatagtaaggtggtgaacagttgatgggacatctaaaaattataaacaagaccacaaatagaaccccagcaacaattaagaggtggaataacagacaggacgctaagcagcatagccacgacggttggcgtgacttttacaatgtaaaaaatgaattgcaataacaatcatgttttattttaaaaatcttcaatgataataaatgggcaggtcatataggagtatagtggtggagccgacagcggttggcgaggcttctagaaattaaaaaaataaacccttaaaatttgaaataaaaaaattgacaatgggaaaataattctatgagttcacaaataaaaaaatcggaatgaaaaatatggaattttcaaaaaaatagtccatctgaaactcaacgatgatatataatagtaaagatgagagaaacattaggcctgtaaagcagtaagttggtagcaattcatgcgacatctaaaagctataaacaataccataaatagaatcccaataatgattaagaggaggggcgatagacaagccgttaagcagcacaatcacgacggttggagggacttctagaaactaaaaggtaaatcgcaatgacaatcatgttcgatttttaaaatctcaatgataacaaaaatacatgagcatagtggcgaagtcggcggcacggtggttgggcggatttctagaaagtaaaagatgaacctcaacgatagttatgtccaatttttaaaatcccaacaacaataaatatggaagacaataggtggatcatagagaaatacaatattgatgtttgacaacactcctaaaaattaaaataatggaacctgatgagacaatggactctaaaaacttggactctagaaactaggaggtgcaatttttaaaggtttaaaggaagataaataaaagcagtgatagatcgtacaaataaaagggtgataaaagagtaatgggtaatgactggtgtgacttttaaataaaaactataaaaatttaaggatgataaggttcgatctttgaaggttataagacaacgcaatggcaatttaacaaattttaagtaacgtcaaatataaaaaaaatagataaatttatatggatgctagcctcgcaatttcgcaggtctcccagctagttttcgtaacatgagtaagggttagtcacccgtcccgaagaatggatctgcacaatcgctcaaaaaacagcgggaggccacgccgcaagcccgaacaagagctttacaaaagtcggatagaccaccagtgaggccaagaaagagccgaagggtccgttaagaagtaagaacgttgcttatcaacttcacctgaacaacgacattatatgggatatcaaacacacagcccatagatagaaccgtacctaagcaagatggctagactctagagaaccaaacactagaagacccatatagctaacgttgaactaattatttagcttaacaatccatgttcaccgaatacttcagaaccaaattgtgtagtcgatcgtgtgcccatgcatcgatcgaagcacaaacagatgaatttccatttatattttctagcccggtccacatatgtatattcgatcagcagcaagcccacaaaaacaggtggcctggatgatagcaacgagaacaaacaaatgtgccagcaataatgtgtcttacatttgccctcggtcaagtaattcaccgatccacagctagcggggaaaaagttcttaactcgagtaatagaggagatcagtctatattcgggaaacaggtcgaactcgatccattgttttattgagagttaatatttcccgatctggtgtgcttcttacttttccgacgaaacctgcaattaattaatcaaagtacatcagaaatagccattcactgctgtttaatgcacgtcataattaaaaatcttccaatctagctagctagtgttctagaacacagttcaaattatgaataatggatcatctgaaggctaagggaataagtatatatgtacaaacccttcacaacagttagctgattaatcaattaccagctggtagtagacttgtacgaacttatgaagggccatgctcaggtgggaaagttccaccaccctacatatatggaaacaaagaaaaagaaaacactcatttgagatatctctttgagtttatctccatttccatggcactgtgttgaaatgcaaaataggcgcgaaacatgaatgaactaacacatctataattatcagtgggataatgaaacaatagtacgtactcctatatgggaagcaaaggtgacagaactgagataaattatatgaactaacacacacatgtttaatactagtattacattaattacattattactccttggtgtgatgagagacagtacaatgtggatctagcagatttgtacatagcagatacatttgcatgccacatgtggaaaggtagctaatttgtggagtagtactagtaaattagactgagatgcaaaatcgtaccgcttggaagtgaatgagcgtagtggtgatgcttgccagcggctgctgccgtatcgaacgcaagcaggcaatctttgcacttgacggtggccttagaatgatgtctagacatgtgtctcccgaactgtaacagtttagtggatcagaattcagagattcaaattaaatcatctatcaatcgatcaactgtagtagtagtagtaagttatgcagctgctggaaattaagacaattatattgcacatgtacacatgctctgcatttctgtaccttgtgctttggaatgtagcgtgggtcatcgcactgcgaggcctccatgcagatcaaacacgacaggaaatcatctggacagaatagcatagctatcccgtatcggcggtagaagagcacctcctcgtccgtctcggggtgtaactgcctcacaagcgctaacgcctcgaggaatctaccagtcgcgtcaccgctgatccttcgcctttgttggttttttttcccatttctggtggcgttgcaggctgcatgcagtttcagagagcacggcgtcaatacgattattgcccggtgaaacattacacgatgatgccccatattgccacgcgatcgcaatcgatggtgctcgtctcgagcggttggatcggaggaatgtctcggctggcccgtcgagaagagatcggagaaaggaggtcgagggtttaatttggaagagacctcgtcggtggaagggcttcggtgcggatgctgtggtcggagtcggaggtgtgtcgtcgtcggtgcagtcgaacgcgatgacgaagtacggcggtgggcggtggcgttcggaaactgcagcgacggccggcgtcagcaagtcaatcgcgcgcgatggcgctagggctaggcgctagctagctccgaaccggagagggaagctgggttttggactaattttggtcagaaaacgaacgggatagagagacggcactgccagtactggtttggtttactcccgccggtggacaaatcgccgccggagaagttgacgacggcgaggaatcgatcgaaacggggagaaaacggcaagggaggagatgatgcgggagaaatggttagaaaattgggggagaaaggcggagatcagaatgagttaataccttcccttcgtgtgctcggtgcggtggacggcgcggaggaggtggcgtggggcacggtgcggtcccggagctcgcagccggaggggtcgacgacggcgacggcggcggcttcaaccctcggaaactgcagcgtgagaaattacggcgtcagagagtacaacgatgctacgcgccatggcgctccagtctagaaaattccagaaaactccagaccagttagctagggtttggatcgcgagtggatgagatggggagaacgaggagcgcggatgcaggaacaggatgctaagttgctaaccttaagctgcgtgctcgtcgagatgcggagatggacgaaggcggtggctcgtcgaggtggacgaacgcggcgtggtggtgggtgcactcgccggagcccgcggccggagaggtagaagacgacggcgcgcgcggcggccgcgctctctctctctctccgtcgcagcaaaggagctcgcctcggctccgcgagatcggggggtcctggtctttatagccgagacagaaggcaaaagcttttttttctccctttttttctttgttttttttaaacatttcttatttccttattacttcctctcgaagaatggaagacttcgcacgaaatacaagcccaacacaacacggcccatctcctctgtcgccatcgcactgagataaactctctcttccgtagcccaagcagtggacagttactgagtgagtttagcatttgcttgtcagcaaatggaattactggtacacaatgcccataacaaaagctacacaattactggtacaacaacaattactggcacacaacagctaccaattactggtagtccgtaaactactacagtataccagcatctcaaccagataaacatcgcacagcgacgacgtagtacatatcagatgatgaattatccaaacaatatgagcattgttacatatctgacaagccaatgcatgtgccaggtgcatatgcaaaattgtcacttatacaagcattaatcatttcaacgaatcattgttgacttttaccaatagaaaccctatatactgttgtccaaatctcagtcccagatgttctcaacatgatcaagggattcctattacacctcatcaaaagagaagatcaatggagaactgtttcttcatgaacatgagaccaaggaaaaaaatttacaaaaaatagaaggcaacatagaaggaatgtactatctgtctggaaagaacccaacttctttactcaagagaatgttccccaagctccatcttccttgctgattgaagacgaaaacaaaaatatgctgcctgagcacagctaaataatgaacaattgtacagaaatatgcatatatgagatgttcttacagggatttccactaaaaaagtacacatggcacaaaacaacattctccaagtattgaattgcattttttgactggtcttcatcaaatccttaaacaaggcattatgtgcaatcaataatctggatgaatatcattctgatgcatttcagaatacagccttatagaccctggcaccctgcccagttaccttctttacagttctcatctatcagcaaagtgtgagtgtatttgtttggcaccaatccccttgcatcaaagtgtacagttgagaagaattagtgctcatgcaaaatgataaggattttacatggaaaaaagaggggaaagaacgccaggtctaaaattttatgtgcatggaacattatggcaaggaattaagtcaggtagagaacctggaagcagaggtgttgcgtggcaatggcaacagtccgtctcctcaccgaccagaatttcatcacagcttcatctccatatccaaagtgggtgattctgaatttccatcaacaacaaggacgttcgaagcaacaacttacatctgccgagtagaaacagggatttgactcaacataaaccatgtcgaggtaacagtttatgtagcttacagccggagatcacgggctcaagaaaagatctcgaataaataaagaaggaaagaaagtggcatgaaggggtccatataatgatgggaacagactgccaacagaataaagaacatccaacattgcaggatttcccctccacaggacctgtaagacagcttcttcacaattggcaccccttgcctgaaagcaagccaggatcagggagaaatggttccaaggattggcctgctggttgtgctggttggattggccttccaggcaattctccatccaccacctcaaaaattgtgtggctcaccaggtggacctcctgtgacatctcccaggatcaagctcagtgatagaaggcacgcctacaaagagggtggagttcaaaaagacaaggccaagtagataatcgcagtgcatgcatttgatgaaaccaaggacttacccttgcctgtttctaaggtaaaggcaaacaacaaatacagtaagattggaaattcctctttttgtgtggatcaaatctacatagaattgcaacattgattttttttctttagttcacacttttcttaacacattactttgtctgtcaaaattcaggaacttgtggatgaactgggaatttaccttcttgctttcgacagagcagggtatggggaaaattatccaaatcccaagaggaatgtaaggagtgaggcattggatattgaggagctcactgaccagctcaagcttggacagaagttctgtgttgggaatgtcgatgggaggatacccaatttggggtgccttcagtatataccaaacaggtaaagaccgaaactgcaatactgtaccatcaatggtatatgtgacccttcactctccagaaatgtaaagatacaactactgtgtgcaggcttgcaggagcagcgttagttctgcccattatcaactactggtggccttcttcccccgctgagctatccaggcaagccttcatgggtctcatcatgccagagcagaggacactctggattgcacacaacataaacttccttgctctacctctggatgacccagaagtggctcccttcttctgcggcagccatgcatcatcctgcaatatttagcaagcatgatatggaggtccttcagcacatgatagcgatgcctgtcattgaggtaaatcagagattatttcacccacatgaagtgctatttaatagaacattagaactacagataaacaaatgcatcggccacatccttcaaagcttgcttgatttatactactgtggtcaagagaatgataactttacattaaaaaatagtaagagaaaagctttcaaaattaatatttatatcaaaaccaacctaaagaaaaatgtcccaaaccataaatactacttgttcaggatggcatatcatcgctttctcttcatttttcagaataaatcaacgcagcaaggcaaggatatggaaattgggaggttgatccaatgaatattaccattcaccaatccatttcctcaaaatgagggttatgtacacatctggcaaggatacaaagatagttggtgctggttgagctgcaacggtaatttcaaagaagctttccttggatccattatcatgaagtcccagaaggaggacacatgttcatgctggcagatggatggactgacaaaatactcagggcattcttggttggagaataactctcggagctgtgagcctgtggctctcactgaagatgctatattgctatgtagtccttttttccaagtttatttccgataatatcaaatttggccccattcaatagatgacagaccatactgtcacattaagctatttgttaacagtgaattgggtaatgacaattgaaaacacgaagccttggtgcgtctctagcttcactttggttgtttatgagctgtcacaatgcctgcttcagctttcaagtacagaaggcaggtaaagaaataatgctaagataaatttaagtaggtcaatgggtattttaaaaaagaataatcaaatgcaatacaatcctataaaacagtacctgaatggtactaacatagtaataaaactcatggaaaccacttgtttcttgaaatgagtaagagtttgggcgactgcagaaatatagtacctgttaagattttttttcctctgtctggtaaaatcaagtttcatatattccaaatttgtgacagactgggcattcctgtcattcctgatacacctaacagaattagtccatagtattttcaagtgtagtaataaaatgttttcaataccagtgaccagactaccagacagcatgagccatatgacttaaatcagtccaagaaaatagttcatgatgagagtgaatacatttataagacaacaaaaatgcaatcatcacaaaaagatcagtctagattctaacaaatcaatgaaataatgaagacctcatagacaatagaatccacaaatgtaacacttagttgctttctttatataacacagctaaaagcatattcggaaacggaatgacggtttaactacttcagagtgcacttctggaaagagcgaaaaccaaatcgaagaaaggcaggtgtctacaacctgaccatattgcattaatcaacagagtagaatgtactaggcaatactaaagtaatcacattagtaaacataatactaagcattacttgatctaggttctggcatcatgaatgtcatcaactcactcgcatacaatgttacatctttttcactgctattaggtataccactacccacaaagtacataaatttgcaaaagatcaagaatgaatgtcagaatgaagtcactactttgaaatttgaatgttgcatatggtaataccaacattctgcaacaagttatggtccattttgtcaaaatgatacaacttacaaccttcaaaattaagaaatgaaaccaagataatgtatctgtttacaatatacggttaaaatgtcaagtagacaacagttacacaatcacaaatccttaaaagtactgtaactcaaccagataaacttttggcattggagaatcaaacacctgagtacctgatccacaagaactgattaaaatgcaatagagaatagaattcagagatgcatggattgatcatgttgtatacatgtgttttggatggatctgatcggatacaaaagtacaaatgagaaattcctgagagcaaaataaaatatactccctccattttttaatagatgacgccgttgactttttctcatatgtttgaccattcgtcttattcaaaaattttatgcaaatgtataagatataaatcacacttaaagtactatgagtgataaaacaactcataacaaaataaattataattacgtaaattttttgaataagacgaatggtcaaacatgtgagaaaaaatcaacggtgtcatctattaaaaaacggaggtagtatttatcagtagcacttcagaataaacagaagagaagaaaaatgcatgagcagatgcttcagatatcaggatttcaagtacagcggattaacttccaaaccaaacggcttacctaggtttacagacacaattactattatgacttcttggaatgtttcaagcggcaataattcaatggaatctgaccactagtgaatgaaaaacatactgcagatttgtactacacaaccaacctctagcaagctgtgcaatgatttgagaacacagattaagtggaatagtaaacacttgtgtgtgtcagcaaattaaagggcctctctgctgttgtagtctcataagcagaccatgtcttgctcatctccttatcagtagacatagaattttcacccaagatagtttaacattaaaaatcaataaaatgtatccaaacaatatgagcattgttatatctgagaggccaatgcatatgccagatgcctatggcaaaattgtcagtgttacaaggattattcattattcatttcacaaaatcattgttggcttttaccaataggaaccctatatactattttcgaaatctcggtcccaaatgttcactaccattcaactttttttttttgagatagtaggtatatgggagacatagtcaagagatttctattacacctcatcaaaagagaagaacagtggagaacatctgtatctccatgaagcatgaacatgtgaataaggaaaaaaattgacaaaatttatccaacatagaaggaaatgtttgtatcaactatctatctggaaagcacccaacttcttttctcagagaatgttccccaagctccatcttccttgctctgattgaagacaaaaacaaaaatatgctgactgagcagagctagataatgaacaattgttgcaaagaaatatgcatttatgggatgtccttacagggatttccaccaaacaagttcacacggtacatctttcttaaggacctgtctatgcacccaaaacaacattctccatgtactgaattgcatgttttgactggccttcatcaaatcccttaaacaaggcattatgtgtgcagtgatctggatggataccatgctgatgcatttcagaatacagccttatagcctcttcccagttaccttctttacagttcccatcaatcagcaaagtgtacgtgtatttgtttggcgacaatcctctttccagcatctcatgaaaatgctgataagctaagttagttctccccatcctgcaaagtgcatgtatgagcacattatatgttacttcattaggtcgcactccttcctccagcatcttttgaaaccaaccatatgctgagtaaagatttcctcttctacagtatgcatgaatgaaaacagtataggtcacagccgaaggtggcaacccacttacaagcattccatcaaaaatatcccttgcttctctcagacgccccctttcacaatgtgcgtgaatcaagcatgtgtacgtgatgcagtcaggctgtaaaccgtcactgaccatcttcatccacaacacataggcatctttcaagttaccagatttgcacaatccatcaaggaaaatattgtatgttactgtatcagaagaaattcctcttgaaatcatcacctctgtcagctgaaatgcctcagaagtagaacctagaatcagctctgcagaaatccttgtattataggcaaagcaatctggctgcaaacctttgctcaacatttcatcaaagaactctcttaccatcgcaagattcctcaccttacgagacccattcatgagaatcgtgtatgtagaaacatcaggctgacagccctgctctaccatttcctgcttgaatctcctagcttcctctaaatcacctaatctacaataaccatctaaaagaatgttatatgtcaaaactgatggggctaaccccgcacgcttcaaatcaccaaataaccaaagtgcctccttcaaattccctgccttacaatacccatttattaaagaattgtatgtaatcaaatctggaagtaatcccattgctctcatttccacaaacttcatccgagctgcctccacattaccacttctaaacattccatgaataattgtgttatatgtcaccaccgtgggtacaatgccctcattctccatctccaactgcaatgctccagccttttcaacagaaccccttgcaaaatacccagtaataagtggattaaacgtgaaagctgacgccttcttggacatccgcattctgtcaaccagctgagctgccttctccagctcacctttcctggccaacccattaatcaccacattgtatgtgacatcactcggcaagcatccaccaggccgggcctccatctctctgagcaacttggcagcctgatccaccctaccctccctgaagaaagaatccaacaacgtgttgtatgtgacaatgctcggctcgattccaagctgaagcatctctgcatacaccgagcgcatgtcatcccacctggcttcatcacgcagcgcacggagcacgaggttgcattccttgatgaaagggggaactccgtggtgcgccatctcacggaaagcggcaaggcatagcgtcgaacaggtggagggcgcagggttgcgagctcgggtattgaacttggtggacaggcgcaggaggaggttgaggaggtagtggagggagacggtggtaggaaaggagaggaggagggagacaagggggaggagaaggccgaggtggatggcgcggacggagacggggtgggcggcgtggaggtgcttggcctcggcgagcgggacgaggacggcggcgtacgcggaggcgcagcgcgggaagccgcgcggggtggcctccgcccaccggaacagctggcgcgcgaggcccgggaggccgcggagcgcggcgtggacgtcgccagcggcgagcacctctcggagcgcctcgggtggtgggggatcagacgcgagcagcgacgcgaacgggctctcctctgtccgaggcgggggaatcagcgccgtcgacgacgacgacgacgacgaggagacgaagcggaggccggagatggcggcggcggcggcggatgcggcaggagcttgggatttgcaggggtggatggagaagagcatgggttaatgttcgagtcctccccggcggcgcctcgccatgaatggctgcggcggcgggcggaggcggcgccggcggcggggaggaggaggggagaggagggagttcgatgcggtttgtaagatggtcgcgtggccttctccttcgcacacgacttaacccagaaaattttcttgtaataattcacttctctttgggcttttctgtaaatggcgcaaacgcacgttactctttagctgctccctttgtaatacttggttctttttcactttgtttttacttcaatcatctgtttttttaatggagttttatggctatatttaggatgcaggactttaggaaactttacgaacttgtatttctctttttttagggaaataggacaagtggccaaagttgaagaataaacacttcgtttcaaaatataaagaattttgttagtacaagcttaaaatctcttttatattgcttatatattgggatggttgtagaagtactctagggtcaagtagctagtttttttttttcgtagatacgttagcgttggtagacgaatggataggatagtatcccagtggatgtattgtaagctcaagttgtgtttattgattggaagttgctaagataccttgaactacaataatatgcgggcacattacacgctgaactgtactccaaaatcgatatagacatcaggatttgagccgtagtttccagctttcaatcgcaatctggcatggaccaagactaaaaccacgaacccacaaagccatgtaatgtatgcatatccttgtgatttcgacaggttcaagcgaattataggaaattacagacagcatccatcaggtgatggcctcccagtcccaatgtgattcctctactactgtaggaaccaatggtgatgataacgggccatattgagctgaatctcccggatctggcccgattttaaatgcatcctacgtaaagcataatatacggatgcattttgaggacaaatgtaccacgttttttgttcactacaaccgaaaaatcagcacaatgggcttgcagaaaggaactcaaagcccgggttttcataagaatcagtagctgtcttcatctgtctcgggcctccggagataataacgcaagcaattcacgagcacctatatgatggcatgttaagagatatataagtatgatgttgctgagatgaccaaagattttaacagaaagtagtaatcaaggcattgcaatacctgagataatgagctgttcaattttgcacctctgtaactcacatggaatttgtcctttgcaaccaagccctgaataaaacatcacatatgaagtaaggaagggagttgacagaacaaggggatttcataacaaagaaataggaacatggcatacttcagtatctatctcagctgattccacatcaacgttcacgtcagtgatgatcttcactatttccagaagtagaccaggccgatcagctgtctctatgtacagcatgctgcacatgtttaactaatatcaatgaggaagacggatgatgaacatcatatggagcaaacagagaagtaaggcacatgttatatcagatgtgatattgagaaacaatacatgcattactaataatatgtagacatgtatcaagcatgaactattaaatgatgtgcatagaaattcaatgatttacagactcaaattaccatgaaaaaaattatacctgtataaaactagggagggttggggtcacagtgttatataatgcaaaacttcaaacatcttataatagattcaatgtctttgcacaaatcttggtggactttggattgataggataggcatgaacatacatgtatatgtagttgtgtttctcaagttacttctaccggttgcattcgtaaagtatgctatcaggtccttgttttgtggagaaatcagtaacgataatatgaatcaagagtccttgtgtgcctttttttcctctaacacataggagagctgcgcatcattctattaagaagagagggagtctaggaagactcgtacaagcccttaaggaccagggttaaacacaacaaacaaaaactagaagaaaatgtgtgcctatttttaaggtaactatctagccgtgcacttgtaatgccccataagtgttcaattatacaatctgtggacatgtcacatcccactcctaagcaaggcatactgaaataaggaatcacgctaaaattgtatataatcattatggcttagttggatcaaaccttcttttaggtccatcatcttcaacaattacatgtgttacaacatcaacatcaacctgagagtttaaagaacaaataaatcacgttcatgctaaagttaatggaatacaaaattaacagcataacaaaacactcaggaacctaacttttttactgtgttaaaattgaggaaaacacacaactttaaaattgagaagatgcttgataacagagcatgggtggtgaacaagcagaatgagaacatccaatgaactcaccttcttctcaggagcttttattccaaaaaattcacccatggctaaattctcacttgattcctacatgcatatcaaccagacaaatgagttagtttgatactttgattcataaaaacaagaacggatccaaaattactaacggtagaagttctaaacacaagtaaaaggatgtgacgctcggaacatacaggatgatactgcagaaggttgttaataactgttagccgtatcttttccaatgtgtcagggtcctcaactttgcgccccctagatacagacagaagagggggaaaaagataatattagacatgaaattatccaaatcaccaaaacaatataagaagcatgatagttgctaaatgttttaatctcgtattgtgtttagtgcacatgtaaactattagtatggtactttgataaatatgtggattcaatgagaaaatacaccctctacttcaaatataaactaaacagcatgacaaaatgcagcacacagaaagtggcgtgcacccacgatcgcatgatgtggaactttgtttgtgtgacagctgattcagttgacacacttcctttcgtcacatcaaggcccaggtccttgagtgccttcatctgcaaacagtgaataccaggacaaaataatttactgatacaacaaaaattactaattacgaaatatatcttaaacaagatcagatcaaatagagcacccatagcataggaaaattataccgtgtcaagtagtgcccccagacggtctccaaaactcagctgcactatggttgcatcacggtctgagtcttgatctatcagaacaactggctgtggaattgcatcatcagatgtctgcaatatttttggggggagaaaaggtacatggtagaaaaatatcattagctaaatatgttctaaaatattttaatggtagtaagcaattaaaaatagcatacacgaagcaaaaaaaaagtaatgtcaaaacaaaaaaaataataatcggactaaatggaaacaatataagttctcatgcagatattgaaatgtgaagcaactcttcccgcggaccatgtctacaactgaactgacttcacacatgtcctcagatgaataattgcactgtggacctaatttgcaggctgggttgttactccagatctccactgtttaggaagacaactctatccttcatcacttgatttttttttaagtggaacaacaaagctgaaggacgtgtcgctgtgaaatgtgtgtttccatatggtgacatgaatggaaaatcaatatgtacataccgttgaagaagcacccaagacatcagccgagttgatagattggcaaaaaatcctacagtgatggcattgagaaaaatgatttagaggagggaatgagcttagttcaggacactgatgtactacaaataaccgcagaattaaatagcaacactagaaatagaatcacgttatgcatttcaaagttagcactcagccactcagtagccattggactgacatacatgaacaaaagtaacaaagggaaaataaggattgcacagttgactgcaactaagtactgattctgtccctttactgatgcaccagcattcaacagaaaatccttagatggctcctaattataaagcacacagatttctttaaaacgatcatatagtgtttacagacggacacgttgaatagaaaatatagttttagaaagctttatgccacaattccagtgctaaagcccacagaatccaacacatgtaacaataggccttcacgagttagtaaatgaaaagcccatcgtgtagcaaatcggtcttctcatgttgtttattcatttatgacttgtgagaaatgagaatcaaagtgtaggtagagttgtaacttgtgtcaatatggccttgaaacaaatccgcacaccgtggcacgagctctctatgtaaagtttctttcgagtgaactaaggatttgaagcatgaaagtaatttttttttcttgttcattccattcattttccaactcctattagtactccaatcaactgatagagaccttctccaacattcatgttcacctaaacatgaacctcactaccttagtgaaactgagactaacatggatatttccacaccgggtgaaactgcacctaagtaacgcaagatatacaagtgagataataataaaacgattgcatctcaagatactagaatttaggataatcgttcttgccagctgacaattacaacgttttaggcaaaaaaaaaacgtaaatagtgtaatccgtgtacaaacaaccgcaggacaatatctgtactaggtaaggaatctatcaagatactattagtacaaccgcgatttctccaagccaatccaaaacaatatcaactaattcagtctaccgacacgacactccaatagtccaatcctaccgcacatctcccgacacggcgaaccacccctccctcgtcatcgattcgaatcaaacagccagacgcaacgcggagatgcctagatcgctcacctcggggccgcggtggcggccaggccgacggatcgggggaagtcgtggaggcggaggaaccccggcgacacgcgagccgagtagtacggcgacacggcggcgggcgcgacgaggtggtgggcggcggcggcggcggcgagagccatggctggttggtggtgacactcgctgcgcgcactgcggcgaggcgaggtgaggtgaggcggtttctctctgtgtgtgtcttttctgtcgcttgctctggtcggggcggttgggcgaggaagtggatcttttttgcttatttttatttttttaatctgccacttggctgcattattggattggatgtgccctttttcttttcttttttcatttttttcccctgctgttgtgttgttcgtcagctaggattttttggacagtggttgttgcagttgtcaaaattttcattgaaatagttttattttaattattggttgccttgtctggcatgagagtatgaagtgtctcttttttttctctctctttctaggtgacgccagatgagggtgatgattcattcactcattcgttgattcccaagagttgcaaacgaaattggcatgcttactgccagtaataaagttgaagacgtgtcgatgaaacggaagtggctcgttctctgtttgtttaggaagatgggccgggctgaatcacacgttagttggaggcccgtcggggcatgtagtccatgtactccctcctactcagaactactcagaataagtttatttgctccttccgtttatctcaaaataagtttacttttaaaaaagtattacatcctagcttataaaagaaaagaataaatgcatttcttatgtatttactgaagtttggtaaaaaaactaaatgtatgtaaatatttggtaactttataaaaaaaagtatggtttaaaatgacatcaatccgaacagcccatgaattttaaggaactgtctatgtaacatccagctgaaatttttttgtcttttcagctggatttctagccgtcggatagacctcttgccagcatcccaacctcgccttgcgctccctgcctgcgcggccgcgcctcgagcgcttctcatttttatgtcttgttggattgggtacgggcttcaagcacgtctgtgttttgtctattataaaaggtccaacaaacaaacgggcttgaaaaacactggcccaatcactgtccacgtaacagaacatatcaggctttgcaacgaaagctctgtttaatagctaacattctctgaacatacgtcgggctatgaaaaacatgtaatctactgtgttcaaattttggttctctgaaccaaaacccttgaaaagaaagcaaagcactagagccacctaattactagtgcctaactagattgaccattatctccactggaagatcagccagaaaacatcacaagattgactttatctgttagcttcctagtcatccatagcgcaatattagaccctgcaaaaatttgtacattttacttagttacttcgtaccaagatgcagatatttctattccaatctgtgacagaaggaaaatcttgtacatcttcatgttgaattttgtagtcccaaaattcagaatgagtattagcttagaaaattatggatagaattttaccccaaaatcaaaatgagtactcattttaccccaacatgagtactagattgaatcattcctgcactttaagaaattcaacagtaattataccccaaaaaaaaagcatttgtggcatatactagcaccataaaaggagaacattaattaaggatggagaagtggatagcaggatgtcatcgaacagatgtaaactgtggaaaagaagttctcataacaaatactcatttctcaatatcaaaaccacactgtccaaacagcacagatcaggtaactaaagatgcaaaccgtggggtttaccgtggctgcctcactgataaccgttttgggatgccatgaccgacacactaacaaccgctggagaggtataggccatttcacccagcgccaataggatacacaatacaatggatgccttgctgacctccgaggaagacgttgtagccatctcgccaaccttgtctcgcgaacaaaaacacggcgcatatccttggccacgggctccgtcgtgacccggcggaacggacgccgacatcatcgcggatgctgctgccgcttcgccgcctcctcccccatcgacgacttctctctctcgctgacaacttgtcgggttgctctctctttcatcccgtgcgtggaggagagaccggcgaggtgggcgcgtgtgtggctgaagagaggacacgacgacgcaacggggtcgcatctccctgatttgggctggccttgtgcacgaatcttgaacaaaaaatcaatggccacaaattcagctgacaaagacaaataaatcagcaggcagccagttatcaattcccttctgggagtactaaaaaaattagtgacaaataaaaaaatatatacggtgaatggccaagatgcctttcttcctcctccatcgattcctcccttggcaaatgaatggcacaccactcttcacgcacctctgctcccctctgttggtttccatcagaaagaaggaaacaagtttctctgcgtctccgatctgcagtgcgagccacgaaggttggcgtcgtctcctcctccctctcctcctcgcgcgcggctgccgtcgagaagacgctcggcctcccttgtgcggcctcacctcctcgcgctgaatcccctactccccgtgttaggtccgctcctgcttgcctgatgctgcccgttgctggttcttgatccgtcatgtttgttacatgttccagttttatggatgggtttttttggttggctgattcgttgttggtgccttcaattaatcagtactactacattgtcatgccctggtagtgatgcgaaatggcattttttttctgttttcaattttgcgtaataacatgattgatgctagctagaacattttatctaggggtgaaaacggagcggatattacccgatccactctgtatccgtccgaaataaagatatgataagggtttttagatatccggcggatgcggattttaacatgtggatgcggagccgtatgtgatatcaacaatatccgacagatgtggattatccaatattttaatcggattatttggcggataatccgcatttctcatgccatagcccattttatatgggcagcccatgtagcccatctaccgttaacctaatccaatccccaacatgcctgacggcgcgtcgtcttcctaggtgcgccaccacttctcctcctagcgcgccgctgcagcctgctgcttctagcgccgccgccgcatccaaccaaaagcagcctttctactatttctagcaccgcctctgcccttgccgacgccgtcgcctgccgtcccccattccccgcgtcagcgcctcctccagtggagtccccgtccaccgttggcccgtcgcggagtcgccagcgcccagcgcctccaccgtcaggtactattgttttcttgtgatgatgaataatgactgaatgagaagtgaagtctggatccttgcatgttggcgtgtgcagtgtgttgtatggaactagttcatattagttcgtatttgcaacttactaaattgcaagagtaatggtagtactgtatggaacggaactttgttaatgtactgaagacttatatttttaagcaacgccgcaatgaactgaagacttgtattatgtatttgctggatgtattttggattattcaagctcttaagcacttgacaatctgctgtatgtgttatattatcaattatgcaagctgcactttactagttaagcaaaattatattattgatgtgttttgcctggtttttcctagagagctgagatcataaatcatgttcagatgttttgtcatcgtattgctgccctcttgttgtatggattgaatacaaacttaatatccgacaattttattccattttcgaaccgagtccgcaccaactccgtaccgaatccgacgtccgaaataatctgcatccgcacgtcatccgcacccgcttcgcatccactttaaaaatatggattaggatatggtatagaaactatccgtccgaatccgctccgtttccacccctaattttatatgttcttgtctttttaagcattggcacttgcctcattgcctgcattggtcaagcttacaccacttatgtaactgttaattgatgctcgctgctaaattggttgtgaattttgctttataatccatatcaactgttacgaattttcctaaactatccatgtctgaattagatgtaattcaggagtccgtacatgccaaaagtaccttttgtttttcgcccttatgttgcaagaatctgctgatgcaaatcttgatacagatttgaccttcataatccaaaagaagaggttttagttcaagcgaacgataatggggatatccaaggtgattggcatcgctggaacaactcttctagtcacgtctgttggtctgtggaagatcggcttaagaattgtcgcggttccttttctagcaaccagtactattgcctatatcatcgctgttgcatcccacaattccatcaacataccttggatcttgggaaagaattcaaaggggaggtttccaatttggtcaagtgtactttttggtcctttcttgatacttgcccgggtatatgcaactgtgaagagacatatgaggaagaaggaggctgtgtataacatgatcactgaaggtgtttatctgggaggatggccgtttatgttgaagcatttgcccccaggagacccgtctgttattgattgcacttgcgagttgccaagaagtgattttgtcccaacaaatgagtatctttgtgttcctacttgggatacaagagccccgacgatatcccaaattgaatttgcggcatgctgggcatgtgaaaagagagccaaaggaaaaccagtttatgtacattgtgcatttggttagtaacgacctatctctcttcatatattccaccttttttaaacgttgacacaaggactgtagttctataatctagttttgtacataattgcagctgctaattacttttgaatattgtgtgtgcacgcttatgttttgtgcatgactgcatcaggtcatggaagaagcgcttgtgtcgtgtgtgcagttctagtagcattgggcattgctgaaaactggaaggatgcagaaaacatcatccgagaaaaaagaaagataaaaatgaatgctgttcaccggaaaaccttagacgattggtcaaaatatagagcttctcagaagaaggataaataactgtgagtcgattgttctcagatgtacttctgtcatgttgaaagaatgctcaaaacacattaagagttgtattgtttaacatcttaacattcttaattagtaaaattgctgttttgacaatcaaacgcttatggcaatcgtttgttgaacatgaaatccaaccatcattaacttctttgatatgcttgctagtcatatgccttaaagccttttatgctaccaacttctgtaaaggtgtggtcttagacaactgctattagaaatttagaattttagcatgcttttaaaggttgctacttcatccccctctcctactagttcaactgttgcaacatactgattgcagcagaataaccaaaagtacttcagacccaacaacaatgtgtgcaatgtcagactttagatgagttgctagatctggaaaagacttcatttctaggtagtttggacctctctttttctgggcgtcagattcacttctattctattagatagcttttaaattcaatccaagatgttctggcactggaagtgtagattctgttccaacttttagctactcattaactttagaactgtaaaatcaacccttttatcaatcgaaggcactcttttcgaaatgaagggcttcacgggaaacataatttgccactaaatcacataaataagtagtatttcagcaacaaaatctagctaacccctttttgttgtcactgggcaggacattaaatcatttgacatctcaggcaaattaccatgtgagttctatgcaatctgggttctgagaaatcttcctagttctggagcttgcattgtttcccagctcatatcagtgtttcccacacgtgtcagattacttccaaaatttgttcccagttttgcttacttctgctcctatctgaaggttagtcttcaaagtccttgtaaatcagaaagctgaaaattggctttcagatggttgtgctgctatgcttagctctccacagttgccttcatctgccaccaatatcctacaggcaaataaggctccagctataaatatatgatggatgcgtccagataaatagcactacagctgctgtcctattattcttttagacttttatagaatttagttagttggctgaaagcctgaaatagttgaaacatgcatagaaagggacaaaatccatatctagcccttattttgtacaccttcacatcattgtattttatcataatcttttttaggataagggactaccactagtttattggtgtaatgaccttcaaaattatgataaaataaagtgcatgcagtatgcatgatgtgcaaaaaaaagtttgctagcttttgactacctccagtaggaggctggtccattccatgctgatttaatagggtgcattccttatatttttttgtctagtaaataatggttcagttatatgtacttcgaactttccaatcagagattaaaccttcaacaactacaggtaggaggcttatcataaaataaagaaaggaaaagaattaattgcaggtaggactagagcatggtgcttactctcggggacgagaagcccagagggagctgagggcacggaggcgattatggtactcgccaattgccaagaaacatcgagctgcctgcctaattgtcagaattctgtgcatctgatgaagagtctgttgcctcaagttatcagcctggaaatccaatttgacagttgcagttttagtacatgatgaaaggatctcactcttggcactagaaaattgaaaactagagcagatactggtagtaagtttgttttactatgccatactatagttaatcagataagctccaaagtccaaaataaggataatgtcacatgtttaggtgaccattcttttctttgtatgatgtagagataacatctctacatgttgatgccatagcatattactgtaggaaaatttgttccttttcactctttattaattaacatgttggcatgtcgcattattaaaaggataaaaatgactgtttttttgctcgactgtcaagtgattggattgctcatctagacatccacaaagttgagtcaaacagggagagaaggatcagaactggaaaaagggcaggcaacaaggacttcacctgtatgacaaagccttcaaggttggacagcttgcccagggcaagggccatgtaacccatgaagctcccaaggctggcttcgttgaccacggagccgccattggcgacggtctcagctagtgactgatgcagctgctccaggccctgggagagagcttcctctgcctgctgcgatgattgctgaaggctgcagatgccaaccacttgctgttcagtcagagggtctagctggggtgccactgtctgcatcaacatcaagagtttgtaatgaaattagaaaaaccatacttgtacttagaagatgaggtcagatttagcatggttaaaacttgatttggcaaattgttttgcacattgtgaactgtgaagtgagcttcatgtttgatgtcagattgtcaggtgcattttcttatgaaaactagcctagctttaacttatcatgttcagatgtgaggttatgactacataccatgagcatgtttaagcatgatatagtaaaagttttgctttatcatgaactgtgaagtatgctccatgtctgatgttactccagattttcaggtgcattttgtgacgaaaaaacttagctctttttatgatgaaagctttcttttattgtattgtttagaccacttattttaagctattcgttcaatttatttatcaaaatatttaatttatcctataattaaggagataatctgcagcagtaatcggctaaataatctgtttcaataattaaatagcttcgtgtccagaaaggggtttagaaatgaggaggatcatgtctaacttacttaaacttctaattactgacatgtgagcccgttgagtagaagatccacatgtcagtgactcatgtcagacaaaagtaagttagaggataggatctcgagtatgtatataccttgagcagatcggacggttggaaaccgcccatccagaggaagcagcgctcggcgggggtggcccacgtgccagtgatgaggtggaacacgtcggccttggcggcggctgccctcaggcggaagagctcgtcgtagtgggccagggcgtcgtcgacgatcgccctcaggtcgccgtccggcaggtgcgcgtgtagcccgccgtgcagctccgccatccgccgcccgccgtcctccagccaccgcccgtactcggcgtcgaacatcgccgctcctgccacgaccaaatggacagtaaagtaaaacatatatactgaattattactgatctgatgcaaatcctatatgacaatcaaactgaatttcacatttcagatcagtagataaaagctactaaacatgagagattgatcaagtgaaggcaatgcattacctgcgctggtgtttccacctggtgatcctcccagcaagaggccctgaaccaagaaattcagattttactgcattcatgatcctacctataatgtttagtaattagttcagaatgcagaaaaaaattactacctgggaacgagctctctcgagatcctgctccatctgagccagcctcaacttgctgctctcaagctgctggatgtaagcctgcaaattggtatttttgacagattatgctgtcagaaacttattgggaagaagaaattcagttctgaacaactcattttctttctatgcaggtactgaaattctcatggatctagctaggctcaccttctttcgcagccggctcttgcgtgctgcctctcggttctgggctaaccttctcattatctgattacaccaacactagagagtaagtaattgtctcaaactcatgtttcaaacagtctttaattagcttgcactgaatggttctgtacatacatataattgcatgagcacgcataatcatcatcatcatgctatctaattaagcatcaactgggagtatgagagagctaggagagtaggattaacctttggatcaagtgtctttgtcatcctgtggtcactgtgagtggaacttgctgccatcttctgcatgccatgtggacatgaacaagttattgttaattacaagatgcactttaattactacagttttgtgcagttagaaactatacaagataaatagaaaaatagtgatgatatacatgcttatgtgcctatggtgcaaataaaatatactagtatgatctttggatgcacgttacatcaaccagatataaaaaaacagcaatgtatatgggtggaagccacccactctaacaacagacaaaaatattgttctgcttttttgtttatgttgctgtcacgccctaatatgcaaagttctctttcagttaagcgtgagttagatataaacattgggtaataattgttcatccaatgtgatcttggcagttcatcaattggccagaaggaacctaaagcacccctgatggccaaattgccattgttcaggtatcagttggtgcaatttttttgggaccatactttgtgcaagctagagacaattaacatactataagaatgcatacttgtcgcctaatacagcacataagctagcatgcacaagtctaacatatcctttcctagacttatctgctcctcttcttttttccaaagaatgaaaaagatagaaatttgtagtggcaagtaaggctaaatgtcaaagaaaatgcatgggtaattactaaagtgatcatattctgcatctgattcttcagaaaaacgctggtcccttggatgaagcatcaggggaacaagttggaactttctaatgtagagccaaataatacacctaacttgttgggattggtgatcttgggagcagcaagatcttaaatgaccctgaactcttctagtactactccatgagcatcttgagttgtgggctagctactgacatgacaccagactagggaacaacgcattgcatctgcaccactgcatggctttattttcttctcgcgatgtaggtatatgcatgatcaggaatcaggagatccatgcagaagcaaagacaagatgaacacctccaagaacaagcgtttacaacaccaaaacgcatcaagaaactcaagaccaagaattacaccaaaacgcacatcaagaaactccagtgattgatgagaatgcaaaccttgtgctgcttctgctgctgctgtgggatctgatcaaactggctcgccatgtcggctgctgctgcaccctgatcgccgttgttcttgctgctgctctcggagtccgttgtgtctgccgttacatttgaacatccatcctacagaacacagctgtaactttgcctttgctttgcaaaaatgaaaaatgcagtagggatcatgctcaagtatttaccttcggtgttggaagagagctcctcctcataggccaggatgggaagatgtccagtgtagcaggaggcctagctgttgctgttgctgtagctgcagcagcagcagtggagaaggctgcaagaagatatcataggggaggaggagatcaagaaatgcatccaatcctgcaactgcaacatcagaaagctactaccagctgaagcactgcactgggatcacaaggggcaagtggggcccatgtggcagtgaaaggtggactggaatttattccctttgaggagctaggagtactgcacagactgtgtgctttgctttgctgccatggcagggagctagccagagctggtactatagtactttggagaattgttgcactctagagagagagagagagagagatggtgatgatgatgaggagagtcacaaggcagtcacaccactacacacaaggtgacaagaagcacaactgccactcctgctatctgtagctcttgctttgcattgcatgtggtttggctagctacaaagtttttgctgttctttttttttttccaaatggatttgcatggttgcttttgactacactgccctaacctcttgggaaagttggctcactaggttgtgtgcttttgttcttggtcagagaaagagagagagagatgatgttgtgagtacgtacgagtggtgtgtccatggtgagaggtggtggtggttgcagtttgttgagccctcctcctgagtgtggcaacctgatgaacaagagcttcttctagctctccaaaataggcagcgccacctcctcctcctcctccttgctcgctgtcagtgtcaggccaatgcaaattaagaagggaaattaaaacatgtaacatgagatcaacaacttgttgggaataaatttgttgaccagaatgatctgaagaaatattcatgaagaacagtaatgagaaagcaatatgaaaagaacaagctgagaagagtgctgattcagcaaccgatgcatatagcactcttcccctgaacgtgaaagagaagctcatggttcagaacttcagatcatgtttatgttgcacagtttgcacttcgcaatcaccagagagagagagagagagagagagagagagagagagatattgggagagaaggagacagaaagatgaaaacgagatgttgggagagaaggagagagaggatgatgatgaactgatcttacaagaggtttgcagaagccatggagttgggcaaggtggtgccatggaagccatagccaagaacatgatgaggattctgccctctcctagcctctcccatcctacgagccacaaaaccacagctcgatctcccagtatctccaagaatcagaacgaagcgctagctcaaatttcttcgatctacctccacaaagaacaacaaaaaagaacatcatgatcgctgctactgtacatgctagtatgctacacgccagatgatgtgaagaattcaagatgagagagtcaaagaaagaaacataccaagattgtggtctcttgtgataagcaagagccaagagctactatagcagaaaagtgaccggagtagctttagctagcaagaagtgcaagaagcaaagcttgaccggttcttggctctcagctggagtagctagctgttcttggctcttgctattgctgctcactcctatagctttagctctctcttgaatcttgatatggagtatctgaaagtgtagcagcttcaccttccggtctggggcatgctaatcacacagttgatggaaagatcttgtccttcctttctcctatgctggtttttttcttctttgaagagaggaaaggagagagaggtataggtcttgtctctacttgaaggtgttttgtcatggagtctgccacaggaatccctggctctacactcttatcatcttggaactgacttctctttctctctgtgtgactggtcccagatgcactgcagatgcaagtctaatttcttctggttcatgcatgtgtaaaccttattttgccccagataatgaatgggatgttgaatttgggttcaagttgtattgatcagtaccactattttttttcaattgttaatggctgttgacaaaacttgcaagttactatgcactggtgtaggaagtacatgatcctgtttgcaaagaaaaaatgattgagattaaccatgttgctactggattgttcaatattacaagctatgtatgttattcagacttcaacggtgcatgcatttcatctgattattccatactctcttcgattcaagattgactaatttacaccgacatatagtttattatatgcaaaaccatagctttcggatagcatttagaaatgttaaccattctgaccacacaataatcctacgttgataaacgcttctctcaccagtctcatgatttgtatgtacgatcttatctagttatagctctctagcaacttgattgcaactttgaataatctatttctcatttcaaatcgaagataaaataattgaactatcgaatcattaacatcaatagtaccgtacaagataaaactgaaaagaggaatagaaaaccaaacctttaaagaaatctttaggttctaaaaaaaataagtatagaactctctatattctccattattaatatatatcctgcatttaatttgcttggcaatattctcctctgttaatgcgtcaacatccgtgccttgtcaaaatatcacctagctaaacccatacctgaccaatcatatccatttcacaatacgaagatcggctaacttaatcaatttggaagttgattgtcacgtctaatatatcaatgacgctagtttaattgatttcctaatacgctcacctatatatatactttttaagtttttgttacgatatgtataattaagagcaactccaatagaatggccaagtaactacccaagctaaattttagcaaatatagggggaaaataccattcaacagtctctccatccggatggccaaatcgcacccctcattgaccaaacttggagagtctctctgcctggctattcgtgggctccacactcccctcccaccccatctctctctctgccctggctagagcaagaaggcggcaacgatgccgcttgtgaacggcgatggctaggaaccgcacaacggcgacggcacggaggagagatgcgccggagccagctgcgaccgccgccgtcgtccgcgtcgtcccatgcagcgactgtcgccgtcgtccacgccgtccctagtcgcgaccgccaccgccgtccgcgccatccctagccgcgaccgccgcccccgcgtggatttgaccgggcggcgtggattcgggggctgttgccatggtcgtcgtcgtcacgagccgccgccgctgccaccctttgctcaatcgccgttgcctcggggagtgctaagagaagaggaagagggagaaaaagaggaataaggggagaaagatgagaaagaatgggtatagagaggatggatggagaggctgttggagtaaagaacgaatttgacttgacaaataaaatggagagttgaccaaatagacatttagagagtcgaatttagagaaactattggagatgctctaagctagctttattaatagtacgtttcaataatgattacctctttaattggaccgaggctcctgtgattgatgtaccagctgtgactaccacagctgcatgcttatgcgtgtaagtgatgcactccctccgttccataatataaaggattttggtgggatgagacatatcctattactaatttgggcagagatacaacgaatatgattatagagtgtatttattgcactaggatgtgatgtattctagtaagcgaggttagtttttttgatggaggaattagctatcatgctgcctatgaattttaaattttgattttgagaataattttaggcaacgacagcggcagaggaaaacctaaaacttaaaatcaaatcctataatcgacgcagtgctaagtactccgtacacccttattcaaggttgactgcctactgttatttgactatttgttattaattgttactacaaattttgggtgaaaatatacaagaaagtagatatattttgttttcttgacaatgcatatgtatatattcaaattatacatcaccaactttatcacaatttattatcattactattgcatatttactacaattcacacatatatctagatctatcgtaatactctaccaattattttcatcatatcaaatttcatctaaaattacttctatatattttcgtagcaacacgcgtggtatcttcttgtatttttaatggtgagtaggagctagttgggatgagtgcaatgtccctttcattttgcacttggaggaaaaaatcaattaagtaaattaactacttcatgctccgcctagccgccaatcaaacagatttatttctcctcttcacccactatatttttcctaacaatgattggcacaataaaatgcgccaaaaacacatgacaagatcgagaacctactaatagctaggagtaagataactgaataattcattcttatttttcttttttgatctgctaattgacacacatcttatagctagtcatcaagtggcaacttcgggggcatgcctaataagacaaaaatagaaatagtagttgaactcctatataaactttggtttttatttatgagaaaattgattttggtggttagtgtctagctagcttctatggattgtataattagctgtggtcttatattagactagtggtttaattaattatggcacatgcatttggggctgaaaatttattgaacaggtagagtgcacgcatcatgcatgcatgcgcgtgacaaaatgattatgtcattcattctgctagctaagctagctggaaacctcaaacacatactcggtcagtcccaaatctcaatatacttattgttgtaggttatttaaatatagattaagatttgtttgaaaaagactataccgtttattattaaatgatgtatatatggtcgaaagtgagagggttgttaggggtagaatggcaggaggtgattgatttagtaaattatattttagagtaacaactattttaagataaattttaaatcttgaaagtgcatctaggcaactaattatgttggtgattaataacaatgtgattagagatgactaacaacttatttgagtatgagtgaatgaatgttagcatcggtgaaaaacgatgttaaaggcaaaacctctaggcctcaatgaccttgcaaatctcgaaatacaactattatgtcgcggagatagtattctactaatataagattatatatatgaaatttttttcaagaaatacattgacaaacattcaatttcaagaaatatcatcgataagtacgacttttataaaatgccactgtacaagcgactttgtctcggaaataccatcatcgttagggtttcgttagtagtcctccgttaagtattataggataaacggtgcatttaacaatggggatggacggaaccttaacagcaatgatatttatagaacaaaatcgcttgcactcgtcgatgatggctttgattgtttgttaatggtatttctggatgttctctatatgtatgggctcattgataacggcactatatgagtgacaatgagaaacagcgtgagcgaatctgtatgagatgacgtacgcgatattcatatacaggcattgatacaaacttctacacagtagctagtgttgctgaatatagcttggtcgtgtactccctccgtcccaaattaagtacaataaattttggttagatggaacataactataaatctaaacatattttttcagactcatattactagaatgtgtccaatcaaaatcttatatattttagtacgaagggagtagaccgtatgttgcgtccactgtatgttacatgtcgcccactgaattaaatatgaaactctgaaatattcaaagacgtcatcgggaagtgtgttgtaagtcagaaattattttgagctggggaatattagtttaatttcatttgcctctgatataatttgtaaggtgttttcaattttgttcaacgttatacttctctactttcatattagtgggccgggtgctttagcttaaactgtcacggagatataaaagcctatcttaatttttttttgacgagaaaaaacagcaagagaggctactactgtgattttaataagagaaagggaataattacagagagtatgtacatgagggggaaggaaagaacaacaaaactaaactaatcaagctaaacaagaaactgaatccatgattcccacgaaggtttatcatcctgttttactctatgcaaatgtagagtaaagtcctccttgaaatctgatttccacttgctgaaattgattgaaagattgttgaagataaagtcatttctcctgctctagatattccagcaacaaatagcaatgacctccatgaagaaaggataaggaaagttgttctttgcttctgagatcgtgttcataacatccagatgaaaatttcagttaatgcctaaactagaccagcattgctgagcaaaagggcaggagaaaaaaagatggtgggagtcctctatgaccactgatttcaggtaacacatttgatgcctccttgggtgttgaaatgttttctttgcaagagttccttggtgttcaatctgtccattagaagcaaccaaaggaagactttcagtttcagagtgcatttgcatttccaaatccaaataagaggagccggtgggtgaatgtgagcaaagaacaaatcatagacttttttggaatgatattgatgagaattccactgataagtccagcagtccaagtcattaaagttatccagattttgaaccagatcgtttaagatttgccattgttgaattgcttgtaccaacatgggtgtatgaaaagactgctcaatactattcagatcgaggaaacctttaagtgagatatcttccaattttgcgaatgagaataggatgcttaactcctcttgcaaaatgcttctagtccaattatctttccaaaacaaagctgtttcaccagaaccaacagttacctttgagattgctctgaaaattgggattaatctgaaaatgtccttccaccaaaaagaacccttttctgtgtgtgcatgagggggtaaatttgaatgagagtagtatttgttccaaatgagatttacccaagggagatctttcttattgaaaaatttgtccagatgttttgtgagtagggcaacattttgaagaggaggggaaatgagaaaactaaaaatatatgtaaaacaagataagttattagtgcatgattaattaaatattaattattttaaatttaaaaataattaatatattttttaaataaattttgttttttttaaaatatacacgatttaaccgtttaggaagtgtacacctgaaaaacatcatatatccctattgacactcccacctctcactcgtgacgactctatccaatccttctccgtctcgtcatggccacggtagcgccactcacatcagagccccaagatctcgaccctcatatatgggcccttatatatttaacctattagctagaaacaaaagtttaattaattaaatcccttaaaatatatgttggatctaatatgtatcccttaacagcaaagctatgtataatgactccatcaatcatcaataccggtttagtttgcgggccttctcaaatggtttggatgacagttttgctctgcgtggcgcacgttgatctaatctctatcctacgtctatattatattataaaataaaatagtaggacccatgtctcatcctcgcctcgttctctagctccttacacactttgagaaagcagggtatactggaagcagagagggcaggagggcgacagtagcagcaagccgaatcctggaagagcggcggcggctcctcccctcttctctcctaccgttcggttggggcacgggtgcgctcttctctcccttcctcctctctctctctctctctcttttttctttgagagcacttcagaattttctcaattcgctcctttgttatgtaacgaattttctcaagttcccttggatcagttacaaggacttgaacacccaattgcacttttgtcttctgaaggttgaaaccaagacatgcaattcctcctccctctcttggcttgattgtatacgtgcgttgagctttgctgtgactttgtgatgtcaagtttccaaacgctcattgtaccattgcaattattcaaatgaagaccggttgaagatagggatgaaaatggttggaaaatccctataccattttctttttcatatatatatttctcgtaaacgaaatcagaatggtagatctggaaatggtaacgatatcggtaatattggtatatcagaaacaggactgtcggaacgaaatataccgatattggttggaagtcgaaattcatgtcagaatcagcagagtgtggcatagcacacatttaactatacatgtaaatgacattttaactttattcttttatcatcacacaccacataacaccgttatatgatgattaataatatgataataagtttgatgaacagtataaacaaagtttaacaatacttaacatcgataagttgagaagactaaagttcagcaaaatccacatgccacatcatagggttaattaacaacatttttctctggtcactttcccttttttatgggccgcaagcctactagacttccttcattcatggacttctgatgggttaggcaggctaagccgctagagaacttccagaattttttcggaattttgacgaaaattatcatacaaatacggttaccgacaaaacggtcggaaaaacctccatctcatttccgctaccatttccagaagatattaccgtttccatttccaccactgttggttaccgataccgactgaaaacggtcggtgtaaactagaaacggcagccggaaatttccataccgttttcagggttggatgaagatcgatgatgacggtgctacccgagctcaagcttgtagggggctcgccagcatccctgttgttaccttctttcgcaggcgagtgtccaagcacgatctcgcgcgggacagccgttttaacggttttgcaattgagagttacgaatgagatttgacctgtatttgagataattaaatcggacattttcttatctggcctaattagctgaccctttgtttggaccagagtcattcttaaaagtacacaccttggcctttctctttcgcaaacattcttgaacagttgcgtacgagttgggcttttctttatatagcttaacgtttccggcccatgtatttccttctctcctcctaatcgtttcggacgatgcaagaggtggccacgatggtgtgctcagctgccgtacgtcgtcgtgccaagacgagtcgccggcggcgagctgggcctgctgctgaagctgacgccaaattaattaagctcccaaacggccgcgccggaggactatactcacaccgttaataaatatttgacgccgcttattttttaaaatatatttgatcgttccttttatttgatttattgttaaatataattatatgtatacatatagttttacatatttcacaaaagtttttaaataagatgaacggttaaacatgtgctaaaaaggttaaatatttagaaataaagggagtatatttttcaaaaaaaaaaaaagcttcgtggccggagctctgccggccggatttaaaagagggaaagccggaggattatatatggatcgcattcaggtctataccttcctgctttcttcctccgcgtggcgtcgatttccgccgtgcagatacgaggacgccggcgccgagtacgagttaaggcctgaagcggatggacgagaaagcctataggcctttgcagcccatatatacattcctgcagtaaaaaacaaatctatctctgtaaacatcttgttttgtcgtcagagttgcaacgaacagaattgacaacgggacacacgtacagaaaacgaagcaacactgagtgtgccaattctttaaatattatagcatgactacaagaatccaggatttttcttttgacagacacaaaccactaaggatagcatcaaaaccgttaaggtaacatgttttgccggccaaccgccaagtttatagaccaaggaaaattccattttattggcggctaactgttatggaaagagttttttttttgtctccccaacaagaaaattacgatcatttccaactttcgaaagcgccaagaaataaaaacttgtcagttcggattgacaataatatactttactttagatgttatcgaaccgccaaggaaattatcaagaaaataccttattcatggccgctacaaccaccaaaggaagtatcaaggaaataccttattcatgaccgctacagccgccaaggatataacttggcggttctacgtaaccctcaataaaatagttgtatccttatcaactagttatgatcatcaagataacgaataatattggcggctttgttttggctgccaaaaaatcttggattgttgtatgcgcaggagaaaatcgatcagaacatatataagagggaaactttatatggtgaaatagctaagctataagctcaagaagagatgttttcctccgccaaagtctaaggttttggcctcttccttgatctttgctattagcttgattatcgagagtttcttatgttggaacattcattgatttctctcctatattttccatgtcgtaagtaggatgagagtgcacacccccctttttctgataggcttcgacctgtgagcagtgccacccaccattcatatactatcgaggttgtgctccatatttatgggctgagttgctcctgggatgtccaggtggaaatcatgtccatattctcctcatatatctgcactctggacacaagtaggtggaaggatgcttctaaggtgggtcggcaaagcgagtagtacaagtaggtggaaggatgcttctaaggtgggtcggcaacgcgagtagtaggtattgtttggccaacttctcgaactgttaatctctgtcagacgtccgtactaatgttatgtataattagggcatgtttggtagagctccaactcccaggagagctggagtccagtcaaacagtttcaactccatccaatgggagtgaagctggctggagtgctctcacaaaatgattaactagagaggtggagctgggtttggttgctccataatttcactccagatccagttcttgatgttaaatctaagagttggaacctaccaatcaggcccttagccaagcgaagatcatgtatttctttggagtctaaagcttccaaatgaaatatgatagttctgttaatggagccgaagaactgtgctcagcttctcatgaaattgagtcaaacagtagatacaatgaagagtttttagtcataatctctcatgcatgaacgaaggcatgataaaactatcatcttgcttgatttccaggaccatctttaccccttcttacatgcatatgtttaatcaagaagaaaagacaaagagaatccttgcctcaaaattccttatcaatctagctattatatacccctctatctctctctaatatacatatataagctaggactgctcttgttgtccatgaatacatacataaacttattcaagagatccaaaatggtaaattcatgcatgcatcattctttgttctgcatgcagctagaaaacgctgccttcaggtatgctctgcagggtaggctgccacactgatccgcagctctcctgctggtgcagcagctcatctgcttcagcttgtttttgcatgagagacaccatgtcgttcagggagatggcggcggcgtcgttgtgcagcagcatcttcttcagctcctgctttctgaccaccagcttcaccctcacgacggcgccgccgggtgggtcgtcagccatgtcggccgtcgccggccggagtgcctcgtcgtcgtcgtcggaggagacgccgttgaggggtggcggcggcggcggcagcttcaggatctcgccgtcgacgtccatgctcatgatcttgatctccctgttcctatcttgaatcaccatgcaattccccatgatgatacgacgacgaagacgagttttgcaaggagatttgggatgatgaaattacgaggtagctagcacgaccgaatgatcgatcgatcacaattcacaagttagaaatgtgtgtgtggtgtagtatttcttggcgaaagagtagggggttggaggggaggagttatgtgtggtatttaaaggaattgtattaggaggatagccacaaactttggagcatacttcatctctgtgccattggactagccaagtgagctttgcttacttcatgtcatgcctcaccaaaagcaagatatagccactgagaaagtgagaattagtgaaatcgaccagccatttcttttttttttgtctctatcttgttgtcgtccttgactgttgcatgctgatttgcatcagggcggttccgtgaaattcgaggccggttgcgcacgtcaaacatctcggaataaacttgatgtgcattttcagctagattttactattattgtcttttcagtcttattctagtctactataaccttaattttaagtactatgatgttgttgaattttctatatatgtttaacaatttgtcttactaaaaaatattaaaaaaatataaaagtcatgcttgaagtgtctataataataaaactagccacagtaaaacaaataatatttacatatttgtttgataagagaatgatcaaatatatgtccaaaagacaacgacgttatatgttaaaaatagagggagtatatatttttttataataaacaagataaaaaaggtatagaagttattaaataaccgttgaattaatggagcaaatcgactgtaaactacaccgacacttatatttatgacaacaaatgcttcttcctagtgccaggcatgcatatatatgatctcattcttatccatgcatattacatatatgtaattagatggcaaaatcataattttgtgctgagtagagggttttttttgaagatatataattgaattagcaagcaacatacccaggtaaagggggagagatcacaaaacattagtagtaggatacatgtggagcccaacatttgggcaggcctaatccatatccttgtagtggaggtaagaatcatttgcacctcttgtcaaatctgcaagtgaaaatggatttgtgtactggtcatcatgtggtttaatttgcaagtgaaagtgaaactaatagagaccatgcatccaatgcgtgttactggtcatatatatagacaggccgaaaacgatcgatatgatggatcctcctctccatcaagcactaacaaccaatataaacatttgttgcacgatccgcatcatttcaattcagtaagaacgctatgtaccccggcatctatagttctatttatatatacacgtgatgtgttatatatgcgtgctatttgactacaagaatccagaattttctttgcggtcaaaaacaccaaggcaatatatttttacgactacctgccaaataataaccaccaaatttagagagccaaggaaatccagattaatttcttggttgctaatcgtgagggaaagttctattagcggtctaaccgccaagagaactacggagaatattaaacttttgaaaagccaagaaatgtaaccttaccagtctcgaccgacaagaacacatcttaccttaggtggtgtcgaaccgtcaagaatatatggtcattgagtgaagctggagacgatcgattaatgcatccaaggctatgtatccaactatatatccattatatatatggttattgtaatgggataaggcaagagcaattattgtgttttagaattcacaatgttcgcggttgagttttcttcttctccttttaattgtttgtagctaacacagaccacacattaattcaatactttagtgaattgcacattatatcgcatatgttaggaaacgataagcgaacaaacgataaagaacaatagatcaatcacagaagacacgagatttaacgtgaaaaaccctcccaaaataggagagaaaaaaccacgggcgccagccagcaaaatatcttcactatatctggggtgaggttacatcgccgcatggcggcttacaagagatatatatatatggtggaaccctaaaagggatgatgatccgtacgggagacgggcctccgctccactacggaagctggcctttattaagtgcagatgaatttcgatcacaactcaacagcatcgaccaaatattctccccgaagtttcctcttgcaccacaattaattaactaatggtttcgctttcaatcatttttcattcttttggtttgctttggaccctagctgttgttgttgttgctacttccctagctcgttgtcccctctctcctctgatggtgagttagctccaagatctaatcatcgatcaaggcatcctgcataaggtaatggggacctgaaccctgatccttgatgggtaaaacgtccattaagaacaaaatgagactcactcacggggttcctaatggcaaaatactcccccattagtccaatgcatcctcctttggaggatgccactaccacacgccacctcgttgctcccatcctctacttctactaacatggtgactgcgaaaagggtgcatagggatggatggtgtaggtcaactcacgcccatctctctagcggtgtgctctagcaatattgtagtggttcataggatatgaaagagtcaaagcaacggaaaatacatggggtgcaatgcaagaagatatatgaagaaaggaggcgtgtatgtagtattgtacagaagagagaaggccaccagaggggggggggcagtgccaatgactttccttcattcagaatatatcacatataggagaagagaatgaaaaggctcaaagttaaactaaagggaagaaaagtttgtccaaattggaagaaaaaattaggtcaagtaacctaagataaaacttggtatgcaagaataagtgatgacctatatacatacgtgtaattcacttttaaattttttcaacaaggctgccgatattccttaatagaatacagttttgtatgtgttgcataacagattcattggaccctaggcaaaaggttgaagcacaagaaaacaaaaacttgtccttgttgaatgtcgatatcaattaaagaacacgtcctttcacgcacattctaaaccccactatactttttatgatccttcttcctgtacttttctttgtttatacatttgcttttgtagtgctccccataaaaaacactttaatcaagataaaagctttgttagcattagaaaataaagtgaaatgtggacactaatatggtgatcgagtcaaaattatgtggaagactatttcaatccctttaacgagagtgggttgttaatcacgaagagctctaagtagctaattgaaacatgatatatagacaggaaaatactacgagactgtctgcatggtatagacgtagctagggttttgacttctagattatcctagaattgatatgcaactagaaataacaagctttagaaaaaggaaaaaaaaagagaaaccatcagctttcagaaaacaaaatattatataatagtaatcaatgaaacttaatggaaagacttccctttactcgctcactactatctccgtcttaaaatatagcaatctagtataaaatgagataaattctagtactttaaatctgaacaggcataaacattaatgtaaatgtgagtatacattcatcattgtaagacattcacacataattactctgctatatataaacatctctagctgagccgacacatacgtcttggtatatattcacaaaattattataaacacttctctcgctatcgattggcatgtcatctaatagaaaaaacttaactaaaatagctgtggtatagtaaactaatatatatatgtgcatgtatatagccttagtggctagtgatcgatggtgcagcattagagcaagtataataggaggttgtaagccgactaaatactgaggtggaggagagaagagagaagaaagaggagaagtgggctgtaaacttacagccggcttggacacataagaaccaagaaactctgtgagagagacaagtgatcatgtattaattgtaaagagctactctctccgttccataatataatgcacaactatttttttaggatgttcataaggcatgcatgcatgtatacaatttattaggacttcttctccattaaattattacttttttttaaatcctccaccctcaagatctcaaattctattggatgcatgcattatatttattagggtgattcaaactaggagatgataataattgtttcttggtctttgggttaatggtggttgtgccttatattttggaacggatggagtaactattatatgggtgagctgagagaaggctgcaaataatcttacagctaacaagttagctgtattattagtcttgctcttgaggtagcttagctcactataatatgtgcaataagcactactctgtccgtcccaaaatatagtaaccttgtatactggatgggacacatcatagtacagtaaatctggatagaggtatgtccagattcgttgtattaagatatgtcctatccagtataaggttgctgtattttaggacggagggagtatcttattagctcactcctttgacctatatctagctaagctagctagctatagctactcgcccgttgaacgctttttaaccacgcgtgcatatgcacacgcgctgagatcgcgcgttttgacgattttacacgcggctcgttttggcgacgcgcggcggacggcgagtggccggcaaggctagtggggcggcaccgccgcagagactaagccggcgacgtcgccgtcgacgagacgaccggccgctatagctattagctgccggaagacgactgccgtccgtacgtcgtcgtcgttggtggtggcgtagtacatacgtatatatgcgcatgctagcttgcttcgcttttacttctccggtcgccgcctcgccggccgacgtcgccacgcgtataagaattgagaagttcggataaactgatcatatagtagtatctactcatcagaatattataaggttaattaacaaaagtcgatgcaattataattatgagatattaaaaaagactcgactcattatgagtttctcaatggagagtagaaaaccccctcaagaatttgaactttaggaacagatcgtcttataaaagtccttgtgatctctctcactcatctagctttgttatttggtgtcactaatagtttaattgttgtttgtgtaatcctctccccaattgccgctattctttattcttagttagtttactcgtaatctgagattttcggaatatccgaaaacatttcaaaaatatccaaaaatattaggaaatatctgaaaagttctgtttctgtattttcttcaagaaagttttaaatgcctattcatcccctctagggaacatcaagatatatactatatatagatattattatatcatttttacaaacttatatggttaaacttgaaaataattgacttatattaaaatcaagacatcttgagttctaaaacaaaagaagtactccctccatttcaaaatagttactatttcaggattcaaaatttatcctaaactaatcattattttaaaatactatttttccttgtcaatcaccttccattttacctcaaccatcatctcacttctattcaaataagtgtcgctatagtcttttttttttcttctcaaaccttaatactccggaggcagttgtatgtaagaaaaacgtctcaatctgtgattaattagcagtttcaggggctgaaggggatgtgttggatagacgtggttacctagagatctctgtcgaatctcagaaataaagtgcatcagaaatttttgtgtagtcgctttttatgtcgttttgctcttaacgacactcgtgcacgcatgtagtcccatttttctgatctgtcgtcgtagagtactgttcaccatacgcacggaggaaaaatgaggctcgtcgcgtcgttctgtttggattcttttgagtagccttgatcgagatttttcagtatatgccatccaattcgcaccattttcaggatatgccacttaattcgcatgactttcagaatatgccattggaagcacgaattccttcattccatgccatttttctctattttcccaaatttctcagatttctaatactttccttcatctttctcacctgaccggacggatttacccatgggcccacctgtcaggagagtagagagatagcctcctcctcttagggaacagatcgatctatcgcaacaaaaaaaagggaaacatatcgatccccttcctccttcctcccggccgacagacgcaacgccgctacgagccgccgccccgaccgcgccccgcccccacacctcgctggcagctccgtcccccgctctgcaccgtgcaaccgcgcctcgccggcagcttcacccccgccccgcgccatgccaccacgcccagcaatggaaaccctaaatatctagggtttgaaggaggagatggagaggggggagacagcggctcgagaagagggcgtgccgcaggcgacggcctcattgctacataatgagctttcttcggggtaagatcatgctcccctgctatctattattgcagaatcgaggtgcaagctcaagagcgtgtaggtcagcaacgattaagcgggcaaactaatgatttacttctctcgtttttgttgttactattcgataggattgatcccgatgcggtgtttagggtgtgcgttcagtttggtcaatttacagctaaacttgttgatggaacttgtgttcatgtgccacgaaagtgcttggaatgggttgtggactatcagcaatgcactttggagagcttggagaaggaccttgcagcaagggtaacatggggcaagtgccaacaggttgtgatgagtggatatgacatgaccacgggtgaggaaacaccgtttaaggacaatatggatgtagtgcatgcattgtttgttaggaaaagtgataaaaagttgtttctgtatgctgatgtggaggacaagcatgatcagttggttactaattcatccgtttcagaggtaaatgagttatttatggatgaggttgtgacagctagacatggtgatgaatcaaacaatctgcctgacattgattgggatggattggaaatagctcaaattccacaagagcaagttcatcaccaagtcattgattgggatggattggagatagctccaattctagaagctgatgtaggttcttcagtgcctttgatgggggaagatgacatgtatgcattcgttggacttagagctgaggatgagagagctgaacaagctaggctacaagctgaaaaccaaagggattctgctcctaatccagctgcagatgttgcccaaggggacttaaaccttaacgaggcagagatagatgttaatgatgtggttcctggtgaagctggagttttctatgatagggatgatcctccaatggaagttggaagcttatatataagtatggttgagtttaggtcagctgtgaggcaacatgctataaaggggcaatttgagttagggacagagaagattgacacagagaggtttcggggctattgcacagctgagggatgcccatgggctattgtggcaaggttacagcctgatggaaaatctgtgagggtactaacaactaacttagcatggctatgttacatattcaatattttgtttcttagtgataattataaaataatacattttgatcatgcattgtgttcttttgtgttgtaggttactttgaacagatttccccatcattgtacatcaaccgcgagagttaaaaccaagatgtcatcctacaagtgggtagcagagaaggccattccctttctaaagaaggacccaaatatgggtgcaacaaagctacaagatgagttgcaaaccacacacaaagtcacagtgggatactcaacagtttatgcaggtatgcaaaagtctatagagcaaatatttgggacgtgggaagagagctttgcatttttgtttaactttaaggctgagattgagttgaaaatgccgggaaatgttgtggagatagatgtacaggaagatggtgatgggatttattttcacagattcttttgttcattcaaaccttgcattgatggtttcataatgggttgccgaccttacttgagtatagactccacggcacttaatggaaaatggaatggtcaactagcttctgcaacatctatagatggacacaactggatgtttccagttgcatttggattctttcagagtgagaccactgacaactggacttggtttatgcaacaacttaataaggcagtaggcaatcttccaaccttagctataagctcagatgcttgtaaggggctagagaatgctgtgaagaatgtttttcaaagggcagaacatagagaatgcttttggcacttgatgcagaatttcataaagaagtttcaaggtccagtgttcgggaacatgtaccctgcagctaggtcttatatgccagaaagattttatcattacatgaataaaatttatgaggcaaattcagatgtgaagccatacttagaaacctatcacaaattgctttggatgagaagcaagttctcagaagagataaaatgtgacttcatcaccaacaatttagcagagtcatggaacaaatggattaaagatatgaaacatcttccaattgttgagcttgcagatggtattaggtcaaagacaatgaatctattggctaggaggaggaagataggtgagaaattggatggtgtgatgctatctattgtggtttgtcaactcaatgcaatgactagagaactgggccacttgaaggtagttcaaggtgatagagaccaagctgaggtgactgagatcactgctgaacatcagattattagacatgctgtcaatctagtaaaccatacatgcacctgtagagagtggcaagtttctggtaaaccatgcccacatgctttagctctcataatatcatatagaaaccctaacatggctgattatttagatccttgctattcggtagaaaggtataagcttgcatacgcaggagttattttaccacttccagataagtcccaatggccaaaagtgaatattggttttaagttgttgccacctcttactaagagggaagttgggaggcaaaggaagaaccaaatagtcgggtgccttgataagggcaaggctaggagcaaaggcaagtggcaagttcaatgtaagagatgtcttgccatgggccataggtcgacgtcgccaaaatgtcctttgaatggaacgaagaaaaagtaagtgtataaattgtcatttgttttagttctagcatatttatttgtttcagatctagcaaatttatttgttttacttttgcaggccaagtcgggccaaaaaagggagaccacttagtgaagcaaattgtgcagcaagtactagcatagaaggcacacccaaaagacagaaggtaggcccaaatggttcaactaatactagtccagggcctataacaagaaggtaggcaaaccctttttcttgtttctgcacttgattcaaaaaatgttttactaacacctaattttttttaagtcaatcggcattgacaacaactggtggagaaggaccaatgaggcagatgacaactcctccaaggcccactagagctgcaaagaagatcactccaaagaaagggctaaaaacgagtgctccttgattatatattctcaaatatgggaactattagattatggatgcttttgtatgtgaaccacatgactgtgcaagttgtggcttttattttgtaatctgaacttctatgcctggattatgtattttggatggcattctctgacttgcttacttagaggtgcttgccttggagattgttttacttgctatatatcatgccaaaatatggttacatgctgttcaaattggaaattctgggtatatgctgtcagaattttgggtatatgttgtcaaaattttgagtacgttgctgtcaaaaattacatatacaaatttttggtgtatgctgtcaaaattgcacagattttaggtatgtactgtccaaaattttgttctcacatggctcaggtaaacaactgcaacttgaaaatatgcttcaatctctaattgaaaaaacttctgtaaatcacgattgggaagattgaccattctctacgcatgctgtgaaaattgtctgcacatgctgtccaaattctcagattgcacatacaaagtgatatttcatcgaaattgtaaatgccaattaacaaacatgctacgagttgaaccatcaaaattgtctcagtttgcaactttccatacaaacaatgcgttgatacaactagctgaaccatcctactagcaaacctgcactcctggaaattttctgattacaatcaacttccaaacagtacaaagtataaagtttttggtaaagcaaattgtttgcagcgctggagtcgacggctcaacgcggtctggtcaaagacttcaggagaccgacgggaggtgggggagccgaccggcgcaggcgatcttcgcggtgagggcgtcgctcgaggcggggcgcggtggcgcgacctgaggtgggggacggtgctgccggcgatgcgcggacagagcagcgaggtgcggggacggggcgcatactgggcggcggggggctgagctgcgagcggcgagcggcgagcggcgtcgcctctccgtctctcggtcggccgagaggatgaaggggatcgatctgctttcctgggaggaggaggctatctctttactctcctgacaggtgggcccatgggtaaatccgtccgatcaggtgagaaagatgaaggaaaatattagaaatctgagaaatttaggaaaatagagaaaaatggcatggaatgaaggaattcgtgcttccaatggcatattctgaaagtcacgcgaattgagtggcgtatcctgaaaacggtgtgaattggatggcatatactgaaaaatctcgccttgatccgattctctttcatttttcgcacgtttgccatagagagtttgatgaattatatgaggcccgagagagcatgcacgatcgagacagaaaataataagtggatgaactcagttgggtactatgcacgattgatatatggcctagctaaggatgctttaaaaaaattgaaaatatattatttttaccgatacagtagaaatatactcgttttagaataattggcatcattataccgttgttgcgtctataggaaagcgaaatcgctgacatgctggtggatgcgcgcgagttcctaccaccaacgtgcaaactcgtgatgtcatcggcgcaaaatcatgcaagtacataaatgcaccacgcgaactgacgacatcgtgcgagttcatgagttcagcgtgcaaactcgtgacatcatccttcgtgaacttgggattgggatttggtgatattcccccgtaacattctcggtgacattgag

SEQ ID NO: 57902 - DNA, 74255 bp, Oryza sativa
aagcattccaagaagactttgaagaaggttgtgtcagacaaggaggagtgcaggatagtcaagctcttgagcgaggctagagagaacactacatctctattcgagtcaacaatgcacctcttgtcgaagcaaatcgagatgccaaaattgtccctcatctccagggcattccagaagaaaaacacaatgatttgcaatgatgagcagttgcaggtgttagagtgctgcatcggggaccttgaggctggagcaggacttctgttcaggagattggtccagagcagggttactctcctgaacattcttagcttatagatattcctcaagatctgaaactcttaagaccttgtgattggcatccgtcttttaaaggatttgctgatccttaccatttgtatatgttataggcttactgtacagaaaagaaaacatacatgaaagagagttttgatctaattctttccatcccctgagtcctcacgtatctctgaggtacatcatgtgattatgcaagcgatattattaatgtctttgtgatgaatataaatcgcacaacatggcaaatgaattataaaatatatgtgccacataaacgaaaatcttttcattttttttgctggcaaattgatctgtgatgtgccatagggctatcaaatggccatgtgggtcatgccactctgataccatttgttgcctcattagcaagcaaaggatctttatgcagtagatcttgctgccacagctacaacaggccagctcccatacacgaggatgagcgtgcaaactgcattaattgcacataatataacagtagttggaattaacaaaagcataaaaagatagatagtgcacgtatcagcaataccacggtggtagcaataaattaaaataatcctggagagcatgcaattatgtcaagatccacaagtagagtgaactaacctgctggttcttgctgccgatagttgagacatgacaatgtgatatctcccttggaagaaagatggcagtgcattaaaaattagaacaacacacaagagattccatatgctgtttaatgttgctgccagatctcaaacaatgatagacagcgtcagggagctgaactggaaggattctttttgtctaccatccaaatgatgctgtgtatagcacatccactgaataaataggtctcagcacaaagctagacacatcaaaccataagtttcctttccttctcatctattggattcaacacaaagaggcaacatttttagcaacagacatggctttccaccaaagatcaattagcttgccttccaggcctatctccaaagttgaagaggagctgcacagcattgaggcatggatctcttcaccctccctgaccatcgagacaatctctgatggtttcaggaggcttggggacatctacagctccattgaggagatcatgtgcctgcctagcaaccaagtttgctcatccgagcagaggaggttgttggatggagagatggaatgctcccttgagctgctggatctctgcaacgctatgaacgaggtcttcaccgagttgaaggccatcatccaagatctgcaagtgtctctcaggaaaggagatggtgcagttcttcaagccaagatccagtcatacatccgcttggtgaagaaggcaaagaaacactccaagaagactctgacgaaggttgtctcagacaaggaggactgcaggatagtcaagctgttgagcgaggctagggagatcactacctctctatttgagtcaacaacgcacctcttgtcgaagcaaattgctacgccaaaattgtctctcatttctaaggcattccagaagaaaaacccagtgatttgcaatgaggaccagttgcaggtgttagagtgctccatcagagatcttgaggctggagcaggacttctgttcaggagattggtccagagcagggttactctcctcaacattcttagctcatagatgctcctcaagatctgtcactcctaaaacctgcgattggcgtccaccttttaaaggatttgctgatccttaccttgtatatgtcatagatttatagtgtacagaaaaaaagttatacatgaaagaaacagaaattttgatctaattgtgcgctcaatcctcatgatgtgattatgcaacaagatgccaaaagccgttgtgatgaatataatttgcgcaagccggcacatgaattatcaaatatatgtgccgcgttagcaattctactttcatttcttttatattttatagtcaaattgataatgatgtgccatagggctgtgaaatgcccatgtgggccatgtaactctgatgctgtttgttgcctcactagcaagcaaaggatgcatgtactgtggatcttgctgctgcagccgaaacagaccagctccaatacacgaggttaagcgtgtaagcagcatggattgcacttattagaacacaagttgaaactaacaagagcattaataattagataacacgcatgtcaactataatactctggtatcacgctattaaaataatcccttgagagcatgcaattattccaagaaccaccggtagagtgaactaacctgctgattcttgctgccgataattgggacatgacaatgcgatagctcacttggaagatagacggcaatgcattaaaacattgaacaacaaagagacttgcaacagccagatctcaaaaccatgacagacagcatcagggagttgaactgccagtattctatttgtctaccatccaattgatgtagtgtcttgcacatcctctgtataaataggtctaaccacaaagctagacacatcaaaccaagactttcctctccttctcagctctcagactcaacagagagacagagcttagcaacacacatggctttccaccaaagatcagttagcttgcgttccaggcctctctccaaagttgaagaggagctgcacagcgtagaggcatgcatctcttcaccctccctgaccatcgaggcaatctccgatggtctgagggggctcggggacatctactgctcaattgaggagatcatgtgcctgcctagcaaccaagtttgctcaccacagcaaaggaagttgttggatggagagatggaatgctcccttgagctactggatatgtgcaacactatgagcgaggtcttcaccgagttgaaggccatcatccaagatctgcaagtgtctctcagaaaaggagatgatgcagttcttcaagccaagatccagtcatacatccgcttggtgaagaaggcaaagaaacattccaagaagactctgaagaaggttgtctcgaacaaggaggactgcaggatagtcaagctattgagagaggctagagagattactacctctctattcgagtcaactacacacctcttgtcgaagcaaattgctatgcctaaattgtctctcatctccaaggcattccagaagaaaatcccagtgatttgcaatgaggagcagttgcaggtgttagagtgctgcatcagagatcttgaggctggagcagggcttctgttcaggagattggtccaaagcagggttactctcctgaacattcttagctcatagatactcaagatctgtcactcttaataccctgtgattggcatccgccttttaaaggatttgctgatccttccatctgtatatgccatagaatagaattactgtacaggaaaataaaatatacatgaaagagatacaaagttttgatctaattcttgccgtgtgctcaggcttcacatattgctgagatacaagatgtgattacgcaatgtgctgtcagtattattgcctttgggattaatatacaacggacaatccaacaaatgagttatgaaatatatgtgccatgctagtgatattattttcatttcttttgtatttttacagtcaaattaatccatagggatatacatgctatacctctagacatgaggattgcagacaaatacccatagtgtcctagttgtttatatattctattgaagacttttttttttatattcatgtggccatgttacctcacacctgtttaagtccattaattagtgcccaatcagtgtttggtgcattttgcattacattcatgaaacctgccaggcccaacctacatggattaaagcttgcaattagcacagtgactacctgccaatgtccgttgcattatcgcacgacctagcatggtatgcatcctttttattttatttatattttttggacacatatatatgcatcaagttcagaagtattttttttcccctaaaaaaatgtttaaacatagatgagttatggttcaaaataaaatatgtcagacgagtgagaaaactgcacgcagattggagaaatccaaactgccgcaaaatgatttgcaaaaccatgtcgcagatgcttccatggaagcctgaatcacatccactcatgaactcagccatcaacaatagagaagaataaaaatgattcacaaggcattgcggcacacagattacggagaaataaagtggtagatgcatgcatacctcggctggaccccctgggttctggagggtaaacagcggccgcggatttctcccatcgtcctgggggaatccatgggggcggacatcgccgccgccgccgccggtggcgccggagcggactctctctcccctccgccctttctcgccggagccttctccggtggtgggagtctgggagacgagacgagacgagtaggcagtagtaatttcttctgggccgtgggcttacttgtatttgggcctggtgggtttttccggtatctcatattaggcccactacaaaattgggcccaacacaatcaaaatcaaaatgaacatcgctgaataaaaagtgattcaaaattaagggcactggaggatgccccgtgcgttgctgcgggacttggttaacattaatttgttagataggaggtacaatctcaagaagaaacggaagaaacaaatggctttcttggagaaattctttttagcaaccctatccaaattttgtaaataatttaggtagcacattcaaagcataagctacgaagaagcagaatgggcattcggccataaagctcttttatacggattgatgagccggatacatgtagatgtgtgtggagatgggccaatatgtttacgtgggctacatttggtactgagtaggcggagagactcacccgatgcttgatggattgggctctatgctgcgttccatccaacggctgagaagcaatctaacgcattcatccaacggtttacaattgatgatgacgtggaagtatgaggtttgagcttttggtattgactttatagaaagaagggattactaccaaaatcaacttttcctaaattggcaataccaaaactatggtagaataagataaatgtattgttgctaaaattacctatttgataataaactaaatgcaactatatatttgtcaattttattaaacaatccatagactaaatgcaactatatatttatcaattttattaaataatctatagtttaaaatggcatcaatctgaatacactctaatagccaaatttgcctcgctaatactactgcgtatattagctgcttggaattgttcatgacagcttcgaatgcaagctctcaactagagatcgatgaacacacgcgatgcaggatttttgcatccgttgcatcgcggcacagcattgtacgcatcgtccaactagaagatccttgctgccggctggtaattcagccattttttgccgggtcggcgcaagtacaccgaccaaattttattaagacagaaagaatttatagattttacatgatattatactgtcgagtcgggaataacccccaaaaaggataattcagccatagaaaacaccttttattcatctccatcatctctccttatttttttaaaaaaataagtaattattatttatgacgtgacttggcttatcactagattacttaatgtatgacttatattttcatatgtttgtattaaattttaaacaagacgaatgattaagtatatgtttaagagttagcagtttcatccattaaaaacacgtgaaaagcacgaggaagtaactctgaacagtgaacttaactgtatcaggaactttatcctggatgtaagttgtaacagccctgaccgccctatgggcttccctgacaacactcttgcccatgggataacaccttctagaattttcagaacacctaacaccgttttttttttcttttttagataagggtattttttttacccggcatctacatccaaccggatatatacggccattgaaatagggaacttagccccggaaacaacccaatctaaaattcgctccatagaagatttgaactcagaaccttggggtactactcaggtcactgtaaccactaggctacatgccctttcataaagggtgtccaatgtaaggcactcgagtgacaccgcgttcttgaggatataacatgttagctcaatcaagttcttcgcggagctgaaccctgtcatcttcacactcttgaggtagcaatggcggtgttccggcatctgcctcaaaggcgaggaatctccaagaaccgattcatgcttcatatgctcttgtgatacctgataatgataaaagataagtcaaataaagtatacatatccaagagatcagtgatcagatagaggagtatatctttgcaggatggaatgagcgaagagtgccttacattcaagatcaatgtctccaaggaaggagacgcgtcaaggaaagaaacaagagaaaaataatcatacgacgtgttaaaggaggctgctgagctaacggaaatggtgaggtgcttaaggtagaggaattttgtaggcagcattggtgtattgaccacctgcacaatgtatgtcatgtctcaaattaattagaattaataatcctataatatacaactactcttaatatgcataataaaacgcctaatgttttagagatcgatacctcatcattggagtaaatggcaagagtctcaagatttggcataacggatggcagctcggcacgagcataacagacaacctttggatggatcatgcttaatctcttcacttgcaatgggtctccaagtgagagttttacatttccgctgaagcttaaactggaaagatttggagcattgctctctatcactcgcagcctacagcatccagcaaccaccaggcagctcaatttttgcagcacgcaaggtatcttcaggcaaattatctcctcacagttgctgaggttcaactgctccaaagcaatagtagaattggaaagaaagcactccaactcatcctcggtaacatgtacaaaatgcagactcagacttgttagttgttaggtttctcaaggtgccaagttcagctgtggggcgaaaggcacaatagccaagtttaagataccgaattgagcttcgaatcccactggataaaactgagcatgggaaattgtactctgctgtaatactagtacatagcataacaatgagctcttcagtcatcggtgtaacagcaagtttaagccaacggtcgaggcagagaagggaaatgccctctaattgaagcttcaatatcttcacaccagagcctgagcggtttcttagaatgccatcaattatgtcgctggcattcactatatgtgaatgtagtgaatgtacttccgggagaaacacttccctagtcaaggtgagattgggacgacatctccaggaatgaagaaaggcacgagataggcaagcagcacgagcagcatcacgcagtggcattagggaatgtacatggcaccagatgtcctgcatacgagcatatgcgagtagagttcaatgccgaaagagccaaatggttacttggacagtagaaagaaaaacagaagtaccacatggagtaggagggttatattctacccaggtataccttttggcatgattaattgcaagtgatatgcagatttacaagagttgataattaattgatagtgcagtggaatgtatcagaaaggtcagaatttcatgccgccctacgtacctcaggaaggtctggaattgttgctttgacagcttgagaatcatcaccatcttgttgactagagggcaagcccgagcccttttctagtattcattgaagcaatggatccaactgcaacgcaaccaagcacagagacttactcaatatatatatattgataatagttacaataatagtccatatatatcccagaccattatctaaaaatatatatcccagatattgatatggattggaacaaggggaaaaattaagaaggaactcaaggaaacagcaaccgattgagcaaaacgaaagtatcaatcagagggaacccaccgaggggcaaagatactttttttttttttgagaacagatcaactaacccatggttaaaaacgataggcaccagaggggcgaacctatagccccaagttatttttttctgcaaacaaattgcatatgctatcagcataaataatactcaaggttaaggcagagagaaaagctcccagatcaacaagtagagaatgtaatgttatgggaaagagagaaaaatgaggcgctcaccggccggcggcgaggacgccggcgccgctggtcgcgagattggaggtcggcgcaggcggcgggccgaggagtcgaggccgagggagcagcgagtcggaggccaatacaacgtcttgtttgggctttcatggtttgagtccaggacggtgaaaggctcaaacacaaattttgcaggagtttgctctgcgtgtatctgtatttcaattcaagttatgtatatccctttcactaaacaaatataactaacaagtttctgtctttcttattcgcaacatgttttgctgataaattcattcaacgaatgctggtatgtcgtatcaacatgctgattgttcgcctgacaactcgagcctttattttccaagcaccgggaggaggcatgaaattaatgataaaaaaatagctatacaaatttttggtctcttctcttgataacaaacaatatcagcaattcagcacatagttgcgtttagcaatcttgtcaagcccccttgcattccaaattaaaatgaacgtaggattcattggggacattgacagggaggatcacactacaggatacacattcaaattaacacaggcaggtcaggtcagaagatagtccagaatccacaagataagagttgcctgcgacaaggaattgtaggtgttagaactgaacattgttaatctagacaatggaattaagaacctgttcaggaaattgattcaaagtagagtttcactttccgactcctacttcagcttgaaggtagatttgcgagctctaatcccctgtgcttggcacccgcgttttagagaattcgccgatcgttgaaatagtctcccaatgtttatataaacatgagaaaaatgtgtagaaatatactcactgaaaaataaaaacaggattcagtccatcttctattgttgattacactgtctatgcacatgctttagtaccaaaaggtaaaaaacttaatttccttagaagattgatgctcatcaatattgactgtcacaaaaaaaaaaaacagatgacattaaagttcaccttcgaaatgctttaatgtgaaatgggcaaatcgcccatgtcactcagatgacaaatgctgcctcagcagcaagcaacgatcttgctccaccaataaaaataacagggcagctccaacacaagatgttgagcgtgtaagcggcacggattgcacataatacaacacatgttgtaatcaacgagagcacaagaactagaaaaacgcatgtcaacagtaatacttgttagcactctaataagataatcccttgagagcatgcaaatgtgtcaagatcaaccggtagggtgaactaacctgctggttgttgctgccaatagttgggacatgacaatgcgatagcacattgagaagatagatgtcagttcactaaaaaatcgaacagcatacgagtgattccatatgctgctgccagatctcaaaccattgatagacagcatttgggaggtgaactggcaggattctgcttgtctgccatgcaaatgaagctgtgtcttgcacatgatctgtataagtactcctcagcacaaggctagacacaccaaacgaaactttcatttccttctcatcttcttggcctcaacacagaaatacagacctttagcaacaggcatggctttccaccaaagatcaattagcttgccttctaggcctctctccaaagttgaagaggagctgcacagcctagaagcatgcgtctcatcaccgtccatgaccatcgagatgatttctgatgttttgaggaggcttgatgacatctacaactccattgagcagatcatgtgcctgcctagcaaccaaatttgctcatcccagcagaggaagttgttggatggagagatggaatgctccctcgagctactggatatctgcaatgctatgagtgaggtcttcactgagttgaaggccatcatccaagatctgcaagtgtctctcagaaaaggagataatgcagttgccaagatccattcatacatccgcttggtgaagaaggcaaagaaacatttcaagaagactgtgaaggtagcctcagacaaggaagactgcaagattgtaaagcggttgagcaaggctagagagatcactacctctctcctcgagtcaacaatgcacctcttgtcgaagcaaatccagatgccaaaattgtctctcatctccaaggcattccagaagaaaaacccagtgatttgcaatgaggaacagttgcaggtgttaagagtgctgcatcggagatcttgaggctggggctggacttgtgttcaggagattggtccagagcagggttactctcctgaacattcttagctcatagacgctcctcaaaatctgacactctttaagaccgggcgattggcatccaccttttaaaggatttgctaatccttcccatttgtatatatcatagacttactggccagaaaagaaaagatacatgaaagagacagttttgatctagttctttccatgtgctttgtcctcacatatctctgatatacatgatgtgattatgcaagtgatattagtattaatgcctttgggtgatgaatatacatacaaccaagcacatgaattatgaaatatatataccatgttagctttcctattctttcctcaatcaaaccaacccttctcttctccacaggcactcaatccctatttgagacagcaagaaattactttcaaattgatctgtgatgtgccatagggctatgaaaatggccatgtgagtcatgacactctgattccatttgctgcctcggtagcaagcaaaggattcttgtgcagtggatcttgctaccacagctgcaacaggccagctcccatacacaaggttgagagtgcaagcggcattgattgcaaatgatagaacacatattgaaattaacaagagaacaaaaaattaaaaaaaaatacatgtatcatgtatcgacaataccattctggtagcactcaattaaaataatcccttgagagcatgcaattatgtcaagatccacaagtagagtgaactaacctgctggtttatgctgccaatagttgagacatgacaatgtgatgactctcttggaataaagaggcagtgcattaaaaataagaataacatatgagatatttcatatgctgtttattgctgctgccagatctcagaccatgatagacagcatcagggagctgaactggcaggattctgtttgtttaccatccaaatgatgctgtgtctagcacatccactgaataaataggcctcagcacaaagctagacacatcaaagacataagttttcctttccttctcatctgtcgatccaacacagagaggcaacatttttagcaatagacatggctttccaccaaagatcaactagtttaccttctagacctctctccagagttgaagaggagctgcacagcattgaggcatggatctcttcaccctccctgaccatcgagatgatctctcatggtttgaggagccttgtggacatctacagcactattgagaagatcatgtgcctacctagcaaccaagtttgctcatcacagcaaaggaagttgttggatagagagatggaatgctcccttgagctactggatctctgcaatggtatgaatgaggtcttcaccgagttgaaggccatcatccaagatctgcaagtgtctctcagaaaaggagataatgcagctgttcaaaccaagatccagtcatacatccgactggtgaagaaggcgaaaaagcattccaagaagactgtcaagaaggttgtgtcagacaaggaggagtgcaagatagtgaagctgttgagcgaggctagagagatcacaacctctctattcgagtcaacaattcacctcttgtcgaagcaaattgcgatgccaaaattgtctctcatctccaaggcattccagaagaaaaactcagttatctgcaatgaggagcaattgcaggtgttagagtgctgcatcagagatcttgaggctggagctgcgcttctgttcaggagattggtccagagcagggttactctcctgaacaatcttagctcatagatactcctcaagatctgacacacttaagagtttgtgattggcatccaccttttaaaggatttgctgatcctttccaattgtatatgttatacaattactgtacagaaaaaaaatatgcatgaaagagaacagttttgatctaattcttgaattcttgtcgtgcacccaatcctcacatattgctgagatacatgatgtgattatgcaaatcaatgtcaatattactgactctgtgattaatatacattgcacaacccatcacctaaattatgaaatataagtgccacgttagtgatattagtattactcttatttcttttcttttttacagtcaaattgatctatgatgtgcaataaggctatgaaatgtccatgtgggttactgactctgatgccgtttgttgcctcactagcaagcaaaggatccatgtacagtggatcttgcagctgcaggtaaaacaggccagctccaatacacaaggttaagcgtgtatgcagcatggattgcacataatagaacgctagttgaaattaacaagagaattaaaaattagataacactattaaataatcacttgagagcgtgcaattatgccaagagccaccggtagagtgaactaacctgctggttcttgctgccaatagttgagacatgacaatgtgacacctcacttggaagatagatggcagtgcattaaaacaataaataacaaagaggccatatgctacagccagatctcagctgaactgccaggattccgtttgtctaccatccaattgattctatgttttgcacatcctttgtataaataggtctcagcacaaagctagacacatcaaaccaaactttcctctcaactctcagactcaccagagacagagtttagcaatagacatggctttccaccaaagatcaattagcttgccttctaggcctctctccaaagttgaagaggagctgcacagcatagaggcatgcatctcctcaccctccctgaccatcgagacgatctctgatggtttgaggaggcttggggacatctacagctccattgaggagatcatgtgcctgcctagcaaccaagtttgctcatccgagcagaggaggttgttggatggagagatggaatgctcccttgagctactggatctctgcaacgctatgaacgaggtcttcaccgagttgaaggccatcatccaagatctgcaagtgtctctcagaaaaggagatgatgcagttcttcaagccaagatccagtcgtacatccgcttggtgaagaaggcaaagaaacatttcaagactgtgaagaaggttgcctcaaacaaggaggactgcaagatagtcaaactgttgagtgaggctagagagatcactacctctctattccagtcaacagtgcatctcttgtcaaagcaaatcgagatgccaaaattgtccctcatctccagggcattccagaagaaaaacctggtggtttgcaatgaggagcagttgcaggtgttagagtgctgcatcggagatcttgaggctggagcagggcttctgttcaggagattggtccaaagcagggttactctcctgaacattcttagcccatagatacccctcaagatctgtcactcttaagaccctgcgattggcgtccaccttttaaaggatttgctgatccttccatctgtatatgccatagacttactgtacagaaaaaaaatacatgaaagagatacaaagttttgatctaattcttgccatgtgtgctgtcctcacatattactgagaatctgagatacatgatgtgattacccaatgttctgtcagtattactgcctttgttatgaatatacatcgaacaatccgcaaatgaatatgtgccatgttagtgatattgttttcatttcttttctattttacagtcaaattgatctgtgatgggccgtagggatatacatgctctacctctaaacatgaacattacacgaaaatacccacaacatcctagtttgcatattctattgaggccatgtggttatgttacctcacaccggtctaagtccattaattagtcctcattcctcaatcagtgtttggtgcatcttgcactacacacatgaaacatgccaggcccaaactacagagattaaagcttgcaattagcacaatgtattagctgccaaagttcgctgcatgatcgcacgacctagcttggtaagctcttgtgtgtacatccattttatttattcattttggaggactcatatgcatcacattcagaagttttcttaaaaaacaaaaatgtttaaatactataattgtagcgtagacagcataatctgcaattctgcagcaaatatgccggacgagtgggaaaactgcaagcagatttgagaaattcaaagctgcacgaagcgatttcgaaaccatgcgtacgcttatcgctgtggattgctgattcactcatgaactcaggcatcaacagtagaaccaagatgactcacggggcattgcattgcagcacacaggttacaggaaaataaagtggtagatgcatgaatacctcagctgccccccctgggtgctggagactatacagcatgcggccgctccctggggctgccgtcgccgtcgccgtcgccgactcgccagagcgggctctacccctccactctttcttgccttctccggtggtggtgagttgtgggaggcgacgagtaggcagtatctcctgggccccatcagatcaaaagcaaaattaacaaccaattttgcctcaccctcacatacaccacacaacttgcatatgcttacagtagattagatgttttggatgattggatgccccatttcctcgcaggctcgacgatgatttcacaatccaatctgacagtacttgtgcgtgtgttcgtgcaacggttgctgcctgcagcagctgctacatgacagcctcgcatgccaactctcaactagagatcgatgaacacactacacaagcgtgcaggatttatacatctgctcgctggagaggagacagggcagtcatccagtcgtacgccgagcggccaagaaggcacagagacacatcaggaggatcaccggcggtggcagcagcaagcctgcagcttctgaagccagagagatcgccgtcgcagcgctcgaaacagcagcagcaaagctcttgccgaagcagatcgccaccatgtcgagttcaagcaggtggtcccagctcgtctccaagaagaagagagatgcctcctgcgaggagagcagttgcaggtgttggagttggacattgctggtcttaacaacggtgttgaggttctcttcaggagactcatccagagcagggtctcccttctcaacacactgacactggtagatgatgagatagatcatagatcatgcaaacactagctcctttgtgatctgcgtccgccttttagaggatctgctgatcatgaaacaattttgccatgagtacaatgagacaaaatgatgaattgtacagtcattttgagaaaagaattcttgttggtccatgttctcttgtcgattcactgtatgtactttgatgagaactttattccatgcctatgacatcaggcctagtacaagattatgttcacttggcaaagtattttcttttccaagaagtgccactatgaaaacaggatagacgaagatccctttttttagataataatgggataaacgtagattcatgctgacatacacaaacttgatttaccaatagcgtgctgtagaccagcttgtaattagcataaccagtgcccaataaaacaatacttaacaaccattaacacgaatggaaccactaactagtcagcctgcttactccattaaacaagtgttagagcatgcgtgcacacctgtgattgtgaggacccagcaatgaactgccaagctgattctttgtcccaacaactggaacatcacaatgtgataagcctagttaggagcacctaatgcatcggaagaaaattgcacagcatgtggatcatcttgaggttgcaacaaccagatgctaaatgccctggtagagacatgccagcaatgatgcacgggtggtcagaacaagataagcatggcgtgttgcattggaacctggatgggaagtcaaccatagttttttcttccagaaagaatcatcaggcagcagccagcttcatttctctcatcatttaactgcgtgctcacctcgcatcttgatctgaatctgacattaaactaaccactcgtgcagatgagtttgccgctgataattcagacatgacaggcttgttatgctcaaatgtgagagttagaaatgcctcttatattgaggagacataaaaaagcatcagtttgtcttggagatgggtggctttgttgcagcagcacaaccatcaatattgatgagattctttctgttgcttctgtttcttccgttataaatagagacagactatgctgggctttcaccattgagcagtttcttctcttctcttccgtttccagagaaaaaaaaaaggaaacaccacacaccatctatagaaaccatggcatttagatctgcaagcgctccttccagccctcgttctaacaaaaccaatgttgaggaacagcttcagagcttgaaggcaaccatcacttcacccgctgaaaccattgaaacaatgcttgatggtttcagcaggattggagctgtgtacaacaacattgaggagatcatatgcttgccaagcagccaagctcaactttgtcagaatcagcagaggaaagcagtagagcaagagctcgagcattcccttgtgctgctcgacctctgcaactctatccaagagagtgtttccaagctcaagacaagcattcaggagatgcagttggttcacaagagaagggatgctacagttgttcaggccaacatccagtatttcattcgtctgaccaagaaggtgcaaaagcagtccaagaagatcagcaagaagtctgcttcagctgagcaggagggctccagggtgatcaagctgttggccgaagctagagaggtcgccatctcaatgcttgagtcctcttcacatctcttgtcaaagaagatcacaacatcaaattctagcaagtggtcacttgtctccaaggcatttcagaagacaaggcttgcatgccaggaggagcaattacaggcgttggagttcgccatcgttgatctcgagagcggagttgagactttgttcaggagattgatccagatcagagtttctcttctgaatgctctaagcttgtagatagacgatgaaccaactctggctccctctgatctgcatccgccttttataggatctgctgatcatcaaaacaattttccaatgtgtatatgagaggaaatgacaaatgtcaaaatgtacagtacatcagttagtcaaaaggaaaaaaaatattttggcccatgctcagttgtcaatttttactgattttgaagcttgtatgtatgaccatttttcctttccaggaacttatttaacctcacactgaggacggccaaacaatcacctgaattttggggtacttaagctaaagtttattgatagaaaaaaaacttaaattatcaataagatgctcacttttcctggatgttatagaaacaatagtacagaaagtttgaaaaattcctttgaagccagcattctttactagagatgatgagatggccatgctttcctcattcacaggaatattattatacaatatatcttgacatcatgccagctggtaattagcataacctatgcctaataaaccaaccaattaacaattaatagcacacatagagaacccatacgactcgccaagcgtgctccattaaacaagtgttagagcatgcatttttgtcaagggccagcactagagtaagctgccatgctgattcttgatcccaagaactggaacatcacaatgtgatagagctagtcaggagcacctaacgcatcgtataaaaatacgcaccatgtggatcatattgagattgcaacagccagatgctaaatgcactagtaaacatgccagctatgatgcacgggtggtcagagaagataagcacagcatcatgtgttggaacctggaagtgaagccaattagttgtccctcccaccaagaatcatcaaattaaccagctcctttctctcataagatcactggcatgttcaccgatctcactacactgatccggatttgacattaaactactcactcgtgcagatgagtttgccattgatacagcaggcatgacagactgatcatgaactcaaatattagagatagaaatgcatcttataccaaggagacaaaaaaaagcatctgtttgtcatggagatgggtggccttgttgcagcagcacggctttcaatatcaatgagattcttgctgttgcttccactactttcgttataaatacatacaaaccatagcagggtcaacaacattgaaacacggtttctcctgttctcttccatttcttcagaaaaaaaggaagcactgcactatccatagaggccatggcatccatgcttagatctgcaagtgtgccttccagcccttgctccaatgaagccaatgttgaagaacagcttcagagcttgagagcaaccatctcttcaccctctgcaactgtcgaaacaatgcttgatggtttcagcaggattggaggtgtatacaggaacattgaggagatcatgtgctttcccagcagccaagttctcctttgccaaccacagcagaggaaagcagcagagcaagagcttgagcgctctcttatcttgcttgacctctgcaatgccatgcaagagagtttctgtgaactcaaggcaagcatccaggacatgcagttggctatcaagagagccgatgatgccgctgttcaagccaaggtccagtccttcatccgtctgaccaagaaggcacaaaagcagtcgaagaagattagcaagaagtctgcttcagatgatcaggagggatgcagggtgctcaagctgtcagctgaagctagagaggttgcaatttcaatggttgagtcctcgttgcatctcttgttgaagcagattgtgatgccgaattctagcaggtggtctcttgtatccaaggctttccagaaggcaaggattgcatgccaggaggagcaattgcaggcgctggagttggacatcagtgatctcgagagcggagttgagactttattcaggagattgatccagagcagagtttctcttctgaatgctctgagcttgtagatgatacaccaactcttgttctttgtgatccgcgtccatcttttagaggatttgctgatcatcaaaacaattttgagaagtgtatatacacaataggtactgacaaaatgtacaagaatactgaaaagaaaaaaaattatctatgttcagttgtcaactttactgtcttagctttctgcatgaccataaatcccttccagaaaatcttatttatcctcacttagaatggccaaactatcacttgtattttggagttcttatgttaaagttcacttagaggtaaaaacataacttataaacaagatgctcaccattactggttgttgtagaaataatagtacagaaagtttgaaatttccttctgaagctgcaccctttcctataaaataatgagatggttgtgcttttctcatccacaggaagtttatagtacagtccatcttgctgtcatgactaatagcacactagcagataattagcataattgtccaataaaccaactatctaacagttaatataacacatcgaacccataccactttcccagcattctccattaaacaaatggtagctcatgcatttatgtgaatgcgcagcactagagtaagctgacatgctgattcttgatcccatgaactgaaacatcacaatgtgatcggcctagttaggagcacctaatgcataacagaaaattgcacagcatgtggatcatcttgagattgcaacagccagatgttaaatgcactagaagaaacatgccagcgatgatacacgggtgatcagcacaaggtgaagtcaactagttcttccttacaccaagaatcatcaatcagctccttatctcatcatttcactgcatactcacagatctcaatacatcaatctggatttgacattaaactactcactcgtgcagaagagcttgtcattgacaatgcagacatgacaggctgatcatgaactcaaatattaagagtgcaccgaagggacataaaaaaacatctctttgtcatggagatgggtagctttgtaccagctgcatagctttcattatggatgagattcttgctgttgcttctatttcttcacttataaatagagagaaaccatagctgagtttacaccattgagcaaggtttcttctcttctcttccgtttccagaaaaaaagggaggtgctacaacatccatagaagccatggcatccatgctcagatctgcaagtgtgccttccagcccttgctccaattaaagcaatgttgaagaacagcttcagagcttgaaggcaaccatctcttcaccctctgcaactgtcgaaacaatgcttgatggtttcagcagaattggaggagagtacaacaacattgaagagatcatgtgctttcccagcagccaagttttcctttggcagccacagcagaggaaagcagcagagcaagagcttgagcgctctcttgtcttgcttgacctctgcaatgccatgcaagagagtatttctgaactcaaggcaagcatccaggacatgcagttggctatcaagagagctgatgatgccactgttcaagccaaggtccagtctttaatccgtctgagcaagaaggcacaaaagcagtcgaagaagattagcaagaagtctgcttcagatgatcaggagggatgcagggtgctcaagctgtcagctgaagctagagaggttgcaatctcaatgcttgagtcctcattgcatctcttgttgaagcagattgtgatgccgaattctagcaggtggtctcttgtatccaaggctttccagaaggcaaggattgcatgccaggaggagcaattgctggcgctggagttggacatcagtgatattgagagcagagttgagactttgttcaggagattgatccagaacagagtttctcttctgaatgctctgagcttgtagatgatacaccaactcctgttccctttgatccgcgtccgccttttagaggatctgctgatcatcaaaacaattttgtgtatatagagtatatatgatagaaaatgacaaaatgtacaggaaatcatcaatcgaaaagaaaagtttttagtccatgctcagttgtctattttactgttatttgaaccttaaatgcatgctcacgactcctttccagaaactgctctgtttcacctcactgaggacagccaagcaaaaccatgaatttttagagttctgaaatttaatattatttataaaatacataattttctatcagatgctcactgttgatcgatgttatagaaaacaacgatacataaagtccaaagtttttcttttaagtctgcactcttcactatgaaacaatgggatgataatttatttcttctttttccaataacaagcgaatttttgtgtttgctaagaaatgaaatacatacaatggttagtacaggattgagatccgagttgtgcaaaaataagcatatcaaagggactgcaggcaaagttggaggaaatcacagcagcagatatcaagtgaccaagacataaaagcaacaatagtaggttgttatatcaggattgtttatgtggtggtttttgttgtcctgatgtcaaactggagattccagtcttttgcttttacctgtatgctgtaagacttatgttcgctttctaagttaagctgggttgatctgttgatatatggtctaaaaaatatcagaaagtttctcggcgacctactcctgccattctccattggcatgcttttctcatgcacatcaaggtttttttatacagtagatcttgctgtcatgactaatagcatgccagccggtaattagcacaacctgtgcctgaaaaaccaactacttaaaaaattaataacaagcatagaaccatactactagctagcattctcagttaaacaaatattagaatacacatggatgtgaaatcctgcactagaataagctgccatgataattcttgataccaaaaaatgaaacatgaaaaggtgatatggctagttaggagtgcttaatgcatcaatagaaaatcgaacagcatgtggaccaacatgagaaacataccagcgtccagaacagataagcatgtgtgtcacgttggaggcttggagcttggagatgaagtcaattagctgttccttccaccagaaaacatcaccagctcctttctcgccatttcagtgcatgcttgtcaatctcaccacatgtccacattgatctggatctggcattaaactaatcactcatgcagatgagattgctgctgacggttcctacatcacaggttaatcacaagaaaaaacatcaacttgtcgaggagatgggtgccattgttgcagaagaacaaccttcattattgacaagatcctttctgttgcaatgcttatttcgttatagataagagataaaccgtaggcaggtctacaccattgcaaaacagtttctctactctttctctcccattatcagcaaaaggagagcattgtggcttcagctaaaaccatggcattccacctcagatctgcaagcatgtcttcaagtcctcgctccggagaaaccaacattgaaaaatagatgcagagctcgatggtgatcatctcttcaccctctgcaactgtcgaaacaatcttcagtgacctcaagatgattgaatgagtgtacaaaaaatattgaggtaatcgtgcataccaagcaaccaattcatctttcatcagaatcagaaaaggaaagccatggagcaagagctcgaggattcccttgtgctcctcgatcttttgcaaagccatccaagagatttttttctgagctcaagacaagcattaagaagatgcaaaaaaatccaatcgttcatccatttgaccaagaaggcgcgaaagaaatacaagaagttcaggaagaagtatgcttcagctggctaggggagctgcagggtgaagctagagaggtttatatctcaatgattgagtccttattgcatctcccatcaaagcaaattgagataccaacttctagcaagtagtttttgtctccaagacattgcaaaagaaaagagttttatgcaacgaggaaccactatagacataggagttgaacattattgatcaggaggttgttccagagcaaagtttcacttttcaatgctctaagcttgtagatagattataccaattcttatcccagatgattagttcccagcttttataggatttgctgataatcatgtgtaaatgaaaaggaattgtacagaaatttactcaatgagaaacaaaaaaaaaaatcatttaatttcctgctatttatttaactgtttaagcatgctttgatgcatagcaacgtatgggaccagatcattcagataaaattcaaaagtaatataataatttactcagatggtgatattattattgactgttatagaagtaattagcagtttagcacacgtgtgcagtggatctagttatccatagctaacaagtcagctccaagcctccaatgcacgaggttgagggcgcaagcagcatgtaatttgcagtataaagtacctctgataatatcagttatacaacaactaaatagcaagcatgatgccaataatacgctgtttaaactccattaaaaaaaacgttttgtgcatgcaatcatgtcaagatccactaacagagtgagctaacctgccgattcttgctgctaatagtagggacatcacaatgtgatagctcatttggaagataaatggcagtgtattaaacaattgaacagcacaccaaagattccatatgttgttgccagatctcaaacaatgatagacagcatctgggagctcaactggcaggattctgtttgtctaccatacaaaggatgctgtgtcttgcacaccaactgaataaataggcctcaccacaaagctagacacatcaaaccagaacttccctttccttctcatctcttggatccaacacaaagagttaagagttctagcaacagacatggctttccaccaaagatcaattagcttgccttcaaggcctctctccaaggttgaagatgagttgcacagcatagaggcatacgtctcatcaccctccaagaccaccaagatgatctctgatggtttgaggaggcttggtgacacatatagctccattgaggagaccatgtgcctgcctagcaaccaagtttgctcatcacagcaaaggaagttgtttgacagagagatggaatactcccttgagctactggatctctgcaacactatgaacgaggtcttcaccgagttgaagtccatcatccaagatctgcaagtgtctctcagaaaaggagatgatgcagttgttcaagccaagatccagtcatacatccggctggtgaagaaggcaaagaagcattccaagaagactgtgaagaaggttgcctcagacaaggaggactccaagatggtcaagctgttgagcaatgctagagagatcactacctctctattcgagtcaacattggacctcttgtctaagcaaattgcgatgccaaaattctctctcatctccaaggcattccagaagaaaaatgcggtgatctgcaatgaggagcagttgcaggtgttagagtgctgcatcgcagatcttgaggcaggagcaggactgctgttcaggagattggtccagaccagggttactctcctcaacattcttggctcatagatactcctcaatatgtgacactcttaagaccctgcgattggcatccgtattttaaaggatttgctgatccttcccatttgtatttattataggcttactgtacagaaaagaaaacatacatgaaagagacaaagttttgatctaactcttgttgtgcactcggttcagacatatctctgagatacatgatgtgattatgcaagcgatattagtattattgccttgttatcgaatacacatagcaacggctcatgaattatgaaacatatgttccacacaagcaaaattattttcttttcttttttgcagtcaaattgatctgtgatgtgccatagggccatgaaatggccatatgggctgtgtcactctgataccatttgtagcctcactagcaagcaaaggatccatgtatagtggatcttgctgctgcagttagaataggccagctccaatacacgaggttaagcatgtgagcagcaggtattgtacataatagagcacttgtagcaagcaaaggatccgtgtgcagtggatcttgctgccacagctaaaacagtccagctaccatacatgaggttgagcgtgcaagtaccactgattgcacaaaatagaacacatgttgaaattaacaagagcataaaaaaagataaaacacatataaaaaataccactctggaagcaatcaattaaaataatgccttgagtgcatgcaattatgtagagtgaactaacctgctgtttcttcctgccaacagttgagacatgacaatgtgataagtccttggaaggtagatggcagtatattaaagtattgaacatacgagagatcccatatgctgtttattgctgctgccagacctccacccattgtggacagcatcaggaagctgaactggcaggattctgtttgtctaccaaccagatgatgctttttcttgcacatcaactgaataaataggcctcagcacaaagctagactcatcaaaccataagttacatttcctcctcatctcttggtttcaacacaaagaggtagagttctagcaacagacatggctttccaccaaagatcaattagcttgccttcaaggcctctctccaaggttgaagatgagttgcacagcatagaggcatgtgtctcatcaccctccaagaccatcgagatgatctctgatggtttgaggaggcttggtgatatatatagctccattgaggagatcatgtgcctacctagcaaccaagtttgctcatcacagcaaaggaagttgtttgacagagagatggaatgctcccttgagctactagatctctgcaacgctatgaacgaggtcttcaccgagttgaagtccatcatccaagatctgcaagtgtctctcagaaaaggagatgatgcagttgttcaagccaagatcctgtcatacatccggctggtgaagaaggcaaagaagcattccaagaagactgtgaagaaggttgcctcagacatggaggactccaagaaggtcaagctgttgagcaacgctagacagatcactacctctctatttgaatcaacactggacctcttgtcaaagcaaattgtgttgccaaaattgtctctcatctccaaggcgttccagaagaagaactcggtgatctgcaatgaggagcagttgcaggcattagagtgctgcatcggagatcttgaggctggagcagtacttctgttcaggagattggtccagagcagggttactctcctcaacattcttagctcatagatgagtcaagatctgacactcttaagaccctgcgatcggcatctgtcttttaaaggatttgctgatccttcccatttgtatatgttataggctcactgtacagaaaagaaaacacacatgaaagagacaaaattttgatctaattcttgccctgcactcagtcctgacatatctctgagatacatgatgtgattatgcaagcgatatcaatattattgcctttgtgattaatatactttgcatgacaagggcatggcacatgaattatgaaatatatgtaacgatattactttgatttcttttctttttacagtcaaattgatctatggtataccatggggcaatgaaatggccaagtgggtcatgtcactacgatgacatttgttgcctcactagcaagcaaaggatccatgtaaagtggatcttgctgctgcagctaaaacaagccaactacaatacatgagattaagcgtgcaggcagcatggatctagctgcagcagctaaaacacgccagctaccaaacacgggactaagcgtgcaagagcctctgattgcacataatagaacaatcagttgttaacaagagcataaaaaatagataacacatgtaataacaataacactgttgtagcaatcaattaaaataatcccttgagagcatgcaattatgccaaaaaccacaggtagagctaactaacctgttggttcttgctgctgatagttgagacatgacaatgtgataactctcttggaagatagatgccagtacattaaaaatgagaacagaacacgagagattccatatgctgtttattgctgctgccagatctcataccatgatagacagcatcagggagctgaactggaatgattctgtttgtctaccaaccaaatggtgctgtgtctagcacatcccctgaataaataggcctcagcacaaagctagacacatcataccatcagtttcctttccttctcatctcttggattcagcacaaagaggcagagctagcaacagacatggctttccaccaaagatcaattagcttgccttctaggcctctctccaaagttgaagatgagttgcacagcatagaggcatgcatctcatcaccctccacgaccatcgaggtggtctctgatggtttgaggcggcttggggacatctacagctccattgtggagatcatgtgcctgcctagcaaccaaatttgctcatcccaacagaggaggttgttggatggagaaatggaatgctcccttcagctactggatctctgcaactctatgagtgaggtcttcaccgagttgaaggtcatcatccaagatctgcaagtacatctcagaaaaggagatggtgcagttgttcaagccaagatccagtcattcatccgcttgatgaagaacgcgaagaagcattccaagaagactgtgaagaaggttgtctcagacaacgactgcaggatagtgaagctgatgagcgaggctagagagatcactacctcactattcgagtcaatattgtacctcttgtcaaagcaaattacaatgccaaaatcatctctcatccccaaggcattccagaagaaaaacctggtgatttgcaatgaggagcagttgcaggcattagagtgctgcatcggagatcttgaggctggagcaggacttctgttcaggagattgatccagaccagggttactctcctcaacattcttagctcatagatactcctcaagatctgacactcttaagaccctgcgattggcatccgtcttttaaaggatttgctgatccttcccatttgtatatgttataggcttactgtacagcaaagaaaatacatgaaaagagacaaagttttgatccaattcttgtcgtgcacttgatcctcgcgtgttgcagagttacatgatgggttatgcaattcaatgtcaatataattgccatggcatatgacttatgaaatatatgggcaagttagcgatattactttcatttcttttatttcttacaggcaaattgatatatgatgcgccatagggctatgaaaaatggccatgtgggtcatgccagtctgatgccgtttgttgcctcactagcaagcaactgatccatgtaaagtggatcttgctgctgcaggtaaaacaggccagctccaatacacaaggttaagcgtgtaagcggcatggattgtacacaatagaacacttgttgaaattaacaaaagcattaaaaaatagataacacacttggcaataataatactctggtaacactttattaaaataatcccttgataacatgcaataatgccaaaatccaccggtagactgaacaaacctgctggcttttgctgccaatagttgggacatgacaatgtgatagctgacttggaagatagacgcagtgcattaaaatattgagcatacaagactatatgctgcagccagatctcaaaccatgatagatagcatcgggaggtgaactggcaggattctgtttgtctaccatccaattgatgctgtgtgttgcacatctctgtataaataggcctcagcacaaagctagaaacatcaaaccaaaacttccctctctttctcatctctcagactcaatagggagacagagttctagcgacagaaatggctttccgccagagatcaattagtttgccttctaggcctcactctaaggttgaagaggagctgtgcatcctagatgcatgcatctcttcaccctccacgacccttgatacaatgtgtgagggtttgaggaggcttgccaacatctatagctctattgaggagatcatgtgccttcctagcaaccaagctttctcctcccaacgaagaaaattgttggatggagaaatggaatgctcccttgagctattggatctatgcaacgtgatgcatgaggacttcacagagttgaaggccatcattcaagatatgcaagtggccctgagaaaaggagatgatgcagctgttcaatccaagacccaatcatactaccgcttgttgaagaaggcaaagaaacatttcaagactgcaaagaaggttacttatgaaaaggaggattgcaggatggccaggctattgagggaggctagagatatatcaacctctatgctggagtccacactgcatctcctgtcaaagcaaatcgaaatgcccaaacaatcacttgtttccaaggcattcaacaagaagaaagtagttatttgcgaggaggagcaattgcaggtgttagagtgcagcatcagagatcttgagagcggagcaggacatctgttcaggaaattggtccagagcagagtttctctcctcaacattcttagctcatagatactccagaatcttcactcgacacccagcgattggcatccgccttttaaaggatctgctgatctttcacattgtatatatataagtagaaatgtacagaaaactccatacataatagtgaacaaaagttttggccaaactcagtgtcatgaaaatccttgcatgcttctgatttcaacctctatgcgattatccatgtcagtactgttgcccttgtgcagttgtgctttgctccgaacatagtctgcaaaagaaaagacagcatgtgatctgtgaaatacgtgcggaattatttgatgacgccaacaaaaaaaaaatgttcgatgaatgcagaatcacaaggaattatccattggccctgaacattcgcttgtctactcaggtctcaacaggatggccgcgaaggattcggctgggaacgcaaggcattgcgaagataccgcagataccgtgtgctattgagttagggttagtgggatacctccgccagaactgatggagacctccgcgatcttgtcgggggctgccttccagggcgggggtagcggcgggaagggtggtcgcggcctcaccggcagccggcggcgagcggcgcatctcctcgctcctcttcttcttctccggtggggggtggtggcgagtggtgagacgaagacacgtggattggggaacgagtggggtactgagtggattcatgggcttcctgtgggccggatggtctcgctatccttcagtttggcccatgaaactacattgccaacaacaattctttttctgtaaaaatttgaacaactctgcatagttagaaaactatttatatcttgtagtatactcttatatagggtctgtttagattggtgtcgaaataaactttaccaaaattttagcaaattgtcaacattgccaaagttttggtagaattggcttattaatgttgccaaaattatatacacattgtcaatatttggtaacaaactaaacgtagctacataattgtcaattttaccaaataatgctatggttggaaatgtcatcaatctgaacatgcccatagatatggttgaaggggtggagtcatttgcagccccattgtttctcttattcatatgcttatccgaatcgcttatttttaaggaaaattgttatatacgtgtccttagcgatttaaaaacaaatgttgtgaaataaactacgatgaaaaaaacaaacaaatcaaattcaaaatttagttctaaaattcaaattttataatcataagtcaaacaatactccctccgtttcacaatgtaagttattctagcatttctcacattcatattgatgttaatgaatctagatagatatatgtctagattcattagtatcaatatgaatgtaggaaatgctagaatgacttacattgtgaaacggaggaagtaagacatttgaagtcggcgcggctataaatatagatttttctttctttttgcattgtaaagcgcttctttttttcatgttcagaattaagggtttacttaagtacatcattaatcaagtcttaaaagcaaatgcaggaaacaattaataattttgttcctatcatttgatttattattaaatatacttttatgtatacatatagttttacacatttcacaaaagtttttaaataagacgaacggtcaaacatgtttaaaaaagtcaacggtatcaaacatttaggggaaaaaacatttagggaaaaggagggagtagatcaaaatagcgtactaatgttcctgaacgaacgcgaggacaagcgagttggtttgcaacttcgcattatcgcatattagacgcccttgtggattatttgcggacgattaataaaaaaaaagttagcaaacatgacagcccgataagcttagttattgttcaacacacggatcatctcgagattgaggtgaaacaaaccagccatgcgcacgaaggcaattatggatggaatcatcgtgtagtaatacagaaagcgtaagccaaccaaatacactgcgatatctgcttccaacggacagatagatgggagcgtatcctatgcacacagaccctcgcatgtacacaccgtgtacagcaactaaaaattatcacaaaaaattaatacatgtactttcaatagtattacatctacgtgcaaagtcacatcttcaaattcattctacatagagaataacaaaaaagataaaattctgacaaaattgcaaccttaaaacaatcagattttttgtttttttgttacggctaaaatataatgaatttaacgttaagattttaaccctaggtgtaatacaattgaaagtatgtgtatgattttttctaaattttttattgacattttttagttggtgtgcacgtgtgtacacgtgagggcctgtgtgtataggatatgtttccaagatagatatgcacacgaggcaaagtcaaactctttgcacggttgcaacagcaaccacagctcatctcttctcactgcattgcattggcattgcttgctcatcacagatctcacacgatctggacctggcattaaactgaagtttcacgcgctcgtgcagatgagtgtttgtctccagtttcaggtgagacatgacagctagtcatctactagtattatctcacaagttcattcaatcagtagagatgctgcctcttgcatcgagcaaagcatataatgatagagattaaagaaacagaaacctgttgcttctgtagttctgttgcagcacaagtgatcgtcaattatcaatgagattctttctgtctgctggtccagcaatgagacctgcttctccttccttggttatatatacagagaagccatggtttggtgtcgacaacattgcgaagcagtcttgagttatctcctcttctcttccaattccagagagaaacaagtcatcagcttccatcccagccatggcattccacctcagatccgcgagtgcgccttccagccctcgctctgccaaaaccgacgtcgaagaacagctgcagagcctcgaggagatcgtctcctcaccctctgcaacaattgaaacaatgtgcaatggtttcaggagacttacagatgtgtacagctgcatggatgagatgatgtgcttgcccagcttcaggcttcagcagaggagagctgtggagcaagagctggagcggtctctcgccttgcttgacctctgcaacgccatgcaagagagcttctctgagctcaaggcgagcacccaggagatgcagttggccatcaagaggggtgatgatgcagcagttcagtccaaggttcaggcttacacccgcctgaccaagaaggcgcagaaacagttcaagaagatcaacaagaagtctgcttcagaagaccaggagggttgcagggtggtcaagctgctggctgatgccagagagatcgctctctcggtgcttgaatcaactttgcacctcctgtcaaagcagattgcgatgccaagtcaaagcaagtggtctcttgtctccaaggcattccagaagacaagggttacatgccaggaggagcaattacaggcgttggagttggacatcgttgatcttgagagcggagttgagactttgttcaggagattgatccagagcagagtttctcttttgaatgctcttagcttgtagatagatcatacaccaactctgatcccctgtgattggcgtccgccttttagaggatttgctgatcattgaaacaatttttggatgtatagtagtgtacataaatgagaggaaatgtacagaattcactcgaatgaaaaacaaaggatttttccttctgtcttatttcactgtcttacttcccttttcccctcaatcgacatggatggcaggtgaacaatcatctatcattttgaatacttcagctgaagcttgttcaagagggcacatagcaatttaatcagaattttcttcatctatcttggttgttataataaagaaattagtataattgcactgttcaaatattttattcgcaaagcttttaccgtgagatggacacgtcattgctattcacatgagatgtgcctcaagaacaggcgcaagacccttcttcaatggatattgccatgcatataattgatagcagcatgacagattgccagttagccggctgatatagttcttgataaattgttccgcaagaagatggtggatattgccatgcatataattgatagcagcatgacagattgccagttagccggctgatatagttcttgataaattgttccgcaagaagatggagtagcacagatggcaagttggaaacaacacaactcgattagcattctccattaaagaagtgctgcagcatgcatgtatgacaaggctctgcactatgactacgagttagctgccatgctgattcctgctggcaataacacactatgatatctgcgaccagcaacagatgacacatgatgtcaagtcaactcctcctttgcacggttgcaacagcaaaaacagctcatctcctctcactgcactgcattgctttactcaccaatctcacgatatggatctgatattaaactaaactgacacgctcgtgcagatgagtttgtctccagtttctggccagcgaggcatgatagccacctcaatgcaagctcaattagagaagagatgctttgtgcattgagcaaagcatacaaatattaaagaaacagaaacctgtcgtgcagatggtggcttctgttgcagcacaaggcttcgccaattattagagagattctttctgtctgctggtccagtaatgagactgcttctccctccttcgttatatatagagaagccatggtttgctgttgacaacattgcaaagcagtctgttctcttccatttctagagagaaacgagtcatcagcttccatcccaaccatggtattccacctcagatccgcgagcgtgccttccagcccttgctccaatgaaaccaacatcgaagaacagctggcgagcctcagggagatcatctgttcaccctctgcaaccatggaaacaatgtgcaatggtttcaggaggcttacagatgtgtacagctgcatggatgagatcatgtgcttgcccagcagccaagctagcctttgcaagcatcagcagaggagagaagtggagaaagagctggagcggtctctcaccttgcttgacctctgcaacgccatgcaagagagcttctctgagctcaaggcaaccacccaggagatgcagttggccatcaagagaggagaagatgcagcagttcagaccaatgttcagtcttacacccgcctgaccaagaaggcacataaacagtgcaagaagatcaacaagaagcctgctagttcagctgatcaggagagctgcagggtggtcaagctgatggctgatgccagagagatcactttctcagtgcttgaatcaactttgcatctcctgtcaaagcagattgcggtgccgagttccagcaagtggtctcttaaggcattccagaagacaagggttacatgccaggaggagcaattacaggtgttggagttggacatcgttgatcttcagagcggagttgagactttgttcaggagattgatccagagcagagtttctcttttgaatgctcttagcttgtagatagatcatacaccaactctaatcccctgtgattggcatccgccttttcgaggatttgctgatcattgaatcaattttgtcatgtgtacataaatgagaggaaatgtacagaaatttatgcgattgaaaaacaaaggatttattccttttgtttaatttcactgtcttccttttccccctcattccacatggatgtcaactgaacaatcacctgacattttgagttcttcagatgaaacttgttcacgaaaggaaatagtaacttaataagaattttcttcatcgatcttggctgttataatatagagatcagtagtaatgcagagttcaaatattagatttacaaagctttaccgtgagatgcccatgtaattactattcacatgtgacgtgcctcaagtacaggcacaagatccttctgcagtggatcttgccttgcatatagcaccatgacagattgccagctcgtacggttgttgataaattattctgcaatcagatgggcagcacagatggcaagttgcaataacactactcgattagcaatctccattggataaatgctggagcttgcacgtatgacaaaggctcaacgctagagtaagctgccatgctgattcctgctgccaataactggaacatgacattgtgattcagttaggcggcctaattgaccagaaatttggacagcacgtggaatcatcttgagattgcaacagatgctaaatgctgtgagcacagcaggcaagccagtgatgcaatgctgcaagatcagtgagcagattctaccagataagaaacacggtttggagcctggagagagaagtcaactgctgctcctgtgagcaaggctcatccttctcatgatctggatctgaatattacattagactatacacttgtgcaggtgaacttgccgccaataatcaggacatgacagcattgtaagctgagctagagatgcctctacacttggttgggaaacataaaaaaacatcagcctgtcgaggagatgggtggcgtctgttgcagcagcaaagcacttcattattattgagatttcattgttgtctacacggtgagggatgccattgcttctgcctctttgtctatatagaggaaagctatagccgggtcgacaccattgcagcacagcattcttctcatcttcacttccacagagaagagaaaaaggataagcttccactgcagccatggcattccacctcagatctgcgagtgtgccatccagcccttgctccaatgaaaccaacgctgaagaactgctgcagagtctaaaggtgaccatttcctcacccagttcaaccatcgagacgatgagcagtggctggaagaagcttgggagtatctacaactgcatcgatgagatcatgtgtctgcccagcagccaagctctcctttgccaaccactgcagaggaaagcagtggagcaagagttagaaggctctctcgtcgtgctagacctctgcaacgccattcacgagagcttttccgggctcaaggcatgcatccaggacatgcagctggctgtcaagagaggagatgatgcagctgtccaagccaagatacagtcttacatccgcctcgccaagaaggggcgaaaacagttcaagcatatcagcaagaagtcttcttcagcagatcaggagagctgcagggtgatcaagctgttggctgaagctagagagatagctctgtcaatgctcgagtcgtcatcacatctcctgtcgaagcagattgctttgccatgctctagcaaatggtctcttgtctccaagacattccagaaaagaaggcttgtctgcgaggaggagcaattgcaggtgttggagttagacattgttgatctagagactggagtcgagaatctgttcagaaaatcaatccagagcagagtttctcttctcaacattctcagcttgtagatagatcatacaccaactctgattccatgcgattagtatccgccttttagaggatttgctgatcactggaacaaaattttgatgtgtacatatatgaaaggaattgtacagaaactcagttgagaaacaaaaacaaagtatttgtccacttcctattgttgattacactgtttatgaatgtttgatataaatacctaattttctaacaatatgctcatcattattgactgttagagaagcagttagcagaattttcaagttcagcttcgaaatgatttactatgatacggcctcgctattcagatgctatgtgctaactcaacaagaagcaaaggatccttgagcagtggatcttgctaccagagctaagacaagccagctccaatgcacgaggttgaatgtgtgagcggcatggattgcacataataaaacaatatttaaattagcaagcacactaaaaactagaagacacacctatcaccaacaatactcagtaccactcccttaaagtaacatcttgaaaacgcaataatgtcaagatccaccaatagagtgaactaaccttctgattcttgcttccaatagttggaacatgacaatgtgatagttcattgggaggatatgtagtgcactaatatatgcagctacacatgagtgacagaatagattctatatgctgctaccagatctcagaccttgatagacagcatctgggagatgaactggagggattctacttgtctgtaaaccaaacgatgctgtcccgtgcagttcctctgtataaataggccttggcagaaggccaaacacatcaaaccaaagcttggactctccttcccatctcctcagccacaacacaacaagaattacatcaacagatatggcttgccaccaaagatcaattagcttgccttctaggactcactccaaagttgaagaagagcttcacatcgtagaggcatccatctcttcaacctcgatgaccattgagatcctctccgatggtttaaagaggcttgaggatatctacagctctgttgagggcatcatgtgcctgcctagcaaccaaatttgctcatcccagcaaaggaagttgttggatggagaaatggaatgctcccttgagctactggatctctgcaatgctatgcatgaggtgtttgctgagttgaaggccatcatccaagatatgcaagtatctcttagaaaaggagatgatgcagttgttcaagctaagatccagtcatacattcgcttgatgaagaaggcaaaaaagcatttcaagaagactgtgaagaaggttacctcagacaaggaggatgacaagatggtcaagctcttgagcaaggctagagagatcacaacctctgtacttgagtcatcaatggacctcttatcgaagcaaatcgcaacaccaaaaatgtctatcatctccaaggcattcctgaagaaaaactcagttgtttgcagtgaggaacagttgcaggtgttagagtgctgcatcggagatcttgaggctggggctggacttgtgttcaggagattggtccagagcagggttactctccttaacattcttagctcatagatactcctctgtcattcttgatagcatgtgatcggtatccgccttttaaaggatttgccgatccttcccatttgtatatgtagtgtacagaaatgttcatacatgaagagacaaaagttttgatctaatttgtgttgtgcattcaatgttcacatactactgaggttcacaatgtcattattccatgagatgtctgcactattgcctttctagtgaaaaaaacaaaatgttggcatagttcatgttgccaatttactatgacagaaccaccaatctcactaatatcaaaatggtatcatatatatacgtgaagtcaacaaatatgcaggacatttgaacagatgaaaatacatcaatagaaaaagtatatccgtgcttcagtaacaaaagtatattttttgtcttatgagaaaatacattttggtgcatctatctgggatggtagtgcagattttttttttcagggatagagattaagcttagttatctgatttacaaatagtagtgttgtttcaacaactcataatgattgtgatttgtacactgatacactccttatgaggtggatctggcctatataggaaatatgccagctccagccgcaaggtctaaaatagaagtaaacaccagagttggtctgatatgtgccaatcataaaggggaaaagaaatcaaactttaacccccacccccacccccacccccaggtaataagcaaaacattcatttggaatataaaatgtgcggtacactatttgaggctagaaagctttgctgcttatggctcctttgaggatttgaaattgatctgttgcaacacaaatctaggacattaacacacaaaatttatggtattaagtagcaagattgtatttatcactggatgtcatggcctcatttgtttcctcttcataggtaagccaggtaggccttctccaaaggtccaaggaaatttcatgtgcatctctttctttaattgttatgcaatttttattgtttgtcatagtacagattaaaaacaataattcatctttagtctatcccaagataatacaatacattctggttcactagtcatgctaaaacgcgtgattatagaaaagcagaagctgactgtgaattcatgaatttaggtctgatctacacaaactccaggtctttgatagttgaatagttgagatcctatatacatgacctgatagttcaatagttgggattctgtagacataacctaatagcatgcacttcttgcacataccacaacaacagatatacaagaaaatttgtattcactcatctgtgttttgaagcacagatctgcatcagaaaatatatccataggtttgtagatatccttcttgtcaaaagaatatgtcagtttgcttggactgtgccttgagatccttcaatttttttaaaatgttagtgaagtaatcttgcaaatacttctctaaggtgagaatatcctttgaatctaccccaagaagctggtatgtatcattcattggaactgagaaaattgtgtcactggagaggacctgaattataacaattaaatactagttattaattttcataagccttgacaattttataattactgaaaaatcaagtgcactatttagataagtctagagtgtaacctctgagaatgccagtctgtcagccacatcatttgtccactggaagaaccgtgtcaactgacgagtaaatctcaacactgcaacagggacagtagtaacgttggcatcttggccagccaaccgctcacacagtgtaatcacctgagtaaaaaaacaatacaatagttgagtaaatgatagtattccaactctcagaagccatcatttggtacattctgacattgaaaacgaaattaagagcaggaaatacaagattagtactcccatctcttgaagaattcatgacattttggacaacaatatagtctccacatgcaactttgacctttacatttatatgaatatgcttgtgaacataaattagtatattgcaattttttccattgaacacgcagaagagctctgtgctatttcattaagaataaataatatagtactacaaggggagggttaggggttaaaagcccttcctatccccaaaatataccacataaacacacacacacactggaaaactaaaacagatgcgccacagaaaattccagcaaaaattttcatgacaggctttcatggaagccaaatatgtacatatgacaagcctaataccatttgatatgttggtggacaaagataaggaagttcagctgcacattttgcaaaacgacatatatttctgacagagggagtatatttccagtcaagaataaacatgctgtgcaatttattcatggaaaccaaatatgtatttacatccttaaaaaaagaattgacgtcattagaacagtgtacagtatactacctcttgagttgtccaggcacgtggtccggcaaaagttaagagcttcttgctagccttctcattccgcatggcaataaacgtcagtcgagcaacgtcctacaatcacacgagggatgttgtatcaaaggaagggactttgaagagataatgttacaaataggtcacatattcatctttcaatggagaaggagaaagataaacctgggtatccatgtaagcaatccgggtaggagcatcagttccccatactgacttctcttctagtatgggcacagcatattgcccaattaggccctactcagaccaacatttgacagaattcgtttcaggaaacaattaactacccttgtttatattcgaaaacaaatcaatttcctggccaaatatatagaaccccacagaaggaacacatttacctgcatgaaaccacacaaacggatgatgagataatccagaccggcatcctgaataaacttctctgtacaatgcttgatttccatcaagggaacctccgggtgcttgtcacagttatgaatagagtagaacacatacttttgaattcccatggccttagcacattgtattagagcaacctttccttcccaatctacctaaatagaacaactattagcaaaacggaaaccaaattcactcaacgactctacagcatatatgtcacaggactcacagtataaggactacatcacaattacgtgatatattaaaagcaatgtgattagctttagtcacgactcaacaatagtgcaaatacacttcagcaagaatcaacttcaggacaggaatacagaagtatcacattatgcttaaagaaatgctaacaacataccgtccgaatgggctcttcgggacgccctgtagcacaatcgatgacggtatgaataccaacaagcgtcgcgggaatggtctctggcttgctgagatcggcctaaatcagcaaacagaaatgggcatgaggcggataaacattgaacagtgaggttgatatagcagcaaggaaaacagtggaaacctacattgaccacagtggcgccccagtcgcggaggaaatcggccggcgccgggcggggcctgacgaggcagcgcacgtcgtagccctcgtccagcgcccgcctgaccacctgccgtcccagcgtcccggtggcgccgaccaccaggatgctggtcggcctgacgggcgtgccctgcgcaatgctggtcgggaccgccgtctgcgcgttgcaggtcaccaccagcctgcagcctggagaaccccccaaacttcgtttacctcacacgatcatccgcaactgcaggcgaggggaaggcggaaacgggataggtattgtacctttgggcggtgcgcggaggagggggtggtggtggtggcgcggccgcgcggtagcggaccgggagagggcggcgcggcgggcgggggaggcgagctgcgagggcagcgcggcgaggctggtcgacgacgccatttgcgcgcgcgagagagagagcgtggagaagtggcggcgtgggtcgtcggggttgggtttttggttggggggagaggcgggcgaggagtggcggagaggggatgcggagtagccgatggccgtcgcgccacgtctaccgccatcccgtcatccgttctgtccacgtcaccctcctgtttcctctgtctctcttttttttttcttcaccgcagacgtggactctgtgcaggaatgctaattggcgcgcacgcgccggcccacacggcccaatagacggcaagacacggttattttttttttccgaatttttccatatatgtgtaaactttcaacccagatttgaatacttttaactctaacttgaaaactttcaacttcaacttgaaatctttcaacttcgacttgaaaactttcaactcatatttgaaaactttcaactcagatttaaaaaattttaacttgagattcaaaaacttttaactcagattcgaaaactttcaactcgagatttaaaaactttcaattacagatttgaaaatttttaagttaagatttgaaaaaatatgaaaactttcgactcagatttaaaaactttcaactcaaaattcgaaaacttttgactccgattcgaaaactttcaactcaaatttgaaaacttacaactcagattcaaaaactttcaactcgagatttgaatactttcaaatcaaatttaaaaattttcaagttaagatttaaaaactttcaactcaaaacattttataaaaaaataagtgtgctaaagattaaaaaaagtaataagaaagaaaacgaaaaaaaccgaaaacaatcgcaaaagaaaaagaaaaaacaaatcgcgaaaaaaaagggctgatgggccttaggccgggagcagctggtgcgcgcgccaactagcaacccccgactctgggctggtttggtttgtggcctaaattaggcttaccaatttttggcaatttcaatagtgtttagtgtctatttggtttgaagccaaattttggcatgcctaagaaaataggccatttcaatagtgaacttaggctattttggcttcaatccaaacacaactttgccttaccaaaattagtcatgccaaaacttgccaaattttggtactaataaaatttggtaaggcctatttagaccacaaaccaaaccaaccctctgcttccttttttttaaccgtttttatacggaatacgtggacaaacagtttacagttagacggagtcattagagcacccgcgatggtaaagtaaagtgttctctataaaacatgtacatctcagcaatatactagattaatagtaaaccacctcaatagtatgtctacatgggtatctatagctctctcatgcattgcctcgtttttctctatagactatctctatgttagtagatagcttcgctctctctctcttcatttaatatcttccaagtagaaaaatatgctgacatggatctcttgtagagagcttatagataatcattgcgggtgccttagtatccaagtaatatacaggtggctatattacatttgcgatgacaaaattaatgagttagagaagaaatgggtgaagggagagtgagtaggtcacttaaataatcatcggtttctacagcactcaaagacacttaaaggctagataaaacgcatcaggtcagcttttattgacccatgtgatgtagagatactgagatagtggtgacatcattgcacaaacaacaatattgcctcctttgggacaacaaacatgagagtgtatgcatcacgccaagagttacccaatgttgtacattgtttgttctgtttttcatggttgtcatcaacaatgttctcatttgtagcgggtccatgtcagtaaccgtgcataggcgcgcgcgcttgaattggcaatagaatagtcgctcgcttctctctctctagtccttctcttcttacataagcaggctattatcttgcttactctaaagtgacggtgcttgatatagagtagtggtggtactctgtttttagactttgcaataatactctctgtcaataatgatcagcggcggagctagggcccggcgaccctgggcacttgcccgggcttcggcgccgcaagcatcatttgattagtgctaatttatggtgcttagccacggcatgaagcagtataagcacactatttggttgggacacttaataacgtgtataagtattagagaacatacttagccacagcatacaataactagcatgctgcatgcagtagtataagtacgttttaataatctgttagacataatcatctagggtataacctgaagcaccagaattatttactagctagattgttgtacccattacttgagtgtaagctattagacatctgcaacctgaaagcaaagtaaattttctagcaccattataatttttctcttttcgggataataaattactaagtcccatagcctgcaaaaacacaaccatgttttcctctaaattagaatagataaaaaagttgttgtatggtacacaatctatgaagttatgtgtgatttgttatatatccgttggcgtaacaggctcacacaaatttctagatccgcattggcactgataatgattctggacgtcgtccactcgttctaaccttgagaaagcccggactcctctcacctgctgctttcttctcataaagaacaagtgctgaaattttgagaaggaaatgtgtgacacctcgaaaatcgaaataattgatggaaaaaagttttgaaaagctagagctagcaagctgttggccgatatatctttgatggtcgatggctgttgggtttgtgggcttgtgctaggcgtcccagctactcaggctgtaaggggtttccggcctatgtgcggcccatattgcatgggccgcaagtccggaacggactgtaacttccttgcgggcccacactaggcgatcgtagatgggccgggccgtattggggagccgaatcctatttgaacggcctacctacctttcccaacgctcacgtctaaccaaatcttttccgcttcgcatacgtagaaaacgtaaaccattgaccatatcggacacggtctcaagaagttcgtttccatgtgtacgaaacgtattctttttctcgataagaagtgtagaaggcgccaggtcgccgtagtctcgctcgtctccgtgcattccgcgatctccgtgcccgtcgaccaccgtggtgctcgccggcgacggacggagcgagaatgcagggcggatctagcggcatcgtctacggcggcctcaagtaccaggcaagccttctcgaaccttctagaacagtctcccgtaggggggcgcccctcacccttgcaccccactcttgcaggcgcggtgcatcgccgacgtgcgcgcggccgccgggtcgaccaccttcctcgccggaaccctcagtctcaaggaggagaacgaggtgcgtctcctggaggagggggggagggctctccgccccaactcgtcttcttccatcgactctggctctgccctgtgtgttgcagcaattcgagcaattgtagaagagaacgttgtgattggatctctaactcgttgttgctgccaagtaggtgcacctgatccggttttcaccggcggagagcgagctggtgtgcgacgggctgttctaccatccaaacgagatctgggaccttaagtcttgccccttcgatcatagggtcttctccacagtctacacgtctggtaaagaaagaattcccctctttgttactctctttctgccggtgcattgggcatttcatctagttgtaaatttctaaaaatttctttatgttatgatatggatggaaggcgagggctatggtgcatctgtttggaagatcccggagctgcacgggcagtcgaattcgccgccacttgagcagcttttcacgcttgatgagcacacgggcaaaataagatggtgcgcgctcttgtttctgttgatgttctgtgctcgcttgttctggtgccgtttagtcttattgctgtagagtattttgccgcttgttgattttatacatactggtaagtagtaaccagagtctagttgaagaatgcaactgtatgctgatgatttgcaaagcccaaaaagggtctcttattttggggattagtcgactcacaaaaacgatgactgtgattttaccaatgctactttatgaagcacattgtcatgagaaggttatacaccatatagggttcagcggatatttcaagttttcctagcataccttacttgtttacaacacatagctacaattcgaaggccaaagcaacataagaattaattttggctcgtccgaggttctctatagggagcacacaatagatgaaattttaatatttttatttaccaataccattttttgatctaaagttttagataagttatgacctttcttcacagtcttataacaatgtataagctcctttaatacattgttatttctggtggataccatgctcagactgtatctgtaagctggcttatctttgcagtgttctctggtggccactagggaagcacgacaagttaattagtattgatgacagaaatattttcctctggaatatagatgcatcaaataagtcagccaaggtgtgcccagcatccttctgttttaccaatagtacatcgacataattacgtgatattacattgtttctaagcattatcttcgcacttcagtgtcaactttatggaaacttacagttctgtatctctgttagcagaagttctgaacttaatcttgtcctaacttgaattcctaagttacaggtgatgcaaaaggggtctgctgacatgcttcccaatttacgtggtggatcttgggatccacacgatcacaattcaattgctgcaattactgattcctcacttcactgctgggatctccgttctatgaagttaataccttcacaatcttgacatattagatttgttgatctagtgtctgtggtttagatgctgaaatgttccacttatatctttatctgtgaacttgttcttttcaggaaatcaaatgcaattgagcatgcgcattttcgggatgtggattataaccccaagaaacagcacttaattgtgagtggtgatacttgccgtacttcatttcaagtgtttcagatcaagccatagttcgtttgcttaagtcatggttatgaattagtactgaagagaaaaacactgttgtattacttccgttttctttgttacctgtcaacttcgtttcgtctttgttttgattaaggatcctgcagagattatttttcttacattagtaggtactgtgtggtatcagctgtgccgctacttgctagccgttacttcttttattgttcaatgaaactaaacactcggatttgattgtgttatctagctgaatcattgaaccctatttcagaggttgttgaatcagacaattgtgcaattaacggttatagtgataggtactgtttatttttattcagtttaatttatttatggttccaataaaagatcctttatgcattgtagacaacagcagaagatgaatttggtatccgtttgtgggatctcagaatgcttaagtatcctctgaagaatctccctgggcattcgcattggtatatttctatatcctgttttactcagattagaatcctttcgattcaatgtttagttagtcgacccttgtgaattttgcaggacatgggctgttcggcacaatcctgagcatgaccagttgattctggtctctccctctctctctatttcttcaagtggtttgcatattgtgatgtactgttttattgtgtactgactacattgtaactcctgtagagtgctggaacagattcaactgtcaatttgtggtttgctaaagttggcactgatgactcaggacctgaaaggtttctattccttgtgtattttcttgtttggttactttgtttgttataatcttgatgcccacattcttgcttatcagtcctcctggttcacccacaagagaagaagaaccattactaaattcatacactgattatgaagatagcatatacggtaccctcaggaattcctacctgtgtttataattctacgttataattttgacaaggaatcacacagcgtattaaaaaattgtaggtattgcatggagctcccatgatccgtcattatttgcttctttatcttatgacggaagggtaagtacctgcagcatttgtatgcttatttgaaatatttgtcttgtgattttttaaagccagtttatctgatatctgaatcttgactctaatgatctgtgataatttcctctaatggtcaggttgttttagaatcagtcaagccctacttgcagagaaaatgaagctgcatgttctctccgttgtaagggcacataactccacttctttgctcggtatgttgttgatgcgattaccaatagtaccttctcttgttctaacagaccttcccttttctgctcaagcagacttgtttgttgtgcatattattggtgttgtagattttctccttgccatcctatatactgtactctggtacatggagttgatgcgatggcctgattcgacagcttgtgaccccagaacaatagcaagccaataatgtttcagtaaccatcttggcagaaatccagtgtctcatatgatctgccactcttgtgattcaggccagctgtaattgcaaaattcagcctggtacaattgccaaatactgctcctcgagtgattcttgaatgtcatatatctgagaaaggttggtgtcaattgttgcgttatgtggtgaagtacaaccgatctgaattttgtagaactgttgagattgacaagatctgagcttctgtttttcattcgatttttcactgtatgagtggttcccttactttagcaaagattaatatttcgtctgtatgttacaaaatcattcagggaatgagcaaattaacttcaaattgttttgggcatgagccacctacgaacttgtcatgcgttcaggacggcaggctcacatgctttcagcatttctttttcgcgaagattttgtcgacagtttctttttaaatcatatgtgttcgctgataccccctccgtttcaaaatatttgactccgttgatttttttagcacatgtttgaccgttcgtcttattaaaaaaatttgtgaaatatgtaaaactatatgtatatatgaaagtatatttaacaataaatcaaatgatatgaaaataataaataattacttaatttttttaataagacgaatggtcaaacacgtactaaaaaatcattttgaaacgaagggataaatttgttttagaaaatgatcaaccttttttaatgaaaaaaaacaaatcaacattttgcttgttttttttagtctggtcccatctgtcgccaaaatcctgaacggattgggattcggtgacatcaaatgagaatgtcacgggagaatgtcaccgaatccctcggtgtcacgggagaatgtcaccaaatcccaatccaacccgaacacacgcagacattcacgtttcctccatgtgtcatcaatgatggtagagaaattcgtgcttcaattactccattaaagggcaagttttaaccggaggattacagaaaaatttcgaccaatttgtactagctaatgtgaatacatctcctttacaaatgtacacaaaagtctcaattcctacagaaatcgacaataaatacctgtatccttttttagatgaaatatcttgtattcaaattgcatcgtttaatcgttacagttatatgtgctatgaaaaaaggaaaagaatttgaaaattagtacaaaatttgcaatacggaaatccagtttaatttaatactgcactgccgtacactggaacagtatcaccttctcgaaagttcaaacccactcatcgaaattccacaagtctcccatgtcgccgccgtctcggcgaccaccccaccaccaccgccgccgctgccgtcgcggcactacctccctagcctagcctgagatctccgggctccggaggatggcccagcctcgacggcgcggcggcggaggccacaacaagtgcccgcgcccggccctgctgccggcggcggcgctcctgctcttcctcctcgccgccgtcgcgctgctctacgtctccccgccgccgctcatcgatcacccggccctcgcttcctctcgccgccgctcccctcatgcccccctggtggtgttgcactagtaccccttcctacctgctccccacgcttatcccgatctaatttgtcttgctctgtgcattccgagtgcagctgaacagctccggcggcggaagcacggtggtgtccgagcacagcgagatttcgcgcgttccgataagcgtaagcttctttggttagattaagcgaactaattcctcgattaattgtcagaggttgcgtggttgtgctgttcagaaattagtagatacagtgcacttattccagttctagtgcctaactaattgtttctgggaaatggttgttttaattggtagataatgattcaggttccattccctgtgccatttttgaagcaaattagatgatggcaagctattaaattgagctcttttctattatatttacggagttagattaggatgttctagagtattttctaacttgttatcatgggtttatttatttcctttgaaacacaacttgttctcatgggttttctagatgtgatcctctgagatttgagttaaactgattttatttaatgcgctcaagagtcaagacactccctattttgaaatatagacccatgaaatatgtactcattttgctccatttttgtctaaagtagcatgaaaacttcattgcaatttctcatactgcagaaagaggcagatggcctttggggttctaagtttgcgagcagattctatgggtgcagcaactcaagcagcaggttccttggtgcgcattatttttccactgacggttaaaatttgctcgaactgagtagtgttttagatttgtagtgtgcatgtttctgaggcattctacatataggaggttttagtggcagtggtactattctttgttgtatggattacctgaaatagtcaatgttttaaattgtgcaggttcaagtgttatcacgcaaccagaccgttatttgatgatcgttacaagtggaggcctcaatcaacagagaacaggggtaatatatgtgccacactgttccgtatcaaatactgtgatgcgtgtggatggataggaaaaagaataaaagaaatcagtttgcaaatgtacatgaagaatcaacttgtacacatagattttatgtgatccattatgacaccatgttccatgtaactccgtggtagttatgtgtattctgttgttccatatgcataactatgaccatcttctgcttttcagataattgatgctgttgttgctgcacgtatcttaaatgccacacttgttgttcccaaattggatcaaacatctttctggaaagatgcaaggttaatttgagtattgagcgcttcctaccctaatattctaaggctgcccatgtttctatgaacacttacatttgtatgtgtactgtttctctgcagcaatttctctgaaatttttgacgtcgactggttcatctcgaatctatcaaaggatgtaaagattgtgaaagagcttccagagataggaggcaaactgcggactcctcatagaatgcgtgtgccccgaaaatgtactcagagatgttatgtgaaccgtgtgttgcctgcacttcttaagaaacatgtaagtcattgctagcagcatataatcccaagatacttttaaattatgtgctaattcaccgtcttgatgatatgaatttttgagatcaggaatagaaatttcatattcttggtaggtcaattgactgtactttcgttccactgactgaccattgaccaccttgtgtgacttcaaataaatttacttcttctgttcagagacactcataataccaataccaggataccttatatcattactttcacgtagtgcaggttgttcggctgacgaaatttgattatagactagcaaacaggttggacacagatctgcagaagctgagatgcagagtaaactatcatgggttgagatttactggcctaatagaagaaatgggtgaaaaattaatacaaagaatgagagagagaagcaaacattttattgctcttcatttaaggtacacgcatctcaagttctggtgcttgagctctcatattttggttttcctttaatacaaaactagagagtcttatattcttagtgctgtatttgtgaagaacatagtttctttttctcaggggattacttgaaacccattttaggtcataaggggggcaattttcatctctagcttggattagcaaatgttgggctccttagcatgtttcttttatcatgaataccccagttgagcatagcctggatttgagagggaggatgcacaaaataggatgcatgcacaaaatagtgaagggtgatatctaaaagttgtcaaccaatactgtccaaagtagcctttgtgcgggcacatactcatactagtagaacatatatatggagttccgaatggcatgtcaaaagagggtcctcctgtgctccatctatgtattgagaagattggtctcagatcttatcgataatatcagtcaatcacttgttggtcatgctagtaaagagagaaggccatcatatagcatgctcttgtcaggagaagttcagtttagtggattggctgtgacctttgcttcagaatagaccaccatcttggtctgaagttgtactggtttctgattttcttgtatgagtaatataagtatgttgtctatttagtttgtagtggtttccttttttttccttttccctaaacagtctttctcttgggttgccagatttgaacctgatatgcttgcattttcggggtgctattatggtggtggagaaaaagaaagaaaagagcttggtgcaatacggaagagatggaaaaccttgcatgtacgtatggcatatcattatagtgtattagtacgtacttaaaatggcatatatccttgaccgaactacctactgcaacctcttctttgtttaggctatcaaccctgagaaaggaagaaggcaaggtagatgcccattgactcctgaagaggtggggctgatgttgagggcactgggctacagaaatgatgttcacatttatgttgcatctggagagatatatggcggggcaaggacattagcacccctcaaagcgttcttcccaaatctccacacgaaagaaacaatatcaagcaaagaggagctggctccattctctaaatactcatctcgcatggctgcacttgattttattgtatgtgatggaagtgatgcttttgtgactaacaacaatggtaacatggctaaaattttggctgggcgaaggtatacttctcttctgctactggaagctccctgctgtcatcatgtacttcgttattagttctgaccatctatactgcttttgataggagatattttgggcataagagaacgatccggccaaatgctaaaaggctctattccttaatttcgaacagaagaaacatgtcatgggattcattctcctcaagagtgcgcatggttcagaaaggatttatgggagagcccaaggaactcaggccaggaaggggagaatttcatgagaacccttctacctgtatatgtgaaaaaaccgttagcaaaacagtagccaaatctaactcccaatctgagcaagtcttaagtaatgatactgagagaggaatagccattcaaactgagcaagtctcgagtaatgatactgagatgggaatagccactagtgagcccacagttcctgatcatactgatgaagaggcaggtgaatccgaggcagatgaagatgctcctggagagaaagaggagataattgatcctgaagcggatgatgatgtgcagttcagactagaggatccagagttagaagggattctttcagattagttgagttgtcgatgcttcaccaaccaatttttttggtgagcaattgaggaattttgcccctctaacgcctaaactgtacataacttggtttgctctgtcaatgtacatctctaggctagttcatagtgacatttttctgtagttcactcactcacagtgtcacgccggcggttgatctcttagaagctttgagtttgtagtacttgtggtttgcattgatatagcctgtagcatatgctcttgtacctgttattcaactcctttttgtggtgtctaaaatggatgttctattttgacctgtttgcagcaaatgcaactgagcagctttgtttgaaaccagtgaggtcttcttttaactgtatcaaatttatctgtgttgatttcaacctttcatgctatcaactgaattacaatgatacccgcctacctggatcaagtaaaggagtaaagctttgcaaaaagttaccagtttgcaaggaacataactcctgtccgacactaattctcaacattataccactaagtgctgtatttgtgacaaatttgtgctcttgaacattccctggagagagatcggatctgttggtgggtcgtcatcaatgaaaaagaagagtgacaacacctccaaatctaactgaatggaactgccatattactcttgctattgatgaatttgcaggcgttcttcgggatatcgtatggttttgttgttactgaactaacttttctggagtctgtaacctccatggacgtaaataaccggccaaacaaacagaggttagttcaacagttctcttccctctccctgttttaactcattttcttactgccctgtttgatttctgcaattgcagataactgtgcttctcacttgtgatcttttcccctaggtgattcttgctcacttttgctcttgcctattgttgcatcaagccctccacgagcatctcatctttctactttcaaggatcagtttttttttttacctcccctctgcaattctctgaatctgacgacggagaacgcaattttcttgcaagcagcacatggcaggatagggaacccaaaacttttcatagctggagtacagttcttgattcactatgcaactatccctttctaggaattaggcaattaggtccccgtgaatatctcactagccttgatgcttggtacagtagagagtacagtaggaatcctagctgaagagatgtatcagctgagctcccatcacatgatcactgtgctgaactacctcccctgttccccatacaatctctgatgctttggatttcgctgctcgtgccggtgttcttccgttccaaggacaagaggccaaacgctttcccccaatgcctgccaatatctctatgcttgctccaatgaaagtcttctcttcctgtcgttttctcttttctgaacttgtgttttctcttcctctctgcctcacgggactactagatggtgacacttgggatgctgtggctatcggcatgttccacgtgtcaatgccacagagttcggacatacaccaactagttcatcatctagtagactagtactagtgtcagattctaatgttggcgtactaatctgtgttaaaactcaccttttctcattgatttgaatttttcataagtataggaatacataggacacgattttatgcttttgttttgagctgaaagcctctaaataataagccctttgcatcaaacacccctttttatttgaaggtttgcagcgaacagcttccactgaagaagttgccagatggtggcaaggcacatacttcactcaaaagctccaacaagctgttagttaattaggtcaaatcagttgctgaccccactaaatataagcaaagaaatcaattcttgaagcagtagttatctttgacaccttccttttgctgcaggtctcacctctcaacaagtcaagcctctgaagcttttgatcccttcacctcgcactcgcagcagcagcaggctgtactgaccaaccaccaagaagtatcggcgccattgctgtcctcctccttggcttgaactcaactcaactccagtgcaggcacatgcttgctttccaaaccaagggataaccactcatctaatcaagccaactccacaagcagctggccatccactgattgatcaatccatccatccatcagcttgctcatggggaaacttaggtactactgctgcttctgcattcttctttcttctgttgctactgctgcatctgcactgcatggccatgtccactccacacacttggccggcattgccagtcattgctatactatatatgctgctggtttcctggtttggtggtctcatgctcatgcatgcacacgtccatctgtgttgaattctgaagctgcaagaacctattgccgtgctgcatgggccatccaccggcgacctcaccggccggcgccaccgccggcgtcagcgttaaggtcagcgaccgatatgtaagtgtgctgctgctggtcagctctgcctgcgcatgttcgatcgattcattgttgacatgattgattgaatgattgattggttggcccgcgttgcaccattgcatgcgcatgcaggttgagattaaaaatggcatatttgagcttacgctgtccaaccccgacgggatcgtgaccggcgtccggtataatggtgtggacaacttgatggagattcttaacaaagaagacaacagagggtgcctactgacaattttgcttacgctttttatcctctctttgatatgtttaattagcaagtacaatagtttggtactacttggatcttgccacatcctacaagtgtacatttgttaattgttattcagctactttgccaatttaaaactaaagaagaaaccttttagtcctcattcaagtacaggctgcaactgaggttatggtcaatgtactcatatggtgttgcatgttgtcaggtactgggaccttgtttggagtaaactgggagaaagaactggcatatttgatgtgtaagggctctcaattcactcggatttcaggaatcgcctccatatgattacactttttgtgctagagagagcccaggtgtatctgacattgaacgttgttacgcagaataaaagggacagagttccgaatcatatatcaggatgaaaaccatgcagaggtctcgttcgttagaacatgggatccttctctggaaggcaaagctgttcccttgaacattgataagaggtgatccaatagcacaggcataacaatggaattgttctcagcaattcatttggaaaaaaggcaatcatgtttaacagagcaagtaatttttgaaatattttgacagcgcaagtatgtttgtacaggttcattgtactccggggctgctcaggattctatacctatggaatctatgagcatcaggaagggtggcctggttttagcctgggagagaccagggtggccttcaagcttcggaaagacaagttgttctagttcctgaatttaagttttcttttttttttttgcagtttgctgaattatgctacatcttacactgaatgtctgaatccattactttggtgcaaattcaggtttcattacatggcattagctgacgacaggcagagaataatgccgatgcctgaagaccgagtgccgccccggggacagcaattagcataccctgaagctgtccttcttgtggacccaataaatcctgacctaagaggagaggtaagttgacaaatataggattttttttatctatgataaacgtattatatcatgaagaatctaaacactgttactggtaaattgtcaaggttgatgataaataccaatactcctgtgaagaccagtataacaatgtccatggatggatatcattcgatcctccaattggcttctggcagatcactccgagtgacgagttccgaacaggaggtcccgtcaagcagaacttgacctctcatgttgggccaactatgctggctgtaagttcagacattgtattatattgaaataaaaagttcagattattaagttcagacattcttctgaaaccctttttttaaaatatgtttttcagatgtttcttagcggtcattatgctggggatgaccttacacccaagttcttgactggtgaatactggaaaaaggtccatgggcctgtcttcatgtaccttaactccagttgggatggaagtgacccaactctactctgggaggatgcaaaagttcaggtgaaaaattggatgcatatttcgtctctaatttgatatctttcttttattcacaaaagttcaggtgataacattcaggttgattcttattgacagtacaagtgttatgaacacggcacaagtaacttgtaatttaactctctctttctccttttgaaatcagatgatgattgagaaagagagctggccgtactgttttgcactgtcagatgattttcagaagactgagcaaagaggttgtatctctggtagattactcgtccgagacaggtagtaattaatgacatctttttccagttttatacaacagtagtaactaaaagaagtttgattcagtccagatgtaatttagttcgcgatacatctattactaatgaattcatcatgtgttatttaggtatttagatgatgcagatctttatgctacatcagcttatgtaggcttagctctaccaggagatgttggatcctggcaaagagagtgcaaggtgatgcatgctatatacacacttattcttttagaacaagcttgaatacatgttagactatgaagtatattatcaatcacatattccaacaccgtgacccggcaaaaaaaaatatatattccaacactgtagggataccaattctggtgtagggcagaagatgatggaagcttttgcataagaaacattgtagctggagactacaacctttatgcatgggttccaggatttataggggactacaaactggatgctaagctaaccatatcttcaggtcagtatctacctgacatttattcctcttgcagcttccaatgagatatcctgatatgttcagcactcctgttcaggggatgacatttatctgggtgaccttgtgtatgaaccaccaagagacggtcccacgatgtgggagatcggaatacctgatcgatccgcctctgaattctttgttccagaccctaatcccaactatgtgaataggttgtatatcaaccatcctgacaggtgatgcagactggctaccaacagacttctcaaacatgtagtaaccaagtgatcatcatttcttatcatatagtgttcttatcgttcgttacagatttaggcagtatggactttgggaaagatatgcagagctgtatccagacggtgatctggtatacacaattggccagagcgactataccaccgattggttctttgctcaagtaaacaggtgatgttttcatctcatttgaatacaactgattgcgcagagttacatgatctgcttctaacatctgtgtccactgcagaagaactgatcagagcacctaccagccaaccacatggcaaataaagttcaatcttgacagtgtcagtcctaacagcacatacaaattcagagtggctcttgcatcatccgcaaatgccgagttgcaggttatttcagaaaaaaaaaacacaaaaatacttagattggccaatgtccattcctatttcattatttgttatcatcattcaagaagttgatcctaaatacacaaaatgcttgtattttcaggttcgtttcaacgatcaggacagaactgctcctcacttcacaactgggttgattgggaaagacaacacgattgcgaggcacgggatccatgggctgtactggctgttcaacatcgatgtgagtggagcttggcttgttcaagggatgaacaccatctacctgaagcagcccaggaaccagagtccatttcagggactgatgtatgactacctgagaatggaaggtccttctggcagctaaggccagtctttagctagtttaaccagcctcacctgtatggctagtatagctgtactatgcctaggtatgcagtacgattatgacccagatattcccatccactaatattctatttagtgtgctttaaagtttaatcttattttaccaaaaaaaatcctgggttttgtctaaccccggatttagcttatctgatttaggttagctggtaaagatgtaagctgccgaaatttcgcagagcatcagaattcagaaaacgattagatatactctaaatcggtgatatgtattggaaaaagaaataacatttccctgctgttttaactctagtgtaacaatttgaaataatctaaattggtgccatgctcttgtttctcagaattaaggtttgcagcaaacagctttcactggagaagttgccagatggtggcaagacacattcttcactcaaaagtcaaaagctccaacaagctgttagttaattaggtcaaatcggttgccaaccccactaactattagcaaagaaatcaattcttgaagcagtagctatctttggcaccttccttttgctgcaggtctcccctctcaacaagtcaagcccctgaagcttttgatcccttcacctcgtactcgcagcagcagcaggctgtactgactactgaccaaccaccagtttcggcgccattgctgtcctcctccttggcttgaactcaactcatcgatcaactccagtgcaggcacatgccaattgctttccaaaccaagggataaccagtcatctaagcaaagctgatgatggattgatcaatcagtggattgccagctgcttgcggagttggaggatgtggtggtgcttgattagggcatggaaaaccaagggataaccactcatctaatcaaagctgatggatggattgatcaatcagtgcattgtcagctgcttgtggagttttggaggatgtggtggtgcttgattagggggagtggattttgatctctcgagagggatgtcccctcgttgtttgtatgtcactcaaatggttatgaaaaagctctaaaaaaattgagaagatgtattaacatgtgatattactccatgaacatgctagttcaaattcaacttctacatctcgcaacgaaaaacaaatttgactgtgaatatacgttaactagctgtagtttaattatttttttttgttgcgagatgtagaagttgaatttgaacttgcatgtttgtggagtgatatatcacatgttgcattttttttaattttttttcataactatttgaatgatatgcaaacaacgaggggatatccccttgaatgatcaaaatagtttccccaggattagggcatggaaaaccaagggataaccactcatctaagcaaagctgatggatggattgatcaatcagtggattgccacttgccagctgcttgtggagttggaggatgtggtacggtggtcactcctacggaacacatttttgcatactggcaaaactgattttcgcatgcggttgctctagccgcatgtgtgaaaaggtttgcgaaaatcggtatttttgcatgtggccagcgcaatctcatgcgaaaatacgattttcgcacgggcacttaagccgaccacatgcaaaaaaaaataatcgccccgccgccgcctgagatcgtcgcagccgccgccaccgctcctgtcgtcgccgtcgccgtcaccagccgccggtagaaccgtcccgcccggatccgccgcctgagaccgccgccgccaccaccgccatcatctgtgccggatcctccggtcgagaccgccgtcgcgatctccgccacgctccagatccgccgcccaccgtcgtcatcgccgtcacatccaccgcccccaccgcacgaggtaggatcctgtagctggatctgccttcgtcgtccggatctgccgctcgccgtcattgtcgttgagggtgccgtcggatccgccacccgccatcgttgtcgtcatcggcactgttggatccgccccccacctccctccgtcgtcgccggtgccagatccatgtggggagggcctgctcccggtcgccgccgtcgttgccggtgctagatccacgcgagcccgctcctcctccggccatcaagcccgccgccgccacccaccccactccacaccgctctcggagtctcggttgctcttgccgtcgaggtgacaaggagagagagagagaggattgagaggagaggaggagaagataagtatcgacgtttgaggtctcgactacggtatttgcatggtgtggagatcgtcggtgtaccagggtatatgcgagactgaagtgaaagaaatggagacaaggatttttatacaggtaataaccctactcctattgaccaaagccggtgttgctctttattcatctggatcacacaagtacaatatttgggataacctatctagctgtcatcgacttggcggcatagataaccaacatgtagtcgacgacaagatagtcttcctcctcgagtacgaactcatcgagatcagagatggcgctagatcccttttgtcggcctccgcaggcaccatattgggtctgtctaggcttatctctgatgtcgatgtctgccggcgtgttggtttgtgtgtcgatctatcgtgtcctctctcccctagtgtcagggttatggataccacatacataatagtagtcgactaaatctcggcaggacccaccacataccatgtcttatacgggaacaatcttcggatataggaggagttctacataaggaaggatgaatagagttctacatgaaaatgacaaggactactcggattgtatccatattggtttccctagttctacttggacaaggggacacctatgggtataaatacaaggccccctaggaggaaaggggacacgaacaacatagacgccacaaagccacatgccaatataagcctacatacgccaagacaagctggcagatatcgatatcagagataagcctaggcaaatcccatatggtacctacgggaaccaaagagaggaatctagcgctatctctgatctcatcgggcacggattcgaggaggaagactaccctgttgtcgactacgtgatgatacttcagtccgccaagtcgacaacagttagataggctaccccaaatattgtactggtgtgattatggtgaataagagcaacgaccggcttcggctaataggagtagggttattacctgacaattcaggggcccgaacctgtataaaaatcatcgtctccatctcttttacctcaatctcgcatatatcctagtactaacgatccccataccatgcaaataccggaatcgcggcatcaaacgtcgacacctagggtgtcttgtatttatacccatagatgtcccattgtccacgtaggaatagagagaccaatatggatacaatccgcgtaatccttatcgtttccatatagaactctactcgtccttccttatccggaactccttctatatatgaggcatgattctgtataggacttggtatatggtgggccccgccgagcttagtcgatttctattgggtatgtggtatccagaaccatgacaataaggttgggtgaaaaattttaaaccggtggacagagaaggagaaggctaattagacttcaagtccaatccttaagaggctcgcatgcaaaaatcgattttcgcatgcgggtctcttaagtggcctgcatgtaaaaatgaggaacttaagcatctgcaaaaatcaatttttgcatgcggctctttaaacttcgagtcaaattttatcatacattcgtactaaatgaactcatataaaaaagttgtcaaaaacaaagttgtataacttattgagatctaccaattttttttggttatttctccatcgagtttgattaaactatataaattttaaattttaaaatataagaaatttaaataattttttcggtagtaaatgatttcaaatggaaaaattgttaataacaaagttgtatatatatatatattgtactggttatatatatatatatatgtatacatacatacatacatggcaacatatcatatgcacacagaccctcacgtgtacacacgtgcacaccaactaaaaaatgtcactaaaaaatctagaaaaaattatacacatactttcaattgtagtacacctagggttaaaattttaacgtcaaattcattatattttagccgtaacaaaaaaaaaaacaaaaaatctgacagttttaaggttgtaattttgtcagaattttatcttttttgttattctctatgtagaatgaatttgaagatgcgactttgtacgtagatgtaatactattgaaagtacatgtatgaattttcctagaattttttgtgataatttttacttggtgtacacggtgtgtacacgcgaaggcctgtgtgcataggatacgctccctacatacatacatacatacatacatacatacatacatacatacatacatacatacatacatacatacatatgtatatgtatatgtatatatatatatgtatacatatatatacatatacatatatatatacatgtatatatatatatatatacgtatatatatagatatacgtatatatatagatatacgtatatatatacgtatatatatacgtatatatacgtatatatatagatatacgtatatatatatacgtatatatacgtatatatatgtatacgtatatatacgtatatatatgtatacgtatatatatatatacgtatatgtatacgtatatatatatacgtatatatatatatatacgtatacatatacatatacgtatatatacgtatatgtatatattatacgtatacgtatatgtatacgtatacgtatatgtatatgtatacgtatacgtatatgtatatgtatacgtatacgtatatgtatatgtatacatacatatatacatatatgtatacgtatatgtatacatacatatatatatatgtatgtatacatatatatatatacatacatatatatatatatatgtatatatatatgtatatatatatatacatgtatatatatgtatacatatatatacatgtatatatatgtatacatatatatacgtatatgtatatatatatacatatatatatgtacatatatatatatgtatatatatgtatatatgtatatatatatatatgtatatatatatgtatacatatgtatatatatatatatatctgtgtgtaaactataagagaaatgtaaattttgtgaagaatattactatcactttgtcagatgaagaagtgaccaaaataaaagttgtatgtcttggtgagttctaaaacttttatgttcatgactttttcagctgaaattatttactacttcaaaatattatttgaagttttgaaattcaaatttttaattgataaaacaaagtcacaagagaaaatagccaaaataatagcagtaagaacacaataacatgatagaggatgattttaaaaacatttaggaaaaaaatcatccaatttggagttcatatgagtgagataaactagtttcaaattttattttcgcttacggctgcttaagacgactgtatggaaaaatcgattttctcataggggctcttaagtgatccacatgcaaaaatgagctcattttttacatgcggacatcttaagaggcttgcatgaataggaaaatcgatttttccagaagccgtatgcgaaaaagctgcttgatttttcatgcggtaagttatggtccgtttgcaaaaattatgagggtctcgtacacaaaaatcgtttatgtagcagtgggtgattgattagtactactgctgcatctgcactgcatggccatgcccacacacttggcctgcattgctagccattgctatactatgggcctgtttggggagctttagattctaagaagcagctatttggtagccagcttttgagaatctggaaaagctctaaaacctagcttctccagcttctgacttattagttcatttttcagaatatgtaactccatattctcagaagctgtggactgtttaggatagcttctagcaaaagcagctttttccaaaagctgccgctgagacaagcttcccaaaacagggcctatatatgctgctggtttcctggtttggtggtctcatgctcatgcatgcacacgtccatctgtgtgaattctgaagctgcaagaacctctcgccgtgctgcatgggccatccaccggcgacctcctcaccggccggcgccaccgccggcgtcagcgttatggtcagcgaccgatatgtaagtgtgctgctgctggtcagctctgcctgcatatgttcgatcgatcgattcattgctgacatgattgattgaatgattgcatgcgcatgcaggttgagattaaaaatggcatctttgaggttacactgtccaaccccgacgggatcgtgaccggcgtccggtataatggtgtggacaacttgatggagattcttaacaaagaagacaagagagggtacctacctgacaattttgcttacgctttttatcctctctttgatatgtttaactagcatagtggctcacgcagattgcgtggctagcatcgttacatttttttttctcatttaatagcttaaatattttcacattttattattaaaatatattaaaatgacaacgtaattttaaactcttggttgaactaacaaatgtgtgatatttttattgtatggtatacgtgatagttatttataaattatatttatatatggactcaagaataatcttttaatattccttagtttttaaatttcgaatttcctttgttcataaattctattcctatatggattctagactactcttccaatattcatttttctaaactctgaattttagttatttataaattgtatttctatgtggactttaaactcttctttcaatatttattttttttaattttgaattccaattattggtaaattgtattactatattgactctagacttctttttccaatagtttttattttttaaaattcagctatttctaaattgtattcatatatggacgctagacttttttttcccaatattccttatttgttaattttaaatttcagttatttataaattgtattcctatagacgctagtctcttctcccaatcttgtttattttaattttgattttttgtaattctaaattgtatttctatatggactctaaactctacttttatttttttttatttttaagttctaactttcatttagttctaaattcctatgtgtggaccgtagactcctcttccaatatttctacttttttaattctcaacctgttatttctaattgtatttctatatggattctaaattcatttttcaatatcttgttttttaattttttaatttaaattatttataaattgtatgcctatatagactctagactcttttttttaatatttcttattttttatttcaaatttcagttatttataaattgtattcatgtatggactctagactcttctcctaatcttgcttttttttaaaaaaaataatttgaattttagttaattctaaattgtatttctatatggactctaacttctacttttagttttcctattttttatttccgaattttaattaattctaaattgtatacttgtatagactccagtcaactctttcaatattccttatttttaattctgaatttcatctatttttaaattgtattcctatatgaactctactttttttttctttttctccgattaatatgggaatttctaagccgtgagagtaaacgtggtggaccgtagactcttcttacaatatttctacttttctaattcccaatatgttatttctaattgtatttctatctggactctaaattcattttttaatattttgtttttttaattgtgaattcaaattatttataaattgtattcctatatagattctagactttctttctaaatatttcttgttttttattttgaatttcagttgtttataaattatatttatatatggactcttgactcttctcccaatcttgcttttttattttgaattttagttatttctaaattttatttctactagaaaaaatgcccgtgcattgcaacgggtgaaatctattttaatcttattattgttatactgtttagttaaggtgagattcaccgtgggaatttgcttgaatttatatattttcaaaaatcatgagctgcaattaggattcttgtgcacataatataattaactttaatttttaaattaaaaactggttcattataagattttataatcaacaaaaatttgttgaagaaagaggtactatagttttgatttttcatcaaccggatgtgtatggtccgtgctagtggtcgagaaaaaaaaatttgcgcgcaaatatgatttgacaggagggagggacagtagacttattctaggagaggcccataaaaagtagatttattccaagagaggcccattgacacagtgcaagtaatataggtgtaaaaaggagagagaggtgattatatggaagatacgtatactatatcaaccgcggttttgacccgacaattaaacggatcccccgaaatccttacgtatttttttaattaggtacagaggtatagattagaattagaattaaataacatgttattattaaaataaaatacaatatacattttttattaaattcttcatgaatgaaccacactatctagaattgttttgaatttttcaaagctcatttgctaattttaataatacaaatataattttaataattaatttaaagtaaaaacaaactaaaagccctctcctaagtctgggccaaatctggcccattcttcttctcctccctcttaggctgccatccctccctattgggccgtcatccctatctccacttgggcccagcagccacctctcttcctttcctccttcttgggccaccatcctcgggcccaacagccatgccaacccatgaaaagaagcggatgggaataaaaccgaaaaagacgacggaaaaaaaaggaaaacggcgaaaaaaaacgcacggacgaaaaaaaattgtcggaaaccttatgtattttctaattattaggtgtgtgtgtgtgtgtatatatatatgaactctaacttctacttttgattctcctattttttaattccgaattttaattaattccaaattgtatacttgtatggactctagtctactcttttaatattccttatttttaattccgaatttcatctatttttaaattgtattcctatatggactctacctttcttttttttctgattaatgtgagaatttctaggccggaagagcaaacgtggtggcttcttttttattactttaataatataatagataattagcaagtacaatagtttggtactacttggatcttgccacatcctaccagtgtacatttgttaattgttattgagctactttgcctatttaaaactaaagaagaaatattttagtcctcattcaagtacaggctgcaactgaggttatagtcaattggtcatatggtgttgtatgttgtcaggtactgggaccttgtttggagtaaactgggagaaagaactggcatatttgatgtgtaagggttctcaattcactcctcagatttcaggcatcagttctgtgcctccatatgaatacactttttgtgctagagagagcccagatgtagctgacattgaacgttgttacgcagaataaaagggacagagttccgaatcatatatcaggatgaaacccaggcagaggtctcgttcgtcagaacatgggatccttctctagaaggcaaagctgttcccttgaacattgataagaggtgatccaatagcacaggcatacaatggagttgttctcagcaattcatttggaaaaggcaatcatgtttaacagagcaagtaattgatatattttgacagcgcaagtatgtttgtataggttcatcgtactccggggctgctcaggattctatacttacggaatctatgagcatcaggaagggtggcctggttttagcatggtagagaccagggtggccttcaagcttcggaaagacaagttgttctagttcctgaatttaagtttttttttcgattttgctatatctcactcgaaagttttttttcttatctctcactcgattttctcactcaaatttatagtgcattttcttgtaagttacaatgtaatttatgaaacttacgctgtaacttttacaatgtaattttgaatcttaagttttgaaatttatattggatttggtctttttcttgcagatatggtaattagtgtctattatggtgtttcttagttgtttcttgtcttttactgtgtctattggattttaatccaaaaattaaaaatctgtgtgatatgatcataaaaatatttcaaaaaatgcatagatactcccttttttttttagtttgctgaattatgctacatcttacactgaatccattactttggtgcaaattcaggtttcattacatggcattggccgacgacaggaagagaataatgccgatgcctgaagaccgagtgtcgccccggggacagcaattagcataccctgaagctgtccttcttgtggacccaataaatcctgacctaagaggagaggtaagctgaaaaaataaggattttttttagagaacgatggcaggagatctgccggaattttaattatcaattaaacactattcctggtaaatttacaatatcatgaagaatctaaacactgttactggtaaattgtcaaggttgatgataaataccaatactcgtgtgaaaaccagtataacaatgtccatggatggatatcattcgatcctccaattggcttctggcagatcactccgagtgatgagttccgaacaggaggtcccgtcaagcagaacctgacctctcatgttgggccaactatgctggctgtaagttcagacattatattatattgaaataaaaagttcagattattaagttcagacattcttctgaaaccctttttctttaatatgattttcagatgtttcttagcggtcattatgctggggatgaccttacacccaagttcatgactggtgaatactggaaaaaggtccatgggcctgtcttcatgtaccttaactccagttgggatggaagtgacccaactctactctgggaggatgcaaaagttcaggtgaaaaattggatgcatatttcgtctctaatttgatatctttcttttattcacaaaagttcaggtgataacattcaggttgattcttattgacagtacaagtgttatgaacacggcacaagtaacttgtaatttaactctctctttctccttttgaaatcagatgatgattgagaaagagagctggccgtactgttttgcactgtcagatgattttcagaagactgagcaaagaggttgtatctctggtagattactcgtccgagacaggtagtaattaatgacatctttttccagttttatacaacagtagtaactaaaagaagtttgattcagtccagatgtaatttagttcgcgatacatctattactaatgaattcatcatgtgttatttaggtatttagatgatgcagatctttatgctacatcagcttatgtaggcttagctctaccaggagatgttggatcctggcaaagagagtgcaaggtgatgcatgctatatacacacttattcttttagaacaagcttgaatacatgttagactatgaagtatattatcaatcacatattccaacaccgtgacccggcaaaaaaaaatatatattccaacactgtagggataccaattctggtgtagggcagaagatgatggaagcttttgcataagaaacattgtagctggagactacaacctttatgcatgggttccaggatttataggggactacaaactggatgctaagctaaccatatcttcaggtcagtatctacctgacatttattcctcttgcagcttccaatgagatatcctgatatgttcagcactcctgttcaggggatgacatttatctgggtgaccttgtgtatgaaccaccaagagacgggcccacgatgtgggagatcggaatacctgatcgatccccctctgaattttttgttcca

SEQ ID NO: 57903 - DNA, 5445 bp, Oryza sativa
tcctaatatatagagatcagccaaagtacctgaccaagtaggatcaacgcttttctcttgagtaaacacagtgctaaatgaagtcggatcttggggtttgtatagcggatccatgtgatttgaaggaatcaaagagactgcaccatcctaacgcggaggaggaaacttttcactcttgctttcgcagttgcatgtgttattaatcttcttttaacgatatttacttggaagcattggaacggctgtattttaaacaatgtcatgcctagtgtcaatgttgttttggaagcagtggtaggggagagtgttttgtggtccgtggctagagctagggctctccatgaactcctgtgtctgtctatcctgttgactggttatttgttgcctgaaagtgtgttttgtgttttggtgacgcatcgcctgttgtgatgttttctttctcaagagggttccttcgtgaaattctcttttcaacatattttgagtattcttaatgaaatgaagcacatggcttttgcgttttcatgaaaaaagaagtccaaaaatcaatttgactttttagtgaatcctgtaatccaaaaccacttctaattttccttgtatggcatataacttacccctcccattgtttagtaccatcagaacgtctacatcttctcacaatacaagccaagccctagtaggcagtcaaccaccgaaaaatcttctagctagaagctctcacaaaaaccaatccccttttatgtagtgcggcacagctccatccgtcgtccaagtttgttgggtgcttgtcatagccaagcgccatggtacacatcaatccttgtatcgtggaggacatggcagaggccatgtacaccgctatcaatatggatgtccaagagacacacgaatggaaagtcaagcactacgcatttgccacgttgcatggcatcatcatatgggcgatgtcattcaccgctgatctatcctcctagccttctcttgttagggattacatgttgcgaagactaacattctcactggatgtcaaggtgctcctgtttcagtcaacgacacacatgcgtgcacgtgaccataaacactccaaaacacacacacacacacacacacaaactccgcgtggaccccatggcctcacctgatttccctacctccctaccatcactgctccatctccaagcccaaatcccaaaaccatagcccatggtcgcatctcccactggctcctcctcctcggccactgccgtggcgacgatggcagcggcagccgagcccactgacgggccaacccttagcgtcgtctcgaagtggctccacgcgctgcggaagaagcacaacaagattatccaaatggaggagccgctcgctgacgggcggaagctgaacaaggagcagggggaggtgccctaatccaagcccgtcatcgtcgtgctcatcgacgagctcgagcggatgcgtgccccgctcgccaccgcactcgctgaggagctctcctcccgtcccgcccgttccccatccgtcgtcgtgtcctcctcctccagtgtcgatttgtctatcaaggatctcctcgcgctcatctactttggctccctcttcgacgtcaagccacagaccgagttcatcgccaccatgctcgtgcgtcccaaggagtgggactgctgcatcacctttgactatgtccgcccttgtcgcctcacgcgctgtcgctcactggtcccaccgccactcgcagctcgtcagtgcgggaagaagacaggagaaagaagaaaaaaagggaaaaaagaagagatggatggaaaacatgacggcgatggcacagttccaattttgtaaaattttagtggcacggctatgaatagacgaattatagtggcatttttctgaactgacatatttgtaattgtatggatccaattaaccctagtatttattgtgtggtgagcaaaatcgataaaaatcaagtccaaaagtcattgtctgtaaatatcactcttcagttccttaccgagcacgggcaatgcctggttgctttgatgagcggcaaaatttgtgcttccacttttgtttcccacctatagagagatcagccaaaggacctgaccaagtaggaacagagcttttctcttgagtaaacatagtgctaaatgaagtcggatcttggggttcgcatagtgggtccatgtgatttgaaggaaccaagagaccacaccatcctgatgtggaggaggaaacttttcactcttgctttttgcagttgcatgtgttattaatcttcttttatcgatatttatttgaaagcatcagaacaattgcatttcaacaatgccattcctagtgtcaatgttattttgaaacagtggcaggggagtgttttgtagtccatgtctagagctagggctatccatgaactcctttgtcggtctctcctgttggacggttgttgtctgagagtgtgttttgtgttttggtgacacatcgcttgttgtgatgtttttttttcaagatggttcctctgtgaacttctcttttgagcttattttccctcttcttaatgaaatgaaacacaaggctcttgtgtttcatgaaaaaaggtccaaaaatcaattaacttttagcgaattctgaaatccaaaacaacttctaatattccttgtatggcatatgactcacccctccaattgtttagtaccagcagaatgtctaaatcttctcacaatacaagccaagcacttgtaggtagttagccacagaaaaatcttctagctagaagctctcacaaaaaccaatccccttctacgtagtgcggcacagctccatccgtcatccgagtttgtcgggtggttatcatcgccaagcatcacgatagacatcaatccttggatcgtggaggccatggtggaggccatgtacaccgctatcaatatggacgtccaagagtcacacacgtcaagcactgcacctttcccacgatgcatggcatcttcatatgggcgacgtcgttcaccgctaatatatcctcctgcccttctcttgttaggaattccatgctgcgaagcctgacattctcattttatatcagcgtgctcctgttcgtgtgaccacacacacacacacacacacacacacacaattatagaatttactgtacagtgagcaaaatcgataaacataaaggccaaaaatcattgtttgtaaacatcactcttttgttccttatcgagcacgggcagtggctggttgttttgatgagcggccaaatttgtgcttctacttttgtttcccaactctagagagatcagccaaaggacccgaccatgtagggacagagcttttctcttgagtaaacacggtgctaaatgaagaaagatcttggggttcgaatagtgggtccatgtgatatgaaggaaccaaagagaccgcaccatcctggtgcgaaggagaaagcttttcactcttgcttttcgcatttgcatgtgttattaatcttcttttttcatatttatttggaagcgtcagaacgattgtattaccaacaatgccatgcataatgtcaatgttgttttgaaaccattggcggaggagagtgttttgtggtgcatggctagagctagggctctccatgaactcctttgtcggtctctccatgaacaccactatcactggacgtccaggagaagcacggggcagtcaagcgctacaccttcccatgctgcatggcatcatcatatgggcaaggttttcaccgctaatctatcctcctgcccttctcttgttaggaattacatgccgcgaagcctgacattctcactggatgtcaacgttctcctgttctgattatgaatagacacgcgggcgcgtgaccacaaacactccacacacacacacacacacacaatcatagaatttactgtgaggtgagcaaaatcgataaaaatcaagggaaaaaataattgtttgtaaatatcactcttccgttccttatcaagcacgggcagcggttggttgtttttatgaggcggccaaatttgtgcttccacttttgtttcccaactctagagagatcagctaaaggacccccatgtaggaactaatattttctcttgattaaacaacttttatcttgagtaaacacggtgctaaatgaagaaagatcttggggttcgtatagtgggtccttgtgatatgaaggaaccgaagagacagcaccatcctgatgcggaggaggaaacctttcactcttgctttccgcatttgcatgtgttattagtcttcttttttttatatttatttggaagcatcggaacggtcgcattttcaacaacgccatgcataatgtcaattttgttttgaaagcattggcgagggagagtgttttgtggtgcttggctagagctagggctctccatgaactcctttgtcggtctctcgatgaacatcgctatcactggacgtctaggagaagcacgggacagtcaagcgctacacctttcccacgccgcatggcatcatcatatgggcgaggttgttcaccactaatctaccctcccacccttctcttgttaggaattccatcccgcgaagccagacattctcactggatgtcagcgtgcttctgttccgattatcaatagacacacgggcatgtgaccacaaacactccacacacacacacacacacacacacacaaaatcatagaatttactgtgcagtgagcaaaatcgataaaaaccaaggcaaaaaatcattgttcgtaaacatcactcttctgttccttatcaagcatgggcagtggttggttgttttgatgagcggccaaatttgtgcttccactttactaacaaccaaatttggtaacattggcatcggaaaagaagattagatcgaagtggagttgaaggcggagatcgattcaggaacaaagcaggaatcggctagagtccagatcgactacgattaggatcggctgagtctgagtcggactaggtgggctgatgcagccgattccgacaatacaacttggtgtatgacatcgggttgaattgaggtgcttcgagatgattaccgcacatggatagagtcctgagaaggcaattgtatctattaattaggatattttatgtaatttccttagagatatgcttgggcaaaagtctgccgcaaagacttatggtattttagagtttgttagagataatagtcgtgtccggtatggacatatcttgtaattctcgggtataaataagaccccgagccctatgtaatttctaacacacacgttcaatacaatttcggcgcatcgccacctttttgcttttgttttatttcgacgagttattgctttcgggttgagctgcatcggtttcgatcttcaacaagaggtaaaacttgttatgacaatttgcgctctcgggattagaggttccatctttatgacactctaa

SEQ ID NO: 57904 - DNA, 4457 bp, Oryza sativa
ggaggaagctgaacaaggagcaggaagaggtgccctgatccaagctcgtcgtcgtcatgctcatcaatgagctcaagcggatgtgtgccccgctcgccaccgcacttgctgaggagctctcctcccgtcccgctcgttccccatccaccgtcgcgtcctcctcgtcctctagtgtcgatttgtctatcgaggatctcctcgcgctcatctacttcggctccctcttcgacgtcaagccacagaccgagttcgtcgccacaatgctcgtgcgtgccaaggagcgggactgctgcagcaccttcgactatgtctgcccttgtcgcctcacgccctgtcactcaccggtctcgccgccactcgccgctcgtcagtgcgggaagaagacaggagaaagaagaaaaaaagggaaaaaagaagagatggatggaaaacatgacggcgatggcacagttccaattttgtaaaattttagtggcacggctatgaatagacgaattatagtggcatttttctgaactgacatatttgtaattgtatggatccaattaaccctagtatttattgtgtggtgagcaaaatcgataaaaatcaagtccaaaagtcattgtctgtaaatatcactcttcagttccttaccgagcacgggcaatgcctggttgctttgatgagcggcaaaatttgtgcttccacttttgtttcccacctatagagagatcagccaaaggacctgaccaagtaggaacagagcttttctcttgagtaaacatagtgctaaatgaagtcggatcttggggttcgcatagtgggtccatgtgatttgaaggaaccaagagaccacaccatcctgatgtggaggaggaaacttttcactcttgctttttgcagttgcatgtgttattaatcttcttttatcgatatttatttgaaagcatcagaacaattgcatttcaacaatgccattcctagtgtcaatgttattttgaaacagtggcaggggagtgttttgtagtccatgtctagagctagggctatccatgaactcctttgtcggtctctcctgttggacggttgttgtctgagagtgtgttttgtgttttggtgacacatcgcttgttgtgatgtttttttttcaagatggttcctctgtgaacttctcttttgagcttattttccctcttcttaatgaaatgaaacacaaggctcttgtgtttcatgaaaaaaggtccaaaaatcaattaacttttagcgaattctgaaatccaaaacaacttctaatattccttgtatggcatatgactcacccctccaattgtttagtaccagcagaatgtctaaatcttctcacaatacaagccaagcacttgtaggtagttagccacagaaaaatcttctagctagaagctctcacaaaaaccaatccccttctacgtagtgcggcacagctccatccgtcatccgagtttgtcgggtggttatcatcgccaagcatcacgatagacatcaatccttggatcgtggaggccatggtggaggccatgtacaccgctatcaatatggacgtccaagagtcacacacgtcaagcactgcacctttcccacgatgcatggcatcttcatatgggcgacgtcgttcaccgctaatatatcctcctgcccttctcttgttaggaattccatgctgcgaagcctgacattctcattttatatcagcgtgctcctgttcgtgtgaccacacacacacacacacacacacacacacaattatagaatttactgtacagtgagcaaaatcgataaacataaaggccaaaaatcattgtttgtaaacatcactcttttgttccttatcgagcacgggcagtggctggttgttttgatgagcggccaaatttgtgcttctacttttgtttcccaactctagagagatcagccaaaggacccgaccatgtagggacagagcttttctcttgagtaaacacggtgctaaatgaagaaagatcttggggttcgaatagtgggtccatgtgatatgaaggaaccaaagagaccgcaccatcctggtgcgaaggagaaagcttttcactcttgcttttcgcatttgcatgtgttattaatcttcttttttcatatttatttggaagcgtcagaacgattgtattaccaacaatgccatgcataatgtcaatgttgttttgaaaccattggcggaggagagtgttttgtggtgcatggctagagctagggctctccatgaactcctttgtcggtctctccatgaacaccactatcactggacgtccaggagaagcacggggcagtcaagcgctacaccttcccatgctgcatggcatcatcatatgggcaaggttttcaccgctaatctatcctcctgcccttctcttgttaggaattacatgccgcgaagcctgacattctcactggatgtcaacgttctcctgttctgattatgaatagacacgcgggcgcgtgaccacaaacactccacacacacacacacacacacaatcatagaatttactgtgaggtgagcaaaatcgataaaaatcaagggaaaaaataattgtttgtaaatatcactcttccgttccttatcaagcacgggcagcggttggttgtttttatgaggcggccaaatttgtgcttccacttttgtttcccaactctagagagatcagctaaaggacccccatgtaggaactaatattttctcttgattaaacaacttttatcttgagtaaacacggtgctaaatgaagaaagatcttggggttcgtatagtgggtccttgtgatatgaaggaaccgaagagacagcaccatcctgatgcggaggaggaaacctttcactcttgctttccgcatttgcatgtgttattagtcttcttttttttatatttatttggaagcatcggaacggtcgcattttcaacaacgccatgcataatgtcaattttgttttgaaagcattggcgagggagagtgttttgtggtgcttggctagagctagggctctccatgaactcctttgtcggtctctcgatgaacatcgctatcactggacgtctaggagaagcacgggacagtcaagcgctacacctttcccacgccgcatggcatcatcatatgggcgaggttgttcaccactaatctaccctcccacccttctcttgttaggaattccatcccgcgaagccagacattctcactggatgtcagcgtgcttctgttccgattatcaatagacacacgggcatgtgaccacaaacactccacacacacacacacacacacacacacaaaatcatagaatttactgtgcagtgagcaaaatcgataaaaaccaaggcaaaaaatcattgttcgtaaacatcactcttctgttccttatcaagcatgggcagtggttggttgttttgatgagcggccaaatttgtgcttccactttactaacaaccaaatttggtaacattggcatcggaaaagaagattagatcgaagtggagttgaaggcggagatcgattcaggaacaaagcaagaatcggctagagtccagatcgactacgattaggatcggctgagtctgagtcggactaggtgggctgatgcagccgattccgacaatacaacttggtgtatgacatcgggttgaattgaggtgcttcgagatgatcaccgcacatggatagagtcctgagaaggcaattgtatctattaattaggatattttatgtaatttccttaaagatatgcttgggcaaaagtctgccgcaaagacttatggtattttagagtttgttagagataatagtcgtgtccggtttggacatatcttgtaattctcgggtataaataagaccccgagccctatgtaatttctaacacacacgttcaatacaatttcggcgcatcgccacctttttgcttttgttttatttcgacgagttattgctttcgggttgagctgcatcggtttcgatcttcaacaagaggtaaaacttgttatgacggtttgcattctcgggattagtgcttccatctttatgacactctaatcttgtttacgtaattcgtcgagttatcatatatcttacataatctctagcaatattgccatctaacccacaatcggctaacatctgttaaaagagggcagccggttaggttaaatatcgatattggtttagattatataagatatataccactctatgaaatgtccagcggcttgattgtctagatattgttcttcttttcatacttaatgctgcatcagttgagtttgatctattaagtcgtgcttagaatatcaatctgtagcgcccgttccgtcgtggcgcctagcgggaaaattatctcttaaaaaccctaattgcgaaatttgtttctttgcttgttgtgtagtgcccgtgccatctcaagatctcaaatccccgatc

SEQ ID NO: 57905 - DNA, 25347 bp, Oryza sativa
caggggggtaatttgaattatcaatatcagccaccatcacctcatattcagaaccagcaagcaggatcggtgtcacatcctgattttcgtttcaggatttataaattatttaataaattaataatagaatttatattaaatgttcattaatttacaagtgaagttaaatgtgggaaataaaatttcctaaatataaagcatggatggatttaatttttattaaattctccatggttaattatactctctggaatattctcggatttttcggagctcaattcctaatttttaatcttacaaagagcatttcagtaattaaccacatattaaattaatcattaaatggtctaattgtaattttattaagtactttgagtgtccaagtattttcaggatttttcttgaaattatttgagcattggaagtatttttaataattcaaagatcatttaagtgattattttaattgggaaagtaataaaatcctcctcctcagcttgggccattttcggcccattccttcctttccttcctctctcttccgccggcccaacctgagccgcctcctctcctctcagctcagccggaaaagtctactttccctccctgcgctactgttcatcttccaactcaggcagagcccgagccagccgtgccgtgcacagtgccgccgcctcttccttccaaatctcgcctccccgttgctctttttctccaatttagttgaggggaaatattcctcttatcctcctctatctttacccccaaaaatcggagcaaatcgttgagtatcttatccgaatcaaactcgttttcgagtttatctccaaaaccgagtttttgatttcccggatcgatttcttgcgggaggagtccgatctcttcaatccaaggctataaataggaccccctagtcctcctctttcgtttgccccctctcccgtcctcttccgtgctccgtagctccgtcgccaccgccgccaagcaaaccgccgccgccggccatctccggtgccgccgcgccgccgtctccatcgtcgtcgccggtcgccgtcaccaccgttgggtgcgccgtggtgaggggaagctcggccacccttccttttccgtcgccggtcatcggagctccgccgccccgtgcaacccgagccgccgccgtcgcctcctcgtcgccggccgtcgtcggtcgtcgtttggcacgagggtgagtatcgttgggttcgtctcgtcgtcctctacgtgttcatgtcctccaaatccgcagccggtcgctctatatccggcgaggtcgccatcttggtccggccattgatgatgtcatcatcgtttttctttttccagttttttctaatagattaaatcttcggaaattcataactaaatcatcgtaactcggttttgagtggttcaagttgctaaattcatctaaaatcatgatctacatgtttgtttactttatatgtactgtttatttggtttttattagtctttttcttcgttttgcgtgttagcttgtcgtttccgtcgttgcgaaggttcgtgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacctattcctttgttatggccagtttgcattgattaccctattccttgataccttgggttattataacttgactagttgggctttatatattggttcagctagatattagttatgattgcttagccatgcttagaaacattagcacactattggaataacttatgactcactattatttaaggatggcttaatgatagttcacgatggtcaatcgtgattggttaattaattacttgccaactaaaacttgataatggtgggttgtgagcacatggttttgagagtcgtgctcatgacaattaaggaccggttcgcgagctactgttgtgaaacatttatcgtgccaaccacaagccagcgtgggcaacggctttatcttttgtatagcgtgattcattatagtgcgccagactgagaagtggcgagaagtccacgggggtcgctggggagtccatgcctctggtttttgagggggtgattatgatccaggaaaggtgcgctgtaatggattatgttgtgcaaggggtattgtcacaactcctttccgaggtaccgtggtggtattgaggcacatggtgacatgatgtggggttgtgtcttgtgggtacagtggtacacctctggccagagtaaaactattcgaatagccgtgcccgcggttatgggcgggttgagcaatgtttttcgtgattagtctcacacctctcacaatagttatggatgttataactggtaataatttgcttagctcctggtttggagttagatctgtacagccgggtatggttgttcaggatggttgggcctgtgcagcatgggtgtgctgttcagtgttgattaaaatttttaattaattactctactgttttactactcttaactatttgctaaatgctgctttcgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagctgaagccatcgctagaccgttaattccgctgctgttttcttttcttttgtaagtgtgtaacgttattattatgatggatttgtatattaaattgtcagtttgtgtacctcggctgattcctggacgaggattttatgcacaaataagttcggaaattactagtgaatttccgggcgtgacaatcggctcaaccccaatttgttcctcaatacaaccaattcgagcctatgccacaacaacctcaaggggcacctcaacagcgaccatgggccgatttgattgcagatgtcatgaaggaacagtttgggcttaggccgaaagatgctggaaatctatatcgacagccatatcctgagtggttcgagagagttcctctacctaatcggttcaaagttccggatttttcaaagttttcagggcaagatagtacatcaacttatgagcacattagccgatttttagctcaatgcggtgaagcatcggccgtgaatgctttgagggttagattattccggttgtctttgtcttgattggcctttacttggttttcttctctaccatatggaacaatcaacagttggactgatttagaaaaacagtttcacagctacttttatagtggggttcacgagatgaaactgtccgatctgacatcgatcaagcaaaaacatgatgagccggtacatgagtacattcagagattcagagagatgaggaataagtgttacagcttaagtctgactgatgcccaattagccgatttggcttttcagggtatgattgctccaatcagggagaaattctcgtcggaagattttgaaagcttgtctcatctcacacagaaggtgatattgcatgagcaaaggtttgcagaggcaaggaggaattccaagaaaattaaccacgtctgcccttatatgtatgggtcagacaatgaagatgatgattctgaagtagctacagctgaatgggtgagaagtaaaaaggttataccatgctaatgggtaaagagctcaggaaaagaggagaggtatgactttaatatcactaaagatgacaagatttttgacttgttgctccgagagaagcaaattcaacttcctgctggtcacacaattccatcgactgaggaattaggcaagaaaaggtatttcaagtggcacaattctgggtctcatactactaatgattgcaaggtgttcaggcagcagatccaagctgctattgagggaggcaaaatcaagtttgatgactacaagaggccgatgaaaattgatggcaatccttttcctattaatatggtacatacagctggccgaacagccgataggggccgtgcaaggggttttcaggtaaattcggctaagattatcaacaaatatcagaagaagtacgacaagcagcaggagaagcattatgaagaagatgacggtggctttgatcctcattggggttgtgagttctttagattctgttggaataaaggtatgaggctaccatctattgaagactgtcctgggtgcagtggtattgccgagagctcaagccgatcatatagtagggggcaatcggttaaggcagacaagagttcctgttcaacaaagattgggtccagtgaatcaagatcatggccaagaggacaatgaaaataggaaaagtcaatggtgtccttctggtatctttacgaagaatcaaaagagaagggttcaaagattgaggaacagggagcgctttcaggaggtcgagtaggaaattaaccaacggctgaagaagacaaagtcgaggcaagagtggcgtgtcaagaatcaaattcctgtagctgatgaagccgcagccgatgaggcgaaaaggttggctaaagggaaaagtgttgtaactgctttggttaacatggttttcacattgtctgccgagtttggggtcaagcacgatgaagttgaagaagaatcggctaaattgattttgtcaccggagcaggcaatttttgagaagccagaggggacagagaatcggcatcttaaaccattgtatataaatggttatgtcaatgggaagccgatgtccaagatgatggtcgatggtggggctgcagtgaatttgatgccttatgctactttcagaaagttgggcaggaacgctgaggatctcatcaagacaaacatggtactcaaggacttcagtggcaatccatcaaagaccaagggagttttgaatgtggagctgacggtcggcaacaaaaccatccctacaacattctttgtcatcgatgggaagggttcttatagtttgttgctcggtattatcggatggcttgtcatggatcgatccaagtccccccttacaaacttgtttatggacatgaggctgttttgccatgggaagttagaatcggctcaaggagaactgagttgcaagatgatttaacagccgatgagtattataaccttatggctgatgaaagggaagacttggttcagtctaaattaagagcccttgcaaaggtactagggataaggagcgaattactcaacactataacaagaaagtggtacccaaggatttttcggaaggtgaacttgtatggaagttgattttgccgattgggacccgggatagcaaattcggcaagtggtcgccgaattgggaaggaccgttccagattcataaagtagtgtctaaaggggcttacatgctgcaaggactcaatggtgaagtttatggaagagcattgaatagcaaatacttgaagaaatattacccaagtatctgggttaatgcatgattggctgatgttgccgatacatgatagccgatgtattttcatcgtcttgagatggccgatattgttatatcgcccttagttgttttttcatattgtactcggatgtggtttgccgatatacaatggccgatattgttatattgcccttagttgtttttataattttatcaatgcttttgacattgtaaaattaggggagcatatatatatattcaaaaagacaataaagtatgagagtatcttagccgattacagcaatttctaaggcttattacacagaaagtcaaaatttctaaggcttattatacagaaagtcattgagataagtatcgctggatagccgaaatagccctttgcttatatttgttctacttcaatagcttgggcatcttgagcatcggttccagggatgactttcaaacatttggtcaaatctgtaacattcttgatagccaatttgagtttggctttttgttcttcgatagacattgggaaatcggctaactttttctgttccatatctagctcggtgttgcattcttcaagttgtgccaagagctcaatcttgcgagcttcgagccgatcaatattggatttgatcggacccttagatagttgatcaagtttggtcttctcttcatgcacaagctgccgattggcttggattgtggcctcgatatccttgcgctcccgacgttcggctagtcttagcttggccttctccagcttgaactgatgttgctcaaggtatactactggagtaaggatatcggctagctcatctgggattagagcttggatttcatgtagtcgagtcctaattggcccacagtttaccaccagactatctaatgatgatgcttccagccgatgagagatatcttcaagtgttttcttcacatcatcggataagggagctaaagctttgcttgaagtatcttcctctgcctcattaagataatctctgatgtcaaaagaaaagagatcggctaaaacctgcagacaatttcaggaagattgagagttaggtaggtacagccgatctaaattcttgcatcaaaggaaaacttactgggatagcaggagcagctggttgttattcttccacaatatgatgactccccacagccgatggagttcggtcactcgatgattgttgtacaggggaagaaggaggaggaggaggctgtaaaagagacaagtgttagacaaaatcggctggaatcaactagtagaattgagagtgtcttactagtgaagctggtttgagaattggtgctgccgatttcttctttacagcagttttcttcttctgcagctacaaagtctatgagtaatcggctgaaaagtaataattataaaaggggatgcaaagaaagcggcttactcttaagatgtgagtgggggcagaaagagttggaggtgtctgcttaggcgaagccaatggcgtttttttagtatcgcttacttcggctgcagcctgatcaacatcatcctcaatatcttcttcatccagagcttgttcaatggatggatccaaggcaggcaggtcgtcggttggcttgattttcctagacttggcctttttctttggagctagaatcaaagtgctcacagccgatgatctagtttttcttttcttggttgcatcagttggttccctgattgcgccttgaaggagggttgagaccttgggggcatgatagccaatgacagtgggagacagtccgcctccattaggaatcagacctggagcatattcaatatctctgccgctgttgctgtgatgtggagaagaagagtcgattgtctgtaaaacagaagagaaattgatcaagtaatgaatcggctgacaatcatccaaaatttaaatgacaaagtttaccttgggtacgacatcagggaatagatctgtcatgtacattgaggccgattgatgaaacaagtgcaacttccattcgccccaccatctgtcaaagtttctgcttttaaatccggccaactcaatattgttaatactacctagaggaggtccttggaggttaagcagccgatccatcattagagttgaagaaatttctcctcggcaatggatcttgtcagcaaagaataagccgattggaagttggcctaatccaagttgtcgagctgaactcatagggtgatagaattcgtaggagacttggatatttcttccttagtggatgccaacaggtaagatgcatgggctaattgcagctgtaaagacttccctggatatttgatatctttcatggttgatatcttcaaatctaaagtctgatgggagctcaaggtttgctgagtcttcataaggaaaccaaactcgggcatctttctggaagccttcataaaagctgcagaaccagtctttgagcagctcggccgatagttttgccccagattagggttgaaagatatccaagagatggccaagacttgaaagtattcttctagtgacccagattagggttggctaatctaaaggggattctgttggtttcaccgatgatgaaatcagtggggtcaagattgccgattggaccaagaaagtagtggttttcgtgtgacaggctgggaattgcgattaggttggaaaagtgctgcacatccaagggaattgggaagaagaaaacacggtgaaaagggggaaatcgatttcatacgaagaaaggggatctagccgatgagaacttacctcggcatactcggcgatggcgcgacagatgagctggcggaagatgacattgctgcgggcggagatttgatcgagaatgaaatcgcctgggagtcgcctcgagcatcgaaggagtcgccgaagaaagagaaggcaaggttggtttcagcggtgaaaacggaagtaacggggtgaagatttttcagggcggcggttagtatttaaagcgttggggataacggtcagaaaacggcagattgcgaaactcgttcggggtcgatttatagcaaatccgaaacattaccaaatgttccggacttggggggcatgtgttaacaaccaaatttggtaacgttggcatcggaaaagaagattagatcgaagtggagttgaaggcggagatcgattcgggaacagagcaggaatcggctagagtccagatcggctacgattaggatcggctgagtctgagtcggactaggtgggctgatgcagccgattccgacaatacaacttggtgtatgacatcgggttgaattgaggtgcttcgagatgattaccgcacatggatagagtcctgagaaggcaattgtatctattaattaggatattttatgtaatttccttagagatatgcttgagcaaaagtctgccgcaaagacttatggtatattagagtttgttagagataatagtcgtgtccggtttggacatatcttgtaattctcgggtataaataagaccccgagccctatgtaatttctaacacacacgttcaatacaatttcagcgcatcgccacctttttgcttttgttttatttcgacgagttattgctttcgggttgagctgcatcggtttcgatcttcaacaagaggtaaaacttgttatgacaatttgcgttctcgggattagaggttccatctttatgacactctaatcttgtttatgtaattcgtcgagttatcatatatcttacataatctctagcaatattgccatctaacccacaatcggctaacatctgttaaaagagggcaaccagttaggttaaatatcgacattggtttagattatataagatatctaccactctatgaaacttccagcggcttgattgtctagatattgttcttcttttcatacttaatgctgcatcagttgagtctgatctattaagtcgtgcttagaatatcaatctctagcctgccttctggttgccgattagggtagcatcggagtttcagccgatcttatctgatttaactatatttactctatatgcttcattgacatgttaaatctgccctttatatcaagatattgtcgcatctaagtatattaagcttttgtttgatatattatacctgttttaatatcctgatatagagtagtatcggagtattagccgatacatgctaaatccatctgatcggctatgctataaacatatatagtcctgttattaatatatattctgatctaagtgatttatactgtctcggcgtggcgaccgatctatctcaatcacttgatttaagtatatatcgatataagagttatatattggtaatatctacagcagatcgagtagatttagttctttattatctacttataatcgccaatcgattcacatatgacatcggctcaaagataaatgatatgccatcggcacatagccgatcggctatcgtttatagatttaaccgcggtgtctttgtctttatttcttgttgattgcaggatcaaatcaactggcacgctaacacacccgaaggcgagctttggacctgcactggagttaagcagatctcccaggcctcgtgtttttcatcaacacgcttttggcacgcccggtgggaccgataagaagtgaacaagccattctttctcatggccgagaaaccacctctatgaccatcctcggctagcccgggtactgtcacaccctaaaaatcctaaatatataaattgttgtttaattggaattattagaatttattttaaaagtctagaagagaagatctaattttaattaataaattccaatataaaatggggccagataaaatttcattaaatactttgcttaattctataattcctagatttttctgggatttatttgagctaaggaagtatttttaataaatggaattgcatttcaagaataatttaaattgaaaaaggtttttaaaagtctcttttggctttgggccgaaagtcggcccaaaaccttctctctctccctcggcccaagtcggcccagtccgccgctagcgcgcgcgccctcgctcgctgacaggtggggtccgcctgacagtcttcgtctacctccggccgccgccgcccgaaaccctagcgccgcgccgccgccgtctccttccaaattcggccgcccctttccttctccggtgaaatcaattgaggggaattgtttcccgagatctcctctaccttttctcttttggaatcatcgtctaaatcgctttggaaattcatggattcgagtttgattcggattcatttttcccgaagtttccttcgcgtcgccggccgccgtgggccttcaccgccgccctccaacccctatataaggacccccggtgtctcctctacccgccgccaccctcgccttcgtctctcgccgtcggaagagctctagcgccgtgtgacctagcgtcgccgtcgtcgccgtcgctccagccgtgcttcgccgtcgctccagccgtcgccgtcgctcggggaggtcgccatcgtggtcgccaagtcgtcgccgtccttgtccgccccttcgtcgtcgccgaagaccgccggagcaccatcgccgccgtcgacccgatcttctccgccgcttcgacctcgtcgccgtcgccgtccgttgatcttccgccgccgttttggtcaccggtgagttcgccacgtcgcgctctacgtcctggtgcctttcgttcgtgccgaagcatcatcgttcgccggcgagcgtgcgccgtctgagccgccgagccgtcgccggaggtgacgtcgccgctgacgtcatcggggccgttggccgtgagccgccgtagacccgatcgatctcggccgtccgttttggatggatcgatctcggccgttcgttcccgtgaaccgctgccgtgcacccggtccaccgcaaaccctagccgctgacgcaataattcccttttccttttcaaaaataattcattattgcgtcataattcaattaaaatccatataagtgttttaatccgatttaatctttaaaaattcataactaattcatcttagctcggatttagttggttcaagtctctaaatttttctaaaattgagatctacatgttaaaaatatccacatgtattgttcatgcttgtttatgtgctgttttggtgattttgctcttttctgcttagattccgatgtttccggagagtctgttttcgcaggagaagaatttgaagagttccaaggccagcaaggcaagtcacacagatcccaaacaaccctttgagcatgttgatcccgattaaagctattgtttctattcaactattgcatttattttcgaatgtcatttggtggaattaacctattgtttgttatagcccttttgttcttgattactttattccttgataccttgggttattataacttgactagttgggctttatatattggttcagctagatattagatatgaatgcttagccatgcttagaaacattagcacactattgggataacttatgattcactattaattatttaatgaggacttaatgatagttcacgatggtcaatcgtgattggttaattaattacttgccaattaaaacctgataatggtgggttgtgagcacatggttttgagagtcgtgctcatgacaattaaggaccggttcacgagtttcggttgtgaaacattaaccgtgccaaccacaagccagcgtgggcaacggctttaccttttgtgtagcatggtttattgcggggcaccagactgagaagtggcggagataagcccacaggggtcactggggagtccatgccttgtttatagggggtgattatgatccaggaatggtgcgctgcggtggattgtgttatgcaaggggtattgtcacagctcctttccgaggtaccgtggtggtattaaggcacatggtgacatgatgtggggctatgtcttgtgggtacagtggtacacctctgatcagagtaaaactattcgaatagccgtacccgcggttatgggcgggtctaacaatgtctttcgtgatgagtctcacatctctcatcataataaaagatgcaataactggtaataatttgtttagctcctggtttggaatggtatattcctggtttggagatagatctgtacagccgggtatggttgttcagaatggttaggcctatacaacagggtatgttgtatagcgttggattaatattgtttaaatattacttaactgttttattaaattctcaaatgtttgctaaatgctgtttatgcaaatggaaccctattatgccatcctttgttatcctgtgcacttgcatatttgctgcgtggcttgctgagtatgtcatatactcaccttgcaatcgttcatcagaggaagagttctacaatgatgctgatggtgtggaggattaggtgtagccctggtcaagctgcctgtggagtggagtcgtctgcgccgtttatcttattttccgctgcttagatctttattgattgagaggaactatctacctctgtaatgacattttattcgcttattaattagagtaataattgtactctattatcaatttgttattgtgtgcctcggctgattcctggacgagggttcacacacatagaaattccgggcgtgacaggtactgtcaaggaaacaatccagaagttaggttttactgacgtcaatgaaggaaacgtcatgcctatcgatccagaaaagttcacacctgatcaaaagaaagattttgatgcggtgatgcagcaagcacgggatcagttcttgaactcgttcatgcagacccgaaagggaacacttgttcagaagtataaactaaaagtgtttcctgatgaccccaggactagttcttccaatgatggagaagggaaacaagctccagatggcttggctcaaccgagtgacaagaatgccacagagggttttttagcaaatcaaggtgacaacttgccaggagtgcacggggttcaaggtgatgggtctcagggtgttcaaggtggaggtgttaatcaagacagtaatacagcacagttgcagtttaacaactttcaagatcaggttgactatgatgtacaccatgctttgatcaaccaatctgggatattaactaacattttggcaaatatggtgaagtcaatggttgatggttcaatggccgagtatcaagctacaggaccagtatacctaccaggaggagtgttccccaattatcagccattaatcactaataatcaaccagttgtccagtcaattcctctcaatgcaccatcggctcagccgacggcaccagcatcgactccagcacctgctgcgccaccttcggctccaggacaattagttaatccccagttgttggtaagagaacaaccacaacacgctggacagaatgtgaatcggctaacgcaagaccaggttgcatctatgttcttgcaccctcaacacactattgatccaacccagcagcagccgattcaacacaccccgtcaaggcaacaagttgtgcaaccaattcaacaaacgcccccggtccaacaggttgtgcaaccagttcaacagacaccaccaagacagcagatcttgcagccgattcagcagacgccactaaggcaacaggtcgttcagccgattcagcagcaaggtccgatgaatgcatcggctgggtctgcaatacctggtggtcagcccgtgcagcatgttgcaaatcaggttgttctagaacacttggttcatcacgtacaaccagatggcacagtaattcctcaagttattcctgagcatttggtgcgcaatattcaaccagatatccaaaattaccaggggggtaatttgaattatcaatatcagccaccatcacctcatattcagaaccagcaagcaggatcggtgtcacatcctgattttcgtttcaggatttataaattatttaataaattaataatagaatttatattaaatgttcattaatttacaagtgaagttaaatgtgggaaataaaatttcctaaatataaagcatggatggatttaatttttattaaattctccatggttaattatactctctggaatattctcggatttttcggagctcaattcctaatttttaatcttacaaagagcatttcagtaattaaccacatattaaattaatcattaaatggtctaattgtaattttattaagtactttgagtgtccaagtattttcaggatttttcttgaaattatttgagcattggaagtatttttaataattcaaagatcatttaagtgattattttaattgggaaagtaataaaatcctcctcctcagcttgggccattttcggcccattccttcctttccttcctctctcttccgccggcccaacctgagccgcctcctctcctctcagctcagccggaaaagtctactttccctccctgcgctactgttcatcttccaactcaggcagagcccgagccagccgtgccgtgcacagtgccgccgcctcttccttccaaatctcgcctccccgttgctctttttctccaatttagttgaggggaaatattcctcttatcctcctctatctttacccccaaaaatcggagcaaatcgttgagtatcttatccgaatcaaactcgttttcgagtttatctccaaaaccgagtttttgatttcccggatcgatttcttgcgggaggagtccgatctcttcaatccaaggctataaataggaccccctagtcctcctctttcgtttgccccctctcccgtcctcttccgtgctccgtagctccgtcgccaccgccgccaagcaaaccgccgccgccggccatctccggtgccgccgcgccgccgtctccatcgtcgtcgccggtcgccgtcaccaccgttgggtgcgccgtggtgaggggaagctcggccacccttccttttccgtcgccggtcatcggagctccgccgccccgtgcaacccgagccgccgccgtcgcctcctcgtcgccggccgtcgtcggtcgtcgtttggcacgagggtgagtatcgttgggttcgtctcgtcgtcctctacgtgttcatgtcctccaaatccgcagccggtcgctctatatccggcgaggtcgccatcttggtccggccattgatgatgtcatcatcgtttttctttttccagttttttctaatagattaaatcttcggaaattcataactaaatcatcgtaactcggttttgagtggttcaagttgctaaattcatctaaaatcatgatctacatgtttgtttactttatatgtactgtttatttggtttttattagtctttttcttcgttttgcgtgttagcttgtcgtttccgtcgttgcgaaggttcgtgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacctattcctttgttatggccagtttgcattgattaccctattccttgataccttgggttattataacttgactagttgggctttatatattggttcagctagatattagttatgattgcttagccatgcttagaaacattagcacactattggaataacttatgactcactattatttaaggatggcttaatgatagttcacgatggtcaatcgtgattggttaattaattacttgccaactaaaacttgataatggtgggttgtgagcacatggttttgagagtcgtgctcatgacaattaaggaccggttcgcgagctactgttgtgaaacatttatcgtgccaaccacaagccagcgtgggcaacggctttatcttttgtatagcgtgattcattatagtgcgccagactgagaagtggcgagaagtccacgggggtcgctggggagtccatgcctctggtttttgagggggtgattatgatccaggaaaggtgcgctgtaatggattatgttgtgcaaggggtattgtcacaactcctttccgaggtaccgtggtggtattgaggcacatggtgacatgatgtggggttgtgtcttgtgggtacagtggtacacctctggccagagtaaaactattcgaatagccgtgcccgcggttatgggcgggttgagcaatgtttttcgtgattagtctcacacctctcacaatagttatggatgttataactggtaataatttgcttagctcctggtttggagttagatctgtacagccgggtatggttgttcaggatggttgggcctgtgcagcatgggtgtgctgttcagtgttgattaaaatttttaattaattactctactgttttactactcttaactatttgctaaatgctgctttcgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagctgaagccatcgctagaccgttaattccgctgctgttttcttttcttttgtaagtgtgtaacgttattattatgatggatttgtatattaaattgtcagtttgtgtacctcggctgattcctggacgaggattttatgcacaaataagttcggaaattactagtgaatttccgggcgtgacaatcggctcaaccccaatttgttcctcaatacaaccaattcgagcctatgccacaacaacctcaaggggcacctcaacagcgaccatgggccgatttgattgcagatgtcatgaaggaacagtttgggcttaggccgaaagatgctggaaatctatatcgacagccatatcctgagtggttcgagagagttcctctacctaatcggttcaaagttccggatttttcaaagttttcagggcaagatagtacatcaacttatgagcacattagccgatttttagctcaatgcggtgaagcatcggccgtgaatgctttgagggttagattattccggttgtctttgtcttgattggcctttacttggttttcttctctaccatatggaacaatcaacagttggactgatttagaaaaacagtttcacagctacttttatagtggggttcacgagatgaaactgtccgatctgacatcgatcaagcaaaaacatgatgagccggtacatgagtacattcagagattcagagagatgaggaataagtgttacagcttaagtctgactgatgcccaattagccgatttggcttttcagggtatgattgctccaatcagggagaaattctcgtcggaagattttgaaagcttgtctcatctcacacagaaggtgatattgcatgagcaaaggtttgcagaggcgaggaggaattccaagaaaattaaccacgtctgcccttatatgtatgggtcagacaatgaagatgatgattctgaagtagctacagctgaatgggtgagaagtaaaaaggttataccatgctaatgggtaaagagctcaggaaaagaggagaggtatgactttaatatcactaaagatgacaagatttttgacttgttgctccgagagaagcaaattcaacttcctgctggtcacacaattccatcgactgaggaattaggcaagaaaaggtatttcaagtggcacaattctgggtctcatactactaatgattgcaaggtgttcaggcagcagatccaagctgctattgagggaggcaaaatcaagtttgatgactacaagaggccgatgaaaattgatggcaatccttttcctattaatatggtacatacagctggccgaacagccgataggggccgtgcaaggggttttcaggtaaattcggctaagattatcaacaaatatcagaagaagtacgacaagcagcaggagaagcattatgaagaagatgacggtggctttgatcctcattggggttgtgagttctttagattctgttggaataaaggtatgaggctaccatctattgaagactgtcctgggtgcagtggtattgccgagagctcaagccgatcatatagtaggggcaatcggttaaggcagacaagagttcctgttcaacaaagattgggtccagtgaatcaagatcatggccaagaggacaatgaaaataggaaaagtcaatggtgtccttctggtatctttacgaagaatcaaaagagaagggttcaaagattgaggaacagggagcgctttcaggaggtcgagtaggaaattaaccaacggctgaagaagacaaagtcgaggcaagagtggcgtgtcaagaatcaaattcctgtagctgatgaagccgcagccgatgaggcgaaaaggttggctaaagggaaaagtgttgtaactgctttggttaacatggttttcacattgtctgccgagtttggggtcaagcacgatgaagttgaagaagaatcgggctaaattgattttgtcaccggagcaggcaatttttgagaagccagaggggacagagaatcggcatcttaaaccattgtatataaatggttatgtcaatgggaagccgatgtccaagatgatggtcgatggtggggctgcagtgaatttgatgccttatgctactttcagaaagttgggcaggaacgctgaggatctcatcaagacaaacatggtactcaaggacttcagtggcaatccatcaaagaccaagggagttttgaatgtggagctgacggtcggcaacaaaaccatccctacaacattctttgtcatcgatgggaagggttcttatagtttgttgctcggtattatcggatggcttgtcatggatcgatccaagtccccccttacaacttgtttatggacatgaggctgttttgccatgggaagttagaatcggctcaaggagaactgagttgcaagatgatttaacagccgatgagtattataaccttatggctgatgaaagggaagacttggttcagtctaaattaagagcccttgcaaaggttactagggataaggagcgaattactcaacactataacaagaaagtggtacccaaggatttttcggaaggtgaacttgtatggaagttgattttgccgattgggacccgggatagcaaattcggcaagtggtcgccgaattgggaaggaccgttccagattcataaagtagtgtctaaaggggcttacatgctgcaaggactcaatggtgaagtttatggaagagcattgaatagcaaatacttgaagaaatattacccaagtatctgggttaatgcatgattggctgatgttgccgatacatgatagccgatgtattttcatcgtcttgagatggccgatattgttatatcgcccttagttgttttttcatattgtactcggatgtggtttgccgatatacaatggccgatattgttatattgcccttagttgtttttataattttatcaatgcttttgacattgtaaaattaggggagcatatatatatattcaaaaagacaataaagtatgagagtatcttagccgattacagcaatttctaaggcttattacacagaaagtcaaaatttctaaggcttattatacagaaagtcattgagataagtatcgctggatagccgaaatagccctttgcttatatttgttctacttcaatagcttgggcatcttgagcatcggttccagggatgactttcaaacatttggtcaaatctgtaacattcttgatagccaatttgagtttggctttttgttcttcgatagacattgggaaatcggctaactttttctgttccatatctagctcggtgttgcattcttcaagttgtgccaagagctcaatcttgcgagcttcgagccgatcaatattggatttgatcggacccttagatagttgatcaagtttggtcttctcttcatgcacaagctgccgattggcttggattgtggcctcgatatccttgcgctcccgacgttcggctagtcttagcttggccttctccagcttgaactgatgttgctcaaggtatactactggagtaaggatatcggctagctcatctgggattagagcttggatttcatgtagtcgagtcctaattggcccacagtttaccaccagactatctaatgatgatgcttccagccgatgagagatatcttcaagtgttttcttcacatcatcggataagggagctaaagctttgcttgaagtatcttcctctgcctcattaagataatctctgatgtcaaaagaaaagagatcggctaaaacctgcagacaatttcaggaagattgagagttaggtaggtacagccgatctaaattcttgcatcaaaggaaaacttactgggatagcaggagcagctggttgttattcttccacaatatgatgactccccacagccgatggagttcggtcactcgatgattgttgtacaggggaagaaggaggaggaggaggctgtaaaagagacaagtgttagacaaaatcggctggaatcaactagtagaattgagagtgtcttactagtgaagctggtttgagaattggtgctgccgatttcttctttacagcagttttcttcttctgcagctacaaagtctatgagtaatcggctgaaaagtaataattataaaaggggatgcaaagaaagcggcttactcttaagatgtgagtgggggcagaaagagttggaggtgtctgcttaggcgaagccaatggcgtttttttagtatcgcttacttcggctgcagcctgatcaacatcatcctcaatatcttcttcatccagagcttgttcaatggatggatccaaggcaggcaggtcgtcggttggcttgattttcctagacttggcctttttctttggagctagaatcaaagtgctcacagccgatgatctagtttttcttttcttggttgcatcagttggttccctgattgcgccttgaaggagggttgagaccttgggggcatgatagccaatgacagtgggagacagtccgcctccattaggaatcagacctggagcatattcaatatctctgccgctgttgctctgatgtggaggagaagagtcgattgtctgtaaaacagaagaaaaattgatcaagtaatgaatcggctgacaatcatccaaaatttaaatgacaaagtttaccttgggtacgacatcagggaatagatctgtcatgtacattgaggccgattgatgaaacaagtgcaacttccattcgccccaccatctgtcaaagtttctgcttttaaatccggccaactcaatattgttaatactacctagaggaggtccttggaggttaagcagccgatccatcattagagttgaagaaatttctcctcggcaatggatcttgtcagcaaagaataagccgattggaagttggcctaatccaagttgtcgagctgaactcatagggtgatagaattcgtaggagacttggatatttcttccttagtggatgccaacaggtaagatgcatgggctaattgcagctgtaaagacttccctggatatttgatatctttcatggttgatatcttcaaatctaaagtctgatgggagctcaaggtttgctgagtcttcataaggaaaccaaactcgggcatctttctggaagccttcataaaagctgcagaaccagtctttgagcagctcggccgatagttttgccccagattagggttgaaagatatccaagagatggccaagacttgaaagtattcttctagtgacccagattagggttggctaatctaaaggggattctgttggtttcaccgatgatgaaatcagtggggtcaagattgccgattggaccaagaaagtagtggttttcgtgtgacaggctgggaattgcgattaggttggaaaagtgctgcacatccaagggaattgggaagaagaaaacacggtgaaaagggggaaatcgatttcatacgaagaaaggggatctagccgatgagaacttacctcggcatactcggccgatggcgcgacagatgagctggcggaagatgacattgctgcgggcggagatttgatcgagaatgaaatcgcctgggagtcgcctcgagcatcgaaggagtcgccgaagaaagagaaggcaaggttggtttcagcggtgaaaacggaagtaacggggtgaagatttttcagggcggcggttagtatttaaagcgttggggataacggtcagaaaacggcagattgcgaaactcgttcggggtcgatttatagcaaatccgaaacattaccaaatgttccggacttggggggcatgtgttaacaaccaaatttggtaacgttggcatcggaaaagaagattagatcgaagtggagttgaaggcggagatcgattcgggaacagagcaggaatcggctagagtccagatcgactacgattaggatcggctgagtctgagtcggactaggtgggctgatgcagccgattccgacaatacaacttggtgtatgacatcgggttgaattgaggtgcttcgagatgattaccgcacatggatagagtcctgagaaggcaattgtatctattaattaggatattttatgtaatttccttagagatatgcttgggcaaaagtctgccgcaaagacttatggtatattagagtttgttagagataatagtcgtgtccggtttggacatatcttgtaattctcgggtataaataagaccccgagccctatgtaatttctaacacacacgttcaatacaatttcggcgcatcgccacctttttgcttttgttttatttcgacgagttattgctttcgggttgagctgcatcggtttcgatcttcaacaagaggtaaaacttgttatgacggtttgcattctcgggattagtgcttccatctttatgacactctaatcttgtttacgtaattcgtcgagttatcatatatcttacataatctctagcaatattgccatctaacccacaatcggctaacatctgttaaaagagggcagccggttaggttaaatatcgatattggtttagattatataagatatataccactctatgaaatgtccagcggcttgattgtctagatattgttcttcttttcatacttaatgctgcatcagttgagtttgatctattaagtcgtgcttagaatatcaatctgtagcgcccgttccgtcgtggcgcctagcgggaaaattatctcttaaaaaccctaattgcgaaatttgtttctttgcttgttgtctagtgcccgtgccatctcaagatctcaaatccccgatctatcgtcgagttcaatcccgaatccaaatccttccaaatcaaattcctccgcaaagtctattttgcctcccccggggtcgatgggccgaatttctctcggcccatctccccctcttccccggccctctccccccggcgtgctccctctctccctctccccctccgctccgcccgcgcgctgcgcgcgcgagcgcgtgagccgccgcgccgagcgcctccctccccctccgctctgcccgcgcgcgagcgcgtgagccgcccgcgccgagccgagccctcctttccgctccctcgctgccgctccccgcgcgtcgttcgcgcgcgcgcccgcgtggtcgtcgcccgcgtcgcgactgcgccgcccggccccgctgccctgccgcgcctgcagccgctcggccccgcagccagcgcgcgtgcccgagccgcaccactccatccgccgcgcctcgtgttgcaagccgcgcgcgcgtgccgagtggccaaccgcctggtagccgccgtcgtcagcgcctgcccgccgtcgtcagcgcctgcccgcgcctatcgcccgtgtcgccgctccgctccacaccgccctgccgtcatcgccgtcgtcatcgcctcggccccgccaccccgcgtgcaagccgccaagggacggaggcagagccctcctccctctgccgtgacacccccactcccctcctccttttcccaaagaagaaaggggcgagccccccttcccatccctccttttccccttttcctcccgccggcgtcatcctccctccgccctgtcgccgattggacgcgagcgccgagcgccagctcgcgccttgaccgcccaagtcggttccaaaccgacattgccgcccttaaagcccaggcaccctccctctcttctccttccatcgccattgttgccgccgccttccgagctctgtctcgcctccgccgttcatcgccaagcgccgggagagcctgtgcgtttgtggacgcggaaggggactccgggcgctcgtctttctcctcttccccggcccgaggccggagagattactcccgcgccgtcggcctctcgtcacagcgcccctcctcatctcggtagtgcctccctccgttcttcctcctcgctccatctctcccccttagttttcagtagtagctcgagtagcctccccgtaactagccggcgccgccccgaccgttgccgtcgctcgccgtgtgctcgccgccatcgccgcccgagctccgtagcaccgctcgtcgccggcctcgctcggcgtagctccgcccaatccgatgctaacaacggattcccgtggccgcatagatgctctcaccgccgggaattggcccctcgtgacctcgtcgccgtttccccctttgccttccgccggttgccgctgccaaaatccgcc

SEQ ID NO: 57906 - DNA, 10799 bp, Oryza sativa
acgcatataccatcgggagtggtgtctctcaaaaagagggaattcaggtcgctcactcaggggtctcgctctgttacggagtatctgcacgagttcaatcgtctggctcattatgctccggaagaggtacgcactgatgaagagcgctaggagaagttcttggaaggacttaatgatgagctttcttatccacttatgactggagattgtcctgatttccagaagttagtggataaggctattcgccaggaggacaagtacaaccgcatggagcaaaagaaacgccggattgctcaattcaagacacaacaggggaataatcaaaagccgcgtcttactttaggaccccagtccatgccacagggaggttcttcgtctgttgttcgtccgcagcgtcagttcttcaacaacaatgccggcaacaacatccgtaatcaagctccatgccctgttgcagcctcgacacagcaacaacctgccaagagggagcaaggcagcaagcccgtggtgtgtttcaactgtggagacccaggacattacgctgacaagtgtccgaagccccgacgtgtgaaggttgtccctacccagggcaactctaccgcaccagcatcaaaggcccgtgtcaatcatgttgctgctgcagaagctcaagatgctccagatgtgattttgggtacgtttcttgttaacttagttcctgcaacagtgcttttcgattctggtgctacacattcattcttatctatgagttttgcgggaaatcatgggatggaagtagaagatcttagacgtcctatgatggttagtaccccaagtaatcaggcactctctttgcaacgtagcccctctgtcagaatagaaattcaaggcgtaccatttctggccaatcttatcctattagaatccaaagaccttgatgtcatcctaggaatggactggttagccagatataaaggtgtgatagactgtgctaacagaaaagtaactctcaccagcaatgatggtcgagttgtaactgtttatgcattgtcttctgagtctttaaggtcaagactaaaccaaataactttggaagagattcctatagtccgggagtatcctgatgtgttcccagatgatttacctggtatgcctcctaaaagggatatagagttcagaatagatttggtaccaggaacaactccaatccataagagaccttatagaatggcagccaatgagttggcagaagtcaagaggcaagtggacgatttgcttcggaaagggtacatcagaccgagttcatctccatggggagctccagttatctttgtggaaaagaaagatcatacccaaaggatgtgtgtggactatcgtgcactaaatgatgtgactatcaagaataagtacccgctacccagaattgatgatttgtttgatcagcttaaaggtgccactattttctccaagatagatcttcgatcagggtatcactagttgagaatcaaagaggaagatatacctaaaacagcttttaccactaggtatgggttgtttgaatgtactgttatgtcttttggacttaccaatgcccccgctttcttcatgaacttgatgaataaggtgtttatggaatacctagacaagttcgtggtggtctttattgatgacattcttatctactcctgaaccaaagaagagcatgaacaacatcttcgccttgcactggagaagctgcgagaacatcaactgtatgctaagtttagcaagtgtgaattttggttgtccgaagtgaagttccttggtcacgtcatctcagcaggaggagttgccgtcgatcctagtaatgtggaatccgtaaccaattggaaacaaccaaagacagtttcagagattcgcaattttctaggcctcgcaggatattatcggaggtttataaagaatttttccaagattgctaagcccatgacacgattacttcagaaagatgtaaagtacaagtggtcagaagaatgtgagcagagttttcaagagttgaagaatcgcttaatatcagctcctattttgattttacctgatccaaagaagggattccaagtgtattgcgatgcatccaaatttgggttaggttgtgttctgatgcaagatgagaaggtggttgcctatgcatctcgtcagttacgtccgcatgagaagaactaccctactcatgatcttgagttagctgcagtagttcatgcgttgaaaatttggcgtcattatcttttcggtactcgtacagaggtgtataccgatcacaagagtttaaaatatatctttactcagccggatctgaacatgagacaacggagatggttggaattaattaaggattatgacatgggaattcattatcacccgggaaaggctaatgttgtagcagatgctcttagcaggaaaggctattgcaatgctacggaaggacgacagttgccattggaattatgcaaggaatttgaaagattgaatttgggaattgtcagtagaggtttcgttgcagctttagaagcgaagcccactctaattgatcaagttagagaagcccaaattaatgatcctgatattcaagagatcaagaagaatatgaggagagggaaagctatcggtttcttgaaagatgagcaaggaactgtatggttgggcgagagaatctgtgtccccgacaacaaagatttaaaagatgcaattctaaaggaagcccatgataccttatactccattcaccctggtagtactaagatgtaccaggatctcaatgaaggattttggtgggcaagtatgaagcgtgaaatcgcagagtacgtagcagtatgtgatgtttgtcagcgagtcaaggcagaacatcagaaacccgccggtttgttgcagcctttgaagattcctgaatggaaatgggaggaaattggtatggatttcatcactggtctacccagaacgtcatcaggccatgactctatttgggtgatagtcgacagacttaccaaagtggctcatttcattccggtaaagacaacctattccggaagtcggttggcggaattgtatatggcaagaattgtgtgtttgcatggcgtccctaagaaaatagtgtctgattgaggcagtcagtttacttcaaatttttggaagaagcttcaggaagagatgggttctaagctgaactttagtactgcttatcatccgcagacagacggacaaaccgaaagggtgaatcagattttggaagacatgttgagagcttgtgctttagacttcggtggaagttgggataagaatctaccttatgcagaattttcgtacaacaacagttatcaagctagtcttcagatggctccgtacgaagcactgtatggtcggaagtgccgcactccgcttttgtgggatcaaacgggagaacgtcaggttttcgggacggatatcctgagggaagcagaagaaaaggtgaaaatcattcaagaaaggttgcgtgtggcccagtctcgtcataagagttatgccgacaatcgtcgtagagatctaagttttggcgaaggagattatgtgtatcttcgtatcacgccttttcgaggagttcatcgttttcacaccaaagaaaaattggcaccgcgttttgtgggaccttataagattgtcaatagaagaggagaggttgcttatcagttggagttacctcaatctttggcaggagtccataatgtgttccatgtttcgcaattgaaaaagtgtttaagggtacctaccgaggaaactaatcttgaacagatagaagtccaagaggatctgacctatattgagaaaccaatccgtattttggaaatagatgagagaagaaccagaaatcgagttatccgtttttgcaatgttcaatggagtaatcactcggaagaagaatcaacttgggaacgagaagatgaattgaagtcagctcatccgcatctgttcgccagttcttccgaatctcgaggacgagattctgtttaaggggggtaggtttgtcacaccctaaaaatcctaaatatataaattgttgtttaattggaattattagaatttattttaaaagtctagaagagaagatctaattttaattaataaattccaatataaaatggggccagataaaatttcattaaatactttgcttaattctataattcctagatttttctgggatttatttgagctaaggaagtatttttaataaatggaattgcatttcaagaataatttaaattgaaaaaggtttttaaaagtctcttttggctttgggccgaaagtcggcccaaaaccttctctctctccctcggcccaagtcggcccagtccgccgctagcgcgtgccctcgctcgctgacaggtggggtccgcctgacagtcttcgtctacctccggccgccgccgcccgaaaccctagcgccgcgccgccgccgtctccttccaaattcggccgcccctttccttctccggtgaaatcaattgaggggaattgtttcccgagatctcctctaccttttctcttttggaatcatcgtctaaatcgctttggaaattcatggattcgagtttgattcggattcatttttcccgaagtttccttcgcgtcgccggccgccgtgggccttcgccgccgccctccaacccctatataaggacccccggtgtctcctctacccgccgccaccctcgccttcgtctctcgccgtcggaagagctctagcgccgtgtgacctagcgtcgccgtcgtcgccgtcgctccagccgtgcttcgtcgtcgctccagccgtcgccgtcgctcggggaggtcgccatcgtggtcgccaagtcgtcgccgtccttgtccgccccttcgtcgtcgccgaagaccgccggagcaccgtcgccgccgtcgacccgatcttctccgccgcttcgacctcgtcgccgtcgccgtccgttgatcttccgccgccgttttggtcaccagtgagttcgtcgcgtcgcgctctacgtcctggtgcctttcgttcgtgccgaagcatcatcgttcgccagcgagcgtgcgccgtccgagccgccgagccgcctccggaggtgacgtcgccgctgacgtcatcggggccgtttgccgtgagccgccgtagacccgatcgatctcggccgtccgttttggatggatcgatctcggccgttcgttcccgtgaaccgctgccgtgcacccggtccaccgcaaaccctagccgctgacgcaataattcccttttccttttcaaaaataattcattattgcgtcataattcaattaaaatccatataagtgttttaatccgatttaatctttaaaaattcataactaattcatcttagctcggatttagttggttcaagtctctaaatttttctaaaattgagatctacatgttaaaaatatccacatgtattgttcatgcttgtttatgtgctgttttggtgattttgctcttttctgcttagattccgatgtttccggagagtctgttttcgcaggagaagaatttgaagagttccaaggccagcaaggcaagtcacacagatcccaaacaaccctttgagcatgttgatcccgattaaagctattgtttctattcaactattgcatttattttcgaatgtcattgggtggaattaacctattgtttgttatagcccttttgttcttgattactttattccttgataccttgggttattataacttgactagttgagctttatatattggttcagctagatattagatatgaatgcttagccatgcttagaaacattagcacactattgggataacttatgattcactattaattatttaataaggacttaatgatagttcacgatggtcaatcgtgattggttaattaattacttgccaattaaaacctgataatggtgggttgtgagcacatggttttgagagtcgtgctcatgacaattaaggaccggttcacgagtttcggttgtgaaacattaaccgtgccaaccacaagccagcgtgggcaacggctttaccttttgtatagcatggtttatggcggggcaccagactgagaagtggcggagataagcccacaggggtcactggggagtccatgccttgtttataagggggtgattatgatccaggaatggtgcgctgcggtggattgtgttatgcaaggggtattgtcacagctcctttccgaggtaccgtggtggtattaaggcacatggtgacatgatgtggggctatgtcttgtgggtacagtggtacacctctgatcagagtaaaactattcgaatagccgtacccgcggttatgggcgggtctaacaatgtctttcgtgatgagtctcacatctctcatcataataaaagatgcaataactggtaataatttgtttagctcctggtttggaatggtatattcctggtttggagatagatctgtacagccgggtatggttgttcagaatggttgggcctatacaacagggtatgttgtatagcgttggattaatattgtttaaacattacttaactgttttattaaattctcaaatgtttgctaaatgctgtttatgcaaatggaaccctattatgccatcctttgttatcctgtgcacttgcatatttgctgcgtggcttgctgagtatgtcatatactcaccttgcaatcgttcatcagaggaagagttctacaatgatgctgatggtgtggaggattaggtgtagccctggtcaagctgcctgtggagtggagtcgtctgcgccgtttatcttattttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaagttggtatcagagcctccttgaccctaggttatgccaaatggttacccatagaagccctctaaaaatattggaaaagtagaactgttctcctccccttctcttttaattaaaccaaaataatggcacatgcacttcataatctcttttagtggttctcattcaaaatttattccagtgttattagtactgtacatctattattgtactaatggctcatttaccagcaaaagttctacaacattgttttatttaatcttgctgcaaggaaataaatttagcatgttgattttatgactttcttttatttcttttgaaacctgttattcaaaagcacaaaatttgtggccttgtttccaactgtttcaaattatcctgcaagtttggtttactttttttttctaactttattcaaattaatccaaaaacttgtgctattgattggataaatgtcttaactccctcctttcacttgtctttagatgccgcgctacaagcctgagtacttgtttggtgttgagggatttgtccaggagttgcgtacgatgtccattgccataggatttgggactgcccctttttatgcccagattcctcatgatcgtcatgaagagaagtgccgggtcaaagtcaccttaaacagtaatagcgaagatatcccctcagtgatgttcgaagctggaggaaaaaactacatccatgcatgtcagaaggtggcaaggatcgccataggagagctgcgcgatcgctacagtgatcagttggccgacaccgagtatcgctaccatcctcgccaaccacagggaagtgaccgtggcagctaccttgagactgaaggaattgagaatgatgctaccacatagcatttggttgagatgctgtgggctatggatgaaacccgtgcagagactgtgttagcagctcaagatcgtgaagatcggaatcgtggtaagatttgcaagctagaggacaaagtggatcatttggagaaggaactagccgccttgaagggagaagcaccaccgcagaaggccaggattcgtcttaccgcaaggaagagagctctatttgtccctcgctatcaattggcgccaaaggttcgtgtggtggaaaaagaagttaccccagccctagcagatcctccggtcgtcaacgtaagtgatgatgaagtagaagaatccaagcgcacccattccaaaatcgagtggggagccactcaagatgatgaagatgagccgaacgagccttcaatcaactccgatgcccggaagacctagagtgccttgtcaaaccgttgtcttagatcgttgtgttagtttgcttgttttaagtttggttgtgtgtgtctcgcatgtgattacatcagtggtgggatgtaagtgcatgcgttggtttgctttcgagtgttaggtagttggtgagtttagtggtgtgagagtcttcagtttgtaataatgaaactcacttaagatcaataaaagttaaattaattctctgtcctaagtagttttccccggtttctcttcttgtgctcctgttcatgccagatggtgctcactcgcagcaacgggaatggccccaacaacaacaacaataacaataacaacaacaatggagagaatcccacacttgcccaagtcctggctcaacaggcacagcttatgaacatgatgatgcagcaactccagaaccagcagaaccagggaaataaccatgcacctccccagaacaagttagccgaatttcttcgtgtgaggccgcccattttctccagtaccactaatcctgttgaagctggtgattggctgcatgtcatagagaagaagttggatttgcttcagtgcactgatcaggagaaggtctcatttgcatcacaccagttgcatggccctgcctctgaatggtgggatcacttccgcctgcatcggactactgctgaacctatcacttggcttgaattcaccgctgctttccggaagacgcatataccatcgggagtggtgtctctcaaaaagagggaattcaggtcgctcactcaggggtctcgctctgttacggagtatctgcacgagttcaatcgtctggctcattatgctccggaagaggtacgcactgatgaagagcgctaggagaagttcttggaaggacttaatgatgagctttcttatccacttatgactggagattgtcctgatttccagaagttagtggataaggctattcgccaggaggacaagtacaaccgcatggagcaaaagaaacgccggattgctcaattcaagacacaacaggggaataatcaaaagccgcgtcttactttaggaccccagtccatgccacagggaggttcttcgtctgttgttcgtccgcagcgtcagttcttcaacaacaatgccggcaacaacatccgtaatcaagctccatgccctgttgcagcctcgacacagcaacaacctgccaagagggagcaaggcagcaagcccgtggtgtgtttcaactgtggagacccaggacattacgctgacaagtgtccgaagccccgacgtgtgaaggttgtccctacccagggcaactctaccgcaccagcatcaaaggcccgtgtcaatcatgttgctgctgcagaagctcaagatgctccagatgtgattttgggtacgtttcttgttaacttagttcctgcaacagtgcttttcgattctggtgctacacattcattcttatctatgagttttgcgggaaatcatgggatggaagtagaagatcttagacgtcctatgatggttagtaccccaagtaatcaggcactctctttgcaacgtagcccctctgtcagaatagaaattcaaggcgtaccatttctggccaatcttatcctattagaatccaaagaccttgatgtcatcctagggatggactggttagccagatataaaggtgtgatagactgtgctaacagaaaagtaactctcaccagcaatgatggtcgagttgtaactgtttatgcattgtcttctgagtcttaaggtcaagactaaaccaaataactttggaagagattcctatagtccgggagttcctatgtgttcccagatgatttacctggtatgcctcctaaaagggatatagagttcagaatagatttggtaccaggaacaactccaatccataagagaccttatagaatggcagccaatgagttggcagaagtcaagaggcaagtggacgatttgcttcggaaagggtacatcagaccgagttcatctccatggggagctccagttatctttgtggaaaagaaagatcatacccaaaggatgtgtgtggactatcgtgcactaaatgatgtgactatcaagaataagtacccgctacccagaattgatgatttgtttgatcagcttaaaggtgccactattttctccaagatagatcttcgatcagggtatcactagttgagaatcaaagaggaagatatacctaaaacagcttttaccactaggtatgggttgtttgaatgtactgttatgtcttttggacttaccaatgcccccgctttcttcatgaacttgatgaataaggtgtttatggaatacctagacaagttcgtggtggtctttattgatgacattcttatctactcctgaaccaaagaagagcatgaacaacatcttcgccttgcactggagaagctgcgagaacatcaactgtatgctaagtttagcaagtgtgaattttggttgtccgaagtgaagttccttggtcacgtcatctcagcaggaggagttgccgtcgatcctagtaatgtggaatccgta

SEQ ID NO: 57907 - DNA, 10987 bp, Oryza sativa
tcgccattgttgccgccgccttccgagctctgtctcgcctccgccgttcatcgccaagcgccgggagagcctgtgcgtttgtggaccccgaaggggactccgggcgctcgtctttctcctcttccccggcccgaggccggagagattactcccgcgccgtcggcctcttgtcacagcgcccctcctcatctcggtagtgcctcccttcgtttttcctcctcgctccatctctcccccttagttttcagtagtagctcgagtagcctccccgtaactagccggcgccgtcccgaccgttgccgtcgctcgccgtgtgctcgccgccatcgccgcccgagctccgtagcacccgctcgtcgccggcctcgctcggcgtagctccgcccaatccgatgctaacaacggattcccgtggccgcatagatgctctcaccgccgggaattggcccctcgtgacctcgtcgccgtttccccctttgccttccgccggttgccgctgccaaaatccgccaccgacggactccctccggcgaatccgagccgttggctcgctccctctccttcttcctcgtcatcccggtgtacgccccgtcgcccctcatcgtcgcaaggcgccccggagaaaccgccaccgcccgccgtccattcgcggccggcgccttcgtcttcctcccgccagcccgcgtggcagccacgtaggcgccaagtaggcgccatgtcggcgccagctcggccgagatcgggtcgggccgaccccggtcagcccctcccgtgcgcgcgttccaccgcgagccatgaggctgcgcgtgggcccgccgcatccgttcctccgcgaaccacgcgcgtgcaccgcgtccctcccccgcccgcgcgcgtgcaccgcgtgctcgctccgcacggtgaaccgtgtcaccgacaagcgggtcccacccgggaccactcgtggtgagcccggtccaccggcgctctctctctcctcccctcccgcgcgcgcgcgtcttgggccgccttgggccggccagcccatttagctcggccggaccgctccatttctcttgggccacgccctagccgcccgagaaaagtctatattccctccctcttttcttttcttttcttttcttttccaaaaaggatttaattaaatccttttcctttagaccaaaaatccaataatcttagaaattcaatatcttcccaaccgtaaatccgtttgactccgttcaacttccaaaattcctcaaatctcgagatctatctaatggcacgcttagaggtcattaatagggctttattttcgccgtttgttgagttgtcccgtttcgcgtgtagtttcggagcccgaagacccgcagtgcgaggatttcgaggatcaagctccagatctcgagcaaggcaaaccacctttgaacatcttgagcctatatttgaatttaattatgttgcttgaaaaatattatgcattgataggatcgcacttaatctgtttgtcccgtctgcaaggcagattggcggacctacctagcttgttgcatttgatccttcctctgttaattgtcataccatgttcccttgtaaccacccagttgcgcctcggaaatcgtgcactctgcacgagtatcgacggtcgccttcaaacttaaaatctgaaaaacatcttgggtaaaacttgggttttacaaaagacttggaaaacccgacacctgggacggtgcttgcgaactaaatgaatttccaaaaccgcggaccggggaacgtaccgggtgtacggtttcccgctctcgcacttaaggaccgattccttggaatttcatccaaacataagtcaagtacgaccacatgggtggaatgggacacccctggctgagtaactagcttatcaggggagccttgatgccaagagacatgtggattcgccggggtggtgtcggggaggacccctgggcttcctggcacagtatggtctgggacctaacctgttgttggtctgggatccctctcgtcggcatatggtaaacctgtgtcggctttggaaataccttgtcatgaaagcttggaggtctcccgacgtggctgatccccacgggctgggtgatccgggttagtaatgtcgtgtgggtaaagtgtaccccctctgcagaggttaacaaactgttcgaatagccgtgcccacggtcatgggcggatgtgaggtgattcctagcgtagttttgttcgactactgcttgtgaaattgctgttgtggaaaggggttcgatgtttgaaaaaccagcagctgacgggatcagctaggcccgggtggccgtttgaaagttgttggcccgggtggccgtttgaaagttgttggcccgggtggccgtttgaaagttgttggccgggtgccaatctggatcaattctaaagactgatacattgcacatactccgaccggacgagacgcactgtctcatccacgtcgtttgagaagcactcacttagttgtttttagaaaagggttcaaataaaatcaattgcaaaaacaacagcctttccttgaagcctgcattaaacacttatttcccatggcttgctgagtactcccgtactcacccttgctctatataaataattccccccccagttgctgaagaagatgaagcggaacctgctgatgaggagttcttccaggagcaagccggctacgatgagttttagggtttcggcctagttcccaagtcgcgcctgtgttgtttggtccaagtcctggcttccgtttcccttttgtaatgcagttgtgagctcgggatctgtccgcagcccaacatgactgtacctctactctataataaagagacctctgttgttgtgatattctgtctccctgtgataccagcactgtttcctgggactggtatcgattaacaggttaatttggagcgtcacgggctagttccagtcgggactagttcggggcgtgacacaatctctagcctgccttctggttgccaattagggtagcatcggagtttcagccgatcttatctgatttaactatatttgctctatatgcttcattgacatgttaaatctgccctttatatcaagatattgtcgcatctaagtatattaagcttttgtttgatatattatacatgttttaatatcctgatatagagtagtatcggagtattagccgatacatgctaaatctatctgatcggctatgctataaacatatatagtcctgttattaatatatattctgatctaagtgatttatactgtctcggcatggcgaccgatctatcccaatcacttgatttaagtatatatcgatataagagttatatattggtaatatctacagccgatcgagtagatttagttctttattatctacttataactgccgatcgattcacatatgacatcggctcaaagataaatgatatgccatcggcacatagccgatcggctatcgtttatagatttaaccgcggtttctttgtctttatttcttgttgattgcaggatcaaatcaactggcacgctaacacacacgaaggcaagctttggacctgcactggagttaagcagatctcccaggcctcgtgtttttcatcaacacacttttgtttcccaactctagagagatcagctaaaggactcccatgtaggaatagagcttttctcttgagtaaacacagtgctaaatggagaaagatcttggggttcgtatagtgggtccatgtgatatgaatgaaccaaagagaccacaccatcctgatgcggaggaggtagattttcactcttgcttttcacatttgcatgtgttattaatcttctttttttatatatttatttggaagcatcggaatgatcgcattttcaacaacgccatgcctaatgtaaatgttgttttggcggggctagagtgttttctggtgcatggctagagctagggttctccatgaactcctttgtcggtctctccatgaacaccgctatcattgggcgtcccagagaagcacggggcagtcaagcgctacaccttcccacgctgcatggcatcatcatatgggtgaggttttcaccgctaatctatcctcctgcccttctcatcatatgcggcacgatacacatcaatgcttggaacatggaggccatggcggtgtccatgtacattgctatcattatgaacattcaggagaagcacgggagggcagtcaagcactgcaccttcctcacgcttaatggcatcatcatatgggtaaggtcattcactgtcgatcggtcctcctggccttccctcattaggaatcccatgccgtagagcccgatattgtcactggatgtcaaggtgctcctgctccgatcgccgatacacatgcgggcacgcgaccacatacactccaacacacacacacacaatcatagttttttatgcggtgagcaaaatcgataaaaatcaattccaaaaatcatttgattttgttttagcaaaatcttgaatctaaaaccacttcttattcccctcaaatatttagtacaagcaaatgtgtctacatgttctcatagtacaagccaagcactagtaggcatgtggccacccaaatatcttctagccagaagctctcacaaaaaccaatccccttctagctagtgaggcacatcaacatcgtgttgtgagagtttgtcgggtgctcgtcatcactaagcgctcacgatacacatcaatgcttagaacgtagaggctatggtggtggccatgtgcactgctatcactatggacgtctaggagaagcacgcgaggcacgtcaagcgctacaccttcctcacgctacatggcatcatcatatgggcaaggtagtttgccgttgatctatcctcctaccattccctcgtcaggaattccatgtcgtggagcccgacattgtcactggatgtcaaggtgcttttgtttcggctgccaacacacatgctagcacgtgaccacacacgcacgcgcgcgcgcgcacacacacacaaaatcatagggtttattatgccgtgagcaaaattgataaaaaaaataagtccaaaaaatcatttgacttttgtttagcaaaatctttagtctaaaatcacttctggtttccctcatatggcataattcaatcctccaattatttaccaccagcagatgtgtctgcatcttctcacagtagcactagtagtcatgtagccttccaaaaatcttgtacctagctagaagctttcaaaaaacctgatccccttctaactagtgcagcacaactccatcatgttgtccgaattcgtcaggtgcttatcatcgctaagcagctcgatacacgtcaatgctcggaacgtggaggccatgtacaccgctatcactatggtcgtccaggagatgcacgcgaggcacgtcaagcattacaacttcctcatgttgcatggcctaatcatatgggcaagggcgttcttacctcctggccttccctcatcggggattgcacaccacggagcccggcacagtagctttaggtcaagatgctcctgctccaatcaccgacacgcatgtgggcgttcgaccatacacacacagagagaaacacacaatcatagagttgattgcaataatacttatttcgttttgtgtgccggggaggagggttccaacccctcctcccgaacgccagccttagttctatttagcacaactctcgcggttctaggtttatgctgaatttaaagtatggcacaacacaatcgtagagtattttgtagtaatacatttttgtttttaaaaaatagattaatatgattttttttaaaaaaaacaactttaacggaccgtttagtagttcgatcggatggccccgcacatgtgtcgctcgatcggacgatccgcacatgcgtcgcgggcttgagtgggatacggccgttggatcaaatgtggacggccagatctgtgacaactgcagactgtgccgtagccacacccaaacccgcgccaccgccgccgccgtgggagcagctcgaccgttcgaggaggcggcgatggagcacgggacagtggaggactcgagcgcgtcgacgttctccatcgcggaggaggaacacaccctcgccaaccccgccagattcgtcctcaaccaggagtgagagttcttgtgtaccctttgtttcttgtcccctttgttttttccttttatttttcctgtgtcccctttgttggtttccgtgaaattcgatcgtatttccggccaacattttgaatttgtgcggtagatgaatctgtggttagagccctaggagaggaggcaaaaacttggttctagcttctatcaatcttggggtttacagtggaagagaggagagatgtggatttgttaggcaattagatcgattttattttagtgagtaaaccgattggctgtagcagttgaatctccagttatcgataggaattctgatgaaattaagtgggcaagattttgttttgggtttttggagaatgagggcattgtgagtgttgaaaatggtgaagcctactttttttttgttaactaagtaaaattacaaagatagggagaaatatttgtggggtaatgttgcaaacaaccatcttgacctgttgatattagtgtcagttgatagggttgtctattggatcacctaggtttagatctagtcgggtggttctatttgcaatggatgaacaacaatagatgaatgaacaaagagggagtgagaggatttagggttgtgaccagtcgttgttgaggaagaggaagtccggccggccatcgtcgttgtcgtcgcgggcttgacgtggacggcggcgacgatgtgctcggttccgatggcggtgatgtggttgcagcagcgacggtgtcgacgacgaggcgtggcgcggcggtggacttcccgtcactggctgcgccccctcgatcggttagggtttatggggtggagtggcggcaggcgacgaaccacattccttgtgtcgttatgccgtcccgtcctccacccctctttatatggcacagtgtgacgggggcccaccagccattgggctgggcgcccccgatcagggcgcgggtcaaggcccccttgagccgttgggctcaaggggagggagatccatctaacattctcccccttgatctcactatttcctttagctttttctattccatcacagatttacatatagagcatgtttcatcatcacggttaattaccgatggattcgacagccactatacacatctctattcagaaacagatactttaacttttgggccctatagtccaggattcataaggcttcccttaaaacccatgcatgctacatgttccttgaacatgttgggaggtaggcctttcatgagcggatccgcgagcatcctttctgttcttatgtgctcgagactgattgtttgatcccggactttgtctttcacaacatagtactttatgtcaatgtgtttggcagcaccacttgactaattgttgtgagagtacattactgtgggttctttatcgcattataactttagtggtttctcaatactatcaaccacctttaaaaccgggtatgaacttcattagccagttcacctgccccgtagcctcatggcatgctataaactcggcatacatggtagaccctgcagtggtagtctgttttgagcttttccatgaaatagctcctactgccagggtaaacatgtatcccgatgttaactttgtattatcttttgcaaagtcagaattcgaataccccactatgtggagcgattctgattttctgtaagacagcatgaggcttttgttctttgcaaataatctttactaattccagtgctctaggcctggattactttgcaatctgccaaataacccggtaacaaatgccaagtcaggtcgtgtgcacacttgagcgtactgtaggcttcctacagttgacgcatatggctttattttcatttcattgagctcatactgatttctaggacattgtgatgccccatacttttcgcctttgactataggagcaggtgtagcactgcatatgtacatattgaatttcttcaacaccttttctatatatatgccttttgagaaaatcccaatgcatactttgttctatttcggtgaatctctatgcccaaaacatatgaagcctcaccgaggtctttcatgtcaaagtttgaggacaagaatttctttatttcctgcagtagattgacatcactactagccagtagaacgtcatctacatacagaattaggaaaatgagtctcccattcttaactttgaatcaatacagttgtcctctacattctcttgaaaacccaaatttctttattgttccatcaaacttcaagtagcattgtctcgaagctttgcttttaacccataaatggatctctttatacggcatcccatattttcgtttcatttcatgacgaaacctttcggttgtgccatgtatactttttttcttcaaatcaccatttagaaattccgtttttacatccatctgatgtaattccaaatcataatgtgccactagtgccattataatcataaaggaatctttacaagagactggagaaaagtctcattgtaatcaatgccttctctttgcgtgaaaacttttgccacaagtcgcactttaaacttttctatattccctctggagtcatatttggttttgtagacccatttacagcctactgttttggctcctttaggaatttcttctaaatcccagacatcatttaatttcattgatttcatttcatctttcatggcttctcatggcctcttcatatgagatgggatcatcctccatatgcgactctttcaggccttctaggggcctcctattctggcacattatctgtttgaggctgttgcagctcctcctctgatgtggcaataatttctgttgaatcctgtagaacaggttcctcactttcattcattgttgccacaggagagataacaacaggtgttggtaccgcaacggcatgcattgctggcacaacattagcaggtagagagaagaaaggttcctgagtcgacggagcgggtacagacacccgcctctcctcaagatcaatttctcgaattaccgagctccccctaatcatttcgtctttcaagaagacggcgtgtctcgtttctacaaactttgtataactgtttggacagtagaaacgatgaccctttgatcttttagaatagccaataaaatggcagcttactgttttgggttaaatactttatcctttgcaggacttccccacacacggaggatccatagctcatacggtgttttgggcaccgatgcattctatacattgtatgcatcgttctaaaactgagaactccaatggaggaagaactacattcttaaccagtctctcaattctccccctcgaaatatggcataaacaacagtgccataatttcgatgagacatcagaagttcgcttttcttttcttttgtcaacgaggacacaacattcacattctcagaaagagataacaaataaagctgatcttgcaacacaagaccaatacattcattattataccatagttcacatttgccatttcatatctatcagaatccaatttggatactcttattatcaagtttctttgcaaagaatggacataaaaacatctggaagtaaaagtgtgaagccattcgcgagttctaggcgaaaatctccaacagcttcaacttttgcttcaactccattggcaactctaatggatctttcacttctttgcgtagtcctcattgaacggaatccctttaaacaattacacacatgaatagttgctctagaataaatccaccatgtggatctagaataaccaatcataatgagattctttacaaatgtaataatgttctcacctttctttgccatgatcactgtcaggaagtcaggatgatctttcttggaatgtcttgtcttcttgcagtgtagacactgatcttgtctcaactgtaaactgttgtttctgaggcggatgctgaggctgtttttcttttgaggagggtgacctgtggctcttttccttgttatctttgacaaggttaatggagtcaccattggtctctttgtgtctttcctcctcttgcacacaattagagatgagctcttcaatattccaattctctgtacttattttgtagttgacaacaaggttgtcaaagttctttggcaatgaggacaaaaccagatggaccagaaagtcatctgagatgcccaaatctttttgcttcaatttggaagccatgttgctcatcctaagaatgtggtcttttacaccacctccatggtacctctctgtaacaagctgctttatcagctgtgtcgcataaaactttgaagaaccagtaaactggctctttatactttcgaggtatttagagacagtgtcatactctgggattgagcccaatatggttggctcaatcgtgttctttaccgcagccaaacaattcttgttagctgaagaccatttcgcatgctcaatgtcatacgacatgatgagggaagcattgtccctctctctctttttccattcagcatctgactctttttcacctctgaaaatttcagcaggttctataggacatggggtagtcaacacccagtccacctctcccaagataaaggcaaggtcgagttctcttttccattcttcgtagttatctcctttcagggtcggaatatctttaatgtaacccatcaaggagtagccacctgagataatcatgtattgtgagaacaaaattaacattaaaattattatgtattaagtctacatcaccgttgggcagaaaatagacataacacataaagccataactataacattgcaattatcaacgttggtcagaaaaattacaacatcatagcacataattaatgttcctaaaattaaaatctcccgttggttcgaaattta

SEQ ID NO: 57908 - DNA, 787 bp, Oryza sativa
ccagagccgataaggccttgtcagatccttcagagacgaaagaccatgtaagacctggtcgtgtaagagttctcgccgtgcgtattaaccaagccgtgtaatcggaaattgacttttccaacctcacggctgggggctaggatcagagctatttcaaccaagacaggccaggagtccaagagccttgtcacccgaggacatccctccgacgacaaggctgggggctaggaagagtgtacaactcaaacggctaactaaggtcgttaactgagaacacgctcttacaaacaacacccagagtaagaaacatttgttaaagatatatttctttattcacaaaatattccttacagttagcacataaatattatgtcaaattacgtcttttcccaagatatcttgttacagggtacaaattctaccaagaaggccaacgaaaatcttctcggccagcggcgacattgatctcgcgagatggtcaatctctgccggatttctccgagaacggccaaaaccctcacgaagaaattcgagatccaggcgcgggcggtgatctcgcacacaggccaacacatgccccccggcatatcgactcgctcgacgacactcttgcttcagggcctcgtcgatccgctgaccaatgccgtcgagttgagcgcaggctccattgagccacgagatgtaccggccgccgactcttcaggatcaccgcgggctacccgaagatctcggcacaccctcgccatcgaggtgcagcaattcttcagataagaggagaaccacacct

SEQ ID NO: 57909 - DNA, 660 bp, Oryza sativa
aatccatataaaggttttaatccgatttaatctttaaaaattcataactaattcatctaggctcggtttaatgtggttcaagttgcaaaaattatataaaataaagatctacatattaaaattgtccataaattgaattaaatttattgaattctttttaaatgggctttaattagatttaatcttgtaaaattcataataaattcatttgaagtcagaatgaggccgttcaagtctcataattcatctcaaattatgatctacatgtttgtttactttttatgtattgtttatttggtttttattagtctttttcttcgttttgcgtgtaagcttgtcgtttccgtcgttgcaaaggttcgtgagtgcgccgtaagtattcaagaagattaattgaagaccgattattgcaaggcaagtcacactgatcctaaacacaatcctttgaacatgttgatcctatatttaaattctctatttatttcaactgtgcatttattttcgaatgtcattgggtggaattaacctattctttgttatggcccttttgttcttgattactttattccttgataccttgggttattataattggactagttgagctttatatatattggttcaactagatattagatataattgcttagccatgcttag

SEQ ID NO: 57910 - DNA, 899 bp, Oryza sativa
ccggccagcccgcggtatgaccggccgacgctgtgtcggtgtcggtttcgggttgtttatttggatatccgtgattatttcatgattatggcttctagatggatactatacgtatgtaatactattgtttgctgataatgagtcaagttgtagatagcttggtctcggaatatggtttctttgtttgctccacgtgtaggtgacttgatgtctcgggagagtatttgcggtgatggaccgggagtcggcttggggataagacgacgtccgtggtggtcagagatcatgcgggatactaaggctagagttgatgcacatggttgatggagattccatatggcatacgatggagttattgtgtgcgtatgggatgtggagtcgaatttggaaggagtccaaatttggtacgattggttctgtaaagtttctttcttgtactagagggtttcctaaggtgtttaggactcctagtatgagtttggttcgtggctttgggctgcctacctcatgtataaatagagggggagcgtgaggcttcccggtatcgctttagagagcaattgagttgagttttgaattagggtttcgagtttagtcgaaatttttgtaaggagtgttgttggtgcactttataaacacagagagaagaaataaagttgtcatccactttaagagttcttcgatttgtgtttcaccgagtttcggtggtccaaccggcgacataccgacggttagaccagtggcatcgcggcggtccgattggcggaaggacggcggtcagatcggcggcggcgacaggcgccgcaggcgacatcgatggtcagaccgggtgatctataccggtcagaccgacggcatacacttggtcagacccgtagatcaatctgggtcagaccgat

SEQ ID NO: 57911 - DNA, 2138 bp, Oryza sativa
aaataaaacagtggtaacacggaaatttgaataaagtagtaatgcaataattcaaatcaaaatagttttataaactaggattcaatgtgctcaaggatgatgcgacttgccttgctcagagagaacggccttccgaaccttggcgacgaccgtgaaccacgcttcgggaacctccggaacgacaggagctacgcgaagcacacaagcagagctaaaccctataaagaagcaataacaatacataaaaagaaagcacagggttctttaggttataacaaacattaggagacttgaacgggtcaattcagagttcgtatgaccaatgtatggtcatccgaagtttaatgctgttatatggagatttgcggattataataattaggttttgcaactacaaaacatgtgtaagcgctagcctggaaaagacaggaaggctgcgccgttgacatgcggactccacatgtcaacctaaaggaccgcggtaggccgagtacatagacacggtccacgggttgacggaagcggaccccgtgtgtcaaccgaggcgagtggccgacaagcggactccactagacaccacgcgggctgcacacatgaaaccacgcggctaccgagcgggcacactaacacgatcaccacacgcacaaacgaacgactaccgacaccggtacatgggtaccggggtcgacaaccacacgacgggtacggggcaacaccgaaaggacgaggacgggagcagcgagaggagagatccttaccaccacgcgacgaggcgtgggaacgacaacgacgaacgagcgcggcggagacggctcggggacgacggaggcaaacggcgagggaatgacttcggcggtgatccttgcacgaaggcgagacgtggccggcgcaacgcttgacgacgcggaggcgaggacgaagacgacgacggggctgcggcacttgacggagcgaggacgacaaacgagaacggcttgacggagggacgaacgccacgacgaccgggaacgacgagaggacgacaacgacgatgaccagggccggcgaggagacggcgatggcagccggcagcagctgcacagatgcgaggacggcgtggaacatgccgctgtgatgatgacgatggtggtggcgcagcgagacgatgtgccgggcgaccgacaggacgtcgacgtcgaggacgaacggtgacgacgacgacggacagcggaggggttcggatggagggaaggcgatgccgaggacgtcgtcgccggctcgccgctgcgatgccggaggagacggcgacgtcggccggcgcacgggaacggtggaaggggttgccgaaagaactccggcgaggcggagggcgagaccggagcgggcgacggcgttccggcgaaaccgagggtaggccggggtggagggcgacgcggcgatgtcgagggaggatggcgacgacgacagtcgctacaccggcgagcgggcacaagcgtcttgaggcggtggagtggtggcgacaccactggtcgtcgacgaggacgtggctccgataatttccccgcgaaacggaggcgacgccggggaagaggaggcggctacgaggccgctgggggtgacggcacgaccggacggcactccggcgaggagggagaggcggctggaggcgaccggcggcacgggagaaagaggaggacggcggggagaggtggtgaggccacgggatcgaacgcgggagggggctaaaactggagaacggatcgagggggttccattttataggggaggagagggagctggccaagggagaggcggggaacggtggcgaaattcgtggccggcggccgtggaatgtggccggggttggcgcgggcgttcccgacgattggggtcacgaatcaagggggaaatatgggggaaagacagaggaatcaatagggattaaaaccccctaatcaattttggaaaccctggtttgaatcgcgtggattttggggaggttggcgctagggtttgcacaggagagagagaggaaggaggccgggcgggaggaggacgacgactcggcgcgtgggacccacgcggtcgcgcgatcagcgcgcgtgagggggggtgggcggcttgggaggctggggcggctgggtggggtggcttgggcc

SEQ ID NO: 57912 - DNA, 905 bp, Oryza sativa
actcggagccttgccaccactaccagcagcggcgtcggatgcctcctcgaccaccttctccttcagagaagccgccacctggtgatccgcgagcggtccgatgacgtcagtcaagggaagggcctacgctaagtccgatcacaagctgattccaaatgaaggaggaaaaagacatctaaatagacttacattgatcgcctcgtcgcgttccgcctctcccttttcacaaaggggcacagggatgtcgctcgcggttgtcgcgccgctgatcatcacctgaccaacgcgtcgctccacgccgtcactgctcagagctatcaaagaagaatcattttccgataagtcaaaagcgaacgcgaatacggccatatcaaagtgaatacaagaaacataccccgaggagaaacccgggtcgcgtcatctggcctggaataattatacgccgggtgggctcgagcctgaagcggctggatactcctaccaacgaagtctgcaacgacttcataccccgataagccccgttctcgaagatcatcgatgatgtcgataaacgattggagagagggggtcaaagggggcttggcggtccaaaccggaatcttgtttggctgctcgtcaggaacaatgagggcaggattcgagtccttaatctcgagataaaaccacctgttctgccatttgctgcgagaagaggggcactggaaggggacgtgctgcgagaagaggggcactggaaggggacgtattgcgacttcatcccatcacgaagtcagaacccaacgcagccagacaccttgttgagttccatccacgcaactcgtaataaaagcgaaacaaatctagaaaaggctctactccaatgtaggcctcacaaagatgcacgaaaatgctgagaaatgcgatgg

SEQ ID NO: 57913 - DNA, 1524 bp, Oryza sativa
ttcggaggatccgctcttgccggaagttgaagcccacgttagcgaaagcgagctaggcaggtgacatcatctttgaccatattgaatcccagtttataaaattatgtggatttaaattatggcattatcgctttatttaaattcccgcgttatcactgttttatttagccatgcctatttacctttgttatgaccatattattattgttattgttattattattaccttgttcaccctaaaacaaacaaaacctaaactagcggtttaattttatgtatatgcttcgcaatttaattatgtaacattaagtggtttttcaactctcgactttgggaatactcatatcacttggacattatggaatggttggattattgtagaaatggacgcacacctccccctctattcaaaaccctcaaaatggttttaggctgggctcagggtgcatggttttgatagtagcaccttggccacataaggaccggtcttcgggcctctgttgcaaagcactaccgtacttccacatgtctagtgggtaaggcttagtttgtggctcagtctggttataaacaaaggtacatggatggagatggacgaagtcgagggtcgatggacatctctaggacaaatgaaggctacacgagctgcggcccggtagtcgaaatgtcatgtcacaaggctggtgtcctgctgctaggggctcagtcctgcctacctgtcctggaggttccggccgtaggtggggttgggtcggtacccttgtctatggctaggatgggttggaaactatgtgtcacatcctgatttttgtttcaggatttataaattatttaataaattattattagaatttatattaaatgttcattaatttacaagtgaagttaaatgtgggaaataaaatttcctaaatataaagcatggatggatttaattttttttttaaattctccatggttaattatactctctggaatattctcggatttttcagagctcaattcctaattttaatcatacaaagagcatttcagtaattacccacatattaaattaatcattaaatggtctaattataattttgttaagtactttgagtgtgcaagtattttcaaaattttcttggaattatttgagcatcggaagtatttttaacaattcaaagatcatttcattgattaatttaattggaaaaagtaaataaaaatcctcctcctcagcttgggccatttttggcccattccttcctttccttcctctctcttccgccggcccaacccgagccttcatcctctcttcttctctcagccaaagtccggttttgctccctcttctaatcaggctgagaaaagaaaagcccggcaagaagtctattatccttcccccgcgctactgttcatcttccagctccagccgccggctgtagctgagccgagccgccttgccgagtcgccttgccgcgcccgttcctccccaatctctccccttttcttccgattgtttgaggggtttttatcctctcg

SEQ ID NO: 57914 - DNA, 1230 bp, Oryza sativa
  unsure (1)..(1230): unsure at all n locations
gctctgacttcgtaggctgtgttggtggtctaggctttgagattcgatgagctatggctccgcggggggtcccttatataccgtaggttgggcgatatctgagtaggactcgnatgtaccaaccctgatacgatacgtaggtacccaattcttgttcgagaaggtttctccttgtttgttgtctttacgaagaatttccttaagtgctagaggatttatccatatacacgtggatataccttgtcgatacgtgacgtatatcgtagggtgaagggtatgcctaacccgtaaccctgacagtagccnccgacttctgctcaaaaatgaactcgtgagaccgtttgcgactccaggtgtcgagaacgttgccattccaggtgcgagaaccaaggagatgacgtgtaatcgagcgcaccgtttgaagtccaacggtcacgaatgaattttgaactgaagtccaaaaaccaccatgcacaacggacatagaaatctccggcggggatttctcctatttccttggaattcgcaccgtcgggagtgcgtctatttaaaggtatttagggcgtgagctttgaggtccgcctacttcattaagtatacactgctcctttgcattcctcgccttcctcgccgccgcaaaaagccctagcctcaccgattcatcgtccgtttccggcgatcttccggcgatctcccgacggccatggatcttgggaagtcgacctccaccgccgcgaccctgaagaaacttcaggaggagggtggcctccctggccacgacaaggcagagagggaagcagggggtactactccccagcccgtcctaggtcgcatggttgcgattgaggattacattgtctgcgggtttcttcctcccccctctgaattccttttgctggtcttaaacttctatgggctttcacttttgcacttgaatcccaactccatcgcatttctcagcattttcgtgcatctttgtgaggcctacattggagtagagccttttctagatttgtttcgcttttattacgagttgcgttggatggaactcaacaaggtgtctggctgcgttgggttctgacttcgtgatgggatgaagtcgcaatacgtccccttccagtgcccctcttctcgcagcacgtccccttccagtgcccctcttctcgcagcaaatggcagaacaggtggttttatctcgagattaaggactcgaatcctgccctcatgggg

SEQ ID NO: 57915 - DNA, 1014 bp, Oryza sativa
gggtgtgtcttgttaagaacgggggttgtactcagtattgctcaatttttcccaaacccagaagagaagttcctgaagaatgaaggttttggtgtctagctcgtgcctgccgtcaagcgcctgtggtcgtcgccatagtcttccgctgtttctcgtttgtctctgtgtgtgctgggcattcgctgcccatgtaataaattaagtatgtacgcttccgcttgttaaactctgaaatgtatcaacttttggtgtaccttgcatcctgggacaaggattaatgcacgcacgtaaggaacgcccgttgggttatttctggtcgtaacacctgctcccggccacgcttacgtgaccgcctccgggcgcgcggtgtgaccgccgggtggggcccggccgtcagccgcccgtgccctcgggtgcagctgacgcgtggggcccacggcgccggtcggtgtgagcccgggtgtgtccggtccaccgtggaccgtgaggctgccgcgtgggccccactcccatggacccggtccgcgcgccatctcccctggttaacgcaataaatcctttttaaattaaaatttaaatgaagaaattcgcaaatattcacttaaagagcatataaacttcaaatggccataacttggccatttgaactcggaattggaccgttcaagtctctaattttttctttagaagtcaagaacccatttttgtgctttgttcctgcttgttatatggagtttattagagtaaaagcctttttcctttttgttggtcgtgtagacgctgcagcttcagaagatccgctcttcgtggaggttgaagccgacgtttgggaaagcgagcaaggtaagtcacatcatccttgaacatattgaatcccagtttataaaattattttgatttaaattaatgcattatcgctttatttaaattcctgcgttatcactgttttatttagccatgcctatttacctttgttatgaccttattattattgctattgttattattaccttg

SEQ ID NO: 57916 - DNA, 994 bp, Oryza sativa
ctaattaaccgtaactctgtttcaggtggttcaagttgctaaatttttctaaaatcaagatctacatgttaaaaatattcacatgtactgtttatgcttgtttttttgtactgttttattgatttttattctttcgctttagtttccgacgttccggaggagagcgtttccgttgaggaaggttccgaagcgtttgcggaagcccaaggcaaatcacacagatcccaaacaaccctttgagcatgttaaacccgtttaaagctattattttatttcaactatgcattattttttaatgtcatcgggtggtgaacctttccccattaattaatggccgaagatgatcttattttcctatgggttataatttgattagcatgaaccttatatattggattggttcagctaaatgctatatgtaagtttgcttagctatgcttagaaacattagctaactaaaggggttaattataaactatattatattatattattattatggttatatttaatggtcgctcacgatggttaatcgtgtgatgttaattaattgataattaaaatctggataaggtgggttgtgagcatatggttttgatggttgtgctcatgacaattaaggaccggttcgcgagctactgttgtgaaacatttaccgtgccaaccacaagccagcgtgggcaacggctttatcttttgtatagcatgattcattatagtgcgccagactgtgaagcggcgagaagtccatgggggttgctggggagtccatgccttgtttataagggggtgattatgatccaggaaaggtgcgctgtaatggcttatgttgtgcaaggggtattgtcacaactcctttccgaggtaccgtggtggtattgaggcacatggtgacatgatgtggggttgtgtcttgtgggtacagtggtacacgtctggccagagtaaaactattcgaatagcagagcccgcggttatgggcgggttgagcaat

SEQ ID NO: 57917 - DNA, 1514 bp, Oryza sativa
aatggactaggcattgcaccgagcagtcgaagcccccacggaggagatctggacagcgcgcactgacagagcctgcaacgcgtctaggactggtgcagccgcgataatcacttcgcccaccggccgcacaacgtcatttgcggcgcgcttggagttctcggccactaataacacgactgaacacaaagctatcctacaggtgctccgcaaggcaagggctatggtgctccccggcttgtcgttaacaccgattctcaggtggcagctgggcatattgacacgacttacatggccttgaatccggagctggccaaatagttggcagcgttccagaaggctgaagcacacttccggggcatcgtggtcaccggagtgccacgagcaacaagagccgatgtagacaccctagccaagatggctgcggccaattcactcatgcccccgcatgttctctacgaggtactgcgctccccggcagtgcagggcggggagcccccgcaccccccccccccgcgcccgatggtgaaggtcgtgataatcaacgcggagcccaattgaagattgccgactgtggatatcttcgctgggcggacggagccatcctccgctgcggagcatcagcgcctccgccatcacgcaagaggctacgtgttcattgaggacgccttatacaagatggggtctgcgcgcctcttttccgatgcattagccggagtcaaggagctgagctccttaaggacatccgcgagaggcactgctgaacccacctcgccccgagcgccttggcagacaaaacgctttcggcagggcctatactggcccacaattgtggcagataggagcacttggttcgccattgccaaggctgccgacatagctcacgccaattccgccagtatagcctttcgtgcgttggggcatcgacatagtcagtcctctaccgcgcgcattaaagcgcaccaagcatccgccaaccacccctgacgccacggctcagccggcaaggcgaagacgggagcatgctattatccgggggatgccggagccaggaaccccggggcgcgccatactgtcaccttaatagtaagagagctagtaaatccagttgattttattccaacaatgccgatttcgaattttagcaagaggttcgtttaggtgacaaactgaacaactactgccacttgttgggtagttctagccggtttttgaaccggtgctaatagcacgatcattttgcatttgtgtgacaccttattttctctagtgccactttcggtgtttatcctacggaaaaagtacacattacccccccttccccccgaactatcacggttgaccaaattacccccctaaccacaaaaccagacattactcaccctgaactttcagtaccgacgaattaacccctcgaccctattcagactggttttttcctacgtggcgtacgcgtggcaatccaatcagtattttcttttttaaaaaatggtgggacccacgtgtcatacctaccc

SEQ ID NO: 57918 - DNA, 538 bp, Oryza sativa
acttcgccggcacctgcacgacgactacaccaagccgtgctcctaccactcgacgctcgtcgtcccaaatcaccgccgccaagaggtcccaatccgatctccttttgccttggtgatttgttcgattgcaaagcaatcccatggaactcctttgctgacttcatgaggccaattgcatccgatttcttcaaatcagagtccgcatcgccgcctcttctcgtgttcgacttggcttcgtcttctacaattgtgccgcacgcgctgtgaccggactccgagtccgcatccgctactgcgccgcgaaccccatcagaaaagataccgcgtaatcaccgctcaaaccgagcctgctaccaatgacgccgctttggtctacgccgccggcttgaccacaacgcgaggatcgctcacaccgccgcggccctgaccatctccaagcttcatgtacgcctccacgacttcctacaccgccaccaaacacttcgggtcaattccattgacagcgaatgccgccgatcaataaccagtgcctgccaca

SEQ ID NO: 57919 - DNA, 3746 bp, Oryza sativa
tttcatacatgaatacatgctattaactagcacttctttctcactaaattattatttttttcaatgctctatccttaagatctttaattttattgggtgcatgcattatactccctccgtattttaatgtatgacgtcgttgaatttttgaccaacgtttgaccattcgttttattcaaaatttatgtgaaaatatgaaaatatttatgtcatgcttaaagaacatttgatgatgaatcaagtcacaataaaataaataataattacgtaatttttttaataagacgaatggtcaaacgttggacgaaaagtcaacggcgtcatatattaaaatatggaggtagcatatttattagggtgatccaaactatgaggtgataataactactctctctgtcccagaatatagggatttttagggccggatacgggtattaagaaagtaggcagaattaaatgggagaaggttgtgattggttgagaagtggaggtaggtgagaaaattgaatggtgaagggttgtgattgattgagaagagaacgttggtgaagaagttattatgttttggggcaaaacttgaatgctagaagtcgttatattttgggatagaaggagtatttcttggcctttatgggttaagtgtggttgcgccttatattttggaatgtagggagtaccataaagtaagacatcatttattacttattcacagctttaatagtacattgtggatatccttagagcgggtacaataagctgactaggcgggctccaaaattatgcactacagcatattcctacgtggagggaagagaactgatgggagagaaggaaatggatgacaaatttgtcgccgggcgatatctctcttctcaacgtgactgcagtccaactcgactattaaaaacacgcttggtaggtcccacacaccacaaccaatccccttccccaccgagcgagatcgatctctctttccccctccaccccagccgagcccgctcgatctccgcccgcccctcccgtgcgatcttgtgcgctcgactcccacgcgtgatttccgcctctccctcgcgcgcacaatctacctcctctctacttactacttcatccacgagcgtgaaaataaatttacatcttcctattttgccggccccaaaaatccggtggattgacgatgccgcctccactatccgccttccctcttctacctcgcttaatcgctcaccgaaaaccctagttctttaccaccaaggcactaacaaccttgtctcgccagaggaagagagaggttgcgccacctccatgtaccatcgcgagcttttcttaaactcccggtgtttcaaaaattgtgatatatgtgcccatatgcaataagtaccttgttttttttaggatatcaatggtatttgagttatgatgtaatagtgccttgtaatttttgtactacagagaatttggtcctggcagaaatggttacaagagtgcaatttactcttgatcatacacacggatatgtacatgttataattaattatttgattataagatataataagtaaataaacaatctattatattagtagtgggctttaacaatgagctattagtgagcaactggctatactattagctttgctagcctatagcccaacaaagcagtttccacgtaagcacatagtgacacgtcatagccacggcagcgacctcgctggctgaactcaactacttgaaaaataccgagctggttcaggttccctccacaactgctccccccctccacctcctcctccgccgccgccgcctccgccgccgccgccgccgcttccgccgccgccgcgccgcccgatgcgcctcctcgccgcggcggcgagagcacaccgttcgtcacaccgccatttcctcctctcctccagcttccacctctcctccgccgccacctccactaccacctcctccacctcctcctacgatcccatcaagcaattcctcctcctcctcccctccaacacccactcccaccaccaccacctctccctgccggcctccctccgccgcgacgccgtcctcgcgctcgcccgcctcatcaaggtctcccctccatgcctcctcgcgctccacgcgctcacctcccccacgtcgtcgtcgtcgtcgccgtcaccgctcccggcccgcttcgccgccgcgctgcgcctcgcctcgtcggcccaggcgctccccaccttcgcgtcgctcctcctcgcggctctgctgccggatgcgacccctgatctgctagcgttctgcgaggggttccgtgggcgtagcgggaggtacgccgcgcgccgcctcgccctccatgccttcctcgccgctggcatggctgacgaggcgctcgacgtgctcgcgcgcgtccgccgcgccggggacacgcccagcctgtctgcattggcggcgctgctgcgcctgctcttccgtggcggggaggtccgggctgcctggaaggtgttcgaggaaatggctgcgaggggaccgaggcctaaccttgccatattcaacgccatgatctttgggttgtgccacaggggtcttgtacgtgtcagcggtggcctgctcggcgtaatggggaggttccacgtcgtcccggatgcgtgcagctataacatcctgatgaaggggcactgcttgtatgggcaggcagaggatgccttcaatctgtttgacgagatgcgtgtgacaggttgttgtcctactatcgtcacgtataacatattgatgaatgagctttgccgtgagggcaggatggtggaggcaaggatgctgtttgatgagatgttgcaggctggagttgaagtgaatacaatcacgttcaatgttttgattgatggttatgcaaaggctggacagatggagaacgctaacatggcctgcgcagagatgaaggccatgggattaatgcctgactgctgcaccttcaacattctttcggctggagcatacaagtttgggaaggctgcgttgtttgtacttgatcagcagcagttgcatgaaatgtttggttcacagttgtcaacagatgggatagatatgttgatctgtagactttgttgggatgggcgattggatgatgcctgggagctcctgtgtagcgctattgagaagggtgttcaagtgagcgtttcaggatttaatgcgctgattgctgcatatagcaaggagggatttgatgaagaagcttttgagctatataaaactatgaacaaattaggtcttgcaccatcatcatcaactttgaattacttgataatgggactgtgtaatcgtgggagacttgatcaggcacggctgttcttagaatatatggttagaatgggatattgtgtgattgcatcttttaccatctacttggactcatccttcagagctggtgatgtattaggtgccttgaagtgttgggatgatatgaaaatagttggtttacagcctgattttgttgccttctcggcatatgtcaatggtctttgcagactagattttctagatgaggcttacaatggttttatcgagatgataagaagagggcttgttccaaataattttacttacaactccctcatatctgcattttgtagggctgggaatgtgtctgaagcattgaaattagagcagaagatgaggcagagtggccttgttcctgatatttttacgaggaacattttaattgatggcttttgcagagaagggggattgaacacagctaataacctttt

SEQ ID NO: 57920 - DNA, 970 bp, Oryza sativa
aagtgaaaggtgaggcaaacgcgcggttatataggcatcgatgaatacaaacacagcttgcttgcattattgatccatcaatcgatggatcgaccagctagctatgagcaaaaagggccaatttggcgccgaatttgcagatgggcgaattaaggccgtccaaactgaatgatttgatcacgtacgtccaatcctctctgcagcccagctacgagaaaataatgatctatccatcggttggtatacgtaggatccacgcaccgctttatttatgcatgcatgtgaaatcttaacagcaataagtacaataatcgcactgcgtcttaattaacttcttgtaaactgagtctgagagatgattaattgatcaggagtactacaatgagccgtacatcgtatctgcagtatatactttgcaaatgcattggattgttattggattggatcctttgaatatatgatcgcttaacacatgcaaatttaaaggtaatttattgtctgcatgtatatatgcacttagtacatatgtgcagcacaaagtactgacagataaagattttgaacatttgagattaattgacaaagcaggaaacataattaaggggtttttggcagaaggagacatggaaaaaaaaaagaggacagagaaaattcttctttgattgtgcggtcgatcagaatctagattacaacttatatatattgattgggtatacgaagtatgagattgtaaaaaaacaatatgtaattacttattacagatccaatagaaattaacattcatagatgagaaatgcccgtaggcttatattccctcatcagctaattgattttaaaaaataacttctatacttttgaggcctatggccatttctcatctatgaatgttaatttttgttggttctgttataaatatttagagatgaatatcactataattggcaaatataagcattgtaccattgtgcat

SEQ ID NO: 57921 - DNA, 1467 bp, Oryza sativa
ttgaataagacaaacggtcaaacatgtgctaaaaagtcaacggcgtcaaatatttcgaaacggatggagtatatatgtatacgattgagggctggctacaacctaacaattgcagctgacatttaatttgacatgtatccgtccgttcgtctgtatatagtatacgatcgaattgtttagtcgatttgatcacgacgatcgaacaggcgtacagcagcatgcatgcaagatatatagagtatttcttgtgtctttgtcttgttcggattgcactgtatgggttccaatgcttttctagcagtactccctccggtttaattaacgttttagataaggttgaagtcaaacttttataacttagactatcaataactttaaaaatatttagtttaaaggaactagaacaacatatatagatttgtcttttaaaatactataaaaaagtaaacatgcatttatttattatatatattataatagaaaaataaggtcaaagatgtatcttgtagaccgtgtcattgtctaaaacgtcaattaaaatgaaaccggagggagtatatacaaaattaattatactccctccgtttcgaaatgtttgacgccgttgattttttagcacatgtttgaccgtttgtcttattcaaaaaatttaagtaattatattaattattttcctatcatttgattcattgttaaatatatttttatgtaggcatataattttacatattttacaaaagtttttgaataagacgaacggtcaaacatatgctaaaaagtcaatggtatcaaatatttcgaaacgaagggagtatatagcaagatctctatagatatattccttccgttccctatttgacgttgttgacttttttaaatatgtttgaccgtttgtcttatttaaaaatttttgtgaaatatgtaaaactatatgtatacataaaagtatattttatgctgaatcaaatgataggaatagaattaacttagatttttaaaataaaacaaatggtgaaacatgtttcaaaaattaacggcgtcaaatatttagggacggttacgtctctctagctagctcagtagtggcatgcaaaataccataatgtagtgtgcatgcatggcgagagagagagaagctatagctgctggtggtataaattacacggggaatcgtatagtataaaaagaaaatttggcgggggcgcgatacatcccgccatatatacgcgcgcgcgctctcggtggccggccgccggcgtggtctaccacgccgcacgagcgcccggcgaccaccacccacacctctcccgagatagacagagagcttttctcctcgtcttcccttccgactccggcagggcagacgccgcgcctgcaccggcaaggcaaaacccccccccatccctgcatgcaaaccagcataaatatgtgtcatttttctattagtatctgcatcgggggaatatt

SEQ ID NO: 57922 - DNA, 8547 bp, Oryza sativa
tggaccaacggcccaacctgaacacctgggcttgatggagcacaagtttgagccgggcaattcttccttttgaactccaaataaaataaagcaaagaaaggaaaatttcagcatcctgaatgcgtcgacaccaagtagaataaggctgtgttcggtttcaggggttggaaactaatcctttcagcatgaaaaatggagcgatccattagcacgtgattaattaagtattagttttttttaaaaaaatagattaatttgattttttcaagtaacttttgtatagattttttttttaaaaaacgtaccgtttagcagtttgaaaagcgtgcatgaaaaaaacgagtgaggggggttgggaaaaggggcatccgaacacacccttaaaagtgactcgtaaacaccgcaaatacatgtacttcacaactactcccttcatccaagaatatagggtattatttctaaaatagcacaaattaagaaagagaaaatagtatatctgtgtagcttgaaaaaacatccttgacaaagtagtagtagtaccagtacgttctctgtaatctttttggtttttgacacggatggtgtggagtagtggtactactagacgttctctgtattttttagtttctcacagaaatcgattgatggagggcttgcagtccttgtttgttttgggagaagataaatccactatatttctggatatatcaatggggcaaaatcccctgtacttctagacatagtgagtatttctttcgtccctagttttaacataagaatttatcagaaaaaaaatagtttcagagtggtccactacacctctttgaaaccaatagtactctctcctcatcattttctctccatattactaaaagatataattttttttcaacattttccttaatttgttttgcttagctaaaactatactccctccgtcacaaaataagtacagttttacaccgtttatatccaacgtttgaccgtcattttatttgaaatttttttatacttagtatctttattgttattagataataaaatatgaataatattttatgtgtaactatttttttaaaaaaaatatataatttttttaaataagatgggcggtgaaacattgaacatgaatacttacggctgcacttattttagaacggaggtggtacctatttacggatggagagaataggtatgttgtgatattactaaaggtgcatcctgatgaacaaattactattagccaataatgtggagttcgggttcaatgctttagaggtaattaacatgtcgtcaaaactgtcaaatcatggtaagaaacctcagtcaagtggtcaaagagatgaccctgatgtgatcaatcgatgtggcacttcctctcctctctgccctaaactgaagaactgatgaaaggctggttggttgaatcacctgccaagccattctccaagcaacaaaatgtgcagaaatccactgcagcaaaagcatttgggcactggaaaatcagagtactctgcaaacgctcgtagtacctactcctactgcttataaacagacaaggtttttactctgtttcatgcgggagtatttacctgtcactcctcagtcaccaaagtaaaatgtgccggattgactgcgtcacaagttcagtggagtaaataaaaagtcacagggacgaatcaaccctgcactaaaaaaaagagaggaacatacatgagagtaagagaaagatagtgtactagctaggagtttggttgtaggtgtagcatctcctgatgactcagcagtaacattccttttccattttttttttaaatttgatctctcttctttctttctcaaaagcagctccacacaaaaaggacacattacaagacgagagacttgaaacgtgtctctgacatgcataccccaccaccaaacattctcactctcactctctctcagtaaccagaagaagaagaaagaagcaaagcatacaataggattaggaaaagaggcttacttttactaattactagcgctaattaacaatcttgcagtgatgatcaactagctagtagctcgctaaaaactagtgcaataatgcaaacccaacctctgataatcatgatcttgattgatctcgattaattagctagaggccgtggcggtggtgccggtgatggtggtggtgaccaaggacgaaatgcatcggtgccggagccggagcaggagacggcaccggagcggcaaagatgccggcggcggtggagttgaacggcggcagcatcgaggccggcgccggagcgatggcacccggcggcgagagggcggcggcggcggggtgaggcgggcactggtagcacttggcgaagaggccgaaggtgtcgacctggtggacgaagttggtgatgctcgcccacccgccgaagccgaagccgaccaccagcacccacgccaccacgaacgagtttatcacgtacgcccccgtccatcctccggcgaacctcggcggccgctccaccgcgttctgcaatccaatccaatccaatcagttattaattactatcatctcgtgatagcaggtacaatagctgactataagtcagctataagcatatttcaagaagataaaagagtagaggtaagagtagcgggttacagatttgtaagccagctacagcacagactgtaaaatgcatatgtgtatgacaggtgggaccaaatattgattatgtagtatatgtttataggtaactattgtatgaattggctattaattggctattaagttaactatagataatttagagtcagcagttagctatactattaaactgctctaattataattttcagttagattactgttcaagaatccaacagagagcagtatatatgaatgcagggatcagaaagaaaagattatgcaaaagtctaataatattgcacctttacttaattatatatgtttgagttattatactactgttaccgaattatacgaaacagaacatgcaactgtatgtattgtatgtactgtttcagaatcaaacagaacagtatatggatgcagatcaggaagaaattaaagattatgcaaagataagttaagcttgcattgggatgatgtcacaagtaggtcattaggtgaatgatggtattctactgctactagtatactgtgatgatgctgttgctgaaagctttatttttgttgctttctagacatggtatcatgggtgtcgacctagctctctctctaatgcaaatacaatgcaatattgcaatgcagtctgtctgctcggtgccaatggctcccggacagcagatggtacaaaaacattgcagcaggcaagcatgcagcacagcagcagcagcaagcgtcctgattaatctctacaccactttcagtagctttatggtacatatagcttttcttttatcatatcatatcatatcgccacttgctctggtttctagctcagctcaaaggaattgcatgctgtcgctgctcagatttgtcttgcattcagtctcttcttcaccgagaatgacacacttgcaacactcagcagcagcagaaacaataataatagtgtttaattaccagtgttacgttgagttcattggaatttgccacgtcccagcagcagatcaatcaaatagacgccaactagctagtcttgttaatggctagcgctagctttgattaattaagacaaacaattaattaattaattgatctgttctaattatcagtaagcactagaagaagcaagcaaggtgtgatggggaagcatggtgggctcatgctgtctaggctgcattgcaacaaccagctgttccatcaatcaccaaacatttgcttctgtatctagatagctagcatttggcaactatgtatacataggaacagcactgaaactatatcatctctacctaaagcctcagcaaatatggttgcaatggacccccaatgtaggcactcaaagacaaataaattcaagcatgtatatatgtaaaatgcattttgatgatgagaattagaaagataaagaaaattagtactccttccgtgttaggttataaaatgttttggttttgctcaaagtcaaactgtttcaaatttgactacgtttatagacaaatatagtaatatttataatactaaatatagtttcatcaaatcaataatgaatatattttcataataaatttgtcttgaggttaaaaatattactacttttttctacaaacttagtcaaacttaaaacaatttaagtttgaacaaagttaaaacgtcttataacctgaaacggatggagtaagaagaaaagtaagaaggtacctggcgggattgcggggagcggaaggtgaccatgtaggcgagggaggggatgatgtagacggtgaagctgacgaggagggagccgacggcggagttgatggggccgaagaaggggaagatgatggcgaggaaccagatggggaggacgacggggaggcgggcggcggcgcgcttgcagagggaggggcagccgtggaggccgacgagcttctcccagacgaagtagagcggggtgcaggcgaagccgaaggtgatgaactggtggatgagcatgagcaccaccgcggcgtcgcgccacggcgtccgcggcagcagcgccagcgcgttcgagtgcgtcagcagcgcgtccccgaacgcccagtacgccgccgacgccgacggcagcgtcagcgtcagcacgtacaccgtcgccagcaggtagatcgccttgaacttctgcggccgccacatcgcgtgcattatctccctgcatttgcatttcatcccttaattactttcttaattactactactataagttattttgactttggttaaaatcaatctactcccaagttttatagatataaatgtagtaatatttacaacaccaaatcagttcaatcaaatctataattaaatgtttattttggttaaaaatattatttttttcttacaaatttagtcaaacttaaagcagtttgatttcgaccaaaatcaaaataacttataatctaaaacggagggagtacatgtgtgtgctttcagattcgtgcaagagaaacgacgatgcagggcccagatgttggtgggcattgcgcatgtcatgccacgtgtgaccggacggtttaaaatatggcacctataagagtttataggtgtttgttctaggttcataacatcttttttagttataggtgaccgatcgaagttaaatattggttttctaacctgtaccaaagtgattttcctgtagtagcatgtatacagtgtggtcttgtcttgtcttggtttggtacataaagacacaaactatactccctccgtcccataatattaaggaattttgagtttttgtttgtaacgtttgaccactcgtcttatttaaatttttttaaaattattaattattttatttttgactttctttattatctacaatactttaagcataacttttcgttttttatatttgcaaaaaaaatttaaataagacgagtggtcaaacgttaaaagcaaaaacttaaaatctcttatattgtgggacggagggagtacaaagtagctagagatgatggatgcatgctagctgctatagactgagcttacaccaaagggcccagttagcttgtgttggcatttggcattacattgctataagactagcttgatccattaaacatggcaaaaatgactggttagaccacaaatacatgagtcaccaacgagatgtgatcgatgttcattcttcatttgctagcatatatatcaccctcttaatcaacttagacgaaaccaacagcatattatagccaactgccaaattgatatgagctatatttcgtaaaacaactacagaaatacattccatggctaatattacgagttttttcgacggttgcttagactcgacggtagcactggctcaacagaggggatttgcaattataacactgcaaacattaacttttgttataatgacactggacccatattttatagacacagatggacccatttatcatccactcgaagtgttaaaacagcgaagccctcatgtttacagtcccaatattacaattttctcctccatggacagatgaacgggacacgtgtacttggatgttaggaggaaccacatccacgtctcatcacgtggtaccccgtgtgttcctatatgtgcaagtggtggtccctaagtttaatgggaccacatgtcagtaagtacttcaagccatgcgtgcatggcacgtgaccatgcatgccattatgcctcgcatggtgcgcactcacgctccattagcagtgagccgttacactactgctaagctagcttaattagtggaaagaagtaaactaactaacaataggcaggcagcaagccagctataagtggatacagtactaatcgttcgtactttagagtaattaaactaaactaaacttagtaaaattaagtaggcactaatgaccaatcaaatggttaatcgagccatagctaatcaagagagaggatggtcggcttacacggtgacagcgtggcccccgaaggtgtagaggatgttggtggcccccgtgaagtagagcacgatgcttgtgggcccagagtgcgccacaccctccacctgcattattcccaatatatgcactattacaattactatctatcactattactatcattttgttatcataaataagtgacgtttgggactttgatcttatattaaaaaaagatgagtaattttacagttcttgaagatgtatcgtgaggtactattttttatattataaatttgatacattttggtacctaaatactatgaggtaccaaattttatattaaatttttggtacatcatgatacctcctcaagaactataaaactgctatgaatattatgtaagatatatatgtacctgtccgtggatgagggaggcgacggcgatgtaccaggcggtgtaggtggtcatgaggaggccgaggaaggaccaaatgcggtagttgtggaatgacgggatgaagacggtggtggcgcagcaggcgccgaagatgtacgtccatgtccgcttgtccagatggtcgttgatgtagtagatgttgctggcacacccgatcagttggatcaccgacccgaacagcaaaaacgtgcagttgaaggccagtcccacattcctccagtgcctccccagtagcccatccagcaccttaaaccactggttcaaaaacatgtatcaccatatcacgtactgatttatatatcgttaacgatattagagcaggtataatagtacggctatataaagccagccataaacatactttaagaagataaaaaaaaagagagacatgtatcatcatatcacatattgatttatatatgtgagagatcgattttatagtccttgagaaggtaagtaggtacctggatgacgtggttgcggaagtcgaccttgtcgcgctccttgcgggtgcggtactcgaggtagaggatgctgatgaggtaggcggtccagctgccgaggaggccgtagaagagctggaagaggaggccgctggccatgcccagctgcgcgaacgagtagggcagcgtcagcagcacctgcgccacctggttcgacgcgcagctgaaccacgcgtcgtacgccgaccccccgtgccacagcagccccgacagccgcgtcctcgccgccgtcttctcccccatctccgacgactcctcttccacctctccgccgccgccgtgctgctgctgcagccccagcgcctgcatcgtcgccgcccccggccccttctcgtccgcgtagccgccgccgctgctcccggacgccatgtttgttaattagctctgctgctgatgctagctttgagctgaactactcactgtgtgtgtgtgtgtctcagctgagctagctatgtgtatgagctgctgccagtgtgggtgtgtgtggtgtgttaagctaaggggaggagtgaggtggtatatatggagatggtagaggccggcagggctccagcagctggggcataaagaaatcagtgaccctcttttcctgtcccttttcctaacctttctttgcacctccctccctcttttcgcttcaaaattaaaaacaaaacaaaacaatgcgagagaaagaggagagaagagagcgtatgaagaggcacatgtgtcattttacgtacctctaacgtggtcattgacatgtgggtctagaagtagtgggctcgcatatcagtgaccaagtctcttctgactttaaatcggagattgttaatccgtgtgctactggggcttttctaacgaaatcctggggaaagaagaggcctgcaacctggggcattcatgccagggagagagatagagcctagtgtgagacataaagtagtgtacaaatctaagaaaaaaaaaattcaacttttcagcaaataaaatggtagatggatcgaggtgctactgctgcctgtgtgctggtgctgcgatgcaacacaactggaaggatgaggtgagtgac

SEQ ID NO: 57923 - DNA, 5924 bp, Oryza sativa
ccagcttacaggagaagccagcttacggcgtaagccggcttacgacacaagccagaaggtccaaggcttacgacgtaagcctccaccctcctccgcctataaatagggcccagaaggtccaaggcgaggacaaccgatcttcggtctcctgcttctcctcttgtagcttgtactcaaatccagaagaaataaagcttccactcactcatactttctgtgttccacaactctgtgtttggtttgcttgtgtgctgataagtagaatcgactggtttctcaacatgtcatcagcacgagactcttccgagctaaaaaggtaaacaggtgagaaatcagtttctactgatcatcttgctctttatatgcaaatcattcttctactatagttgaaataagcagaagaacatggtacctgaagtaccatcctccgatatcctctcagcaatacacgataacatgatggcggctctcccgccgttatcgtccaattgctagagttgatacatcctctcagcaacgctcggtaacatgatggcggctctgccgccgttaccgtccaaaggcttgagatggtacataatcttagcactattcgataacacaatggcggctctgccgccgttatcgcccaaattctagaggtgatgtaggtgcctgaagcaccggcatggcaacttaatggacggctctgccgccgttgccgccaaatatcggaggcaaacgaaccttctgcacaaccctgaagtgtcgttatggatgccctttgttttatggacaccacccatatgggcccttgatgccactaaggtcggctctatcgccatgaagcgtgggctcatagtggggaaagtactatatggtttatcttactttttacagtctgcacaatatacatgaagtgcccatgtatgctcttcattttgttttacatgcttactttgctgtttgcatgactttcataacattttttttgttatgaaattgattttctagcatgattgataatatttaatcaagcaatctgtaatcctgaagattacttaagttaatttgctaggaaagattctatgggaaactgtgtgataatcctgaagattacacacgatagtaatcctgaagattacgcatgaccaatttatgtcgaccccgcacatcgtatttacctgtcgtaaatactaatgatgttgcagaacatgtcggacatagcaaagaaggaattcaccgagcttgccttggatggtagtaactacctcacttgggcattggacgttgagattaaactcgactccatgggtctcgatcatactattgtgttgcccgaagttggcactgtggagtctacgaaggccgagaaagcaaaggcattgcatttcttgcgccaccatctccacccaaatctgaagtctgagtatatgaccgagaaagatccactggtattatggcaatccctgaaggatcgctttgaccagcaagggtcaattgtgctcccacaggcacaacatgactggatcaccctacgcttccaagactacaagtctgtggtgacgtataactctgccctccataggatcatttctcagttgcgtttatgtggcctgaagatcactgacgctgagatgatcgagaaaaccttatctacctttcatcccaacaacatagtgctgcaacagcaatacaggaactcaaagtacccgaagtactctgatcttatctcagtcctgttagttgcagaaaggcagaattaggttcttctaaagaatcattctgcccgacccactgggtctattgtaacgccccgattttcgttcgggaataaaaatcaattaataatacattttctagaaattaaataaaagttaaatcaatttaatcaagtgaaataatgggagaatttgaaattttcctttaaaaatcattggccgggaatattttgtaatattctttgtgccctaatgtactctccggaattttccgtgaattttcggagctcgagaaatagttttaatagcacaaagatcattgcatcaattaaaataaaaagaaaaaaaaataaaatcctccctcctctctttgggcccctttcggcccaattccccccctctctccctctcgggccggccttctccctcagcccgctcgcctctctctctctccctcaagtctgttttgcctccccagccggcctctccctccctccctctccgacagatgggacccgtggaccccacctgtcatccccaacctcaggccggcagctgccgttgctgccatggccgcccgagccgccccacgacgcggccgtttccgcccacctcctccaccccgcgcgcgcgcgctcgtccgtgggacctcgccgcccacgtccgcgccgtttccccccacctctcccctccaaaaccgccacccacaccccacgatgccgcccacgccaccggcggttgccgccccgactccgcctctcccgggctcgatcccgcctcccctcccctataaaaacaatcccccggccatcctctcccttttccccaactttcccgcactccccgcgctctctcccgctctccccacacgagcccaagcgccgccgatcgccggcgaccctccagccggccgctgccgccactgtcgacgtccccgcgccgcgccgcttgcaccaccggcttcgccgtgccttgccgcacctcggccccactccgttttcccatttcatcgccggaaccacctccccaccgcgctccctctctccaccactcaccgacgagctccggccgccgctcctcgccgctccagccactgccaagccgcgccctaccaccgtcggcttcgctgcatcgcgtggtaccccggccgctcttccaccttcgttggagaccgccgaatcaccgccgtcgtcttcgccccgtggagtgctgccgcctccctctgctcgagcctcatcagccgcctccttcgccgccatgcccctcggtgagctccgccgcctcccttttcgcctcctccgctcgttttcgccgctccccggccgccccctcgctcgtcgggccgacgccgccatcaccgttgtcgtcgtcgtccttcccgcgtcggtgagcatctccctcctcctcccctccctttctttttctctctttgcccgccggccgccgcatgcgtgtcgccgtcgcgccgcgccgcgccgccgccggtgtcgccgccggtggccgtccggccgcgcgccgccgtctggtcgggttggtcggcgagccaacccacccctccgccttgcacctctaccgtggactcggtccacggtgggctagatccttttgcccgctgacgcgtggggcccgctcatttggtggacccggtccaagcccgcacctccttgacccgctgacgtgttgggcccacctgtcggcgtcggcgccccttgctgacgtcagcgaatgccatttcctttgagaaaatatttaataattgcgcaataaatcgtgtttaattctagaaattcatttaaatggcccaaaacttctaaaattcatatctaattcattcgaactacgaattgagccattcaacttgcaaaattcatctaaaattgagctctacatgttggtttactttttatgtactgttttcttggtttttattagagtttttcctcgttttgcatgccagcgtgtagttcccgtcgtttcggaagatcgcgttcgcaaggataagagttcagaagatccaagtgaagaagcaaggcaagtcacacattccccttgagcatgttgatcccaatttacaaatgttttactgtttgcaaacaaatatgcatgttttgctaattacatggggtcagggttttacctatctgctcgcttgtgccatgtttacttgatatctgttctttgtcaaccttgggtaatgaatcgactagctcatgttacttatgtgacctagctagaactatatgcttagccatgcttaattaccactagctcagttgatgggataattgcagtattagacctttttagtatcagagtgagctgcgtgctcgagacacctggccatgcttcatggtcgtaattatccaactaaaatgcgactgaatggtgggctgtgggtgcatggttttgctggtcgcacccatggcagttaaggaccggttcgcgggatgccctggaagaacttatcgtacttaccacaagccagcgtgggcaacggctgggcttgtagtgtagcttttctctagccgacgtacccaggcgagggtgggcgtgatggagttgggtcggccggggtgtccggttgatcggcttccggattcaccgcggcacgaaaggggggctgcccgttgcctgctggggacgggggcgaaccctaaggtgtggtgcgatcggttagagggggttatgcgaagggtcctgtcacggcctctttccggtatgtcgtggtggcatgtcggcgcacgggaacgtgtcgtggggctgtcttgtgggtacagttgtacacctctgatcagagtaaaactattcgaatagctgtgcccgcggttatgggcggtcgaccagattcaccgtgattagtctcacacttaataaatcgacctaatacactgtagtttaggtgggttggttgggcctgttcaacgtggtgtagcgttgatcagtggagatttaatgttactttaattactcaacaattttactgttttgctcaataaaatgttttacaaccgcctttatgcaaatagccacaaaccgtccttgtgttccccttgcacgtctgcatcgttggtgtggcttgctgagtacggtggttgtactcagtcttgctattattcccccttttcagaagtgtagtgcttctgagctgaagacgaagttagaggaccaaggctcagaccccagttgagttttgcctgtggagtggagctgaagccccgctaggatcgcctttttccgctgctgccgcttttgtttcggtgtgaggactaagtgcctcttttgtaagtattttacgctttatttacgtttggaactgtatattacttgtcgttttgtgtaccctggctggtcctggacagggatttaatacacaaaatagtctggaaatttgggctaaatttctgggcgtgacatctatggcagtgcctgaagcacacgccaatgttgttggaaactcacatggccgtaaaagaggccatggtgaaaagaaagggaaaggtaagggaagtatcatattcaagggcaagagcaagggtaaacccagaggtaaaggcaaactcaagaaggttacaggtgaatcatctggggtaaagcaggataactgctatagatgtggaggcagagggcattggtcctgtaactgccatgtccccaagcacctggttgagctctaccaacaaagcatgaatgagaaaaagagccaacatgagtcccacttcaccattgagcctgaagctcagattgaaaagcatgatgacatgcttatcaatgttaaggatggtggggacgtccgtatggacgatgattgggacaaccttcttgaaaaagatgatgacatatttggagatctgaagtaatctcctatatgtcagtcatatgcagtgttccgcatgagtagcacatgtagaactttggtcatgaataatgctcctgaagagcacgcttagtcttttattgggcctgaagtccttgtaatgtttcccttaatagaatcaacttacttcatgtttaatttcatttctgtttatgttccataaacatacttgggtgggaatcccatggcagaagaggatatatgtctagtagacagtgccaccactaacacaatcttaagggaaactagatatttccacaccttaactaagaaaactggaaatattatgaccattgccggaagcaatgctcatatagtaggcaccggaagtgctactctagttctcccta

SEQ ID NO: 57924 - DNA, 4517 bp, Oryza sativa
tagaaacatacggtggtggcgtagtctgcagtctgcaggcgcaaaatacctgctttgtcttgagtgcaagctagcatgcatgctggcatgtagaaatggagagaaaaaatgtgtagtgcccatgatatcttaggtgcttttgctcacttgtcaaccatgtccaaggtcacactggctattactccctccgttccaaaatataagtgattttggatggatgggacatttcctaatactacaaatctggatagcgatctctatccagattcatagtactaggtctcatccgttcaaaatcccttatattttaggacggggggagtctcatccgttcaaaatcccatatattttgggacggagggagtactatatagacgtcgtcgtacgtactctcatatatgtgcatatatggtttttaataatcttgaatatatactgagttagtcaatttatttaatctcatactaggcatttgttagatatatattatttttctccaaggcttcaaaatcttgggatccaataatcacgcaaagtataaaattcaattgaatatggccagtgtgagaaattcaaattataattaatttgaagttgtaactataacttgaagaaattcaattcatgttaatatattacctccgtacataaatataaatataaagatatttggctataaacctatttgtagacagaggtcgtggtcgtatactgtagaacttctgaccagttcaaaaactaatatagatagtgttacccaagataatgagatctgttgagatattgccgagaaaaatgatttataggaatcacatgactggaaaggttgaaaaaatggaacttggatataacatggaaaacccttgcaggagaaaatagacgtactaaggcctaatcactactttgagaaagtagacattataagtaaaggtgggtacttctatgatgcattgtctacttaattcatttctccctttcaacttgggcgtgttgactttcaatttgatgtttttttttctttcaacttctcgctaatccattttagacttaactggttgtaaactaggacaacttagggtgagctcggctgcaagggctgcagcgctgctgcaacctgtacgaacagtgaagcaagaaaaaaaaaggcagctgctggctgcagccagctgctacacctgcttgccgtacaggcccttatacaatagcataggaactaactaaatagcataggaactaactaaacataaatattttcaacgaattagttcaactcatgtaaaaatatgtaaactaaaagtatattttagttctcgtatacattgaaatggtatgccatatataatcctcatcaaggtctcaaaacccatctagatacaatataatggagaggaatagataaaaaaaaaacttagctagtgaaatctatatatcagtgtgatataggtgtacatgtacatgttttttattactttaatatacattaaatgttagtatcggtagtgatggtggttctatctgcagtcagccactacaactgtcatgtggggccccaaacaaaatttgttggtggatcatatttgtcaagctaaccactggaaaatatatagcatgaatgattttataaaatgtatgtcaagctaacatataatgttcgactgatttaagtagtattatctgataattagataatagaaaatagtctaatatcgaaaccatcacacgaggtcttttttaaaaggaaaaagtacgaattaccccttcaaactatcgcggtcgtctgaattaccccctgaatcacaaaaccggacattcttcacccccaactatgcaaaccgaatgaattacccccctcgacccaatccacggtggttttggtctacgtggcagtccagttaggaattctatttataaaatagttgtgggacccacctgccatacttctattctcactcttcctctctctctctcacgggtggcaggcgagggacagagcagcggcggcagcgcgagacgcggagacggcggcggcaggcgggggacagggcggcggcgggttgccgggagagatggagctgtgcctccaccggtggacggctgcatggaaggcggccaccgccgtttctccctttcccctctccttttcctgcaatatagcagcggaggtggtctgggcggagaaggccgtggcagggagggccaccacctttgcgcgagcgctctctgctgctaggagcagtggtcgtcgctgcagggaggaagaatggacgagaaggcagctcagtcgtgtcgtcagccgtttgctcccccttctcttccgctaggtccgccttctcctccgccaccggccgccaggtctgccttcgcctctgccactagccgcctgggcgcctagtccgcctctacgtccacccatcaccgcctcgagatcccccttcgcctcacctcagcggatgggtggatgggccaccatgctgccgccgcgtgacgacaccacacgccgccacccggagtacgagctggtgccgaacgccggcagggacatggtcacaggtctcccccacgacgcactcgtccaccgtcccttagcctctgcgctcgccgccacactcgtccaccgtccctcagccaccgcgccgccgccgccgcctcgcctcctcagccaccgcttgcatagttgacagtgagagaagagagagaggaagaatgagagaagagagagaggaagagtgagaggagtatgacaggtgggtcccacaactattttataaatagtattgctgactggactaccacatagaccaaaaccaccgcagattgggtcgaggggggtaattcgtccggtttgcatagttgggggtgaagaatatccggttttatggttcaggaggtaattcggacgaccgcgatagttcggacgggggagggaggggggtaatccgtactttttcctttttaaaattccgttgtaacgcacggtgcaaaggagaaggccggcacgaacatgtagccatgattggtgattctgatgagtcatgagcgaggagtccccgtcatgtgtagtctcactacatcttgactggtcagtggtcactacataaccttaacaaatgccttgtccttacttaggggtacctaataggccatgcgtgcctcttcaataagatgcaggttttctaaccttgttggctgtgcttttgatgtttctatatccttaattctctgtagcacataggatcggtattgttgttgtagtagctagctggcatgatcatatatctgtaggctccaaattatgcatccaacagtgaacaatgaaaacttatcccagaaattatggtttgctactcctgataatggtgtgatcatgccgtcaacatgtaatctgattcgtatacataaatgttgtacactctagctaggcagctgctagaaatgttgttcctccgcttccaatgcaaaacatggaatcagatagaatttgaatttggaccggaatgtgatatttaatttccttcttatatatcttaatctagtgatatgaaaacagggttttgtgtggactgaaatctccaaaatcagtaagatttggagaatttcagtaccctgacagagtgcattctcaataacaccaactactcccttcattccataataaaatcatttccagatacattttattctgtaactgaaggagattgaattttgccttttttttccactgaaatttctcgaaattcttcacatacctgtatgaaaaattaagacatctatatatattacagggaaaacataagatctatttagtaggagcaaaaataaaaagaaatcccttggaattcccaagatctattatatgtcactggtggacaaaccctttttaatcccggttcacaacccccctatagtcccggttatgcaaccgggactacgaatccgggactaaaaatacctatttttagtcccggttgaaataaccgggactaaaaaaggatctttagtcccggttggagttaccaaccgggactaaagatttagtcccggttggagttccgaaccgggactaatgctcttttttctttttttttttggtttcctgctgcttgcatgatttcgagccccacgaatctccacaaatctttcgaacaccacgtatcattcaaaaaatccctaaatacatcaagctgcattttctatccccaaatacatcacaaatcattcacaaaatcacaaaatcatctccacaaattcattcacacatcacatatcacacagatcagaaaaagaaatccacatcgcacagatcggccgcacagatcagaaaaagaaaccacatcacacagatcgaccgcacacatcacatagatcaggaaaaaaccacatcgcagagatcgggcgccggccgtccgccgcctcgccggcctcccgcccggctgcctcgggctccgccgccgcctagggagcgtcgccgcccgctgccagccgcctatgcggccggtgcccgcctgctgccgcctcgg

SEQ ID NO: 57925 - DNA, 1264 bp, Oryza sativa
aatgcctctctctctaacctaatgatgctctctttgctgcagctgctggcttgggcaaagcttgctcgctttgctacctgctgcatgccctgcctccttgctctccgatcacccaaccgctccatgcacaaacctgcaaaacacctctctctctagatgtgtccctgtgtactggaccagccatgttgcttgcaagcaatgctgctgctgacaaattgggatcacaaggaaaagaattagtatattctagctagctagctgctgcatcagatattcagagatggtgagtgaatggtatcaatgccctttcagtgtcttgcatggtgtgctgcctgcagaaaaggatagcttgttgctagcagggcacacaattgtaaaggtatgcaacaacaaggtgctgcacatcatgccatttccctggcatgtggatgctgctaattgcctgacaagaattgggccaaacagcttttagctttcaagggagagagatcggtcgatcgatgagcgtgtcaacaaacgcactcgatcgatcatcagatggtccaattgacagatatatgttcaggcaacggtggacatgctgtgtgtgtcgatcgatcgtacgtccttcagatcgaaatgcatgaataattccttattcctgtcctaatttcagatgagagatgctgcaggtaacgttaactatgcaagctactagctacctgcaaatctgcaacttgctgccttcagaaaagttcagcgaataagccactacaaagttcagagatcaagcagctgacggtgtgagcacaatgcctgacgtaggatcaagctggctacgcatgtctagctcattgcttgatactactcaaaattaaactagctctacacatcagattctgagcagttacaaaaaagttcaaatctgaattattacttcaagaactatagctagtatgttgaactatatatactgttggtggcaagcatcatcaggtcgatcttgatgaggattttgcacccaaaagacaggtaggaaagaacaatgagagcaggcatgatgctacttaagccccccatatctcctgagagtcatgtgaaatcagaccaagatctcccaaaggtataaagtacaaacatacacacgctctctctatatactatatagtatatttatgtctgcagttagctcttcatgcatgtgaatgtgcaatacttgattcctctctggcgtgtactatatagcctattatacttgacaaaccctgacaaattaaacaaatac

SEQ ID NO: 57926 - DNA, 4534 bp, Oryza sativa
catttgattcaagtagcaggaagttatagaaaagctagattcagtcatggtatgccacatcaccgttagtaagtttgtaacaattattttgtacgtgtagccttttcctttgctgaattacttcaaactatttaagaaggtttacagtttacaccagttgggatagtatttcatggacaggtttcacctttagattataaacagtggttacctttgttctgttgtggttgaaattttacctgccaaacactttgtgagcatcagaacaaaaatttatatctcgatttgctcatatgattctgtacatgttcacaatgtttctgaatatttatccggtgcaatagatgaatttattcatgtacggtactcaataatatctggataccacactgttgaatacttgaatggcctaggaatttgaactggtaagatcaaattatggcaaatgctctgatgcactatggttatcatagatggattatcgttagtcatcttgcttcatcaggcaaaagcatccatagtctgagttgtttctgaaattttttttgaagggtgtgtagttgatttcccacttctgttcttgtatgattattataccatttctgatctggctcaaaactatcgaaatttcctctgttctgtttgtcttgtggttgaaattttagctattcatgactcgtgagtagcagagaaaaaaaaatacttcaacttactcatataattctgtacatgttcccaatgtttgtgagtacttatttgaatataatagttgaatttagtaatagacagaacttggtaatgtttggataccacaatttgttgaatgacctagctttttaaactgctaataggaccagtaaattgtggcgaatgatctagaagttcatttcttcttttgcttctgcaagtattttttttatacatgttttcttagatggcttcccccatatatgttccatatttggcacagtgtttcatagatttctagttatgattttaacttaatattggagtcaatcatctgctttattgtatgtatctgatggttagtttgtttctttatgctttgaatgcaaagtgcttcaagatcgtaagatgggtatgcactgatcttaggtttagaatttctacttgtggcataacaatatttgattgctgcatcctgatagttcctgtgattggctttgctcaaaccactgatcttatgtttaacattgttgtatgagtgcctttggtactattcatatctgtgctcagtattgatgttctcctcgatgtcacttcttttgcatatgactttcacaaacagtggaaagcctaaggactatgatgtctgtgaaggaaccaacggatggccatgcggtagatccggaaaaatcctctgaatcaagtgtaggagtttgttcaaaggagctatctgacagttccagtatttcctgttgtagagagaaccaacgggacttaaactgcaaagaagtcctacacgaatcatcaatcaatagctcccctaaccccaccgtttctctcatttttttggattatttttgggctccttgtttaatttacacgttgtcttttactgttttgggctcctcatgcagattagcttgacgctttgccttgttgtgtccggtaccatcaaccgggtgttggatgtttatgccgagcatgtatgctctatgcgttttttcaaaaaaagaaaaactctcaggaaacaacgaagtagtcctccttattctaatttttacgaaaaaggacttacctttatatgaaatacaatgtaatcccaaaaagtacgagggcattctcaaaaaaacagatcctaatccaatccctcctcttactctgctgccaacccatccccaacacgcaacatctctctgcccaatccgccatccccatccatcaggctaatccatgcggcctcctcccggccgggggcaaggacggcgccggcgtttacaaagacgacggagcaaggggacgacatgcctcctgtgctgacctcctctaccgtgatggcctcctcgaccttgtggttgcgtccacggggggagggaggaggcggcacccgcccgagctgccgccggtgctcccctcctccttctccatccacttgtggtgacggcggcggtggcggcggggggagggcagatccggcgcccgacgccggcggatccgccgtcgtgccccctcccttcccttgtggcggcagtggcgaaggtacctacgttggcggcagagccggccgcgcgtctgccgccgatgcccttccctcatggcggcgtcggaccggccgccggcgcaggactgccatacgtcttcccccgtcgccgcgttgcctctccgtcctctcctccgcagcttcccaactgttcccctctcaactctcgacctctcctctctacgcggaacaccatgaccgtcgccgccgaggtcgacgcatcccctgacggagaggagaggaggaggcaagcttgcaatcgcacaaccatctatcgatttctcccttccttctctttcttctttctttctttctttcgtttccccctctcacatgtcaggttattttttctcctcatcctctccggatgatttcacttttgctcgaaatctctcatgttgttgtgttgaaggcggcgaagggggaaactttggtggtggtggtggccggagaggaggatggcggcagcggcagtgacggcggcgggtacgacaaggccgggatggactccggcaagtacgtgcagtacacgccggatcaggtggaggcgctggagcgggtgtacgccgagtgccccaagcccagcttctgtcgccgccagcagtcgccaacatcgagcccaagcagaagatcaaggtctggttcccaaaacagaaggtgagcaaaagcatgcagggatatactatcaaactggtttgccttctgtgtgtctggctgtgaaatgttctggacaaattggttgacaatggagcaatagcaatagtagtgttcaattgtttgccttggttgtgcatactctgcttcaactatatttaggaattgcaagtctatgtatttatttgttttgcttcctttcttgcataatggaacaacctttatataatcaaggaagtatactgtacttatcagagtatgtgccagattaagccatccattaattagatgctgaagtaaactatatgactatattgcgatgtattctaattccactacttacaaaactgtagggtataagatttgcttatttttagaagataggctaaacgaggatcctttaggtgatatggccaaactaagacacatatacataacgtattatcatgcatctgatagtaatgcaaaacaatgcagtcctatttactttcactgcaggtatttaggctcatcttttatttttctcaagaggcacttaacatgatatacaaaatttgaagagttacattctttaaaaaacttctatgagttctgcctaaatgattgttatccatagtgtgcctaaataattgttcgatctagaggtgatccaaagattcgtctatattagacgtaacaataatgcagtgttttttttgtttattttttagcctacaaatgtttgacaagaagaggatgaaagagtgacataggcgagctctgtagcatatatagaatgtttgctatccactggtacatctttaacccgagcctacctactgtatagatgtgtttagtacgtgcttactatgcttaattttggggataatatagtgcgacgtgtaagaaaattcagaactatgttgtatgctctagctgaatttgtttacttcctacaaaaaaaatggatgaactactgatccagttcatgttgtgatcctcctccaaggagtttgttttgtttctttgctatctgaaagattccttttttttttttttgctttgttgaagtggaaggagctcattggtgtacctttgttgaaatggctccttttaatcctcattgtttcacatgtctgtttcattttcgtttttaaggggctggccttattaaaggttgtttaaaagcttaaacaagacttctgtttgattgatctttagtccctattttacctaccaggtgaattgtcgcctcgggtaagatattgctaacagggaattaactctatttcattgccttgtaattaacttgttatactaaatcagaagattctccggaggaggggatcaggggagaagaaaccaaagaaatggcagcaaccctcttttttccggaggcgatacattgatactacttcgatagtagtagcggtagtagtcgtcgtctatatggatatagaacgctacagagttcactactgctttagctattgatactacttcaatagtagtagcagtagtaatattttggaactaaacacggtcatatatatatatatatataagcaactgcaacgaggctatagggtcgtaaacaattcactgacacgtaccgggcctctccatgtttcatgagacacacgtcatacgtgcagtatgaattatcacggtaacagt

SEQ ID NO: 57927 - DNA, 619 bp, Oryza sativa
aagacacccaacactatattcaagacacatgatcaacatacaagccctcatacgccaagacatgatgccggatttccattccagggataagcacggctcgtcccctacggagtctgcagatactgacgggagagacgactgcgctatctttgatctcgccgggcgcgaactctacgaggaaggctaccctgttgccaactacgagtcagaccttcacaccgccctatcagcaacagttagatagactaccccaaatattgtactagtgtgaacatgatgaacaagagcaatgaccgggatcagccaacacgatgtactggttataacctgacaattcaggcgccctaacctgtataaaaatgcctatatccatctctattacctcagtctcgtgtatatactactcccaatgatccccataccatgcgaataccggaatcgcgacatcaaacgtcgacaggagggcacgatccagcgggggtcaagctgccaagttgtatgctctatcaccagcactaatatctaggttgcagtcaaggaagcctcgacaaaatctcgctcatcaacgacctgaccgtcaaaaataccagaagcttgtggtatacatacaactgcaact

SEQ ID NO: 57928 - DNA, 555 bp, Oryza sativa
ttttagattagacaatttatcggagtgatattgtcatatagaacttgtttttaacagagaatagcatttgcagaattgaaaacacagttgctggagtagttgctacggtgctcacggattctttttccccatatatgtgcacgccgtttgtgattctcgttgcactgcgcatgtgtgggtgatataatttctgaaagaaatttaaaacaaaaggaaattaaacgccaccgctctgactattcttaggccttgtcttccacgtggtgtcggccagcaaaattctgaagagcttaatttggaaatgacatcaccatcatgatggtcgcaattaggacacgtttgtttacgcgaataaacggaccaattattaggaattaattagcccatccattaatgtaagtttattccagcattatggagcgtacgtgcactaccaagatacttctttcgttatagtaattcatattgtaagtatgtcgttttgagccaaactttattagaaaaatttagccacatattacaattaaatataattttaataatttatttgatttg

SEQ ID NO: 57929 - DNA, 930 bp, Oryza sativa
agctgtcttttaacaaattcatgtgttaaaagaatggtttctgcgagtgacaactgctttcataagtattattttagagaagatatatattccctccgtcccattttaagtatagttatggtttttcgcgaccaactttgcccgtctgtcttatttgaaaattttttgaacttatatttgcacttaaaatgggacataatgagtagattggagtaggttgcttacaaacttgcaatgtttcttggacagtaagtgaactcaaatcataattctctaccatcaatcatcaactcatcacctaacttcaaacctttttcccctaaaatcgatgtgattccgtggcatgcaaagttgcgaacgcatcattgctttgtttacctgcagcagtagaacatagagtaggagactccgttgttgcttcccgggaaatataatccgttgcggggccgccctcgtcctctatcccgccttgcctgccgtcctctgcacccgctggccgctgcttcgcctcgcctagaaagagagaagaggagaaagagggagggtgatgacgtggatcaccctgacatgtgggctccacgtaggtctcacgctagctcagccgtcacatcggataaaatcggatgcaatactgctctatgaccgattgtgacgagtcttaattaggcatgcaaaattggttatatagcatcgaaagttcacatttttggttttgtagcaccgaaagttaccggttcactttaatagcatccaaagttcactctgttcccatttttagcacttccgtcaatttttccgtccgtcttgatcgttattgatctagccacacacatgatatgacatttctacccctcattgacatgcattatacttgtacttgtgaggggtagaaacgtcatatcgtgtgtgtggctggatcaagacggacag

SEQ ID NO: 57930 - DNA, 590 bp, Oryza sativa
ttcttaggataagttttttaaaaggtttatttataaaataggttttcaaaagggacctaaaagtaaaaaaaatccagacgccgcgatgggttgggttgggtacttgggttcgggtgactcaagtagaactggggtttaatccgcatcaccaaacacccctccacttcgtctctctctctcgcccaagtccacacttcgtctctctctcccaagtccaaggcctcgattccgtcgtgagagctcaccatggcgaaggcggcggcggcggcggcgaagaaggtgctcaagatggctgcgggctccgaggtttattatctctccccgtctcggtctctctcacttattttgttcctcctcttgtgtttgtgaagctgatcacgaccgccgcccccgtctcggtctcttctcacttattctgttcctcctcttgtgtttgtgaaggtgatcgcgacagccgggaagaggaggggttccgaggtgcacgcgtggcgccggatctcgcgttgcatgtctcgatccgtcttccccatctcggtttctctcactttacgagtttctcttgtttgtgcagctgttctgcccttctccgc

SEQ ID NO: 57931 - DNA, 593 bp, Oryza sativa
  unsure (1)..(593): unsure at all n locations
cgcagtcggatctgatttttgaagactaatgaccgnctacaaaaatataaattggggtgatgttcgctgtccgcctacgaaaatctattttcgcacgcggaccacttaagcggcgcctacgaaaatgattttcgcaggcgcaccttatatggtccgcctgtgaaaatgaggagcaatattaatagactaggctggagtagtttttttctaagtctcattctctccctcacttatcctctccctcacctctttcccttagatccctctacctcactcttctctcctctcctctctagcggtgcggagggaacggtggcccaccggggacggcgactgcatgcggcggcgcggcggggacggcaaggcccggccggcggcggcggttccctccgcccctccctcccaaatatggccggagaaaggaggggggaggccgccgggggtaacggcggcaacaacggcttgggccgttgttgccgccgtgacaacccccccggggcggccggcggcggcgggttcccttggccccttccttccaaaatttgcccgaagaaggaagggggaagcccgttgccgggaccaacggcttgaac

SEQ ID NO: 57932 - DNA, 530 bp, Oryza sativa
agattctttgttatccgtattagctatacttttatttttccagggtaatttagttttaagtgttcaaatcggaagcactgaggctgagagaaatgctgactagtttatgtacttacatacctaaaaagccttctgtgtatgtgcaatattagataatctgtgtgggcatcaacttttgtactatttaggttacaagccttatttttgcaggaatgcactaaatgctcctgttctgtagttattgtttctgcatgacctgagtactttagtgtttctatatattgtgtagttgcttgcatgctatttgtggtgaataacttatgaggttgtacttttgttataattgtggttaatgtactttaatccttgcagtccaatggtgaaagaggctgtggaaatgtccacagacgaagaatcagacggtgtcggtatatgtccaccagatggcaacaatgatgatcgagaggaagccattagtagtaatatcatgataattgccagaaaggcgaagtacctgtgttaaagacccg

SEQ ID NO: 57933 - DNA, 755 bp, Oryza sativa
aagctactcccaggcggctggtgaatgcacctgacataattcattttaaccgtttgaaaaaattacttctgtagtgtaagtgtttatcctcagtaatacgatacaacaatgtggatgcttgattttctccaagtatacacgggattagtaatgatcgatcagttgatcacccttaccttaccttaaatggtaacctgccgtttggacaaataaatggacggggacaaatcgatcggttcttaattagcgagattaattgttagcgacagaccgatcagttgcttgcttcgctgccgagaatctgtcacgcatgcagacgcgtgctgctgttggagggagcggccagaggaattgatggctgcccctgtcgtttgccgcctgttggctacctgttcccaaattagttgtccaaccaccatttaaatttcacttatctccctaaagtactgcttgtcttactcactccgtctaattttatagagaaaatctataaaatactattgacaagcattctaattccagaaatatcatcgacaaagacaacttcctaaaaataccattgcacgaacctctttctcccaaaaatactatcacaccataagtattgttaactcatctccattaagttatatgaaaagacaatcttaccctaggcatccatttgcacacacatcatcattctatattatttgctcacacaatattattttgcattcatgcatattttttctgtccacaactagggctgcaggaat

SEQ ID NO: 57934 - DNA, 663 bp, Oryza sativa
aacttatttattcatagcttcagaactatttgatgacgtgacagcaatacaactctacttctatttcaaagaaactaaaatttaatcccatgcaattgtgcaggatatttgggtagtttcataacaatctgaaaatgtaaccagataagataagtacctccgatggaattaggagcgcctatgtgtgaaacatctgcattcagcaaggatgaaccagctccaggacgctcaggtggaactgtgccagaggcctgaagatgaaaatgacatgagctagcatgataaaatgaacagaactacataaatgattataggataaaccaatcagtgcatgttgctctagttgtccattttaagtccaatgtaacaaaaaattgaattgcaaataataaattataggcacaaaacgaggcatagccacacattgcaacaacataagctgggaaaaaactgaaggcaaccaacaaataggctaatttcagcaaatgaaggccagtgaccatcaaattctggagcacataaataggctatttttcgtttcttagaaaatcgatgacgacatagaaaagacaaattaagctgacatcacccaactaagcacaagcacctagaaatggctgtgacagcttatacgcatgccagggcggattcaacgtgggtgca

SEQ ID NO: 57935 - DNA, 3891 bp, Oryza sativa
ccaaatggcacacaacgccggtggggggatggcgtatggcgtacggcgacggcgagggtaggcggcggcatacgggactacggcggaggccggatccgctggccaggagggcggcgcccggtggtatgacgataggggggaggcggcgacggcgggaaaagggcggtcgttgaaggtgatggcggtgggatggcgcacggcaatgatggggggagaacgtaaggccgtgtctaggggaggtcggatggcggcgaagggagggcggacgacggcatagacagggctacgccgccggggattgggatcctcaaacgtgaagtcagagggacgtggtgactgatatgtgggccccaccgctcgtgggcccacctatcagtgaccacgtcatggggcagttcacgtcagagggaccctctccgtgccgtcgatgcgtggcgtgggtggggcgctgttgggaggaggtgggaccgtgggagacggcgggtagagttcgggaggggatatattgggttctttttcgagaaaaatcatgtgttttttctattttacagcgctacctaggaatgcaagcagatcaatccgcaaacccgcttatataccaatttgatatataaatgagtttatgggtagatccacttgtttctctacaatgtggcaagccaagttaatacgtgaaaacccacatattaccctttatttaacatataagtaagttcgtgggtcgacccgcttacatcccttgagccgctaccgctagaaacggaattttctctttttcgtgttgtatttctgtgaaacacgagggaattttcagataaaacacaacggagcatcagtccattcgaggacataaaatacaaccacacaaaatttgcgtggcagacatgcacgctgccagtcacaaccaggagggcgggaggggggggtgaaacggtcaccacatgcatggctgcacagggatttgactgagcatttgctccctgccagagttcgtagcctaatcgagaagcttttgcgcctgcaaactacttcctctgtaaaaaaaccaacttagaagaggatgtcacctccttacaataaatatggagtatgtgccacaagtaccgtggagaaaaacaattaaaaaaatgagaaaaaccgtatccctagacctgttatttattgatgatgaccagtacgactctacaaggatattccaaaaaaaaaaaagtctatagaaaccatcatgatcccccgattcacatagctgcggtacgtccaaaaaaccctagccgcattgtacatgaaatccgaaatccaactattttaccttccgtttgtattggaagttggtggacgtaaacatgttcagattagaaatcgagtcgctgtaactattggcagggtaggcctaaaatggagacatgcaccatatgttttttttttacaaactaaactgttattagtactgggattaaggcaaattaagaggagagcagctgacaggtcttacaagagaagctagggctgacacaaattaaagaaaaagtgtgggtggagatatgagaggatgtgcgcgaattaagtcttttgtcctactaacttcattttaaaatgtgtgtgttataaaatgattgctacagatagttcaacaaaaaaattataactcttataaaaaaagggagagtgacatttgtcatgaatatggtggttgttatacactataaatattaccaaaaacaacactatctttaaacacatatattatatgttaaatagtttataactgatgataagagtatgagtatttatatttctaagtaataatgtagagtacaacaatgacatgtctttatgcaatttcattaattaaaaatattaaaataaattatatatatatatatattattttgtaaataaatatttttatcaagctgttattaaaaatctaagtttgctactcattattagtctcttattagatgaatgtataatacaatttatccatatgtataaattaattatttatagtaatcaaatattctttcagtatccaatataaatgatattcatctgtcgtataaatcaatttttacacaaaacaataagaatatctaagtgtgaggtcttttttttcgtccatcttattaatctaatttgtgttagctcgatttagttaacatccttaaggattgaaggagtttaaataaagttaggtaatttttaaactatcattttgtattgtatcataaaacaaataatgttactatacaactattaataattatttataattttacttatatagaaaggaatatcgtattttatatattccaaatttatattacttacaaataagtggatatatatatatgatacaaaaaagtaatttatatttaagatgaattaatataaatatttttatttaaaaaataatattcttttttacttaacaaacatattaatttagtgtattcaaaaataagaaatttaataaatatgaatttattattgttaacgaaaaacacagtggcttcgaaaatttacttaattacaatgtaggtccaaagttttggtttaagaccaataaacaagatatattagatgcggaacccaatcatgtacaatatgactaccaagaatggtacttaatatgagtacgaccacattcaaccttactctcaacgtaatacatctcacaaccactatcaacaatactgcagctgttcaatgctaattattctttcgttaattattttattattcttaatatatgtactgggattatttacggagttaattttaggaaggacagatacaccctttcctagtaattagcatgagagagacgtcttcttccatagtttaaattagtgagtaaaaatatatttttaattgaacaaactatatacactgcagtgcatcaatatatgcaagtgatgaagtgaagccataccagcttttttttatctcgtttaaacaatgtacttttgcagtcatttaaagattttagagattattgtcttatcttgttgaggaagagctggatctaatcgagatagccgttaggggaaaagttgatcgggtgggcaggaaatataaagtgttaccatgttacttttgctagtaatttaaagattttagagattattgtcttattttgctgaggaagatctggatctaatcgagatgaccgttaggggtaaagttgatcgggtgggcaggaaatgtaaagtgttgccatgtttgagttgtcaataggttgtataagggcaatatcaatgcacgtggaaaaactacaacggaagactaatttattccattgaggaagagagactaataattcaccggaaagaagaggggaaagtaccacatgtttcaattggttgatccacctaacttacattttcattttgttatcgtcatgcgaactggaccccctctgcctgcatgcttcgtcaatctgactctcaagtctctagcctcgtggatccacaagcaaaaagaactgcctgcatgcttcgtcaatctgactctcaagtctctagcctcgtggatccacaagcaaaagaactattcagattttagagctatgtacacagaattatagaagggcgtcgtgattgaaattcggtattcgttcgcaattccctgtaattatcaagctgtcttttaacaaattcatgtgttaaaagaatggtttctgcgagtgacaactgctttcataagtattattttagagaagatatatattccctccgtcccattttaagtatagttatggtttttcgcgaccaactttgcccgtctgtcttatttgaaaattttttgaacttatatttgcacttaaaatgggacataatgagtagattggagtaggttgcttacaaacttgcaatgtttcttggacag

SEQ ID NO: 57936 - DNA, 4581 bp, Oryza sativa
tgcatgaaaggaaactatcctaactgaataaaacagcttttgcaggcacaagtttaacgtaatatgcaacaaatctccccctaaaccttgtgctcgcgacttacttccaaaaccccgatccgcgagcgtagctcctcaaaccgcactcgaccaagggacttcgtcagtatatcagtgacttgatatgcagtcccagtgaattccaactgaactcgaccttcttccacacactcccggatataatgataccgagtagctatgtgttttctgcggtcgtgaaacaccggatttttgctcaatgcaatcgccgacttgttgtcaaccatcagcttgaaaacatctggttgagcttgattaatttctcccagcaactgtgccatctagacaccctgacatgctaccgtcgtcgccgcaatatactctgcctcgcaagacgaaagagcgacaaccttttgcttctgggattgccaactcaccggactggatccaaggaagaacatgacaccgctggttctttttcgtgtatccacatcaccggccatatctgcatcagaaaacccaactagagtagccggcgtctccgatctccggtagatgatcccgtaatcaattgtgccagcaatgtatcttagtatccgcttcaccgctgcctcatgctcggcagtgggcgcctccatgaagcgactgacataacccaccgcgaacgcgatgtccagtcttgtgtgaaccaagtaccgcaaacttccgacgatgctgcgatagccagtagaatccaccagtggtgcatcactatgtttgctgagcttgagccgctgctccattggcgtcacacaggcattgcagtcctgcatccctgccttctccaaaatacgacgcgcgaaggccgactgagtcagccgtgtgctgcccgccacctgtttgacctcaatccccaggtagaagcagaggagaccaagatcgctcatcctgaaaagagacatcatctccgccttgaatcgatcaatctccacagcatcacttcctgtaatgattagatcatccacataaacaccaacaagcaagtggtgtgttccctgaccttgagcatacacggcgtgctcaaagtcacagcgcctgaaaccaagtgacgttaggcttgtgtccagcttggcattccacactcggggggcttggcgaagtccatagagcgccttgtccagcttcagcacttgatgttcatgcccctcgaccacgaagccaggcggttgcacaacatacacctcctcagtgagctccccattgagaaaagcggacttcacatccatgtgatggacaaaccacccggcctgtgcagctaaagcgagcagcatgcggactgattccagccttgccatcggagcgaacacctcgttgaagtccaccccaggctgctgcacatatcctttcgccaccaaacgcgccttgaacttggtcacctcacctcgggcatcctttttcaccttgaagacccacttcagtccaatggcatggtgtccacgagggaggtcgaccagtcgccacgtcttgttttcttcaatggttgcgatctcctccaacatggtgctacgccagcgctggtgttgttcggcctcgttaaatgaagccggttcctcagcctcctgaagatacaactgttctggagcgagtgcacgctcggcgaggcccggcgccgccgcgtcgcccaagagatcccctagggggcgataccttggcgggcagtcatcgtgatcagcatcaaggtgctcgtctcccctcgacggaggcgaaatgaacactggacttgtcccatgcaaagacgctcgtggtcccaagcttggcgacggcgtgcgcggctcctcaggcgtggtcgatgcagcgcgtcgcgagcttggcgatgagttttcctcctgtgcgccgcgaccaccaccgctcacctgtgtcagcacatactcgatggaaaactccgtctgttcaaggccggactcggccgcttcagcgccccagtcccagctcgcgccttcgtcgaagatgacatcgcgtgacacctgcacgcgcccggtcacagggtcgaacaccttgtaccccttggtgcccgctgcataccctatgaacaccatgggcgtgctgcgatcttcaagcttggagaggtgtgggcgcatgttcttgacgtacgccaggcagccgaatgtgcgcagatgtcccaccgctggcttcttgccgaaccaggcttcgtagggagttcggttctccaagcttttcgtcggggcgcgatttaggagaaatacggccatggtgaccgcctccccccaaaaccgcgccggcatccccttcgccttgagaaggctgcaagcggtggcgaggatcgtctggttcctgcgctccaccaccccgttttgctggggcgagtacggggcggagaagtgcctgccaacaccatgatctgcacagtactttgcgaattcaacagatgtgaactcactaccattgtcgatcctgaatttacgcagcttccggtctgattctgcctcagctgatgcctggaaatgcatgatcgccttcaccgcgtcccccttcctcgcgagcaggaccagccacatgtagcggctgtggtcatccaccagcaggaggaagtaactcttgccgccgggcgtcgccggcgagattggaccgcagagatccccatggaccagatcaagtcgatcagtcgcacggtagaccgcgcgcgttgggaacggcgaacgccggtgcttggagatgatgcagccgtcgcacagttgctcaacgtgctcgatgcggggcagcccgcgcaccatgtccttgtcagcgagcttgcgcagagcatcaaaatgaaggtggccgaaacgagcgtgccacaaccaggccgtgtctgaggtgcacgcggacaaacagaccggatgacccgtcatcagtttaagcaaatacagacgattggcattgcagcgtaccttggcgagcagcttcttcgctgggtcgcgaattgtgcacacaccatggtaaatgcgcacatcacaaccatgctcatcgagttggcccagcgagatcaggttggcgttcaacttggggatgaagtagacttcggtgagggcacggtgctctccattgttgcacataatcagaattttacctcacccttcgatgccgacaacggagccgtcgccgaaacggacggaaccacgcaccgccaggtcgagctccacgaacgcggagcgcactcccgtcatgtgattcgtcgcatcggtgtcgagatgccacacgcacgcatccatgttttcctcctgatggaggtatgcaaacaccttcagctcgtcgagcatgatggtctgtagcggcggcgccggcgcgagagggcgtggcatgggtgaggcccctgaaattgcacaaacatgggccatcagtagcgctggctccacatcgtcctccttggcgtgagcttggtgggcctccgtgttcttcctgggctgacggcagtctttcgcccagtggcctgcacaaccacagttgcgacagcgattgcggcccccgtcttgcgtatcgcaggcattttggtttccgcgatcaccgtcacggccaccggtgtcagagcgcttgcgaccccctcagcgccggcggttgccgttgcctttcttgccggaggatgcctccccagcctgcttctctttcagcctagccgcccattggtcctccgtgagcatgagcttgccagtttctgtggtgagccgcttcgccgtgagcttatcctcggcgttgcgccgacgaccggtgacctcctccagagagagctcctcaacatcgagcagcgtctcgatcgagagggcgatttgctgcagatgctcaggaaccgcattaaggaatttctgaactaccttgctttcctcgatcggagcgcccagagtgaccagcgtggtgaccaggttgttgaggcgtagcgagaagtcctcgacggactccccctccttgaactcgatggcgtcgtactgccgtagaaacagttgcgccttggacttgcgcactcgatcaacgccgactcgcataaccctgatggagtcccacgcctcctttgccgtctccttcacagcgagcgtcaacagcatctcctgcggcactgcacggaggatggcctccagcgccattctgtcttcctgaaagtctgcgtcgccgtgctagacggcttcccacagaccacgggcttggagcataactttcatcatcagggaccagtcaccatagtttgtcttcgtgagggtaggatagtttgctgagccgcccacctccttgacgacgcgccggaccggaacgatgtccctgtcttcgccggcacggcggcgaccacggcgcggaggcggtgagcgggattgacgacgcatgcgcggcactggcgaacgcgagacgcgcggcgtcggagccgacatggctctgataccacttgttggtagaaacacacaggatcgatatatctctctcacttgataaaaacttgaagatgaatagtaagctaaagagcaatgaacacagaaagttttgtggtgcttaaatcttgccgcaccgttttcacgttttcttctt

SEQ ID NO: 57937 - DNA, 6934 bp, Oryza sativa
acccatcggacccatggatacccccctgagtccccccttcaattttttcaccatggttgataagataagaggtgctaaaggtctcttaatagcattttagcatagtttaatactgagatgatgtgtttatgccagtgtactcggtatgttgaatccccccaactttttgttcctggatccgcccaatcaaatacttgcataaagtcacatattgccaatctaaaaaggcaatgtacagtttaagcagccccatacaaaaatattgcaattgcaaacaaaccactgtctcgcagtttagtaagaatatgactgattacattgccaattcgccaggttgcatcgatatcgcaatctcaataccgaggtctatgaagcttccgtttgtacacaaccctacatactttgagtcgaaccaaccaccgacactcaacagagcgcattgcaagaccatggacgccattggtctatagaaatgcccgatctaaatacctataaacattcgatgcaaacagtagctagcattgccgatctcagtaagctctcgagtactagaggggggggggggagaatggctgtaccctccacatggcgaccgcggcgaggtccttctccagcttctgcttcagcatcgcgttgtactccacggggtccaccaccgcgctcgtcgtcgccgccgccgccgccgccgccgagagctgcggctgcttaacatcgaccggcaccacccctcctgcgcccctgatccctcccgcttcggccctcgggctagggttcgggacggggctatcgagcaccgcctcctccagaaacttctggaagtaccactccgacgggcaccggttcatcgcgttcccgccgccgccgccccccgctacaccaccaccacctcccgaagccacgccgccgccgccctgctgctgggccgccgccgccgactgcggcggcggaggcgggacccagaatgggtcggagatctcctccacggagaacacccgctccatcgcggaatcggaatccgctctcgccgacgcggatcgcggggctaccctccgatggattcgcgagggggggattcgagggtttgatcggagaaaacctcgcgcgaattgccgcttggagaagaggagaggattgggaaggcggctgcgtgctgctaattttttgtgtttgggtgtaaattaatgactcggatgctcctggttacgacaaatactacgcggtttttgttccgaggttggggttgggaaaattttggattactactaatcttctttaccggataataattaactaacggcaaaatatgcgtttgtaactactgggtgagggtagtttggtgtgcagtgcgctgatagtaggatatactgctggtagtaattgttatccagaatttatccataaaagggatcaagtggaatttagatatatcgtggataaatggtataccgtatattatgtctttatttttgtcgcgacgaatatctaatatcaattttatggatataattgtgcattcgtatactacacaatgctagaaaactatagggacttcatccgtttcatattataaaactttttagcattgtccacacacgcatatacatacatatatatatatacacgcatatacatatatatatatatatatatatacatatatatatatatatatatatatatatatatatatgtgtgtgtgtgtgtatatacgtatatatacatatacgtgtatatacgtatatgtgtatatacgtgtatatgtatatacgtatattaaacggagggagtagctcggttggtgaattagacacctcaagttcgatttctcccttgtacaaaattataaattgtttgggagatctcctttttcatatactacacaataccgtgaacatgaattgccctagtctaacttggcaatcctataaaacctgcgaaaacccctcgttttcacggctggggctattcaagtaccctaactgcaacaacacaacagatgctatcgaagaattccaattcaagtaccgtagcggtagcgatagtcatacgtagctttacctaagtaccgaattgccccgttatttactaaaatccgataaaaaatatagcctcccataaaaataaataattgcattatccattctctctcttgttattaatgtattagatgggtaccacaaacgaatttgccatttgctttcctgttattgtcgccaaagtgaaaaagaaaaaaaaaaaggaagtaaaacggcatctagtttttaggtcaagactcaagaccgaacacgcacgttgcgatcgaacagaaaaatgtcacgagaatgtcgcggctgatcgatcgatttgacgacgatcgcaacgtgatctccccatgcttatccctctttccgcagcagcagcagcagcatcgacgactcgacgtgacaaaaggaaaaaaagcgagagggacacacacagattctggttgaatgcctttcccatctgcctattgtggattggattgggttcccttctttttagcctcatccaaaaagggcaagccgatggtggtatatgcaaatttatttatttatttttacttatttatttattcctttcatctgataatgactcgtgtcaacattttgtgaatctggccttacgtttcatcatcaatcagagatgataagaatgtttactgcttgagaaattgaaagtgtactgtttgaaaagaatcagagatgatacgagtgtttaggttgtgtttagttcacgctaaaattgaaagtttagttgaaattggaacgatttaacggaaaagttggaagtttatgtgtataggaaagctttggtgtgataaaaaagttgaaagtttgaagaaaaacttcgaaactaaacacggcattactgcttgaggaattgagagtgtacactgtttaaaaggatgagactgatttgtttcgccatgtaggaaaggtatacgaactgtttgcaaaagtggtttgatttgagctcctttgatgttgagattgttttttttctttctctttaatcattgcaaaagtggtttgatttgagctcttttgatgttgagattgtttttttttctctctctctcttaaatcttaattctttttctcgggggatttccaggaaagcgagattgcgcggatgatgcgtgttggtgcaagcaattgactttttccatggctacagaacatcactttttcatggctaattccagttattacagatcatgccatcagggagtaacatgcaaattagtatagctgtttgctcgctaatgcacagctgctaaattgacaagaccaattcaactatacttgcttatgttacactgcttgttccaatgttacactgtccctggaattcagatatgcttaatctctttcattctgacttgacaaggtagcccgccaaccaaccacttggttcattttgattccagatttccagtcaagaacatgtcatagctagatgatgatgataagcatagaagaagtgtatccctttcccctcgaaaaagcatagaagaagtgtatgaatatatatgggtttaattcgttatggagaactggaagaaaagtgtcagcatctgggaccatggggatcattttgaaagacaagtgacccctgcaaattgcagtcttcctggagaacttgggcaattaggggaggaaatctgaaggcaaagtcgctttcagcgcagccgttgtgctgcctcatccatggacaagagatgatggattcagacggcataatctccagtcagccatggaaatcatccaggccttatccgtccttgatgtgttgcctcctatccccacaggaataggaatatgggataactcattccaatcgctgtcttttcagcctgcaaaaggattaacacgatgtttcccagaattgatggcatgacacaactcctgattggatcttacaaaaagagcctaatatgttctgcatattaatttctcctgatatactactactccataaatgttcattggattttatttatgaacttacaaaattggagatgcaattctgggacagctatttcagacagtttctgagctaccttctttattattcatctgtatgttaacagaaggatagtactagagtgagatacagtcatgattcatgaatcatacaagaaaatactggattaaaatgctatgcaatttaatcagacaaaaaaaaacgatgtactgccttcttgttggcttgcatgggtggaggcatggaaccgctcatctcaaggcatagcagccttcatgttcttggcatactcttctactcttttcaacccttcttcaggtgaagcagcctctcctaactgtctaacaatagcgctgccgatgatcacaccatctgctccccagcctgcaatctgtattgcaaatcacaaagttattaacaaagacaggccaaatacgtagtaacaagaacgttgcattgagtctaattcacctgctttacatgctctggagtcgatatgccaaagccaacagcaacaggtttgtctgtaacctgtaaagtcaggaatataagctatattaagataagcgctcttcaatcacgaatttccgacatagtacccttgcaatagtttactgttttactggtgagagaaaaactaaactctacaaaccttcttgatctcctgaagaaggtactcaacacgcaaatttacatttgagcgtgcacctgtaactccaacagaacttacctgcataatgtacagactagttatcgcacacataattgattgccaccgatcagattcaaaggcaaaggtagaatatgatggtatttaatagatgagagatgaccaaaatatggatcatgtgcttgcgatgccataatggttcagtatttgcaatttttagctgtttcaatttcccctcttttttctgttcatgtcagtctgggatgactgatcacatgttgtttcataagcatgcaaaagtgcactacagataatatttcataattgtccctttgtacctgttgaaaacaaatattcaaaatataaagtaggggataaaagaaaggatatcatctatatttagtgacaaacttaaagcaagtgcttggggtctactagatacccacaaagataaataaatccttctgaagcttttgcaatctccttcatcctctctgttggtgtggttggtgttgtaagcagcacctgcaggcaattgtgtaaaatactaaaataagaattgctagatgaatgaaactcaagataactcaatgcataaggtcaactcttgccacagatttaatcgacaaaaggcaatagaactacacaagcagtttttcacttgaacattacatgtcagggaaaaaggtgaggaccaaccagctctatgccatgcatgacagcctcattcctcaacagcgctgtctcttccaaaggaagatcaggtactacaagacctgctcataacaagagtggataaaaaacaatctaaatgcactatacagaactacagatatctcatatctcaatgtaaaatttagaaatatcacttcacaagtagtttgtcaagcagattctgaaaaggtggtatattactgaactaactgccatcttttcactaataataaaagactaacgcagagatagagtcatgcacttcaagagtcaatagaaaataagaagaaatatagcttttctaacaattgagcatatccttatatcttaggcatatacagcagagatatcaacaaagtgaaatccttgattggccacatcttgtgtgatggcattttaaaataaactatggatattcagttcaattcagacagattgactgcaaaagaaactatggtctgctttgatctggtgattaaatcagaaaatttactcgatgccaaattgaacctagaagtgactacagctaacttcaaatcggtcatctcttttcaaagtaaagttttctttcttctcgtgtcttcaaatgccttttccgaacattttttttcctgaaaatctgccactggtaaaaaaattatttgcctatttcctttttctgttctgtgttttgaactccttgattactcaaaactgcaagacattttaagatcattctattaactatgcaggaaaattaccatgtacgccggcttgtttaatgatagccatgaagttactcactccgcgctttaaaattgggttgtagtatgtgaagataactattggacaagacaactcaggtataacccccttgagcatagctatgaccgaatcaaatgtagcgcctttcttaagagcacgcgttgctgcagcctgaaatgaaccgcagccaaaaaaaaaaaacttatgttgcagcccatgagaaacattaaagctgataagttcaaagaagcacatacctgaataaccggcccatcagccaacggatccgagtaaggtacacccagctcaatcacatctgaaccacaggaatcaaggatcttcaacgctttcgatgtggttgccaagtcagggtcactggcggtgatgaatggaatgaatgcagtctgaaaaattccgaggtcagaacactatgctcaaactaaatccctccctgaaagaatatgtgctagtatattttttcttgtcctcaattctgtcacatatagcacacgcagagcaatagcaatatagcattgagcactggagcctgtatgtaaactcacagtctgtctaacgtgttcaaagcaacatcgaacagctgactatcctgatcttagttacactctagtgaaaattgcttcagcagcttacccattcatatactacatagttctccataggcaaattgtcaaattgtcaagtgttacactccaccatagtgctgttttctcaaattgtcaagtgttacagtccatagtgctgttttcttgatgagaaaacttgagaggttttcctgtattg

SEQ ID NO: 57938 - DNA, 674 bp, Oryza sativa
cgcgtaattatcagcttacatgtcattcttgtattaatcagttccgtcatgcaatgttttatgcagatgggcgatccccattgccgtattattgtctttttggcttctttactggcgatgtttcggtagaagaaaacggggcagccgatcgtcactcctgccactccacaacaagatctcccacaagaactcaacgcgcccgagatcagactaatctgatgctcttttttccctgaaaggacagtacaaagtatcaaacttgtagaagcagaagatagctgtgaatcatctgtcttgtcttccatgccgcgttggagtggattggattggatgggccttcttttggtggttccctgccaatgtatcactgattcgtttcttggccgcggaagacgatgaagtcgctgccatttgagcgcgtgcgcaagcgttgttgtggttggtataccgagttttatgcatttttgtgtagctaggctgcccttacgggatgcgatctcattcattgattattgttcacaccccaccggtggatcttatataaggcttcctttttttttctctaaacgaaaaatttaccattaataactacacttgcttgtatgatgaactgtgatgggattctgggtgaaaatgcatcaacttatttgattatgaaaatgacatgtattagg

SEQ ID NO: 57939 - DNA, 1747 bp, Oryza sativa
catgtaaaaatggttccaagatttgctattccatagtggggctggcggctgctgtatattgcattggacttttgttagaaaaaggcagagcctatacagatggtaacacaacattgtcattggatatagtttataagaacatttacaaaacaattgtgtatattgtaccctgacgatcgaatatatggaaatttagtgatagtagttcttttctgcctatcttatgtaggaaaaactcttttcaagtaggaacaggactgaggtctcgcttggcaagaagttgaagaacaattatcttccagagatggaaaagattcacaaggtatctaaccgtaggtctcagagagttaaaattgctggtcgtagaatataatagaatgttattttatctcaatgttttgctcctcttgtagaagaaggagaggctgctcaaaaagcaacaaagagaagcactcctccttgacaaccgcttgacagtgaatgggttcacctctgtccgctctcgtcgtgaaagaaagcgtgtcacctatacttttggtaagcttgaacctgacgcgtttgagggaaaaactgacataggaagaatattggaccatatctgctccgtgccatggttcttctgtctggaaagacagtactatacttcttttacctgtttcattgaaataattgcccttaatagttccttctggttcagtggcattacccaatgatgtttttggccagttcttagtcttacatcttcacgtagttgttccttcattttagacgttcaatcaacttttgaattctactgtaatgtcagttaacatgtaatataatttactaagcttctatcggttttcattgaggaagctatatataccctgattacctcgtaatttgataaatgccagcaaattactctccgtaacctgttaatatgttctcaagtttgctacatgtaatttttatttaagttgcatagtctggtcattttatgcactgaatggtctcaattggagcaaaatcatatcatatacataagttaccaattctcttaactctgaacatgtttacttatcatgcagatgattatgagcgttcaataaatgaagccataaaaccaacaaagtaggtggattatctctgcttgatagttttcatttaataatttacaagtttggaaacatgatgcttgtctgtactatgtcatgatgcaaatgtctgaattatcattgacaggaaaagtgagaactcttctgagttcattactacttctaacagaagagtacacccaaaacgagagacagcgaccaatggtaggttagctggtccttcgccattatgcaatggattctatggagaatatccactaaggtcacatggctaccaaggaagtgagtgggagaaaaaacctgagactctcgatcgcaggtaacttcctaaatgcttgttatttagttggttccctgctgatgcttaccattgacctatagacatatttatcccattatatctacaggcaaagaaaaagatctcgaaggtacacgcaagattttgttgaggctatctcggacgtcgacccaaacttcgacagtgatgatgatatcattggtgaagcagtctatgatgaggaatatcttagaagtcgaaagcaatataaggccagacttttagaactcgataaagagttccaattggaacaagttgccgatgatggtaatgatgaagtggaatatccttcgagtaccagtgaagatgaaaa

SEQ ID NO: 57940 - DNA, 554 bp, Oryza sativa
ttctcgttcatggcgtggcacttggactgtacttacgcgtcggggtcgaagttgtcggtcttgaagatcttcatcttgtcggcgagaggcaccccaacatcaccgcctccagccaaaacgttcaccggcagcacaccgaactgcccagctgggcgcaacctcattcaacttggcggacaacatcaccgcgcgcaagcgaaccccaccgccgccaacaacaacagctttccctcttcttcctcccaaatgattaaaaaacttctataagtggaaccactactcgattgaaaactccactctcctttgcagctgcaccgattttttttttttttaaaagggggatatttttctttgggtacctagaataatgaggaatttaccttgaccgttgccaaaagaaaaaagacatatagttggtcttggaatatctctcgagactgggaatagacccgttctactcccttcatccatatatacctttaaaaacttttatattatataatgatattatatctctttaaaatcttttatattatactaaccttcttttttaa

SEQ ID NO: 57941 - DNA, 1001 bp, Oryza sativa
gttctccgccggtgatcggaatccttcccctgccgcggcggcggcgaagaatcataaactgccttagagtcgcaaacttgcacgcggaagagattcgaggaggcggcgaggaatcataaactgccttagagtcgcaaacttgcacggcggagagattcgaggaggaggaaacggaggcgtatcccggcggggatgaggaggccgcccatcagcgcgcggcgaagcagccatcgacgccggcggaaggagaagcatatgacagtaacaaatcgggctgggcctacttttgccagaaagttcaatagtacgctgttcccctaaatgggccgcaacgaaaattccgaaattggtgtgcaagtcagaatatagcctgcgcccatttggaagtctgaatcatataccaatggaaaaaagtctacagttcctatctgaactgctacctcaaaccgaatgagatttgatatataccaatagtagcatgtattgccatagctatttttctctttatattcaattaatatggtattttctatcctcacattctaacatgatgtcttattctcaagttatatttctgaattcataaaatatgtattcaaaattgaaataatcaaatgcactttattatttattcattcatgtgccaaatatacatgggcaaatatcgtatcagagtataatatcaagcgagaagcaaggctatttactggaataaacatgtatccatatagggtctgtttggtacagctccaactcctaaatttagctctaggagttaggtctggagtggagttatggagctacctaaacccagctccacaactaaagttcattttgtgagagagctccacctagctccactcccattttttatgtagctgaaactgtttgtctgagctccagctctataaggggtggagcagaagctatgccaaataggtccgcactatgtacgtacatgtaatctaggacagctatcagtgcaaagagcacataatata

SEQ ID NO: 57942 - DNA, 745 bp, Oryza sativa
tttagggaaactccagttcgctgtaccaaagacggaatgcgtgattaattaagtttattcttttttaaaaaatagatcaatataattttttaaagcaacttgtatataaaagttataaaaaatatactatttaatagcttgaaaagtgtgtacgtgatgagttggaagctctaacacacgaaaacaaccgaagttccctcaattcttttttcttgacttgatttttcttactccagttgggagcaagcacaaactcgaacaaaacaatgcaaaatacggtcagccacccaggtcagtgaacattccttcctcttcacatgcatcttggattagtgataatttagtgatagttttttaattagttttattctaaaccgcagcatcaggtgttgctaggtcaacagagcgcccccacccgcacggaatcccgcccacatcgaaatagcggtcacggccgccacgcgccacttttctccacgtgtgctcccgtccacacgtcatccttcgtgcacgcggtccatgcaccagccaccattcccttcgcctcgaaggaagcgtagcgcatacaccgcgttcacgcgaccctacccacgtggccccccacaattcctccactaaatattttattatactcttttcgaatcgcaattaaactaaccgaaaatttgagtgaatttttaacgaaaccgtcattaataaactaacacgtccttccccttcgctgtgtgttgggttcggttcgctt

SEQ ID NO: 57943 - DNA, 538 bp, Oryza sativa
attcttaccaacagcctactcagtgtgagcgataaatcgcatcacttttagcaaaggctaatgaactaatctggttaaactatagaaaaaccaaccagcaccctagcattttgatgaaagacagaaagacacgggcaaaggatcagacgtaacaactaaaaaattacaaaatacatgtcacttccaggttttttcttcattgcttgaatggtgctccacttgcattgacttccggcggcgcgttgcagatcctagttcttccactgccttttggcttctgctcgctctcgccaatccagccgctgcggcctacaccaaaggcgttcgatgcccgtggtcaggaggaacgaggaggggaacacggctcgtgctcgccttagccaacccagccgtcgccgccgtcaccgacggcgctcgtggccagggcccaggagggaggccgcgacggcggtagcaggcgagagaagtggccgcatcagttgttgaacggaggggattatgggctaagccaatggcgccaaggagaggcaatcccgac

SEQ ID NO: 57944 - DNA, 1781 bp, Oryza sativa
tgaatattgcctgatgatcactgattaatattagaatctggccggttgtctgtgatgactgtaaagtcctgtctgatgttgctttctcttgtagtgaaactcttcaatcaatctatcagtggcgtagctaatattctgtctggttttgttaagttcctaggaatgcggtggtatcagatagttcctttgaacttcttctgatgtgaaattaaccagtaacagttagcccatgaaccatatgaactttggatagtattggagcaaactaatgcccatcgcatagaaacgactcctaaaatcagtgtccacaattcatgaatcacatcatagatcactgattggccacctgattgagcttcagatagagaattgggttggtagtaaaatgatttgtgaagcagggcgtttaatatctggttttcagcagtgaacattaatgaatacctatatgtgtacaactttttattagccagaccgttcaaagcaaatggttgctggatttcatttttgtcaagcatgatatagccactgcctacatatgtatgctcagtcgagttgctgaaatatttttcttcatttgattattgaattgattcataattacatatgcaccactggcagctttcgaggcaatttgcaccccaaatgggaattaatacacagaatttgacaccacagcagcagcagcaactgctgcagcaacagtggttgaggcgcaatcaactggccagcccccgtggtcctcttacgatggcggacaaaaaccaggctatggtaaatgtgaagattgagaatacggtggactcacagattgatagcccctacggatcacttaccagacaacaattgcagcagctaaggcaccatcagcttctacagcagcagcagcagcagtttcagcagcaacagcaagttcaacagcagcagcaacaacaacaacaacaatttcaacaccagcagcaacaacagcagcagcaatttcaacaacagcatcagcagcagcaacaatcacagcaattgcaacaacagcatcagcagcagcaacaaccacaacaattgcagcagcagcatcagcagcaattggccatgtcaggaggccagaatgcccaactagcgcagcagctagcaatgtcaggaggccagaatgcacaactagcgcagcaattagccatgtcaggaggccagaatgcgcaactagctcagcaattagccatgtcaggaggccagaacccccaattagcacagcaatacaaacaaatgccatcgatgtaagtacctgtacctcctcaactctattgatctgtttaaaatctatgcttccatcttgttaacccctctgatctgattgcaggagtgcgtacggcatgaggatgccgccggtgaaagtggaagcgttccacgagctggtgagtggagattcgtctctgaaacccgatagcgactcaaacaaactcatgtctcccaagtaggtcagtcttacaccgagggaaaatcgcgtagccagcggttagctgtagtgtacaaaggactacatttgtgatctctcactgttgtttcccaagaactgaagcctttgtagttttcatcaaatccagcaaggcaagcagtgtattgtaattgtagatgtataagtggttactaactgaggtgataagatcgatgtggtaatttatcagaaacttgagattccttcatctgcctgtcctgctagttcgattatcttcaagaaaatctgagctccttgtttctgtgaaatcagctggttttgatttaccaatcca

SEQ ID NO: 57945 - DNA, 745 bp, Oryza sativa
ttctgatatacttggtggaacatcgtgcaacatgtaaaaataattcaataataagctaagaaatttttgcgtcagaatatatccatgcgtggtcttgttttaacgatttaattgcaacgaatttaatggtgcactcggatcatgatttggataaataatttaagagaaaaaatagtttaaagtggttttgcacgcatgcgtggcattggtgtcatgctgtcagcgcccgatttcccccccacaccatagggcgctcgacgcgtagatggttccagatttttgaggtgtcctgggtcagtaaagtcaatattaatttgaaacattttactaataattaaactaaaaatatcagtctttagtgtcatgcacgtagttatcatcagatttgtatttgaaaatatatttatatgatattgattcgttagtagctaataatatgttgtaaagaaattcaatggctaaaatataaacttgccatttaaaaagccaatacatcgtaaattttagaattgaagtatttttttttaaaattacacagtacaacgcagatactcacaacgcacgtacactcacccctatgaacgcacacacataaaccctacccctatgagcatctttgaagactgagccggcaaaacccaaattatactcagctagtcgatctctattaaatatttgtcataatacaataaaatctattaaatataacttggtctggactatatgcatggctagatttacgagg

SEQ ID NO: 57946 - DNA, 1193 bp, Oryza sativa
cccaaactagccaaatcttcaccagatgaactgataacttcacatgagattggcagcgaaaacaatgcagcaaacatcacaaactagtagcaataatcccctcctttatcagacacaaaacggattccaaataaaatctctcctatagacaaaacatcaaacggttcgtgggcgctgtcaaaagctgaaaaattcttccgcagaacgcactgaacaagtgaaccccatcccaatccccgtcgtttcgacagtgaattcgtgatcaatcaactcactactcacctcgagaagaaatcgagccctccggtaatacccgagccccgcccacatctcgttcacctcctgcaacaatcggcggcaaccacaaatcaagaactcgattaccactctcccacacacagcatcaaactttacatttccttttccagcgatggtggaggagagataatttctcttgtctcacctcctgcgtggcagcggcgaggctgtccacggtgggccagcgggccatccaccgggagtagtagtcgaccaccacgggcacccgcgtatgctgcagcatcacctccgacacccacaccgcgtacgccctcttctcctcgccgcgcccgctcccgctcccgctccccgccggctccgcggcgcgccgccatggcaggtcgcgccggttggcgtcgtaccaccgcagcagctccgcgcgcaccgccgcggcggccgtggtgagccccactgctgccctgcacccggacggcggcgccaggtcctcgatgtccgcggaggcggaggcggtggcggcggcggcggcggcgcgaggtctccgcgtcgtggggcggcggttcttggccgccttggggttcttggccatggatgcgaaagggcggattttttatttttgaattttttgaattgacgagcttggcgccagcgagaaaaaaaaaacttatcgaggaaagaaatgaaataagtatttcgggagggcctacttacgatgggtgtttgcaagttttttttttttcgaaatataggcttcgtttagttagggaaaagttttaggtttggttgtcacatcggatatacggatatacatttatacatttgaagtattaaacgtagtctaataatcaaaccaattatagatatcgctagaaaattgcgagacgaatttattaagcctaattaatctatcattagtg

SEQ ID NO: 57947 - DNA, 1314 bp, Oryza sativa
ctttatgcctcctttatgctttattcagtttggatgccctctaggacagcatcccattcaaagttcagattttagactaggagggtgcagcaataggctagcagccagctatggctatatatatatgtatccaacctccctcgggtaggtatggcttttgtgtttagtgaatgaagaaaaccacaaaatcgccccatctcgagtgccatcctcttctcaatgagagtaaccattgaaattctaacagcactacgatttacaagctcaatttacagttccctgatccccattcaagtgcaaaccttatctgtaaatggctgtattttgaacttccatatgataccgttttcccatacagctttttcagaattagaagctttatattgatctgaaaacttccaaattgcatagactttgaacatcatttccttgatcacaggcagctcactggtgaactggtcgacccttctaggccaggagacttcaaccaagcaattatggaactaggagcaacactctgcagaaagacgaagcccggttgctcccagtgccctgtctccaaccactgccaagcactcacactttccaaccaaagtgcttccgtaaaagttacagactacccacgagtggttccaaaagccaagccacggtctgattttgctgctgtttgtgttgttcaaatcaatgataatctctttctattgatcaagaggccagaagagggcctgctcgctgggctctgggagttcccatctgttcttgtgagcgaagagaagactgatgtgctgaataggagaaaagagatggacaaatatttgaagcaggtccttagcatagatgttaaaaggagatccagtgtgatcctcagggaagatgttggccaacatgttcacattttctctcacattcgcctgacgatgtttgttgagctgatgattttgaacctcaaaggtaatcatttgttgtccatactagcagttattcatttttgtttagatacactctattattcattcaggcaaaattgcctaatttcttcactgtagatgatggggataaattatgcatggagggacaagataacagcaaactgagattcattgacgaaaatgcagtcgactcaataggattgatatcagggatccggaaggtacgcacaaattcaatgtggtaaaaatatttcctcagagtttggttaaaattgtaagatgaatgctcacttcaggtgtacaacatggtcaaggccttcaaggagaagaggccgaaagagcagagccaagtaccatcgaggaaaaggagtagacggctgaatgc

SEQ ID NO: 57948 - DNA, 677 bp, Oryza sativa
tgcaagtagctcatcaaaaaaggaaacatgggacataacaggcaatcgaagatgcagacttcttcaattgagtagatttgtgttatctttttcatcagaaagtaactgcatttctatcttattatgctttgtgaaatatgtttaaatttgtcatacattcatgtgttattctcatactaaaccaattttgtcatgcatttattttttttaattctcttaacccaataatttcatagacctttgaattagctatcaactatggtatagtacgtggaccattgatggatattacatttcaggtagctgatgtaacgcatgctctacaacagcctgctggaaaaaaggtatatttaccaattgcaatgcacttctgctggtttaggcaagattcctagtttaatggccgactttggtgctactcaaatcctatattgaccaacaaaggaatcaacattatggggatgtccatattttaacaactatctatagcttatatctgatgtaaatttgcatgcaactcgtgttcatagttttttgaacaccatgttaccgtcccttcctcaaatatctatgtatttgtgcaagtagacggttgtcaaattgtgcatatttggttctcttttgtaagcttgatggtggaggtgttgcaagtgggggcttacgagaactaataccat

SEQ ID NO: 57949 - DNA, 621 bp, Oryza sativa
agttttacagtgatcgataaagatagttgctgaccagaatctcttcacagttgaggattcttttgggttatcaggaatagcgtaaagcctgctgataactcggacatttccatccacaacagggacaacctatattagcaagaagttgtgttatcaacttatcatgtgaggatgtaaaggatcatagccatggtgatttcaataggatataaattatgtggaacacaacctcattgaaggctatggaagcaatggctcctgctgtgtaatccccaatgccacgaacttcacggagtgctgatgctgtgcgagggaactcgcctttttcaacaatttgctttgctccctactttgcaacaaaaagcaaaatcttactgagctacaaagagattcaactaaaatacatgcccaaaataatgcattgctccctaccaacaatttctattagttgcccaacactgtgtacatagatgcagaggtacttattcattcatttcatctttcaaggaaaaacattgcatgcacataacagtgcttcagcaagaaagattgaaacgaactgtgtgctgcataaacgataaaagtaaaacattttaacatcattaagtattgagtaaagtc

SEQ ID NO: 57950 - DNA, 1414 bp, Oryza sativa
ctgtacaggtgaattgtttggataagctacgagaaatacatgagaattggatgagaggtcgattgaaataacattttccaagatattagaccccatgcatgctaactttttttgaaaaaaaacatgtattaatctaatccactccaaaagaatttcacaggattttgaagtcatcaatcatttgttgaaagggcaaaaaaatagaaaaaaaatcctatagaattgttccttataacaaatcctttgatgaaaagggagccaagcgtataaagaacgtagagagtgttcttccttcgatattaattacaaggaagagtatacatggcatccctccaatgttcttatgatattaattatttcataggagttttaaatgattttccttgtgtcattcctttatgaaagggccatgcagaaataattttctatagatttcgattcttcaaagtttctttcactttttctttggactggttccaaaggagtgcttactactataaaatacatgaaacacaaaatttccatccggttgaccgacgtaaacggaagttttgtgacgccagaaacaaatggcctctcactatcattgtttgattctgatgactcccttatcattgtctgactctcactgaaaagaacatgataagtgatgatgcgctctcctgtggcccgatcttctggtgaggggataactatcgctttgatcaagtacgacgtttgcgatgtggctaccaaccagaacaagtccaaaacgccgtgcaatcgctacaccacaaacgatgtcgtgccaactgtgacacgcggttgatgatccctgtaaagcaaacaagagaacattgcaagaacaagataaaatgcaatctaaatattgcgaataggtaattaagcacaaagaaatagttgtgattgaagtggtagatctaatcgacctggcaaatcaacgcacaaactattgagggatctgaatttatagtcaccgactaatcgagcgaggactatagacaagttgaatagcacttggcaaacttatacctaaacaaatcccaattgttctagtgggtgtacatagacatttatagagaaaaatagatttagggttaagtgctaattcgtggaggtggagggagacacttctgagatgagtctagtctattacaaggcccaagttcgatttcagcaatatcatgtcttgttttgatgatttccattgactcaagatgaatttggatatgagaccagatgcgtttgaaaggtaatgagataaactatccatcaagtccaagatcacccgaatcagagttggcatgaaaacgctaaatctgtttaaagtcaatgctgtctccggagaccgaactggattccaaaactcattgtactttaatatcttgtagatcctccattcatctgatgcatt

SEQ ID NO: 57951 - DNA, 881 bp, Oryza sativa
agtgatcatgaactaacaaaaataagccttttgtttgctctaatttaatgccgactcctcgtaaagatcggcaaagtaaggttaagtatagttttgacgtggccaaatgtgatatgatttttttttatcttttgcaagaaaaacaaattagattacctaaaggccatgtcataccctctcaagtagaattgaagcgtcaagcttattgtaaatggcatgattctcactctcattctactaatgattgcaatgtgtttcgacgacaggtttaatcggccatagatgaagggcgattgaaatttaccgatggttccaagatgaagcttgatcatgatcctttcccggtgaatacaattaatttcaacaataagaaggtgttgattggtcaaggagtggtcattggagagcctaggccaaagatgatggtgccaaagaatccggaggttggtgtttggaaggagaataggagcgaagtttcaagttctaaagctcctaagaggactaaggtgaccttcgatatgcttttgaataagtatgagaagcaaggtggtgagaaagctcgcaacaaaaggaaaagaccaagatcacctcctagggagcgatttggtcattcaccaagacagtcggaatcacctacatatcatcgttctcaaaacatgtcatgggggccttatccaatgctgccgtcgggttatccttttccttactacatgccatggggggcaacaccatcaatgttcaatcatatgcctccaatgcaatacaaccggggccagctcgttagcgtttatctttaccaaacaatggccagttttatgctaagaaccgggccaatgaggagaaaagggaaggaaagcgtgtcaaagtgcatagactactgt

SEQ ID NO: 57952 - DNA, 5393 bp, Oryza sativa
tttgttggcctagcggcggccggtccggtgttacccttctcctggatttgtatttggcgctgtcggtgtgtgagtggtgctatacttttttccttttcctagttacggcctcataggattataatcttgtaatttttttctagtgtattaatatgtacttcgttcaaataagaaccttcaatatctcatcggctctccttcaacatcaaagaataaaaaaggggaagaaaacataggacaaatacttttttttgtctcatgtgtgtgcttgtcattaatatatccaagatttcgcgaaacgaccgttgataactcaaccctatttcttacttcaaaaaaatcttacgaatttcaaaaataaaaactctacagcagtacatacaactttttttgtccgcccctgaacagtgggaaacatatgctagtaggacaattaattacttgcacacacacgtacgatgcaccacggctcacacagccacaggcgcgcggttgttgcacccaacctgcaatgtgtgctggtgcaaagttgcgagattcaaagtttgacccagcgctaaaaagtggctggttcgcacgaactcatcgatcagcctaatattctataccggccacctgggcgccgtggtaggtggccacatgttacttgcgcaagtggtgcacggaacaaacaattttcgtcacaccttgtcataagctccttatttcgcaaataaaattgcatgcgtcggctaacactatgcgcgcacactccaaccactaccacttttgactgcggttgtggcatcgccaccaaccaatgatatggttaagctagtgctcgtaccttttttttttccatcacggttcacacacatgcatatatgcttattaactgtttcatattacatcatatccgtcctaaaatataacatttccagaattaaatatagttatacatacttattactatctacgtatcaaaaaataatatcgtataactttatatctgggcaagtgtatgtccagatatataaccaaaatctaccatatcgtgagacgaatgtagtaattaattgtttactattatatatgttttaaaatataaatatttttaaagttggataaggaaattaagaaataggtgacaatgattagttaaagtatgtgatttagttaaggaataaataaataaataataaacgaataataattaggattagttgagataagagataggtgaaaaaaatctttatttttttttaaaaaagttaagcgatagaaataactttattttagatagaggaactaccaatgaatcaagtgaatgatggagtcggtgaatttaggcttaaacgtggtacgtatgcatgctgtttggccacggctgctatggctcctggccttttggggtagcgccgtaccgtacctaccttcccaaccaactccaactttgttgagcttgaacacgacccgtgcgtggacagggtttacaaatgcgatctctgttgggagtatgacacccatccaatcaactaaaaccatgagatcgaaccggttgcttttgtcaacataatccattgaagttttgcaaaacgaaatatgagttccaaagctaaccagttgtttacgtgtaaatttgtaataattagttgtaactcgtttagcaaatgataaaatgttattctattattagaaaaggttacgagtgagccgacaacgaaaacaaactggtttacgcccaaaaccaacctttttttgtttttcgattgatttgacccaataccaatctattttgtggaaatgaaaagtttcaagtaacaaaaaatagaaatattgatggaaaagtgaggcaaaattttggcataacctttgctatagttatgatatttcagattttaaacaacactgacaatgcataatgtaacatataaacccaagtgaaaacatcataacaactgtaaaaaaaagttcatccatcaacagtacagcacataaaaatttagaggcacttttctgattagaggcgatttgtaatcgcctcttaagttataaattctacaggcgggaaacacttataaacaattttaagtgtactttttatacacttcctaatttgcattatatgtaaagccattgccttgagacatttttatatctctggaagggtaccttttagcaatttaatcctggtagcgatggagtaacacaaggcatatacaaccaaataatgagaggagtgagatgaggttgagatggttattatagagaagatggaagcagatagtgaagagtgaagagttgccgataggtgggtctactctcatgggctcacacgttagagagaaacgttcctacgatgtactccctctgtcccaaattttaggacaccatctttttaaggaaaatcaaactcgttaacttttaactaataattatactaaccatatatatgctaagtattatgcatgttatatcactttatttatattttaaagtactttcatgttatgctaatttcatatttgttaggaacataacatgtaataaattaatggttaaactatgtcattgaagacagtgtaaaaaaatatagtccttataatttaggatggagggagtactgtatgttagaggagccccagtcgagtgaagatagaaataggaattgtggttttttttcctttcttttcacaaatgcatctaaagaaatattacaagacatgaaggcttattataaaacgcctcatcatttttgaagacaattcatcacaagactacagtgatttattacaattttcactaccatgcctctacagactacagtgttataagtattgtagaaaaacagaatatgattacaaaaaatgattgtgatagagtacattaattcccagctggatacaattcacatcaaaattgcaaagtcaattctctgtctcgttgtatccgattctccatgcttcgatggggatggttcaaactcgagatatgaattcacgcaaaataaaggaaacatactggtattagaagtatatatataaatttacacggctacgaaatgcattttcccatatgatcaaatccggttttcgcaggcggctgggtgactcatgcctccccccccccggaccaccaccgcacctccctatcaccggatccgccaccgctgcgcctccccaccaccggatccgccactgccgtgaagggggagggtgaccgctgtcggatccacgcgggccgcaaacgccgccgccgttgcgcgcctcctctgctctccaccattgcctgagccctccaccaccgttggaaggaagaggagaggggagaagaagaggaagtcatggcacacctcctccgtcctcttgcactgcctgagcgctccactgccgttgggagggaggagaggggaggagaggaggaagctgtcgttgtcgcccttgcccatcgtcgccgccgccgccgccgttggcagagcccaccgcagggagggaggagggaggagaggggcagaggagtttgagaggagggggagagagagagagccgggagagaaaaggagagtgggtggttgactggttggagatagagagagatgagtggaaaataaaaagaagagtgggaatgggagggaggatttttgtatgcggatgaattaagagccccgaatacgaaaatacccttattttcgcgtgtgggtgttttaagtgatccgtttggaaaaattgattttttgcatacgggtctttaaggagccgtatgggaaaacggaggtcgagttttgcatacgtggacacttatggtccgtctgtaatttattggatgctcgttcagaaaaattattttttagtaatgttagttgctgagcaaatgacaattgtcaccgctccacctaactcaaaaagacacagggagcttttgattgaaatggtccaaaccgaagagctgaacatctggttggtaaatgtctcctctcagttcaacgaatatcgggcagataacagattctcgcatatataattgtctcgtaataaactgtgcaatgtcaacctcattttagtagcacatttgttttggatagtagcatggcctagctttgtccatctcttttcttcccttctccgtgccataccacacaacattttgatttgggacaaaaggttggtgaaatggacatattttcacatatatatatgctatatttttcttctcagtttaccgaaaagatgtacccttatatctcgtcatcgattttgggtcaggccagaaaaccattggtaacagaatatatgcatagttttctttatcaataaaattaatgttttatttaaaaatcgataaaggaactttttacaaaattaggctagaaatggtctgtctattatgacaaggtaaacttttgcgacattaatttggatggcaacttcaacaattcaaattgtcgttgtccacaaatctcttggttgtagaagacccacgcgtctgcaacatttttgcgccgaaaacttaatacataaacttgatttgttgggatacatggtgcagaagatacgatcattaataattcaaacagtgcatttcatggtccaactgactgccacgtcattgaacccgtaatcattcgctaagccaaatcaaattggcctcaaatgaattttcagcacgactttttacgccccaaaaacctagtactccctccagttggaaatgtaccctaccaagaaacttgtgtccgtcacgacgcctgtatcatcaatctagtcctcttttgtaacaaaataattttagaagatttcttttaatgccgtagaaattaaattaatcctaatgaaaatcatgtaaaactcacccgttataaaatgtcactaaccccctacacggttggtgtcctctttgtagccgaaatgcctcctctttggccactgcatctccacccatttttcaaacatctccaactaactttttgttccatttgcaaaaatgcaaaatgcgaaatgttaacttcacacacacccccctaccactacaaaactctcaccaaccccaatctagctatcagttcagaaagcaccttcccttctttccctattagagcaagtctaatagtacagctcactactagcttcaatttatctataaccaatctaatagtcaattcatacaatagttgcttattatactattaatatatggtctcacctgtcatacacacagtgtgtcttatagtccgtgctgcagctggctacatatctgtagcctgctagtcttctctctcatcgtttatctcattaaaatatgtttatagctggctaatagcttgctaatagcatgctattgtacctgctcttaccaccttctttcccttttggcaaatggcaatgagtgcaaaaatgcttggaaaaataacccccccc

SEQ ID NO: 57953 - DNA, 41924 bp, Oryza sativa
ggccccgccggcgcgcccatcgtcggcaactggctccaggtcggcgacgacctcaaccaccgcaacctgatggcgctggcgcggcggttcggcgacatcctcctcctccgcatgggcgtccgcaacctggtggtggtgtccagcccggacctcgccaaggaggtgctccacacccagggcgtcgagttcggctcccgcacccgcaacgtggtgttcgacatcttcaccgggaaggggcaggacatggtgttcaccgtgtacggcgaccactggcgcaagatgcggcggatcatgacggtgcccttcttcaccaacaaggtggtggcccagaaccgcgcgggttgggaggaggaggcgaggctggtggtggaggacgtccgccgcgaccccgccgcggcgacctccggcgtggtgatccggcgaaggttgcagctgatgatgtacaacgacatgttccgcatcatgttcgaccgccgtttcgacagcgtggacgacccgctcttcaacaagctcaaggccttcaacgcggagcgcagccgcctctcgcagagcttcgagtacaactacggtgacttcatccccgtcctccgccccttcctccgccgctacctcgcacgctgccaccagctcaagtcccagcgcatgaagctcttcgaggaccacttcgtccaggaacgcaagtaagttactatctcaattaattaccttacctgcactgcatatccccaagaatccgcaagaacaaatcctacctaattagtcccagattattatactaccccatttgatctctccttcaattttttttaaaattttattcgtcatcttgcgtatccaaattgtgtgtggtggtaggtgaggtgaaggtgactagtttggttgcatcttgcatgcatgatgcatttgcatcggtgacatgaactggatgagcgaaaagtttggtagtaaaagcaatattctacgctagtagtagggatgtgcacatgccacgcgaggaaggggattaatttggcagcagcctcagatctgtttgggtaggaggaggaatcaaatcactttgctgttgctgcttgctgtgctgagcggtgacagcacgaggtggtagctgcgaggtcaaatttctggttgtgcaacggcttgactcgggctcgacctgtgccgcggagcccagctaccaccccgtgccaaagccaatgtccacgtcacggttgtttaaactctggagcctaattaaagcggttggtttttggcatgttgggatacatccaaccaaggttgagaattagcggttaaaattcctgtgtcacaaatcttatagattaggtaagcttcaaaacttttaaggcttagttcggcaccccaggttcccaatccaaacatccagtatgcaaaacggaacaatccattagcacgtgattaattaagtgttagctatttttttaaaaaaatggattaattttatttttttaagcaactttcgcatagaaactttttacaaaaaacacatcatttaacagtttgaaaagcgtgcgcgtggaaaacgagagaaagaggttaggaacatgggttgcccaacacaccctaagtattcatatctttccaatatttacatgggagcaatatgtatagatttatctcgaaacttaattactttcatagtattagtactaacaaaaatcattagtttaagtaacactagggtaccagtaccatgtcgatgtccaaaatgatttggtttagtagtgacaacaggagattaatctgtaagaactggacttgcctaatgttcaaagcttccttttcctaaacatgcaaataagtctgacgagtaggtgagccgcacatcatgggttgcttttcgtgccagccagctgaaagcttacgatttgggcaaagtcctgcctcatcacggaagcaccgacggcgacagaaactctctaccagtaacctaaccgatcggaaattcatttcgttctcagcgaattgagcagatctactagctcccccatgtgctcaatgactgaaaaggtcgcaagaacttcagacgcttcccctgttttcttctcgatcagtacactgcataactgagtaatataatcccgtttgattggatcgatcaatggtgccaaacaacaacatgcagctatccctttgattagaagatatacaatttgcagcttgcatttttttttcggtttctggatcgatttgcgactgagaaactgctggcctttttggtagtagctgtgttgggaagcttcggatgaactgttcgactgacaaatcggcatggacgtgtttgtgtcttttttgcaggagagtgatggaacagactggtgagatccggtgcgccatggaccacatcctcgaggccgagaggaagggcgagatcaaccacgacaacgtcctctacatcgtcgagaacatcaacgttgctggtacgtttttgtttattccgcgcaggatttgacttttagtttatcctcagcttaattttctttggatcaggcctaaagtatatatcgtagtacatcatacgtatccatgtcatagttttgacaaagctggagttttactagtacttgaaaggaactgagtttgtggagaatagaaggttcagaaccaggccaaattgcaatgctagcatttttctaccaacacatcacatcgttagtgtggctaaaaagaaccttaattaagtatgcatcatatataatattgtcatgataggctatggttaaagtatggcttcattaaatacgagcttttatatgatcaggttgccatgttcttggtcttgaggaccagttctttgggtaagaagtagtagccacgtcttaatcagagtaaccattacctaacatacaattgtattttttttattatccggcacatgcccaatgcacaaagtcgtgtgggtacatatggtaggcggctatctcataccttatgattcaaaccatatgaactaccgtagatacgaaacatttgagtcaaaaccagtagtaaaaaaaaaaaagggtgtagctatatttatggcgccatatttttcaccaaaaaatagtcggtatgtatttacattgtaactccttaaattacatatgtaattttaatgtatttataatgtaagtctcaaaattacatatgtaattcctaaaattacatatgtaaattcaaaaattacatactaactatatatgtaagtaggatgtaaatgtggtgtaagtgaggtgtaatttctgtgtaaatggcttaaaaaagtcgattatagcatgtgtcgacataattttagctaacccgatccggtgtcgtgcttgattcatatcatgtaattatcacggcacgaatctttgtggggatcgagtgatccagaaatcgactgtaacgaagcaaaaaatgtggcgacagtagtttagcaaaacccaaaaaaaacgccaattttagttggattattattttttagaaaagagtacaaaatgttaattaacaagaagcgtacttttttttgtgcgaaatgtgcagctatcgagacgacgctgtggtcgatcgaatggggaatcgcggagctggtgaaccacccgagcatccagtcgaaggtgcgggaggagatggcgtcggtgctgggcggcgcggcggtgacggagccggacctggagcggctgccgtacctgcaggcggtggtgaaggagacgctgcggttgcgcatggcgatcccgctgctggtgccgcacatgaacctcgccgacggcaagctcgccggctacgacatccccgccgagtccaagatcctggtgaacgcgtggttcctcgccaacgaccccaagcggtgggtgcgccccgacgagtttaggccggagaggttcctggaggaggagaaggccgtggaggcgcacggcaacgacttccgcttcgtgcccttcggcgtcggccgccgcagctgccccgggatcatcctcgcgctgcccatcatcgggatcacgctcggccgcctcgtccagagcttcgacctgctgccgccgcccgggatggacaaggtggacaccaccgagaagcccggccagttcagcaaccagatcctcaagcacgccaccgtcgtctgcaagcccatcgacgcctaggtcgatcgatcgacctactcaaatcaatcatgtgctgcgttatcctattgcactaaaaaaaggttgtatttttgtttggggggggggggggggggtagttatgtgtgtgttctgtgaggcaggcacctgttgttgtaggtttacttaacttttttttttcttatacttgttggttcaaacttaattattggtaatctatactgcccaaacattgcaaatatatcatttctggctatttacacttcatcaagacaaattccaatagccctattacagctcgtaaaacacgtaaccttgagaacatacagcttttgcctccacattggtatataggtgtcggtgtcgccataatttataggtaagtttgttaagaagattcctcatagtgaaaaaaaactgaaaatgaaaaaaacgcagcctacatagtactataggtattgaaaatataagcacatataggtttaatttattttataaataaatcacgacattgaacatatatactagtataaacacatcatacaatttacacatgtaaactagatagtagagcgtgaacatatcgaatgtacgaaacattatgaatgcgtaccggcaattttggtcgtttggctgcacagtaggaacaactcgccataacgggctttgacgttgatgtgcagcacccgagcaaagaggaagacgatccaccataacgggctttgacaatgacgtgcaacactcgagtaaagaggaagatacgagctgtggtggacgaacaactagtagtcgcacgaaacgcttttcaaattcatatgtataatctcatcatactacttccaaaaagcaagccctagtggaagaagagaaagtagccgcgaagcatcgacttggcagtccaattagcaaagaaaattaaaaagaactctttagacccacctgccatccctttccctcaaccaataatgccaccatatatataatctcataattctgattcaattactgtcataatgtatcatcaccaaatgcattatcccacaacactactcaaatatctactcatctacacatcgatttcaatggattttctaagttaccgtccacggctatgctaaagactgcagcaatgtacagtattgtcttggttaagtatcaacaccaccaccatgagggagagggatcgcaggtgggtccagagagttttttttttcctgattcaactgtcacggtggcgtcactaatgcaagcacaagtcaaaacaacccagaacagtgctaagggatgtatttgtccaatataaatagttgagggtgtaaaatatcctgtatttaagtttagggagggggtaattcagtcgactgcgatagtttaggagggaattagtactttttactagtgaaaacgaaccgattgaggactcctggaaagaagaatcaggctgtgtttagaactaaagtttggatccaaacttcagtccttttccatcacatcaacctgtcatacacacaacttttcagtcacatcatctccaatttcaaccaaaatccaaactttgcgctgaattaaacacagcctcagagtagctctatataggaacagcacacagtgttctcttttcttttgtgttaattggatcgtcttttgttgggcatcaaaatttctgggcatgggggttcttgttggatgggttggattggccatactgcatctacttgtaatattcatgttggtatatatatatgctaaatcagactagaagaggtaattaagtggaatactaaattccttccaaactaaaggtacggatctatcattgtagaatattgcatatatatgtagatcatgaacctagatactacctccgttttttaatagatgacgccgttgaccttttctcatatgtttgacctttcgtcttattcaaaaaatttacgtaattataatttattttattatgagttgttttatcattcatagtactttaagtgtgatttatatcttatacatttgcataaaaattttgaataagacgaatagtcaaacatgtaagaaaaagtcgtcatctattaaaaaacggagggagtagaaaagaaggttatatatgatggaataaggattgcagttaacctcaccaaataaaggggtagatcagaatttttaacatttcacattgctcttgctgacttgctgttactctttacatcattacatctcgaaattgaacttgccaccaggcacagaacaacagaacaaagcaaacagaccgaaaggagcgaaaccaacatattagagcaaaataactttagattaccataaaaaatccaacatattatggaattggataatcaattattcattttgccaatatacaattctagccaacttgcggcaccttgctgatcccttcgccaccggttggaagggctccaatcaccagcacgacgcgattacaacagaattcatcattttcctctcgcccaatactattcgaaatcaagtacacaatatttgtcacctgcggattctcacgctttatggtgtcgtaggccgtgtcctggtcctttccgaggagctctggccatgtctgctctgcacatcgaccacaaatgatgaccaagaaatccatgtattataaattgttgttctccttcatctcaaacaaaaagtcaagtagaatgctggtgattggagcaggttgaaagaaggaagaagatgataagagggatgatgggtgtgttactcacttccttgacaaggcggtgccgtacatggctcatctgcagctagtatacatgtggttgaaattagaactagtagaataggcagcaggaggagggttgaatataatgggggttttggcattgtagatgcagtatacatgttcttgttcactcgatcttgttgcaggttggatttggggatagaagcatatatataggtcaaaagcagcatgcatttgatgggtttatctggcgtgagctggcaattgaagatttcaatcatttgtattcatagattttattgcatagattaatacatggattttattgaagatttcaatcttttgcattaatggcttgagctggccagtattaaatttgtggacactacagattttattgcatatgctctagatttatttcatttagagtgaaactagcaaagtccctgtacttcgtagagggatttacaagagaattttattggatgtttatgtagaaaattactccctccattccaaaatataaagcataaccatcattaacccaaagaccaagaaataattattatcatctcatagtttggattaccctaataaatagaatacatgcacccaataaaattaaagattttgatggtggaagatttaaataataatattgtagtggaaaagaaatgctaattaatgacatgcatgcatgcacaccttatattataaaacaacttttaaaatagttatgccttattacgaaatggagggagtgcgttgttttgctagttcatttaccgtgtgaatgtacatatcttacggaattaagcgacagaatcgcatggcattgtaaaggaaaattaacctttgagatcgagattgtcgttttctttttaaaaaataaatcatttgtggatactacagattttattgcatatatgctctagatttatttcatttatagtgaaactagcaaagtcctatacttcgtaacgggaattacaagagaattttactgcatgtttctgtagaaaaaaaatattttgttttgctagttcatttaccatgtgaatgtcaaattcttatggatttaagcgacagaatcgcattgcgttgtaaaggaaaatctaccctatgagagactatcgttttctttttaaaaaaaaatcaaaattagaaaatactagtcgccaatggctattattgttttattataaatattatgattttaggaataaggtaaacatgctgattatttttcaaattatatctacttagcctaataaaagaatagtccacattaattacaccttaagaattattaatttaaaatttttaattaaattaataaatactgttttgatagttcatgatatttcgagctgctactttgtattcagactgatatatatcaatatatgttctctgttcgtaaataaagattaaatagctcagttttaaaatgcgtttttgtcagttgattggactataattacctgaccactcattgataaaacagttcattcaatagacaagaagcaacagaattcattattttaatcaaaacaataacttcacgaatgtgttcattaggtcaaatataaaaatgtaaattttagatgcaatgcgttcgaatgctgctggttacttgttagaatctaaggccctgtttggtacagctccaactccaccttcctagtttattttgttagagcgctccacccagctcagctcctattttaggtggagctgaaactatttggttgggctccagctctaggagaggtggagctagagctggacctgtgccaaacagaccctaatcctagaggcaaagccaccacagatcttaaaaaccgattgtagggatgtaaatcagacatatgattggaccacgtggctcctgagaatttagagttaggtcctctgaaaattagccacgtgtcccccatctttatcttctcaagcccgccgttcggctggaatatgattggtccacgtggcacgttaaatttgcgagtaatttgggagtgcgtttctctttcgtgcgcctaggtgccaggcccgtctccctaggaaagtctagatcaatctagctggttacccaaacaattaaaagccgcactgggcttcacgacccagtaaggacgtcttatgccactcagactctcacaagtcataatcataggctcacagtctcccgccctcacgtagtcacttgtttggatttgtggtgccactgtgtgttgctcctcgagctggagtaatcataaatagaggaaaataaaaaacgaagaaaaaataagaaagaagtaaggaaagtgtgtttttaaatagatgacgttattttttatctaatgttttataattcgtcttataaaaaatataagtaatgattaaaatgtctttaatgataataaatgatactcacatgattttataaataaaacaaatgttcaaatgctatatttaaaagtcaacaatgtcatatatttaaacaaatgttgaagtattttaaatccttgtaggacatactgtaggttaagtcgaaagataaatacgaaataggagagaagtacatgacaacattaatatcctatattttcagaagaaacagtaaataggaaaataaatgaaaaccatttaaaaggttagatccaattttgtgttttgagaaaccatttttgaaaaatatttgttatatactacctcttccatcctaaaatataagaatttctaacaattataaaaccaattaagcttgaagacaaaactagctcgtagactcccaaaataactactaactcatataaatacatgggaaataaattaaagagcgccaactggcatgtttattttctagtttaatttcgagttccagacttgaagtcgcatgagtttcttcaccacttgattggttgggccaagaagttggtcagttgggctgaaagggatgggatatggcccgacaaaaaggaaaataaagacgggctaaaacctaccataggagatggtccacaggacatatgggtcccactaagtctaagccctttcggctgacttaccacaggaggtggtccataaaacacatggatgcgataaaattggttatctttgtgaatggaaaacaaaaatcagaatggactttcagttacgaatagtagtatcaaattttgcagaccactttgctcttgcccaatcaaaattagcgaaactatacaaacagaaatctcaaacaaggcatttgatttcattcacgggccatctgcaaaaggagttgacagtgctggaaggaacacaaatcaagagctagtttcagtcgttgctccctccgattcccgatcacagcaactctccctaacatcatccagcaatgacgatgcagtatcctgcaacaacagcgtgtgcacctaattagaatgcagagcacttgattcactcgaaaaggcatcgaatcctgtcatcctgagttgttctcaaaataactttgtaccaataacagaaaaaaaaatgaaaggctgtgtctcagtgaatctaatgggaatggaagcatttaccagcgaaccagagtgcgcaatcccttcctttctcttcctctcttccttcgatctcagtgattccactggagtgtaaacctgtcaaatgaaattgagaactagccatcagcatccaacagtagcacagaaaacaagcttaaatcgagctaaatcgaatccgcgggcggcacgcggacgaacgagagtacgagactgacctccggcatgccgatcagccgcatgagctccgcgacgaggcgccgctgctcgtcggcccgccgctcccactccctcgcctcccgccgcagcgccgcggcgcgctcctccagggccctccccgtcacctccctcgccgcgcgcatccggccccgccgctcccgcgccttctccagctcctccgccagcgacacctccctcaaccccaccctgcatcccccggccttcgcgtacgacctcaccgacggcggagacgacgccgccctcgccgtccccttccccttccccttccccttcgccgccttcccggcgagcgccgcggctggggaggccaccacgttggtgtcccgcggctgcagcggccgccgcacggcgacgacggcgaggcccccgcatcgcgcctccatcgcgagctgaggatgcaggagaggcgagaagagagaaaaggcggcgattgattaggaggagtttttcaagggggggatttggtgggatgggtgattcgaatttgaacccgggatggaagggaggtaaagtaacggctagtaaaacaggttgccctacgaatggacggttctgcccctggggaacgtgggggtatcaggaagatgttgaggggtagttacggtatgttggagggggtatgaatatgatgctgttttgcatgggttctaggggaggcttttgacgatctggctttgtgctgggtgtcatctagcgggttcggtggcttttggggccattggaggtttaaaatcgagggcccaaagcatgaaagtgatgcttctgatctgagccaatatcaatacatgtaacacaccacaaacacagatgtttatatacacgtgcgcacatacaatatagctatgacagtattttagagactaaatcagcatatcttaatattgataaaatcatcacaatataataattcaatcttggagatacgctaaaccgcacccagtgtgcgttttaactaaaacgctcccctcacatagcccccccaaccttccaccccctccccccacccccatatccatccgcacaatctttcccacatccctccttctctaaaaaattctttcgttaaataatcagttactatcagctgttttagttcaataagtaaccaagttactatcaagtaaaccattttttaatgtactcccgcacttctttcatgattggccccattagtaacaagattgctcaccttttttatctactcccgcacttctttcatgatttgcccattagtaagaagattactaagtcgatcagctatgagtaaataagttactaacactcccgcactcccaaatcgattccatctctcagtaaatggattactcctagagtcctaggttgttttcaacctttctcaatttggttcctcctctcagtaaatgaattactctcacgacgttctcatctcttctcttaataagttagggtgtgttcgcatgtgctagttccgatccagggctgttgggaaccttgaccgtgtgggtcccacgcatccacgtgttgtggcgctacagttgttcggaagcaaatggctcgaacggagttacggtgccgtcacggcttccttgcctatccctcgatcccctttcttccgtcatccactcctctcgctcgatcccctttcctccacactcctctcgctcgatcccctttcgtccacagcgccacgacgaaattgccgtagggaagcagaggaatcccccctgccacccgcgaatcgattcttccacctacaaaatcgcaccgccctcaccaatcccccctggaatctctgctccaacgagtggtcgctgtcaggtaaagctgccggcagcacgacccagctccatcgattcaagcgagcagtatcgccgcaggctaggagcatcggtgcaggaggcagtgctgtggctctgggtcggatagtgctgagcatcgtcctggagggtggcaaaagcgggcaggcgtgctccctgtgcgcgtcggcatcggcgctcgtccggccgagtcatcttgtccatgcctggcagcgcccgtgctcgtcttggagcgagaacagttcgcacggaattgaagcgcggaggcagcaaagctggcggcctcaacaggaagccagctctatttgaggaggcggttgtggatgcggcaatggaggctaaggggaagaagcggaagagagaggttgaggtctcacaccccgcattggagagggcggtagttcctacgaactccgctctaccaatccaccgatccgctctggagtccggcgaggactcctccgagtccgtcacgtcggacgcgggcaccgccaagcctccagccaaggacgtcgtgcatgtcgccaatgcactgtgtacggtgtgcaccaagtcccccaaagccgtcatcgagttcgtgcgccgagtgagcccttccaccgtcagccgttcaattgactgggacctcgtcaacgaggacaaatcatcgaaggtatggctggctggtgtagtttgtttatgtcattcattttgtttgttgactagcatttcagtagatgtccgaatcgcgtggtcgctggaccgatttcgagctgcatgtgtttcttgagagttgcttggaggagatggcggcattcaacataacatcgaactcccccaaacccaaggcatgggagaacttggtgaagaaaatgaagaacaagtgcaagaagaagatgacgaaggcgcaattggagtatatctgggggcagtgcaagaagcagtaccagctgtgggtgtggcttgaatcgtaggcgaccggacttggccgggacccccttactgcagccattgtcgtcgacgaaagctggtgggaatgccaaaatggggtatgctacttgtacacaaattcattttgcaatccgattatcttgctaccattgtgttaccatcatgtctaatatgaacataggcagtatgtagtaaacgttttgggctttggggaatctgattggtgccgctagtataacctgatcagaaagcaaatgatctagattgttttcagcgtataatgaggaatcaaacagattctagaataatttcagtagaataaatgcattctcaaatttcggttggataatgtgcttctgaggaattggataatgtgatgctgctgccctttgttctctagtgctatatggtactataaattggctagtccttagaagtgacttttgaagaacttaaatggagctgcaagtacccttctttactcctaggggtattagtttgtcctatcagttaatacaccagttaaccatttacgcatagaaataatgaatggtagaatgaccaaaaaatgtattgatctatgtttcatgtgtcataactcattcctttgcaaacacttatcaggaggtaccataacccagtaatattattcttacatgtaccataactcattccatgcagcgtagtcacagaagtgtgaaaataatttgaacactacatcttttgctgaaaattgtttcttattttttagttcctaaattcttaacaacattctttgcatcaaagtccgctatatctgctcatatatgtgtcctattggttatgatatgttttactcatttcgctaattacattactacatgccatgctgcctacactttacatgtcatcttgtctgtactgtgccttgtcaaatatttcctctataacaagttccatgtgtacaattgtgacaggtgaagaagggtgtgatcgccttcagaaacgatcccctgaagcacattgatcttcatcacgcggtctttagcacgcgcaccgttgtcggcaaccactccgccgtcgctggggctgaccaaggcccaccgcaacaacccgttgaatggcagcccattgacatcgacgagctgacagcagcgtacactcctccaccgcccgcgccgtcgacatatggtcagagcaatggtagtaagggcaaaaggaaggcatccggtgagacctctggaagttctaacaagcggacacgcagtagcgattggggcgatgcgcttgacaggctcagtgtgctgtgcatggcgtccatggagagccacgcaaagcaaatggatgcttggaaggctagcagccctgacggttgcatggagttggaggaaaaagatggcctccggccaggtagtgaggtctggtttatggccgcgcgcttgctacgtgatgcaagcaatggccactgctttatgttcgcgcgcctcaccgacccagatgatcgcctgcgatatattttaacaagtggcaacgggtttagtggtgcatctggtggttcgaactagtatcagctactctactcctgtttgtttcatgtgttgtgtgttttatttccaactaatcctgttgtaatgtgaaataacttgttcgtggtaacatttggtgttctgtgttgagtgtaagcatctctttcgacatgaacattaatttggtttaatacatgtgttatgcttcattgtctgatttcatataagttggtgctttcaaataaattgttgcattacattccctcatgatcacacaaattgttgttttaaaacgaatgtgtgctttcaaataaatgggttctttctaataaattgctgctttctgataaattgttactctcaaataaatcggttgatagatttgttacaggaacgcggagatgagtagcaatgtcggtccctacggctgggctgatggccataccagcagcgaggaggaagatgccatcatcgacttgctggccaatgagatcaggagaaatgaaagagcacctaaccgaattccagttcagaccggtatcagtaggatgatggacacgttggcgaatagaaggcaatgtcgggccatgttccgcctgaccgctgaagagattcacagtttgcacagccttctagtaacttcttatcagcttgtcgatactggggggatttcttcgctagaaaaattggggattttcttgttcatgatggctggcggccgttcgacaagagacgctaacaatcgttaggtccggtcgaactcaaccgtctctatttccttcaatgaagtattggattgtctcgacaagttggctaggaaaattttgagaccaaaagataccaacttcaggacatctcacataatgtttcaaacggaggaatggtacaaaccattttaccaatccgtgggtgctgtcgacgatacccatatatgtgttgtgacttctgcatgcacgacgatgcaacacataaacagacaccatgtcacgacgaaaaatgttctcgtcatatgtgatcatgatggcagaattattttctgtgattcaggatggccaggatcagttcatgatcaaaggattctgaacgaggatgtgcagtactatcccaatgattttccgcagattccgcgaggttagtgaacttcacttgttcactttacaaactttggtttccacactccaatcaatttatattcattgcggtgcgatttaattaattatccataatatgttctacaggaaggtatctacttgtggactcaggttttcctagtaggatgggatttcttgcaccgtacccacatgtacagtaccatagggatcgattgggacgaagacaagcggcggcacccgaaggccgagaagagcacttcaaccattgccactcctctttgcgaggtattgtggagagaactttcgggatcgtcaaaaagcagtggaaaatactcaaggtgataccgtttaacccagatgatacagttggaccacggatcatacatgctgcttttgctcttcataactttaagaagaattataatgatgatgtgaactacgtttaaacaaatcctctgtacagcagacatcccattccgacgcaaccgggaactttcaatgcgatgtactatgcaacaaacaacgaggaagcgatgagatgagcagatggcgcgacctcattgcgaatgatgttttcagtcgctctcaaagatgagcagcggcataatgtgctttctggtggggttgagatgaatgttcgtaacaactacataaggattgatcaaatacaatatgagctgcctttaattatcactttttgatgcatgtcttaatttcgcaataaatttcattcagtcgctgtcgaccattcctcacatcttatctgcgtaatcctaatgcccgaaacttcttttttagttctttgctaatcacgtggtcttctgaatttacagcggccaactatgcgttctgaatatagattttttcaaaaaaattccctccatgcaatacaaccatctattaacttattaaagaaatcacatgtgtgtgcatatcaaatatttctttcacaattggtgccgcgtagcaaatacctctttcacccgtgtgttgcaaaaaccacccattttcgcatgctacagtacctccactgccagcccctgcccggcatcacacggcacggcaacggaaagtgtcggccatagacggcgtccaggctgccgctttccctccgtccctgacgccctgacgctgctacagtggtctacagtactacatgttcccaacccaaacgtaaagctccgatccggcacttgcgaacgaacccttacttccgtttttttgacaaattgacccttttggaaaacttatttcgaaactaacccctgccaaaaacttcaaccaaaaataggccgtcgcctcagcgccaaacacattggcgctgacgttggccgtgtcagcgccaacgggactggcgctgacattgtgccaccgtggcggccggggccgatccccagctgacgtggcagctacctcagcgccaaccggactggcgctgaggtgggacttggccgcaaccccaaggcccagaccagcaagccttctggatggcttgcgggctgggacctcagcgccagccataatggcgctgactgtgggaaactcagcgccagccaatctggcgctgaggtgggacttggccgtttcggccgtggcccagcccagcaagacttctggatggcttgcgggctaggacctcagcgccatccataatggcgctgaccgtgggacactcagcgccagcccacctggcgctgaggtgggacttggccgtttcggccgtggccctgcccagcaagccttctggatggcttgcgggctgggacctcagcgccagccaaaatggcgctgacattgggaaactcagcgccagccaacctggcgctgaggtgggacttggccgtttcggccgtggcccagcccagcaagccttctggatggctgggctgggacctcagcgccaggtgcactggcgctgagtttgtacatgtcagcgccatttagcatggcgctgacgtcccagccctgctaaactttagcaaaactttgcacacaacacaggcaaacatcaaatgacagaaatttacaggcagtaatatatccagagaaccatacaaaacatacatccatccatcaatcccaacatcattccatacatccatagaatccatcaatacatccatatatgaagtccatacatataagaaataaaaacatcccatcgatcctcgtctatacatccagtcgagtccatacatccagtccatacatccagtcgagtccatccatctatccatccatccattgaaccatgcactcacctcctcctacctctagtgcgaggacgaggcacgtcgggggtgtacctccagtcctgcgaaggagcccgccggcttcgtggtcgagacgggccgggctgcgagatatccggctgtgacgactctggtgcgtcctctagctgcgagggaccgagctcatccgcctcctcttctctgtcctcatccccttcttcctcctcatctccttcctccgcctctttgtcttgctcgccctcctcgtcacccacctccccttcttcatccccctcttggtgggcatgagcatgttcgaccacatcagtcgacctgcagccgagccttgctgccaacttccgacatcgctgccgtagtctctgcataaaaattgttaagtgaaattactaacttgtgtaggtcgatactcgtggagaaacggtgcgggattgtttgaagcctcccgaattgccgcatcacgcggtggcacatctggaactccactgcatagaagcagatcagtgggcaccgtagggtcttcaacgcatcctctatatggcacatgggattcagttctagctcgagcacttcctgtgcctgatatggcatccacaccacctgcagcaacaaaaataaaacacattgaagcacagttagtactatatagtaagaaaccatcttcatgtgtcatagaaccccgaatagcttacatgttctggctgtaggtagtccatctcgtttgtgtagtggtagtacgccaaattcctgcggcctactactggagatgggaccgattcccacaggtgagctacagtgggacgtcggtctgcatcctggtgcggccaagcctgatgggtcctccacatgggccgaccaactggaagcctcatccacatccaaacctgcgtcacatacgttagcttccaacatgttagcaagaaattgaaatgttatgaaacataacatgcgtgaacttacctgtagcaaccaaacacagcctgctaggttcgcgtccccgccttgccttcggcaagcatcacagagttgccggtacaaccaggctagggcagccgacccccagctgaaggtacccgcctcgtcccagtccgcgagcaacggcagccacatccaagaagccatatctccaccagagtcagggaacagaatactgccgaagatgtacagcacgtacgccctgcagtatcgctgtactgtagcctcgtctgcctcagcgggacactgaccaaagttggctcgcaaccaactcaaaggaacccctgatgtctttgtctgcctctgaccatcaggtgccactggaggctccagaccaaggtactcctcgaccctctccctccagttccccgacgctgtgtcacctgtaaccggataggaagtggaatcattagtaattgcaaaaaaattaacaaatgaatacgaagactcgttagtaattccctgacgctgtgtcacctgtgaccgcctgaccccggataggaagacccaggatcatggcgacgtcctccagagtgaccgtcagctccccgcacggtaggtggaaggtgtgtgtctctggacgccaccggtccactagggccgtcagagcagcggcgttgtacagaggcaccggtcgctgcgccatggtcacgaacgccaagagcttagcccgccgtaggtacgggacgtaccggtcgtcgaacagtatgtgcgccgtgtgacctctgactcgaagggtcttcaagcgctgcatcaaaaataaaaatgcgattgcttgattctttttctcttctgcgtaatcaagaataatataaaatcataaagattgaaaacaatccttggagcaatggtcagaatattaacaaaatgcgattgcttgattctttttctcttctgaatcattgcctgattgactgtatggtataaagtcccttagttattcgtatatatgtgtgccattgtgtttatttcagcttcctatactttaggaagcttctaaaagtgcctttgctactaccggagctttcactttggattttataacaatttcctgcacaactaccatgtagtgtgggactaaaaaatatttgtttggattcagtatgatggatcccaatcccaaatcagacaacccttctgagaccattttttcttactcagtgttgcatcctgttttgtccttagaagtgattggtaggaattgatatattgctaaatgatgatacattgctaaatgatgatacattactcagcatttgttttgatttgagggaaatttgcgacgccaagattttgcaattataactctgcatcaagcccataattcagattcttcattttacttctcttttgtaaaattggcattcagtaactcaatttacaattattcattgtggaactgtgcatattattcaagttctaattgtttatttgatatattgactttcccttcgaaatggatttgtctagaatgcataaattggtgtttgaatccagattatcattctttcttttttagtatatggagcacacatgcaatatatcctgtagtcctgtggctaatcttcagaatcttctttgtgtgttcataagatagatagcaaagatctccaggtgcaagtggtagctatctaactacttatgttgacatttatctaactacattatacttttgacatgatggatgatctatctgtacaaactaaaatcaaagaagaaaaaataaattcgatcataaaaaaaatggaatattgttgatgctaacctctccgctggcaatctgtggggcccggtgcttctcctcgtagaaatcctccaaccccggaaagtgctccatcctgcaaatgaaaatggaatcaatagtaattgaaaaaatattaaatggaaaaatcacaatgagaacggaaaggaggacaacagaaagtaaacattgaagcaacaatatgaacttaggaaatgaatgtcatccaatcccacctgtgtgctaccctcaccacctccccccgtcctacggcgctttttcggtcgatccttagacttgtctcgcttcgggcacctagttttcttatggcctagttcgtggcatagcgagcatctattttgcatgaccggctctgaatttgtattgttcggcttttgtgaccgtcggttggctgagcttttgtatgctttgtccatatcgttcttgaaccttcttgtccttcttcttcctccacacttcatccccacccatattatccatctaataatccatccttagccaactattatcaaaccacgtctacaaccaaaacaatgcaaaatatccaataaaactttggggaacttagggtttatagaggggtttaccttctcttccgatcccaaactcaatgccgcacaaatcaccttcgattagagaggtttttgggggagattgggcgaggagaacgcggtggcgaccgaaccctaggcgggcggctggggaaaaaacggaggaagaactggctggggcggcctcggccgggctctaagtagccaaggtcagcgccaacttacttggcgctgaggttgggcacctcagcgccgaagcggttggcgctgaggtagctgccacatcagctaggggatcggcccggccgccacggtggcacaatgtcagcgccagtcccattggcgctgacacggccaacctcagcgccaatgcgcttggcgctgagccgacggcctagttttggttgaagtttttggcaggggttagtttcgaaataagtttttgaaaagggtcaatttgtcaaaaaaacggcccttacttaggatagtactcccaattgattggtataccttctcttagtaaataaattatagtataccttctcttagtaaataaattacttagaattaacattgctattgccacaagatttcttagtaaataaattactatggtaccgatgattctcaacataacttattgatcttgccacaaaattttttgtagtaaccaagttactattaaactaatggttcttaacattttctcttagtaactaaattacaccaatgattctcaacataacatattggtcttgtcacagagtttctcgtagtaaccaagttagtattacaccgatggttgtcggaggcgatggcggcgtggtggataggtatggagtgaaagagggcaacgggtcggccatggagggctggccggtggtcctcttgtatctggccatccgcggccagccgccgggagcacgcgcgccttgtgctgacccggcgtgcttgaggggatgcgggtgcgaacgacctcctcgctatcggtggtgtcccaccttagccgaatcatctctccagggcttgacttagtccctgcaaccgaacatttcgcaattcagtgaattgaaaaggccaataacaaatacataaaggaactcttttggtcaaaacgctcaccaatatgagtgaacaaatggaaattcagatgggaacagatttctgagaatacaacacacaaatttgcaaatgacatatttctaattgacatttagagcatcatatgtgtatgagccccataattttcataacatttcagagcttttgacccaactgtgagtatctaattgtccagccgaccaaactaaaaaattatgaaaagggctgcacttgcaaaccgagagaacatgacactcagagctctgaatataatttctctgaacgaaaattctcagtccatctttcattcagcaataaccgttacaaatcaacatgagagttgagagcagccactagacagattgaaaaattgtcacttctgcgcatgtctgtgtgaaccaaaaacattcatagaactattagccaatcaagatatcaactagaaaatctaagaaactacaagcacatcaaaaagaatatttaagaaactgttggcttatcaattaaatgttgtccaaagactgatgaaccgatagcccaaaagccaagcactagtgatataaatcgacatttgttacatcattaagatgagcagaggtgtgcatatcagctaacaagcctgcccagaacacacatgagaaatttgtagagttgtgatcgatgtgcttccaataacacaaaacgaaataggcagccagatctcacctgtgcacagatggaaataatcaccgctgaggacgcagaaatcaagtggatgagtacctctcgtcaagtgcatcaagctgtacaatctgccatgctttcccttgatgaggaatacaatcaatcagcttcaatgtcgctggccacaagtaaaattaagaatattaggcctgaaaaagtatgttctgtcaaaacattccgataaaccgtagcatgttgaatgggaccatatgtagtccggtagttcagaaatacaatccaatccatctgcattgttgaaccacaaaatttcagagattgtccatccgattaagctccttgcaaatcataaaatgtatgtgcattgcaaaagactaaagacagtgaacaaaattgttcagttatacttgtttctaatagttgaacatgaataaaaactataataggcagctaagtaataccttggttatcaaatctattatgtgctcaatatgctttgttaaccgtggctcgtgagtagggggaggcactgaagatcagacatatcaagaatggctgatggccggccagttcctctacgggaagaggagggcagcaactgctcgccatacatcccaccaggagccattgttagctcgctgtgtggcagcggtggtggcagcacaggaggcggcgccataactggcacatgaacctcctcctccagctgctgccgcttcggcggtggtttacggtccttcaaccgccggtggcagaaccacatctgcagctgcttgtctgtgagccctaacttcacagacagcaacagagaccaaaccaagtcaaaacagaaatcccacggccgtttcgatcgaaaaatcgacaaaacaaacacgaaatagccctaaaatttccagaatccccaattccccgtaggccatcgacgaacctgtgtaagtcctcttgagaacctccaactgatagggcgtcttcatgatgcgcttcaccttcccgctggatccagaggcgctacaccaccaacagcggcggcgggagtgggagagggagcagaagcctgagccgacgccggggcagggctctcctcctccatcctagcgtcgcccgttcttgtccgctcgcctctgcccggctccgatctccggcgactgcagcggcgacccacgagcgctacctctccagccgattccacctgtcgctggccgatttcgcccgtcgcccgccgcccgccgctggaggacaccgccaccgccgacgccgctcccagatcctaaaaatacggggtataaccgtacaaagcaggtgtcaagaaaatggcttataaaatggtgggggtgggcccacttaaagtaacaacgttactatgagtacaaggtaaatacatactcacgtaggaataattttactatcggtactacacgagcgggaggggggtgttccaggggtggggtgtgggggtggggttgtgttttaacccatgtgtagtatagtatatctattcaatcttcattgaatataggagcattataggacactggataaacgatcattttaccgtctggggcccttgtttgattgggtgcacggtccatggtagatgttcaccgcagtggcgtagccaggttttcaagatatggtggtacaactcagcaaatctacaataggattatacaggattgcaaggtttaatttcaatttaccattccaattccaatcgatcggatatcctaaaattgaaatgagattgaacatttgaacctaaagaaaaaaaccctactgttagggaggagaaagagagaagcagatgagaagttgagaacctgctaacgtgctgtttgctgtgctttggtgttgcgtgcctcctgatgaatggagtgctgctgattgctttctccctgctggttgctgctggcctgtggcactgcgcgctggtgcggtcgctgcccgcggtggcgcagtcgccggccgccaacgtggcgacatcacaactcactcgttagtgccttagggcattagcactgcgtcacgtttttctgaggagcctaaacagccacgtacgaagaaacagcgtgaagctcctctctccacaatgcggcgtgggcgcgtgtctttaggtggacctcaccaaactgtttctcatgcgggccccaccacaaaaatttacttttttggtcagcttctcccccttctctctgtgtcctgctttctcatgtgcaaatgcgattaaaaaagctgtttttctgacgaggctctcggagccaaacgaggacgcgcggagctggtgaatacatgggccccatcttcttttcttctccacgtatacaatctgcttagctggacagttgaggccaaataccatgtagatgcattgtgaatggccttagtgcctcagtggacagtggtcgtcgtgactcgtcgacttgcgcgctcgaaaattggaaacgacaattacgatggaaacgaagcgacgcgccgacgcccgacgcggtgcttgaattggcaaaaaaaacaaagcgtcaaagtgccatctatatttttctggaagtagcgtatagggctaatgggccttaggccaaaattctatgatggtccatgaaccacacggaccacattatagctccgcccctggttcaccggttgatatcccaaacctactggatggcacgcattttgtgcagctatattttctttaaagtatttttaagtatcgcaggacatccaacatgcataaatttgaaaatcaatatgatagctctgtttttttaacatatgatatagttgacttttcagttcttttgattattcttctctataaatatttatccaagtttgagaaaataatatttttgtcaaagtttaagaataaaataattacgtcatatctactagagtacttaaaagcagaatcatccaccgtttcgttcgcatagcatatcacacgaagcacaaccaccacctctaaaataaatgaataaataaccgcatcctatcccaaccaaatccttccccttccttgatcagtctgtcatttgagaagagtagcagtagagttctgatgttgagctgtatgtgcctccgagcgaggaagtatcaggtgctacagaacagttccgtgctcccgtactaccaagctttaaaaatgcacccaaaaagtcaaaaaaaatgtaaaaaaaatagagatctgcagcactatgacagcatcacagaaaaaaatcagcttaaaatatgatgtacacagggagaaaaaaaacaacaaatctgtgctccaacagtgttcaaacatgtcgctttactattcatattttgatttgattttatgtgatgttacatgtcatagtgctacagatctctgatttttttcacatttttttgtgactttttaggtgcatttttgaaacatggtagtacatgagcacgaaacatttccgtatagcatccgatacttcctccgagtttttctttgccaagtttcgttatgtttttctactgtttgcaaaacgctgttcaaccttgataatctattattattattattattattattattattattattattattattattattattattattattataacattggacggagatatcacgttcgttgtagagactaaaagttatcatattaattaaagaaaaagaaaaatgtttacactgttagattgtgatgggtgtagattataacaatgtagattgatcatgtatccataaaggaaaataatagacaaaatccatttgggattttcataaaaatatatactccattcatttcatattataagtcatttgaccttttttcttagtcaaaatcctttagattttaccaagtttactaaaaaacttagcgacatttacaataccaatttagttttattaaatttaattttagatatattttgttaatatgtttattttgtattgaaaatgttagtatatttttctacaagtttaatcaaacttacagaagtttgacgttacataagtatgagtaaaagaagatcaaattacagaagtttgacttacataagtatgagtaaaagaagatcaaatgacctataatatgaaagagggagtaatagaaaaggacacatacgatactacaggaactctttttggagtccgactcacatgtcccaagcatgcaaatcctaacatgttttttatatatagaactaaaattaatataaaaataagattaattaaaattcaaaataaaaataaatagactccaaaaatagtatttcaatactaaccccaaataaattaatatttcaaaaaattataacaataatacatctatactcctaaaaaaattagtagtggtggtggtgagcaatgaatctgccaccacccctaccactaagtccatgcctttttagattgcagaaaaaaagtgaggctagaggttccacatatcaacctctacaaaatctctattttttattagaaggaaataaaacagtgtgggacaagaggacccacatgttaataataaatatatgtataaattaagatagggtgtatatctttacctattataaaagttcaaggtgtttttgccagaattttggtacgtcatccgtgtttgaaacagttttagttttatgttttgattttaatctatacctctactaaaaaaattcccatcttatatacgtaaaaaaaaagaaagaaaagtccgaatcaaaaaaggtaaataaagaaagaaaagaaagtccgacttaacgagctattaaaaaaaagaaaagcttccgtcgtagttagtaaaaaaaaacatctcttgtccgactctatagaaaaaggaaaaaaatctcccagtaaaaaacaaaaaatctgtttgattttgttggcaccggtattattttttccttttttctttgcacgcagagttttttttccttttttctttgcacgtagaagagttttttatgcggctaaagcttttggtttttttttatctttttttaatccgatctattcaccgtgcatctcttgggtgcttatagttttttcgtcaatattttttgtcaccggttttttctcccgtgtactttttgtttgtctcatccggttttataatcccatctgttcgtcgcacgcctcccgaggtgaaccctagcaccacgccgctgccatatcgatagtgtgttttttcctccaatttaattgtaaaaatcgattccctactcctctctcaccattttctcaatgatttccccttcgatttagctttaattgttggatttaatctctgttctaaagttgccgattttgacggcgatcttccccggtcatttttatcccgaattttacgctctgattttggagaaaacggaaagagtagattgagtggatcaaaaacctcgaacaattttggttacccaagaaagattcggctggatttgatggggagatttgctttggcaaacgtgcgggcacgagattatcttcgggcacgggattatcttcgggagtcttcgggaggttgaagatggtagtcatattcggaaagttgaagatggtagggtcgaagagaagcagaccaaatggagggaggtagcgggctagcctagggctgaaaaggaaggaaggctttcggctaaaaacctaggaaatattttcattaacttttttttaattataatatatagctatcccaatgttaagatttttattaacttttttaattatagtgtatagtgatcccaatatttcaatttattacttagctcttgatatatcactgcaaaaagtctttacccgttgcaacgcacgggcatcttttctagtataaataatggaataaaggttaataataagttaagatagggtatgatggtggtggttgatggaacatctatatctatacttctatactaataatataaaaaggaggaattgtccccctccaatcctacaggccaaatcatctggttaaatcccaaccgtctatccatagatcaggtaatccgtaccgtcgactgatctccaccgcacggtttcatcctctccacgcacaaagaccgcgcgaagcctcaccctcttcaggcgtgactagctcgctcctcctcgcttgtactgctgtcgccgcctcactccaccgctgcccacgccgaagctgacgtcgtccccagccgccgccgccgcagccgaagtccaccgctaccctcgctggatccggcttcttctccagtcaccaccggcgccgtggtgttttccgacagctaggtccttcccagcctccaccacactacaccgcagcctcccctcgccgacgccatggtggttcccgacggtgaagtccttacccttttgccgcgccactccactgcccccgctggcaccgtggtggttcctgatggcaaggtccttccccgccggcgccgcactccaccagttgggttgattaccgatactatcttgcttctggctgcctcaaatcgtgagaaagcagggaaccgatagagggattactccagcgccaacgtcgatagaccgcttgcctcacttgcgccgtgtcaatcccttctccgatcccctccgtccccatcgtctcttgccgctcacctccttctactctgccacacaacctggtgatctctctattgtcacatgttcccctctccctttggttaacgctgaggagtattaactaattttgttttgcatgttatatattttataccagaagtccagaacaacgtccatcggcatgaagatgagttgtttcaggttgttgaattgcttgccaatcccctttcgattttccgtacgaaatatactcagatcttacatccattccctcatgttggttcctctgtgattttctgttgcagagcatagcttcatcaagccaaatttaatgttttctaatttctcctgtttgttcttacgtgatattacttgtagcagctaaaatcaagatgatctggcttgggtaggtttttaggttgtgtttgtatgcaactaaaagttgccaggctacgctactaggtatgctgtcatgatttatatatttttttttgcagtgtcatcattttgtatgaatcatatcttcatttggtaccattaaaattctttctgagttatctcttaatttcttaccattagaaacaatgactctcaatgttttcaaggatcaagttcactgccatgatacactgaatatagccatgtgagggagctcttgccatcaaaaatatgcattggacgtgcatgattactagtagaagcaaaactaggagtagcagatagcaaaactaggagtagcagatgcatctaccaaaggaaacccgaaacaagccttcccaagcaaggaaacccaagacctgacgaaaacaaactcgggctcagaccctgacggtctgaccggccacatacctgctgttggtatttcttaacgacgttactagaaatataattcccagcaatggcacagaaatactcctggtatattatggttacagagttcatccgcaagcgcacggatataccattgtagtatttcacccgagagtattccaagagtattgtatttatttaatcatgggaagatcatggtagattgaacttgactaataatttatatattacttgtaataatcatagtctaggcaggggttaagataatccaagagtagagtgacacacaagcagtaagctactcattctcatactaaattatctaagctaagtggaaagaaaagagaaagataatgtactcctatacttctagtatacatagtatactacattctagtcatctgatatactagctaataccctctatccgatgcccacctggtacttcgagaagccacccctgactgccgagttccttacgacagcccgtcataaccatacaaccggggctaaatacagaggagtatcctctccaggaaattaacttagtactatatacacgcgcggaggaatacccgtactgagctgtcactatcagcggcccacatctcatccgcagcatataaccccaaataatgatatcccgtaagctagacactacgtctaaactaccagatactactctaatatcatcgtcatggcatagagcaattgcatacgcaaatattatacccgcactaaaacatctcctagatgagctagtagtatattcaatataacatgaacataatgtaaagttggcaatcatatactcggaaagtatttcaattccataaatgtataaagaagagtattctaaataaagtacaaagcttacaaaagagaagagaagagctactagagccataaccgaactcttctgaaggcttccggactccgatttctactctattcctattccactagcttaagaacactaaactaaacttgagagaatatgcttgaggtgtgtggaggaagtgaggaggtgaagcccttttatagctgaactatgacggttacgacggttggaatggtcggaattaccctccaaccgtcataggggcttcatctcagccgtccagccaaaacctggatccaacggtggccaggtgggttcggccgaaccaggggccggcccatccagcccacaatttggctggtggcctcctctactgctcctctccgcagacttgtgaattttggcccaattcgtcgtgttaattttgagttcttggcccattcatgaataagtttgattctcgacatcgtccgattgatttatcgtctgaattgatgtcgattctactccactttatggttattctctgcaaaaagttagtgaaccaaatactagtggaatattattattctaacatataaatgcattgcaagcataactagttcccttctattttggtagtactgatggtcgaaactgatcgctaacgatcgtcaacacctgcggtcagtccggagttcaggctgtggtcaaaccacccacatacctgcggtctgaccggtcctgtgaaggaaacccaacactttccaaactttggcaattttcacctatttcatccataggtgccaaatttgggtgtaaacaccgacatcttcgaccctcctctagatctcccttggaaagaatgttgacatctctagcactcctctaggactcctaggagaaaactccgaccattgggcaactccttcaagagcttcctctcactattttactatattataactctactatagagcagcctaaacatgaaagtgagttgtactccactttgctgtgtgttgagagtgaagcaagctcctccttttctatagtagttcggtaagcttgggtgcatgaaaaaagagggagtaggagatgagaaaccagacttccgaacacgatgggagagaaaaaattaggatggagatgaagatataggaaaaaatgagtaaattgcacacacggtgcattaacttggcagatgagtgcaatttagtgcaagaacttgagaaatgagtgttttagtgcaacaacttggtaggtaggtgcaatttagtagtataaaatttttataagtgatcatataaatgcaacaacttgcaagataggtatgattttgatacaataacctaagaagatatgcgacaatttaattatttggagcatttttttatatagattcaattttaagtacttattttgacaatatactagcgtgtatttgtataagaatatttatatttttatcctaataactgatagctgaaagtcaattaaactggatatagaaattattatatttcggttgatatttgagaaggtgaagaaaacaaaaaaattcttaaaaggtaattggatgtaaattgtatgtgcagtataattcttaaagattaaattcaatattataaggtaatgtccgtaggattactatgtaatggcatattgatatcgtgaaaaaaattcacttagcatatgcttagccaagttgatgtaccaaaatactaataaattattaagttcttataccagaacgctttcacttgttaagttgttgtacttggacatttaattctcaagttcttacactatatcgtatccacctgccaggttgttgtaccataggtgcaatttacttgaaaaaattgagctgggtgaaaaaaatacatgcgggtctcctaactctttttacatgtgagcatcttaaggatgtgggaactttcccaacttaattatctctggttcggtatgcgtgtttttccaaaccgttaaatgatatgtttttttacaaaaagtttatataaaaaggttgctttaaaaatcaattaatctatttttcaagtttttatctaatactacctccattccaaaatatagcaacatttgttctgaacggacaaatttatagctaaaaatacttatattttgaaacggagaaagtatttaattaatcatgtattaatttgccacttccttttacttggtaagtggagaagttccaaacctcatctaacacggccttaaaaaactgtttttactccacatgaaaaaatatattttttatattttttgaactatgtagatttttaaatttaaaactagatacttccaaaacttattttcagaatctgctagttcatccggcgtggtaaaataatactgaacaccacacacaaccagcgtgatagttttgtcctgtcacgtggcgtgaccaaataacgctaccaccacaccaatgagatcagcgtgatcaaataacattgcacgttagccagactgatatgatagtattattttaccaagctagtccggctagcgtgctaaaaattaagatcttgaaaattagttttgagagggtttattttaaaattagaaataaaaaattcaaaaaataaaaatattcctgaaaaataaggtcgtccgcaaaaatcgtttttgattggccgaggagaaggcgaaacagactgccactgtgccacaccatccaccgttcgccggcgccggcgccggccgccgccagccccggcccaccagctcttccccaccaccgcaccgccgcccccaagccaaaccccaacgctgcgtgcgagatgaaccgcctccgccgtcgccgcggcacctcagtggcgccgccggtgaccctgccggacgacgacgacctcctctcggagatcctcctccgcctcccgccgcgtccctcctcgctcccccgcgcctccctcgtctgcaagcgctggcgccgcctcgtcaccgaccccgccttccaccgccgcttccgcgcccgccaccggaatccacccctcatcggcgtcttcgaggactacctcggataccccttcttccggtccgttctggatccgccggatctcatcccacgggagcgcttcaggttgcggctcgccgaggacgagggcggccagtggcgcttctacggctgccgccatggccgcgtcctcctcttcaaccgggccaagaatgagatccttgtgtgggtccccgacaccggcgaccaccgccgggtggccgttccgccggagattgacggcaaggagaagatcatttggaatggggcagtgctgtctgctgccaatgccgacgacgggttcagctcttgccccttcaaggtggtgttggtaggcgtcgccggcaacaacacacagatgttcgcctgcgtttactgctcggagtccggcaaatggagtgatctcatctcagtagctgctcccttcttggtgtttttctttcgtgatcctggcatacttgttggccatgccctgtattggatggcttctggtgatcatgggagtaccattcttcagtttgatttggatgatcaaacccccgccgtgattgagtggccctccgattccgatccaaattgctacactcagacctggctgacagaaggtgattgtcttcgcgtcgccactttctctcgcggaagccttcaaatgtgggagaggaaagtctgttctgaaggtgttgccaagtgggtgctgcagaagacgtatgagctgaagaatgttcttaacccggagattaggttgaatgtagagtatgtaacaaagctggggtatgctcaggatataaaggtgatgtttgtatgggctgctcacagtgtcttcatgctccaacttgattcgttgcaggccaagaaagtttgggaaagttgtgtcatcgccccaattcatccctacgcaagtacttatgttgcaggtacttatgttttcagcatttaactgcataacagattaataggtgtagttgtataaacacgaaataaaaagcacagaatctagatttgaatcatctggcgtctcaaataagtaatttgctcgctcatttcagaaggtaacactgttttttttttcattcaatacctgtttgagcgagatgacattttagaagccttgcggtccaccttgttttgaattttgaacattgcaagatgtagaagtatttagatttgtcatggaaaataattgcatggtattttgtttttatttactcgaaaaattaatgttcagtcttgtcaaaagagggtaaaaagtcagaagcatcaccagtaagaaattaatttgcacctgcatagaaatgtattaatttgcaccaggaagaaatatatatacatatattttttgtattatcttttttctaggataacattctgcttgtcaacgaagttctaattttttttttactagattatgttagcttgaggatgcattactctagtccatttatatacacacggtcagtgcagcagaataattttagttaacttgtgcacccatagttataaggtttattaacataaattttcgaggaatatttgcttccctttagaattttattcagtttacatttgtgatatctccagtacgtgtgtttttttaatgtgtggagtctactattttgggttagggtgtgtttgcaagaggaagttcccaacactcccatctcgttttccgtgcgcacgcttttcaaactgctaaacggtgcgttttttgcaaaaaatttctatacaaaagttctttacaaaaatcatattgatccatttttttaaaaaaatagctaatacttaactaatcacgcgctaatggaccgctccgttttccgtacatgggagatgggttcccaacacccacctccaaacacagccggctttgcatggtgatttgtgattaaagaagtatctgtctgattatgattttgtcagatgaccaccgtatttctaaaataaaatagataactaactacagtaaagaattccttgatagatgcttggagctctagttcaagatgaaattaactagatccctcacttgcattctgaatgttcatagtttttctatttcttagtactaaatttttcaatggcaggaattatggtttaagaaaaactggtaaggtttgttttagtgccatgctaagataaatgatatttgttgaccaaaagaggtttcacttatgagatattgagatacacattagaaagagttgagtgtacaatcacaaacggtagtaatcatacatggctggtgtacttatgcctctccgacaacttttaatttgaacatagtaattattgattggttcttaaatttctgaaagaatacgtatgaactagaaacaggtgtttctactttctacctgctatgtgtggttgtgcccctcatctgccaaaatgaagcagtgaagtagtaatcctttagttgctagatagatgtagccaaagttcgagaatagttccaacaattcaattgttcctctatcgttgttcactgtttcttctttttgtttttgcctggtaataatactgacattattcaactttggaaatttgatgtgcggttcacaatgctgaaaatagtagttgcagtttgcattgcaccaaaaaaaaaaagtgatataactttgtgactgtaaataccagaatgactgatggaattgttctcctgcaggtatctagactttgactcttattggtaaggcgcagagatggattgctggtgcatgatcttccattttgtatgtggtggtggtggctgtgtggcctatgaagatatgtgccaatggcccaatgtagaaactggaagctgaccctctatttatttagtccacttgtcaattgtgaagttgactcgtaggaattatgtactcaaggtttcctggtataagacataacgactgatgccctgacttgctttctactaaagtgaactgaacattaggctaagcattaccaggccatgcacaatatttttcatttcagtagcattttatgtgttcagaattggcaccaacaaaattatggtttgatttgctatgcccacagcataactataattcatttatttactaatctaggtgcaatcatttatttttataactagcaaccgtctatctgaaatactacagtattatatactaaaattatgaatctttgatactccttcctccgtttcacaatataagtcattctagcatttcccacattcatattgatgttaatgaatctagacatatatatatctatctagatttattaacattaatgtgaatgtggaaaatgctaaaatgacttgcattgtgaaacagaggaagtacattggatcgaaaaaactaccttagcattatgacagataaagtggatcatatcattaacactacattactcagtaagcctcttgatttgcaacccttatattgaaatatgccgggtgctaaggttcaaccaggaccatagttttaatgcttagcattgcaacagcatcggacatataaaagttttacccaaaaatcagatttttcttttgtttttgctaataattggtacgaataagcataaggataagcaaaacgatttggctgttaaaatcccaatgacaatgaagagtagagggggcagcaagcggctcataaatgagtaggtgattgtgtttgatgggacttctaaaagcgataaaatcataacctagtgagacaataaaaactaaaaattagaaggtaaattggtggcagaggtgtaagatcaggtggcagctggggtgaattttatagactaaagccatgtgataataaggttcgatttattaatatttagataattttatatagatgctagccgtgtaatgcatggaccatcctactattttcgctacctgaaatggggaaagcttcgccctctctttctagaaaaaagattaactatttagtgccttaatttactaactcaattgattttgtatttcttaatttttcactgaacatgaacacacaccaatcgtaaagatatgtggccgccgttgcccgcgttgcgacctgagaatcgatcgaggcgagctgcatatcgatcacttagctagaacattcgttcggaattcggaaacgaaaacgacatcgacatccatttcatgatgatacacatatatgtgcgtacacactatacagtatacgcaacatgtattgcatggatttatatataatattgtagctttcagccgttgttcatgccttgaagccatgtattgcaaacgttgtacgcctgcgcgcgagtgcggcggctgcaagttgccgaattgggcacgccgcgccgtcatccttcgcggacaagcccagcagtggctacctacatgtttttatgtttttttgataatggaatgaaacatcccggcctttactcatgagagctacagccaattattataagaagtagcacactaaaaggcgcagtccaaaattaaacaagcacaccaaccaaaaataaaagaaatcctaacataacaaggaaaacattatttcagtctattggtgaatctccatccatggttggtaaaaagttacataaccgttgactcaaggttacgacatgcaacagacaggaattctctatcttcctcacacttttgcagttgggcccacagtcgaagccaatatgttgccctgaaaattacctgcatataggaaatagatggtgatttgtcaaaaaccctatcatttctacacaaccacagagcccaatataaagccgaggcaccaacaactatcagtttactcttttccttgtccacaccctgaagccaaccgttaaacatatgagatatacttctagggaggtataaaccaaaagagaattgcaccgctctccaaataaactttgcataatgacaatccataaacaaatgttgaatagactcatttttcatacaaaaacaacatcgtaaacacccattccaatttagtcttgctaaattatccttggttaacacgacacccttaagtaagtaccatatgaagatcttaatcttaagcgggatcttaagcttccaaataaacttatttctgtcaatgcaaccattattaattaaagctaagtacattgatctaacagagaactggccattctgatgataattccatctaaaacaatcagaagaatcatccaactggatgtgagcaatagaagcacataaatcataccaaagagttaggttctgtccaactaaagctctcctaaaagaaacatttagcggaaccgaggccataacactggcaatagtagcactcttccttctgacaatagcatataaataaggatacttatctctgaaggccatgttttctacccatttatcctcccaaaatcttatatgttgaccatcattcacaatccaagagcccatacttaaaaatgtgttttttattttcatgagccctgaccaaaaatgagaatcaccttgtttcctatccacttgggttatagacttattatgaagatactttctcttcaataaatcttgccacacaccattctcattaattaacttatataaccacttacttaacaggcatatattttgaatctctaaattatgaacacccaaaccaccctgatctttgggttgacaaattatatctcatctagttaatctgtatttctttttatgatcatccccttgccagaagaaacgagatctataataatcaatcttttgaagaacccctttcggaatctcaaagaaagatatcatgaacatagctaaactagaaaggacggaattaatcaaaaccaatctatctccaacagacatatgttttcctttccaactactaagttttctctctattctttgttcaataaccttccaatcattattacttagcttcctgaaatgcattggaatacccagatatttaacagggaaagacccaagcttacaaccaaagatactcgaatattgatcatagcaatctttcgcatgaccaaaacaaaataactcacttttgtggaaattaattttcaggccagataatttttcaaacacagataaaatcaatttcaagttctttgcttatcgtaagtcatgctccaaaaaaatgatagtatcgtttgcatattgcaaaatggacaaaccatcatccacaagatgaggaattaccccattaagcgaaccattatctttagcccttttgattaacaaagctaacatatcagctactatattaaaaagaattggagataacggatccccttgtctaaggcctttatgagtttggaaattatctccatttaaccttatcataggctttctcaaaatcaatctttcgaattacatcactattatttttacgatgcaattcatgtaaagtctcatgcaatataaccacaccctccatgatatttctcccaggaataaaagcagtttgagtaggactaatgactttctgggcgacactcattactctatttgtggcaactttggtaaaaatcttgaaactaacattaagtaagcatataggcctatattgttgaattttcatggcctctacacacttaggtaaaagaatgatagtaccaaagttaagcgagaatagaggcaaagatccattgtgaaactctttaaacaggtcaagtaagtcattctttatgacattccaaaaaacttgataaaattcagcaggaaaaccatcaggacccgacgctttattatgttccatctgaaaaatagccttcttaatttccttttcagtgaaatcctgagttaaagcctcattctccaaaagagagatctgaggaatatcagcaactctactctcatcaaattgaagtaaagaatcatcaggaggcccaaaaagacccttataataagtggtaatatgcgattttaaatttgcatcaccatctatcaaatggtcactatcctgtaattgaaaaattctagttttcctatgttttccattcgcaactaaatgaaaatactttgtattagaatcaccctctaaaatatcctttgatttagccctctgataccatttgatctcctcctctcttagaatagaggataatctattcctacaaaaccatctaatatccaattcttccggactcaaaagggaattttctgcctttttatctagcaaatccaacttatctaaaatttttttcttttcttttttatataaaccactactatgttttgaccagcccctaagatgctgtcgtaaccgtcgaatttttgcctgccatctctccatagcagtattgccttcgtcaacactagaccaaatttccttcaccatctcaacaaaaccatcccgtaaaagccaaccaagttcaaacttaaaactatgttgagcattactcagagatgaagaatttgtattcaacggtaaaggggtatgatcagagatatccctattaagagccaccacagaagataaaggaaatttctgttcccactctgtagacattaaaaccctgt

SEQ ID NO: 57954 - DNA, 4648 bp, Oryza sativa
tgtcttagggcagcgtgatttatattccttgcccacccttagggtgatctattctttgtagatgtttttttaattcaaatgtttgaattaatggggtattatgtattatttttattggtattgttggtttcatctctttgccgcaatttctttgcccttgtaagacagcaccggtttacgttgatacaagactgaatgctagctataggaagagcattggcagatggcgaagaaattgttgtttccgaagaatcgggcttgagcttgtttacggacctcttatatgtcgttcatgcacgtactgcaacttcgcgctccttcatatactctgtttgcgtttcagcttcaggttacttttctgccatcatatgttggattgatcgggcctgctcactttgatgccattttcaaccataccatcttttggcaaagttgcccaaaaaaaataactacgtttagtttgttgccaaatttgctaaatacataataaattctgccaaaattttggtaatattgacatcttgtcaaaagtttattttggctacaatctgaacaggcccatcatatctatccacaaagtgaatccacacctccttaactgtcctgaggaataaatctatttagtgaataggataggtatactaagcaaacacgagcgcaaaatggaaataagtaattcatttttaaaaatatcattgaaaaagtagtttaaaaaatcatataaattaattttaaaattttataactaacacttaattaataatacgctaataagtcatctcgttttacgatgggagataagttcccaagttttcagactctttgcaaccaatcactacactggccaaggtcacctgtgacggtcccaaaccctcacctttaacggctttgagcatggtcagtgatcagtggtcactggtgagtccagtcacctttgacggatggccgaccatcacaagtgacacccacctctgacggacaagttactagaagaccatcagaggtgttggtctccgctagcctagggccagttaggactctcacaagtgactcatctctgacggccctttaaataaaggccgtcagaggtgatggtctccgtatatagaagttgccacaggtgatttacctgtgacgggcccgaaagtaaaggcccgtcataggtcacctctaacgtgcctttatttgttctatattaatatagaacaaaatattgccaaactgctatgctcgtgataatgtgcaccaaaataaagatgataaatctgcttaattacatgactaagagcaagtacaatagcggactataagccaactataaacacatatgaggagatgaaagaagagaaatgtgagcagtgggctacacatttgtaacagatcagctgtagcacggactttacgtaatatgtatacgtatgacaagtgagacaagatattaatagtgtagtatatatatttataggtaactattgtataaattagctattaaattgactatatatgatttggagctactacctagttggctatactaactctaacagcagcaccggcctaggatcgccggattatcaacagtaacaaccttttttacgtaaaataacagaattattacagaactacaaaaataattagaaattttgggtcagcaggtgagtcatagtagtttttactaatactatcgggatttcaaatattttagcacactactaaaaaccaatttttatactgtcaaaactcattttccatgggattgggctacccgtctgtccaaaagtgtgctaaaattgctatttttccatatgggtatttatgtcgtccgcacacaaaataaaatttgtgaaaacaaaataaaattccaaaaacccatgcaccgccgttcgtcgttgccgccaccgtcgatgtcgccaaagcccggtagtagctcctcatcatcatcgccacagtctgttgctgcgcgcaaggggagctggatccaccgccgccgcgctccccaccgctggatccgccgccgtcgctttccccgtcgttggatccgccgccgccgtgcctccccatcaccgaatctgttgctgctgcacctcccccaccgccgcacctctcgactgccactcttgctcccgtatcaccgtcgttccccatcatgagaatgagatataaaaattttgaagatgctaagaaagacaaacaaaaggaagatcagacttgtaggcgagtctttaatagccgcattttcacaggtctcttatgcaaccgcataagaaaacatattttttcatgtggctcttgaactgctataaaaataattttacaggcggagtagttatgacccacctatatagtggcagtctgatagcaaaatcagatttaggccttgtttagttggggaaaatttttgggtttggttgtcacatcggatatacggacacatattttaagtattaaacgtagtctaataacaaattatagattccgcaatgaaactgcgagacacatttattaagcctaattaatccgtcattagcaaatgtttactatatcaccacattgtcaaatcatggcacaattagatttaaaagatttgtctcgcaatttatacgcaatctgtctaattgattttttttctatatttaatactctatacatatatccaaatattcaatatggcaacttgaaaagttatgtttcgggaactaaacagggcctaccatgtcgagattggtaaaatcaaacttcggcatcgttgtgttaattaagaaaggacaaaagtttcagatacgattttgctatatattcgtcgacaaattttctcccaaaaatttaacagatgtaattatagtataatcgtagtgtaattacactgtaacttgcatgtaattacactgtaactatagtgtaacttgtatataactttcaaaaatctctctgtaatatgttatttcggtaaaatagaggttgtgggaacaaattcttacacatgtgtgtgctgtgattttttttctccctcaccaaaacaaatcttgtaatagatttaacgattcaaaattacgtgaaacttttatacaagttacactgtagttacatgcaagttacagtgtaattacactataattgtattataattatatctgtcaaatttttagaacaaaatttgtcgccaaatgtataagtggtccctttgggatacaatgattagagcttgcaggtacttgagctctctggggagtagcttggcctacttcatccagaaatcgatccattgtggaggccgatgttatctgggcccatatgactgcggacacgtgcgagccacagcgttgtatgattggcctgacggaaagaacggcatgtacagtaaagtcgtagccaaatggcgaatctttctacagttatggcacaacatttagcagaggattaggcacgtgaagctatatgtttttttttttcgaaagcggaagaacaggattacattgtacccaaatcctcttctcttgcttgtcacacaaaaaaggttaagacccccagctcataatcaagaaccacattactacgtactaatcgtgttgttacttgctagcatgtctgcagcttaaagctgagacgacacatcaacaaggaatttacaaactaatctagccaggctaattaggagtatctttgcaagttccaaattaagatccgcgctgccgctaattatttctgtacacacgcgtggaatccatcttctttcgatcgttttacccggcccgtgtccatccatgattcttcggtgatcaaaagctcaaacccataatgtcgtccagatcgaagacaacctcgtcgttcttgaagaactccatgccggcgacggcgtcgtagctccagtgcagggaggacgtgacatcgccctggtccggcccgaagggacccgcgactccgccgccgccgccgccgccgcgcgccgcggagctgccgggcgtgaggctgctcagcacctcctcctggtcggacgagccgacgccgccctccaccttgagcggctgcagcagcgggcccggcgcggtgaccgtggtgatcgtgctggtcgtcggcgccgcggcagcgtctactggcgccgccggcgcggcgacgaagctgatgaggcgggaccccgcttggaggccgccgcagccgtcgtcgttgtcgccggcggcgacctggtggatgacgtgcgccgcgatgatgggggcggtggccgggtcccggcaggtgtgctcgccgatgtaggtgaccctgtagctcgccgggtcgtcgtcgcagcgctgcacctgccgctgcgccgtgcacagctggtcgtacttgtgcgtgcaccggaagtaggccctgtacacgtagcataccccaaacaactcctcgtcagcgcgcaacgcatccaactgtacagtctcgaacacattgttttttgtcgggacaagtctactcactttgggtgcttggagttttggatctccttctgcccgtacttgcgccatgcctggccgtcgtcgaggttcttgacgaccaccgaattcccggacgattgctgcgtcctgcaatacgtacacacaaatcttagtacattaaggtatcgttcgtttaggggtgatagggaaggtatcgttcgtttaggggtgataggggagattgg

SEQ ID NO: 57955 - DNA, 684 bp, Oryza sativa
tagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagtcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatc

SEQ ID NO: 57956 - DNA, 7952 bp, Oryza sativa
tttgaaatgaaagatttgggagaggctgatgttattcttaacatcaaactacaaagaggagatgagggtgggattacacttgtgcaatcccactatgtggacaaggttttgagtcgctttggatatagtgactgcaagccagctcctactccttatgatcccaacgtgctattaaggaaaaaccgaagaatagcaagggatcagctgagatactctcaaatcattggttcattgatgtacttggctagcgcaacgaggcctgacatctcatttgctgtaagcaagctgagccggtttgtctcaaatccgggagatgatcattggcaggctctggaaagagtaatgcgctatctaaagggtactatgagctatggaattcactataccgggtatccaaaagtactagaagggtatagtgactcaaactggatatctgatgctgatgagataaaagccacaagtggatatgtgttcacacttggaggtggcgctgtttcctggaagtcttgcaagcagaccatcttaacgaggtcaacaatggaagcagaacttacagcactagatactgcgacagttgaggccgagtggcttcgtgaactcctgatggatttgccggtagttgaaaaaccagtgccagctatcctaatgaactgcgataatcaaacagtgattattaaagtgaacagttcaaaggacaacatgaagtcatctagacacatcaagagaagactgaaatctgtcagaaagcagaaaaactccggagtgatagcattggactatgtccaaacggctagaaatctggcagatcagtttaccaaggggctaccacgtaatgtgatagacagtgcatcgagggaaatgggcttgatacccacctaaggttgcataatagtggaaacctgtccattatgatcggagatcccgtgaatttggatggtgaaacaaactattgtgtgactgagagaagagacccttgaaaagggctcattttcatgatgtgcttctcttctttcctgcatggtaggatggcttatgtcttaatgtgatccgagtggcttttccaagcagagatgttgacctgcagaacatcttagaaggaacacacctatatgagttcgactgctagtcacagtctatgagatttgggtgatctctagatactcatgaaaggcctggagtatgacttataagctccaacccgagggaatactaatggttgcctagtatcacttatggaattgagtgaaacctaactgcacaagactgacaattcaaggcatagtccattgttcagttgtggtcaggtgtagctccttttctaggtgaaagttcaacttaacagtcttcaccgaaacactggtatataaaagctgctatggaatagagagcattctcatgagccttgaaatttggtggggattgttagatttaattgggtaattaatccatttaaatcaattaaatcaaataaattccaaggctcattatgctaggaattcatgtgaattcattcttctatgggatatcaatgggatgaagagttttgagaattaatccatttgattaaggaattggtaacttacatcaattactcttaattgattgttggttgatggttgtgtagtggaggatggttcatggctacttgatgacaattagttgctctattcctcttcctattccattggtaacttacatcaattactcttaattgattgttggttgatggttgtgtagtggaggatagttcatggctagttgatgacaattagttgctccattcctcttcctattccatgactcttactcttcatcttccattcctcttataaaatgggaattgatttgatctcccgcgagaaaaagaagacacactttcatccattttccaaagctgttgttgctacggtaatcccatcccgacgagtgtgtgcacacgcgttgggagagtaggcctccgaaaccacgcgttgctgcgacgtttgcacagacgggcgggcgatcaggtttttggggagcgcaaggcgcgactactcactgttcgtcaacatctacttcatcttcaccaacatgtcgaacactggagacaaggagaaggagactcccgtcaacaccaacggaggcaatactgcctcaaactccagcggaggaccattcttggggtataaccttattacattatttcaattagaagttttactgttaatgttcatcgcaatgtcaacattgtgtcattatgtgattgttgatgcttattcaacgttaagcatgctcatgttgattacattcaccactatcactggatcaaatcctattgtaaatatcatgtttattatcttgttattttggattaaaatatgccgaattatgaccaaatttccaacaatgtatacacgtcattttccgccgtaatgtatagtaagcacagtttccatgccagtacactgcaattttcacgtaaccggtaacttttttcaccgcccatttcctgttttacccccacgaccagggacgggcctcggattttaagattgggtattcgatatggaaagagggtaaatttttttttttacaacacgagcacaatatttggtacgtatgatcaatgatatggtattttagtactgcttattgaattagaacttgcgacaaggtttttagcaatttccttgatttactgtgatatactttgtaaaaaaacatatgcagtacaaacttgtcagggttatggataaggcatacctcatatcctacgacttatggaatatactgataaagtataccttcatgtatacggattgttcttgtaaatatcgcgtggagtccatttctaattatggaaaatatctctacgagtcaagtgatttacaaaatcctactcgaaagggatcgatagaatttatgttataccgttacaggtcctatatcctcaaacctttcttgggggtcaagatgatccacggtataaaagggaccccctgggaggggtttagggtatcgaattccatcaccaacgcacccaccaaagtttacgaagccgaagtacacggagccaagccgccgggagatcttgtcaaaaccttagactacgatctcgtcggtgtcatctgtttcgactactctctttgtaatctgttctcatcatcatcaatctcatataaactggactagaactgttacctgataaggggcctgaaccagtataatccttgtcttttgtctgcttgatgtcgtactatgtagggcctcgtttcaacgtacctcaatactctactcatccggtccgcgagtatcactcgtcgacaaatctaccaaccaagtatatatcatgtcatcacaacacggttaatgcacaaattaggcaaccatgcaaattaggttcgaatttgagggagccagcctgctaggcttttttgttgggcttcttttgatcaaaaacgttgttttctttatttctctgcgtacatacgaagtatataccttatatatgtattcttttttaaaaatcttaggtattttcatttgaatacccttgaattgagttggcccacccctgcccatgaccatgacaaatagagtaaggccctgtttagttcaggggtgaaaagtatttgtgtgttataacggatttacggacacatatttgaagtattaaacgtagactaataacaaaacaaattacagattctgtctgtaaactgcgagaagattttattaagcctaattaatccgtcattcgtaaatgtttactgtagcaccacattatcaaatcatgacgcaatcaggcttaaaagatttgtctcgcaatttacatgtaatctgtgtaattagttttttttttttgtctatatttaatactccatgcatgtgtccaaatattcaatgtgattggggaagctggagtaggtaaaacagtactcatcatagaattaattaacaatattgctaaagctcactggggctgggtgaaaattttttatttaggaactaaacagggcctaattaagctgtgtatagtaagcacaatttccacgccgacgcactgcaattttcacgcaactttcaccgcctatttccttcttttacccccacaaccacgaccacgacgacgaccagagtaaacaagtcttattataaccacccccctctccttttccatctacctcctccaacgaagccttccttcgcccttgtcgtccaaccctcctctcctcccctcctcgtcgcggggctagggttacgccccctcctcctcctcctcctcctcctactcgtgtgggggcatgcccgggagcgaggcggcggcggcgcaggaggcggagatggacccggacttctcgggcgggggcggtgggggccccagcttcgagttcgccttcaactcggtcaacttctccgaccgggtgctccggatcgaggtcgtcgcgggggacgacgacgacgacgacgaccacgcgcccggctccagccgggacggcggggccggctcgctctcggattgggcgcgccaccgcaagcgccgccgcgaggagctcctcaaggagaaaggtgcgttgttgaaaccgcccaaattaaacgcttgtttcgtcaattttctttttaattttcgaattgtggacgatcgttttacgaaaatttcggtgccttcgatcatatattaggtggtcaatgaaaagcgaccagggtaacggagaatggatgaaaggggattttatttttctccttccaatttttagatgctctcgtgtacttgtaatagataccttttcagaatttgatattttgttctaggccgttggataattggtgatgcaagggatacaattgtgcaacctagaaattttggaagaacctgtaatcttgtactaattgattatacctgtaggatgatatgggtaagaataattcttttcatgcattgtatggataggcatggtttatgcatggatccatgtagcatactcgcctcgggttgaggggacaatgtggtcaattgtttgagataaagtgaggttatctagagaattggttgttgcatagtatataaacgagggataacgcctttgtagttcatacttctggttgggtgcacgcactagaagtatggaactgattttgttgaaaatttgatcatgaatgttggaaattgtatcatgcaatgtggctattgtgggcatattattgaacaacccttggttatcttggttatatgtttgtagcttataatatagtgattagttttagttgattttcttagattgtgttccaatgttcccccattttgtgtatacctgtacttttaatgagtaccttatgtaataatgtgtgcatattcagttggttatcatgcttcttctggtgaccaaatcagttcccactgactgaaattttttggctagtttatgtgtcaaacaaatgggtcaacactctgtagaaagagctaaagtgactgtgacaacaagccaaatcctcttgatacctagagttctctctttattttttcgtaggtttctatgatgttttttatgaaattcggagacctgcataagtcctactgcacttatgcatcttgtgtgagggcattttgtgctacacagtccacaatgtatacaagatactttgcatgaaaaatgggtttaagggctatgtactgctttgcaaagtgattgttagttttctgtttctccttatggttatatttgaaaggggtatggtgggggttggggggtaaataatacatttttataatgaagggacgcgtgaaaatatgctttgcaaaataccgttagtttttgtgtttaatcttcagacttcagttgcttgttagctgtgccgatcatgatctcaatgcttgttttgtgcttcttaggtcatgctcaaaggtagagcccggtatgggctcttatgcaaacatgtcatttagaaactgcccccttacaagagttgaggcaacaaaggctctaaccattaaccctcctaaatagttttttttattactcttctttcttttccccaccctcatgcagcaaaattttgttttatagaggctaagagtcgatgttaagcttaacattgatgtttctctctcctctttctcttccatgtcagcaaatttgcctagttggcaatgctatgagccccctactagtgactgttgtacataccctaattgtaattatgaaagtccttgattaccaattactgccacaagtcatgacttgtattttcatgttaccttctgttttacaattttctattttcattagtgatggcttcatgctgtagctataactgtgattacttgctgttatctacaatgtgccttgtaccttgatgatctttttctttttctgatgctttttttttgttacatatgattgtctagtgctacttatgcatccatccttgttctttgtgatgggagacttattttactaccaattgctatctgcagagtctgaagcagtcatgccagaccagataaattgcaaagtagaaccagaagaatgtgatgcatatgaagaaaatcaagaagaacctgtagcaatgatggacgactctccacccagtgttggccctgatggtatgtactgatgcaagttctgctacctagggtcagtctgcagtgtcgttttcctaacatgttatgttgcactgtgatgtggaatctaattatttagaatctttagtaaggctgtgttcgctatgggttgttcccaacttggaacagtagcacggaaaacggagcaatccattagcgcgtgattaattaagtattagctattttttttttcaaaaatggattaatttgattttttttaagcaacttttgtatagaaactttttgcaaaaaacacaccgtttagcagtttgaaaagcgtgcgcgtggaaaacgagggagataggttgggaaaatggacgtccgaacacagcctaagacttttctgttagagccaaacaagaaacttagaactaaatgctactattatgcatgcatttgtaaatccatcacaatgctgtcggtatgatttgttcagattactagaagcacagatacaagaaggattcaatatttcatattgttttgttatcattccttctgatagcttgtcttgattttcctgataccctgctctattaattgtatgtaattaatctgcactcatagagaagtacagtgtgctccaagtgtttttaacaactaaaaacctgtctggtgatttgtccctgggttgtgcgccttttactaattctttattgttttcccccaatattgatccgtctgtggtattttacaggtgatgatggaccaagtatggactcaccttggagtggtggggtgagcacaccagttctaagagtaaagaacatttatatcagttcagcgattcttgcagcaaaaagtcctttctttttcaaggtattctggtcaccttatcaagtgaatttgcactgtactctactcagtttgctgtcagcttcctagttcctaaaaactgtaatttgttgttcttagcttttctcaaatggcatgaaagaatctgatgagaggcaggcaacccttagaattactgattcaggtaatgcgatacctctagttaactcaaactttcttcctaacttattataatttgtgttgcagttgtgctataattctgcgtaatattcctaatttatactatattgtaatgtaatattgattttaggttttatggtgaaggtggtttctgcttctcctctttttgtctttgatattatgattagtctctttttcttcattggcttcacatattaaatagatgttttgtcaatctatctgccttcatgcatgcacaacttccttgatcatttacggaagtcaaatgatcaataattttctcttgaactctttccatatgcctcattatcttcattttacttggaacagaggaaaatgcccttatggagctttt

SEQ ID NO: 57957 - DNA, 669 bp, Oryza sativa
acactctcactttatcgtatcttaatataattattgtctactttatctacttctgacgtatattttttatctacttccacaagctcttctaatgtaatgattatagacaaaataaacttatttgggacaaacgggtgaagagaaaaaaaatgaaattattctggaatagaaggagtataagagaattttggataatcataaaatgatgacacggtggggtcccacatccacgtcgggtggctgctaccgaccttgacctgccccagctcctcgggagtcgggaaggcaactccgcctcttcatccttcgccgccgccggcgccttcacgtgctccctctcctctgcgagtcggcggcgccgatctccatttgtcgaggcgagcatagcatgggagccgggaggggagggcatcctggtgaggtgagcatccacatcccctttctgatgaatcattcatctctctcccacctggagtagttttttttttgtctggaattcgctcgcgttcgttaaccctagctttctcttgtagatctggaagaagctcttctcttaattaacctgtgtaaaaggttgttgttcccccaaaaaagttgctttctgggatactaccaagaggaggagaggggatagatagtctgtcagatgatgatgatgccgctgcgttg

SEQ ID NO: 57958 - DNA, 1822 bp, Oryza sativa
tttgtgataatttcgtcaattatatataggtctaattttccagagatgctcgtagggataagatttcgttgcgagtgcctacatctctgtactgtgtttcttgggaaaaaaaaatctgtggagctagtctaacactcaaactttggtactaccagtgtaccatctctactataagcaccagtatcccttgatcacatcgacaaatgacaactgactactccagtatactccgtacggaagcatgtacatgaagattccctcaagcattgaaagattccgatgcaattagctgtcatataatttcgagtactattaaatttctacgctactttgaaccctaggcactgtacatgggaggaagaaaaattggatacaaggacaccctcctgtttgctccataaaatcattgcaccgacaaaaaacgcaaggtttcacaaggcgacagattgtgttgactagatgcagtaaaaagtaatttttttcgtaggcattagctatagtttaacctagagatttgggtcagtaattttatttcaccattagtcaaactgataagggatttgtcctataagatggcagtatagaactgtgcagttatggcatatggtcaattgctttccattggttatgacttactgactcacactgccaaacccttaattgtggggctgactgctattttctatatcatgtgggggccttattaaaaaatatacaagctgtcaaccaacaactaaagcaaaaccacaaaaaaaataattctgaacaattgaatcgttaaatgagcaaattttcagaggttctcaaaaaaaaaaactcagatgtagacacttgggttacccaaaaccataaaatatatggactaagttacaaagatcttaagaagagtaatcaattgagtccaacaaacagcaatgatcaagcatctctcatctcaccaaacgaatcaacaaatgcagaggataccatcacaaatctcattaaacacgtggtcacaattagcatagatgaacttgcaataatcaaatcaattaaatgcatcccccaaattatcactaatcacccccttcaaaagtcactaatttacaaatttacaaatcagtccattctcacatcaccactcaccaacccgaagcgaccaaccaagaaaaggaggaaaaaaaaagatcccatttttatataaaagcccctgtctccgtctccgatcagctgcaggagaggcgaggaggcgaagcagcagcagctgaagcgagccgagccgatccctcctgcccctgctcgcctcccagatctccccgccattgccagttccccgccaagattcgcgcgcccttctcccagatccagcttcgcctattccgaattccgcgcaaggtgaggtttggtggtggctttgacccgggagagacccgtttcttggcgtcttctttggtgttctttgcttcgattgctcgatcagaatgtgttctttgtgattcgcaggctctgtcggtggtctgattcggcgggttttggttggggaattttggtgttcctgctcggttttgtgcttgctgctggttgtggtggttcttgggagcggtggagatgggggtgacaggggagaagttccagctggggacggtgggggcgctcagcctctcggtggtgtcctcggtctccattgtcatctgcaacaaggccctcatgagctccctcggcttcaacttcggtatgagatccaatcttgtctcaagatgctttagcttcactagtacttggcagtggctgttttgttggatgcttgtgctagatgtatagcttgtgtattgcgtgtagagac

SEQ ID NO: 57959 - DNA, 5034 bp, Oryza sativa
gagatcgggttcgcgccgcggaggagacgaaggggaagaggacggacgacggtggttttggttagactctcactggagagcggcttggactaggggcaaattcgttttccttttcttttcttttttttaaagtaaattccacaatactatgtatcaaattatcacggacgagatatttaaagcgatgtatcacaaaactatagaattaacactaaatttatcataaaactacatatttaatgtggagtatcgtaaaactacaaatataataataaagttatcacaaaactacatattttagagtttaaatccttggcactagtgttttgtttgagttataaacatgtaagtttgcgattaaattgtcactaaacctgtagttttttgataattttattactaaatcaataggtttacgatactccacattaaatatgtagttctgtgagaaatttagtgttaaatctatagttttgtgataatttggtcaaactatttgtagttttgtgaaatttactcttttttcatactagtacttcagctttttctactctttccatttcaaaatatttttctactattgaaatataaggattcccatattaattctcattattcccatgatgacaaaaaccaatcatatgtctcaaaatgaaagttctaagttcaacaaatgacaactaaagtgactaaaaggaaatcttttagccgaaccttagttttgctaaacagcctaaaaaatattatatttcaaaatagatggagtagctttgttttcttttataataaaaataacctcatgttgtatagttgaagttacatgaaaccatatttcctgtcctattaaaacacgaaccctagcatcatataaaggatttaaggagagtgataaaagaccaaaatgccctgattaataagaaagttgcattggtgaatgagtaggtggtagtattaaatgaataaagttttttgattcacgaccgatggtaaataagaatataccccctccgggctgataatacttgtcgttttggacaaggatgaagtcaaactttagaatatttgattatgaatcatttttaaaatatttatctttcaaatatggtgactacatgtatagattagtcttaaaaagtattttaataagatcatatatttgctaacaattttatatatattataatgaaaaataatggtcaaagttgttttttggagaccgtgcccttgtccaaaacgacaagtattatcaacccggagagagtaggtgttggtttattttgggacagaattctagaagttgatttattttgggctgagaaagggtattacgactagtgagacataacctcatatatatggttttaaagtttcataaaaccttatccctgtacatactgagcacacatttacttaaacttttaaaacatattgtatgtgaaagaattaattattgagcttgtgattaaggttgatagtttaactattcactactttgaaaaatattgttttagatattttaaatttagtcaagattcaaataattgtggtgttttatgaaacatttaaactataaaacttgtgtttatttgtcacaaaattacaatacatgtggttacatgtggttttcttcaactttgatcatataatgtggggtttctgaatttactctttttctagagataggggggagggatgagctttggtcacgattttaattttcttttagagaatgccggatgagctttgatcacgattttaattttcttttagagaatgcctacatacattttttttaaaaaaaaacacaagtacaaacgcatgagctcactgtgttgagactgacaaatgcgagcaaccatgtcaaatctaagatttgaacctgagtggggtggttccaccacaaggaaccaatccagttgagctacgctcacttcgcatacctacatagattcttgtttgtgtataaaaatcaaggagcagaatacatgtctccgtattcgcgaaaattaaggggcaaagattccgagttttgaggaaaaatttggaacaatttgaatgaaatcattcaaaaaaaatatttccacatgaaacaagggaagttcaaattccaggcaatatattattattttatcgtagagcacaatttgaatcttctcccagaaaattccgataatgtggccatgcgggtgataggaaaatgaaggcctccaagacggcaagaacaaaatacagggcaagcctatgatcttgtcggcctccatgggcttgtcgacaagactaccctaagcccaaatcgccgaaggcaagtaactgaaccattcctttcaacagtacaggttacagacaccgggttaaatgtgtaattaggatgcacacggctatcttggttgtgcattcttcctgctcgtttcagttgtacagtctgaaacctgaattactagtcattatgccattgtgcagaagaagaagatggccttgtgccattgctgaatgcagatcaggggcaaatgggcaatggcatattggcattcacatcagcttcttcagtgtagctagatttattcagaatgcagacaagatccttgcagcttgggtacatgacgatttcttctatgaaaaaacgcagcttcttcagacttcagacaacatctttcagtgtagccagaacttttctcttttgagtgtagctagatccttcagaattcagcttcttaagtctaccttttttttttcagagttgggcacatgctgatttcttttctgaacaaacacagcttcttgccttcttcagagttcagagcagctctacctgctttccatgttgccaaggcaatgcaaacacaaggtacaagcgacgcatcaatggcgtcctcatcgatgaagctgtcacgttatagtttggtccccttcgacctgaatttggttggagaaaattggggatggaattaatacgggaatatcatatcaatatatcattgatttaagtcgcaactgcaatgtgttagcaaggtgggaaaaatgtcggacaagtttggttgagcgacggtcactgtcaccacgggtttggttcggttggtccttcaattcgatttaaatttactcaaagatataaatttgccacgtctttaggaacaaactccgtgtgttgcatctaccgacagatggcaagttgcttaatttatttatttctctttctcttactgtctctaatctctagtgcaaagactttggttatatgttgcattgctgcttataacaagatatgaggagataactagaaataaattcttcagggctttgatctttgtaggtcagctttttctaccctgttgtcgatcagtcgatgtaataatctctgtaaccacatttccaggatcttaatgaaatttggttggccttaatgaatgtggatgatagctctgtcaatgttccatgagagctgatcacctgaaacaagtgcagttgagctcccatttctcagtcaccacaggtgggagatgcttttgatgaactttgtgttgtcatctcggcagaagcagaagcagaagcagccaaccaggtgatcatccatggcgggtttaacgtctgcatcaagagattcccgtgggctcacgacatggattaggcttaagccaagtactagaattttatttgtagtatgtgctaaaataatacttccatgctcatgtcaaatcatgctgtttacaagtgttttttagcatgacgcattcgttttggtttatataagctgctgaatgcgtcactaattagagccataacggtgctcctacatgtttttttttatatttgctccaaatatcaacttttttgataaaacacatattaattcgtaacaaagtaatgcctttttattcccagttttactcaggtacgtaattaacttatttatcataaaaacaacacctactttttcactggtgtagaatgtattattttctaataaatggctcctaaatgatgtaatttcgtaaaaactttctacacatgaatttattagaaaataatttaaaacatatttttaactttataataattattttttgtttgcatgtatgctaaaatagtcatggcaaaatcattcagttatttagccatttggctatgtaggtaaagaaaaaaccaaagtcgaaagacgaagttaactcccaaaaattttagacaaactatccaaacctacccatagtaaattacacataactgttaactgttttaagagtaagtttactggcttcacttctgtctatattctttcacatttacattggtaatatagagtattttgggtagtaaattgttgtatgagcagaaacactatcttataaaaaagagtaaacttgtccttgaaaccgacaaatttcacacgctttcaaattaaaagagagaaaacccgtaccgatccaactattaaatgatgcacaaataaataaacgagcgcgcacacacagtgacacaaacctaaccaaccccaaccaaccgcgcgcacgcaacgcaagcaacgagtcgacgacgatatccaaaccccccgaccacgcccgaaaaagaaataataataaacaaaaacattagacccccaaaaaaaaatctgagaaagaagcgaaaatatcctctcgacccccctcaccggaaaagggtattgcgtcgcctcccgccgcgacggcgacgacgacgacgacgacgagcgcgggctccctccaccgccgcctccgccaccgcctcgccgcctgcctccgcgcgcctcccccgcctcctcctcctcctcctcctcctcccacatcggaccccgccgcggtgaggctgcgtcgccgccggctcttctggaagggggcgcatcgtgctccgatggacgcgcaggttcagcagcagcagcaggcggcgccgcagcagcagccgccgcccgcggccgcggcggcggcggggaggaggtacggcgtgcacttctcggcgtcgagcttcatccaggcgccgctctccgcgctgctcgagtactccgggatcctccgcgcggaccccggc

SEQ ID NO: 57960 - DNA, 9258 bp, Oryza sativa
ctcctcctccaccattatgccacctctcctcctccccaccaccaccaccacgacgccggactcgccactcgcagcagcgacgccgccgtccaccggcgagccaggacggcgtcgtcgatggcgccgtcgaccggcaagccggcggtgacgacggattccgttatcaaccttgaccagtgagttcctcctcctcctttccctcctcttttattcctttcttagctgttctacccatcaaggcatcaatcaactagaaaaagaaaagaaaaggagaagcaaagaaaaaaaatctgcaagttgccatgggtggatgtgtgggcgcgcgcgaggtgttcgtcccaataaagcatgtcattgtcaaggaggaatgaaccaacgaacgccgatctatggcggattttctccagatttacgcgcgattgattcgatgcatgcaccttgttcaaatttcgtctctaaactcgattgaatatcaaatatagatagaaaatggagttctgacattcttgggtgctgcgcagcggcgacccgaccatgttcgaggagttctggagggagaccggcgacgcggcggaggtcgtcatcccggggtggcagacgatgagctacttctccgacgtgaccaacgtctgctggttcctcgagccggagctcgaccgccaggtgcgccgcctccaccgagtcgtcggcaacgccgccgtcgacggctaccacgtcctcgtcggcaccggctccacccagctcttcatggccgcgctctacgccctcgcccccgacgccgccgccgctgccgccggcgagcccatcagcgtcgtctccactgcgccctactactcggtaattaagcgcataaagtattactccctccgtccaaaaatataaaaacccagtaccggtattattaactacgaatctatacagaaaatagacatattgcttagtatcttgaggtaccggtacctaacgatacaaaatcgttttttatcgttggatataataatgtctatcctgtccagttagatctatcaatcagaaacgatttagtaacctgagttaccagtactttaagatactttttatttgattagaacaaatctttaggagtatgaccagactcgtagtactataaaatgtctgatccgttattaggtttatatgttttgggacggagggagtatacaatactaagggtgtgtttgagaaggagaggattgaggagattaggaagatacgcaaaacgaggtgagccattagcacatgattaattgagtattaattattttaaacttcaaaaatggattaatatgacttttaaagcaactttcctataaatttttttgtaaaaaacacaccgtttaatagttcgggaaggacaaaactatctttctctctttctcctgcgcgctaacgcagcctaattcaaccagacagcaacaaacagaggtgacagatgagatgcatcgttgtcgagtgtatcaaaatttttgcatcaaactgcatgaaaaagaaaaatgtttttggcgacaaggatatatagcaaaagcggatttgcctaatgtcacaatcatatcattccccactaaaatgatgtgatagagctgaaattaagagagtggggcagcacattgatgctgccccctaattccccctaattctttgcattggtcacctctctctctctctccatctttatcatatgatggttggtgatgattgatgaagcatatgatgtgtcgctaaatgctactagtaaacatctctgaataatctcatagtatcaagcttgggggatcgaatcaaatcatgtttctttgtagggtcggaagctttgatcatagatggtttgctgcgatttgtagggtagccgacatgtttctttaacaaagggcctgttaattaggcttaaccaagtctgaatcttacttctgcttatttagtaccataaaaaatatactgaagctctgcatgtgcagatgtgctgatcactgatgagaatatctgatcataaggtcacacatggccggccggcacgccgccttatgcgatttctgtttgttcaaatcttgttttagtttatattttttgtggtttggttgatcgatctgtagttgattaacctgagaaaacatagaagtagcgtgtcatgaactcatgattccattgtcatgtgccccgcgacatatctagtgatagatcatgtgtgttcagttatggccctcatgggaggtcggtgtgctaacttcttagtttattattcccttttgcattatagttccaaatatatttttttaactgtaccaatgattggtagaaaagaaaaaaaaaacagagcacactctgactttcttcttttgattttctgaagaatttcactctctgacagtgattaagttcagtttcagtttcactgacctgatccgatctgatcttggatgcagtcataccccgccgtgacggacttcctccggtcggggctcttccggtgggccggcgacgccgacgccttcaaaggcgactcctacattgagctggtctgctccccgaacaatcctgacggcgccatccgtgaagctgttcttgatccaaagaccggcaatggcaggacggtccatgacctggcctactactggcctcagtacacccccatcaccaagcgtgcttcccatgacatcatgctcttcaccgtctccaagagcaccggccatgccgggaccaggatcgggtatgtagatagagcttttcggtcgaactggttggtgcatgaaacacggtcgttttgagtagtgtaaactgagttgaatgtttttgtgtgtgtgtgaaggtgggcgttggtgaaggaccgggcgatcgcgaggaagatgacgaagtttgtggagctgaacacgatcggggtgtccaaggactcgcagatgcgggcggccaaggtgctcgccgccgtctccgacggctacgagcggcggccggagcagacgaaagagacgatgaccactcctcttcgcctgttcgactttggtcgacgcaagatggtggagcggtggagcatgctccgcgctgctgccgccgcctccggcatcttcagcctcccggaggagacctccggcttctgcaacttcaccaaggagaccgccgcgaccaaccctggtatgatttgatggataagatttttattcctcaagagggcatcccctattgtttacatgacatctaaatagttattaaaatttttttaaaaaaatgacaatataaattaatatgaaatatatcactctataaacatgtaagattaaattcagcttttaccagatgaaaaaaaaataaattaaactgaaaatagttatcatacatccacatctatatttattatttttgtggatgttacctcgatctcattggctttgctcatcgtatcaatggcggtgtgccggtgtggatgtggtttgcagcgttcgcgtggctgcggtgcgatagggaggatgtggaggattgtgcggggtttctccgtgggcacaagatcctgacgaggagcggggcgcagttcggggcggatgcgaggtacgtgcgggtgagcatgctcgacagggacgacgcgttcgacatcttcatcaaccgcctctcgtcgctcaagtgaaagaagacggcggagagagagaggacgctgcagcgtgttcgtccgtgcgctagcaagcaaagcatgcccatgactcatgagagcatgagtagaaccgttaactgtgtatctgtatcagtatttggagagcctttttggtagagcttcagagcataaccaaacggtttcagctttactcgaaatgggagtgaggttgattgaagtgctatcacagaatgatctagagatgtagagttggatttagactattttacagctacactttagaaccaactcttgaagttaaatttgtaagttgaagtcctgccaaataggttctcagtagtagtagtaggtagaagaagaggagcttgcttttctctagcttttctttttctcttaaatatttgtttctcgatgttgtgttttatggttaagaatggcctgcaatgtagatcagtgcctgcgtgatttcacatacggaaaataaataaataaatgttcttgttcttccttttttggaagatctaatgtttcaacgagtacttcctttgtccaaaaaaagacaaaccctgagttttcatgtccaacgtttgaccgtccgtcttatttgaaaaaaatatgaaaaaaaaataaaaagacaagtcacgcataaagtattaatcatgttttatcatctaacaacaatgaaaatactaattataaaaaaatttcatataagacgacagtcaaacgttggatacgaaaacccagggtatgtctttttttggacggagggagtagttgttttctctgttagatggaaataaattgcgttgatgggtgtaaataaatataacaatttgcaaatcgctaattcatatacaacttgtcgagtccatgcgaacttgggccaaaatgatgaacacaagcaaaattgatctaacatgagtgcactgatatgtaatattattacacaacaaattttagcctggcaaaatgtgtatttttaagttttatatatgacaaaaatgcaaaacgatcaaaaagcccaaccttgaaaataaacttttgatgaaaatggagtatttgaacatgaaaattaaaatgaactatttcaggagttgagttacttgtacaaaggtatgacaaaaaaattgtcttagtgctgatcataaaatgaacattggacattgttttttccaagacataaaatgaatctcctttgtcctgaacatgaaaaatgaacttttgtacaactgatttgtctttttttagattccaaataagatattcaaacattgtcattacgataaaactgccagataagattctcgaaacatggttcgtaagataaaaactgccacatcatcagggtaggccatgtcagaccaattttgcttatgtggattattttgtcatgggttcgtgcggactaaccaattaatttttaccgaaatgaataatttgtaagttgctatacctatttacatcaatcacgtaagttcacgtccagtcttcgatatctttcagtagcacatgaaggaaaatggaaaaaaagaagatgagtgactcgaactcgaagagaaaataaagcccagttttgctagaggccacctcaagagatttggcccatagcctgcggcaaccctaggctctctgaggaataagatcactttgactccctcaactgaccaccgaatctaaatcgtatccctcaactgcaataccagaaatcttgaccccttgaacttgcaaaaccggtgcaatttaacttccttggtggttttggatggtggtttcgctgacgtggcgcacacgtggcagtgttgacctggtttttgttccacgtggcattgacgtggcgcttacgtgcattaaaataaaaaaaatatgtgggcccatttatcattcacacaaaaaaaaattgtgggacccactgacatgtgggtcccacatgtcatcttctctctcactacccttcttcctcctctctcccttatttctctctctctctccccttgacatgagccggcggcaggggctcggtggcggcatcggcgagtgggtgtcggagtggtggctgcgatgggcggtggacctcgggcgacaagcacgggagcagctcctccttgaaatgggcggtggacctcgggcgacgtgcaacgaaatgcgtcgggggagatgggagcacgctcccagctgccgctcctcgtccccactctgtgtcgtgggcagtgaggtgggcggcggccgcagcgtcgacggcaaggtgggcggtgcccgcggtggaaagggagcaatagcttgcgcgccccaacgcgcggcggcggactggccgagcgctccggcgtcgaccaggccatgatgcggagcagcgactggagctcctcctcctcctccgacacgggccccctccccgaccacgtccgccgcgagaccgcccccttttcctcttggacttgccgccggccgcgctcgcggcgacctcgcagagactcgggaagttggcggcaggagcaggaggctcggtggccgccggggcggcaacgttctcgccggggcgccaccatccctatctccccgtggcactagcaccgctccagtcccggacccgctgaagccaaatccttgctactgcggcggcggcggcggaggggacgcgaagaccatcggctgctgctgcatggcaaagcgcggccctagcctcgccgccatcatcccccgcggcgagcgcaccaccgatgccacgaacgcctcggcctccacgaatgccacgccgccgccggcctccacgacgatggacagcgacccctcctcctcctcctcctcctcctccggcgagtagaccagcgcaccggcgaagcggtagaacgccgggagcaacgcctcgagggagtccctgagtgcgtggacaacgtctccgaatggtggtgggggcggacgagcaggagcgcgacccagtacgcgtcgaatggggagagcagcacgcggcagcagccgccgccatctccatgcgtcgggagcgcgacggaggtgacgctcctcgtgcacaccgacggcggcggctgcggcatctcagcgacggcgaactcctccgccgtgttccgaatctcgccaaagcttgtggggtggtttgacccccactatacgccgtcgccgcattgtccgccgtcgccgctccgtccatcgcccgccgtcaccgccgccgttccggacgccgctctcgcatgaagagaaagagggacagatagagaagggaggagagggaggaggaagaagggataagggatgatgatacgtgggaccaataggtcccacgattttttttttgtgaatgacaaatgggcccgcatatatttttttatgttaattccacatcagcgctacgtcaatgccacgtggtacaaagactagttcaacactgccacgtgtgcgctacgtcagcgaaaccaccctccaaaaccaccgagagagtcaaattgcaccggttttgtaagttcgggggtcaagatttctggtattgcggttgagggatacgatttagattcggcggtcagttgagggagtcaaagtgatcttattccgctctctgatgcgtccgaagagaggcccacctgagttgggcctagtgggcttagttgcttgcgagacttagaagtgggccctaaaaggccacgcggaattgaacgctacagaaaccaattccggccacgttctcttcttctccccgcagcccacagtgtccgcgagagagagagagagagagagagagagagtagactagagacgcctccgcctccgcctccggccaccgcatcgccatggcctcctcctcctccgccgccgcggcggcggcgggggcgggggcgggggcggtggcgttggggcgactcgtcgaccgcacccgcgtccccgaccccaccctgcagcggcacgccgtcgcggccctcttccgccacctcctcacctccgtgcccccgccactcccctccgcggcgcacgacgcgctctcctcgctcctcgcgtcgccgcacccggccgtcgcggcgcacgccgcggcgtccgtcgcccgactcgccgcatcccgcgccgacctcctctccccggagctcgccctcccgctcctcatcgcgcccctctccgcctccccgtccccgcgcctcgcctcctgcttcgtcaaggccgtcgccgcgctcgtctcctgcgcgcttcgctccggctccgccgcgtcgcgcttcccgccccacgatcacccgttcgtccaggcgctcgcctcgggggccgatggcgcgcgcgcggagctgcagcggcaggcggccaggttggtcgccgagggggtacacggggttgtagggtttttgaggccattcgttatgtttgctgcggtgaggaagggggacactgcgttcgtgaaggatttgattggcgcactggccgcagcggctgttgcagcggcaaggccggattctgcagtcccggtgctgaaattgcttgcggagtgcttgctgcattttggccgtggggatggtgaggtatgttgtccttgtctgatgtctcagtgcttatgcttaaacagtcctgaactcctggatgttttagtattgtttaatatgagattagtagatagatcatattgtaggaatgttgctgcatcctgtagtgcctaaattgaatttgtgtgtgtttgttagagtattactttactttgttgtcaaagggatcaacagagtttgagcttatttgtgcttacttttcttcaggaagtgcggctctggcttagctccgtggagtgcttggtggatgcttatgtggtattattgaggaagtttgctcatgctcaaatggtacctctctctcccatttgcttgatttctcgaacggaattcttcctggtttatcccatttgcttgatttctcgaacggaattcttcctggtttattgatattctaagatttactcacattggttatttcattatgaattagagtatcgattaatccatgtacttgtccgtgtttcctgaattagcaacaaacattatatctgtgctcttaatagagctttcatctgctaggatttaggagttatgtaatagattaggaactaattttttggacatgattttttactcagtaattcttaccttgcaaagtttatcaccctccaaaaacacaagttattggggattatgtagttgccttatgtacccacccattttgccaggttttgtttgtggatgttatactgcctatatactgatcactattttttatactggagattgtacttgttctatattggcaatacggctagaaggatctgggcgcattggatgcttactttgttatatttacttgatttcaaatgctattatagtatgagtcatagatatgctataacttgcttcttttaacacttaacaggcaacttatgatgcccaagcaaatagtgtggagttgatagaaatgcttctatcacaatgctcacttcatcaccaatttatgggaaatacttctgttgtacttggattatcaaaacatttgtttttggctcaaaaggaccttggtttatgctatcttccagagatttctgttgttctcagctcccttgctttcattctcagtgggctggagtttgaacatgagcaactgtctggattgaaactact

SEQ ID NO: 57961 - DNA, 773 bp, Oryza sativa
  unsure (1)..(773): unsure at all n locations
ccgaccagtagtagtcgccgccgccggcctcccccctccctcctccggccagatctggaaggaaggggggaggggagccaccgccgcggccccacgcgtagtcgtcgccgccgccgccccgcgccgtatttgccaccgttggcctccctcctccctcctccgaccagatttgggagggaggggggaggggagccgccgccgccagccgaacgccgtgtcgccccgctgccttccgcgccaccccgcgccatggccgccgtcactccccctccggtggctggggagaggaggaggggtgagggaagggaagaaggcgtgaggggagaggagaaggcgtgaggtgtggagaggggagaggccggccgtgggtggagacttagaaaaaatcaacctctaccaagtttatttatatttaagtctattttcgtaggcggaccgaccatttcaccctaatttatatttttgtaggcggtcatttggctttaagagtcnnnnnnnnnnnnnnnnnnnnnnnnnnnnnnttgagaaaaatactttttctagtagtgtcagatacaccacagagcctttttctctctcttggcaacgaacgtatgacaccaaaatagcacaagattaagctgtgtgagcatgggtttttccccctaacttgggtagagatggagatggagataaactgaccaatataactatagatctttgcgatagatgcagccagtgatgcaccgtgagtagattccacgtagagcaggaaaacgacgctcagtttggga

SEQ ID NO: 57962 - DNA, 673 bp, Oryza sativa
aaaagaatattacccaaatacccaatactatatattcgccttttaaattaacaatcacctaatctagaagccacttcagcatcatataccttttaaatttatggatttaatcaacccaactaactagcaaaataaggccaaatttctagttagggtgtaacaagtatcctccggcatcctctaaagtggaagcaccagacctgatcattgacattggcgcctttcagcctctgcgtgtatatataccttccaggcatcacaatgtactgtctcgacccaatctgcgacagaagaaaaataatcaaaatagctccctcgttattattcacagcgctcatacaaaacaaaacacagagaaaccctcttcagatgcactcctgcatatttcagaaatgcatccgaacaattctctgtaagactagtattgtatcattcgaaaacactgtaattctctgcgccgttttcttaatggtgtgtcctgtacatactaataatcggcgtgcgcgcattcctattggcgcgtgaatcctaagcttcttatgcagcatagagtaagcaacacaagcctgaaatcaaatgctcacttcaccgcaagaagcaacgcaactagcgccaaatgcctgtgtaatgatattatttaaagaattcgaggtaatgtagcatgaacaaatgt

SEQ ID NO: 57963 - DNA, 584 bp, Oryza sativa
atctagatcaaataggacggtctaaagactttatatttaaaaataattcataactttttcatgtgaactctaatgaagacaaactttatatcaaacttgtagccctcgacacgatctacaactttgtagttgaattttttgttattttaagtcattttttgtccaaaaatataatattaaaattaaaatttcaaaatctataaacatgcaacaatattttgggaccctaaacagttttaattcaaaaacttttcaactacaaagttatgatataaagttttcaattttgatataaagtttgtcttcattagaattcacatgaaaaagttatgaattattttttgatataaaatttttagaccgtcctatttagggaccggggtgacacaactgaacaagttggaggacctaaacgagtgatttgcaagtttagggaccggaataacacaatcgaacaagtttgaggaactgaacggtcgatttgcgagtttagagaccaggatgacacaacggtacaagtttagggaccggtgatggactttactctttaaatatatatttgaaagctatgtgtttgcttatcc

SEQ ID NO: 57964 - DNA, 926 bp, Oryza sativa
tccatcttgtctaattagctatcgaactactccatatttaaccaactgacaatggaattagcatgtgcaagatgatgggaagaacaattcagtgagctactgtaattgttatctaatctaccggactacccctgtatactcgtctttgagcttattggccaattgtgtttagcagtatgcacacacatgcacgttgctgattaatttggtttataagtttagtttgtgaagcaacactaataatccgtcagctgcaatagatgcctgtaaacattaattgggacgttgctgacctgcttatatatatgtatgtaatctggctagttcgatgtaggaaattgtagttgatgatctctctagtgccatataatttcattgtgttaaaacaactttgtgtgttctttcatcattacgcctcatcttttttgtcctccgccctctctgtttgtgttattgaagtttcctgcattccttacatcaactgactggagttctcgcccctctttatttttcttggtttttcatttatagtttccttcggtgttccctaccagaacaagagaaggatcctaacgatgcgagtctactgcgctgctgatgaaggttagtctaatggtaactgtagattggcaagttgtagaagcggtcaaatgttttattttaggggcaaatgcaaatttgccactactttaaatcgttattgcaaaactgccactagaaaattgcaaaaatgccactagaactgtcattcgagtggcatccttgcaatattgaaaaaaccggtggcattgcaaatgccctattttacagttttttattctggagtgaaaattcttgtacccaagctcagatcttgaggtggttataaacttttgatgtatcttacactagggactactatttcaactcttttcttcttttttttt

SEQ ID NO: 57965 - DNA, 1017 bp, Oryza sativa
caatcaacaacaggacaaaatgtcctgaaggaaccagaagcagcaaagcaatctgacgtttctggtgaatatgagtcagtacttgttggtaagcaaaatgaatccgctaacaatctgacaggagattctgcgaaagaagagccccctcttgtgggactgggaatggaagctgatactcatgaaagtgctcctagagaattgaaggatgaacctattttgccagagacggagagaagtgaattatcatgtgaacatggtgacatcacaggacatgaggattccgaaatgtatgcgccaccggaatgcgaaaccgatgtgcagaaagagagttgctgcgttgataggcgtcgtgcggacatgcaggtgccaaaggaagttgaatgcgatgagctgggagatgataatccgaaggaagatgctagtgttcagacagagaacatggcatctgaagaagcttccttggcttctgcaactcctgatggtatgaaagatgagaacaaggttgctgaagaaactacttcagattatgcgactccttatagttcaaagagtgacaatgagaacaaacttgctgaagaaaaccagaagctgaaagagatgctgcaaaaccttcttgcatctggcagcgatcagatgggagttatcacggaactgagcgagaaggtcaagacgcttgagcgtaagctggcgcgcaagaagaggccaaaggtaagggtacacagaccaaccaggcaagcaacggccaaagtccactgaagatgatctctgaagttttgagtttgtgtttatggattccatgtagctgtttgtaaccatgcctgtatgaatgtactacttgtaatgtacacatgagtgttgtggtactatgcattggagaatgtaagatcatgcctgtgttgggtccttgtaatgctcatgtagcctagtttaacacggagtatcaatgtcataagggagttgaatattttccttgtgtgctatttttctggttaagaaagctgctgctgctccatacat

SEQ ID NO: 57966 - DNA, 780 bp, Oryza sativa
tttagggaaggaggtagtagttttatatatttcacaaaagtttttgaataaaacgaacggtcaaacatatttataaaagttaacgacgttttctaaatatttagggaagtcggctatttagaaacggagggactactactagtattgatcagcacaaacagccgaacaaagttttctgaaccaatgcaattgctcttcagcatcatgctgaagaagcacatgctgaacaagctctccaagagtgtgatactagcagtgtagcacatgctgaagaagcttgctgtaaactttcgttttccaagaggatccaagagcttgtcagagtgaatacatggatgcagcagtgaaatttgtcaatgcttcttcaatgcacccctgtcaccattcatgactcatgagaggaggaaggtacgagcaaaaacaactgtgatgcttgtgcaagaacaggcaaggaatcttggacccaagaaactctcaagctccagatgacaaaattttgagcggttcagattattcagtcgaaatcatcgtcgcaagaacttgcttggagaaaggccaatgcgaaaacaaaaaaattgacaaggcatcaaatcgaccaggacactacagaaataatgtgaatgagtcctagtggagtaggagcaagaaaaaagaacaatgtgatgtacttactactacataggattagacagtgaatttcatagtactgaataatgtgatgcttttgggtgtgtttagttcacgctaaaattggaagttcggttgaaattagaacgatgt

SEQ ID NO: 57967 - DNA, 4383 bp, Oryza sativa
ctgtgctcttattgattgccacacgttgtcagtgtctacatcgtctgttcctttatgattgtgctgcttgcttagcctggagtagtactagcatatatacttgctcatgcatatgagcggtcatgattactttataaccagccgcactggaggaaaaaatgcttgtttttaagcttatgtattacgtatatcactctcttatgatactgtgttgaaataattactcattccttcgtttcacaatgtaagactttttagtattgtctactcatttagatgttaataaatttagacacatatatatgtttagattcattaatatctatgtgtatgtgggtaatactagaaagttttacattgtgaaacggagggagtactgcattactatataaccttcgaattctcattaacttcccgttgtaggaagtacctttttctttggttctaatcgaggctaaaacaatgcaaacgttgcattatttaatacttgtataattttaaaatctttggctatgaataacttctaaaatatgtatattagaaatatgtagattgttttattaatgtatagattagttttaaaaagtacattaataagatcatatatttcttaatattttatatatatatatatatagaaaataatggttaaaattttttagattgtgtcattgttcaaaacgacaaatattaggaacctggatggtagtaaagtacgtacgtacatgatgattaaatccgtgagtatatactacgtacgttggtcaatatgcagttagttaggtgtatgttggttgcatagagcgatgtttttttaatatagtttataccttgtatttgtatacatgaactctatgagcacgcgtacgctcgcaggcagctggaactatttgcgaatgatgatgagatgaggaaggcactgtggtagatattcttacgagtagtggcaatgtcaccctcacactttttcttgtactgccattaatcccgatttgtccttatttatctgtttactttctccctcgctctctctctctctccccccatgtcttttttgcaacaccataatattcttcaactctcactccatcattcaatactgggccttgctttttcatattttgttgcctctacatctcacctttcccttgtgctgcagttgtgtatagtaggagaagctgatttctatatctctcttcccctctctcctaaagatcactaccagaaagaagtcatgctctcctgcttgatcgtatgctagctcatcctacagacaattctttgattcgtatccaaacagacaagattattgatcttgtttcattttccgtttctactgtttctcctctattttccattctgcagcttggatatcagtggatcttggaagaaacaagcagcaactaagaaaatctgccacatattgctgttgtctttcttcgtcagatcatcagatctatcctcttcgaccacaaataggtaaggatgagcaggttttgactagctggctagatccacctgagggaaatttgagaaaaaaaagagcatgattcagtctctgtctctcttcccttaggtactaatatatatattaatatctattcgagctctttgagatttgagcaaacatcaggttgttttcgcttcgaaatttgtgcttttcttgttgagagtcgcacacatgtgctcatacagtggatcattgtccaagcatttgtttcaatcggaccattaattctcatcggtacctatttcaaataattctacagcataaaatctacagtttcaatgtccccttgtttttctatagtttttctgtaagaaaagcaaagctaatttccccatttcttgcctccaaagtttttaaaagatcagatcaaaacaccttatgctctgaaaccctatcctccgcccatcttttcagtacaatccttgctgccatgaaaaccctaaccctagaagaagttgcacaaatactcatgcatttgtttgagaaataactgacaatttcagtaccattcttcaatttgcaggtgtagctagctagctcgccggaaatggcatcctcgtcgagcaccagcaactccgccatctcctcggtggtcgcgtcggcggtggccacgacgacgccgggcgccggatcgccgtgcgcggcgtgcaagttcctgcggcggaagtgcctgccgggctgcgtgttcgctccttacttcccgccggaggagccgcagaagttcgccaacgtccacaaggtgttcggcgccagtaacgtcaccaagctcctcaacgagctgctgccgcaccagcgggaggacgccgtgagctcgctcgcgtacgaggccgaggcccgcgtcaaggaccccgtctacggctgcgtcggcgccatctccgtcctccagcgccaggtccaccgcctccagaaggagctcgacaccgcgcacgccgagctcctccgctacgcctgcggcgaggtcggcatccccaccgcgctccccgtcaccgccgccccgaggctcgccgcggcaatgccggcaccaggccagctcgccgccgccgtcagtgccgggatgtacggcggcggccggaggctcggggtcatcgacggcggcgggatagcgccgccttccccccacacggccgggtgctactacgcccgcaacaacaacgccgggagcatcggcgctgacgtggcgcccgtcctaccttacgcttccgtggctaattggacagtgaacgccattagcaccaccaccaccaactcaggatcagagagcattgggatggatcacaaggaaggaggagacagcagcatgtgaattgaagcgcggcaaatagtaagtaacatttgagtgaatttgttgcattgcaatcatgcacgtatatgcatctgttcgctgtatgtatgtgttatcagtgtgctactactacttcttcttcagatgtggagatctgcgctttggccttgatgagagaggatcggagaggcttcaggaagatggcagcccattcatcccaggttaattaagagttaagaagcaacctatctatctatctatatatagccagcatgaattatatatatcatctccccgtccctttttgcatgttgtgcaaaaccatactttggagttctatatgtaatcgaatcgagatcttgatctctcgtcttttcatgattaattcgcgtttttcgcaggatccatcagtcattagtacgtagcatgctttgtgatcagaaaataaccacctttaggccgattaaacaatgcaccgaacacatctatcgataggtgaaaagatcctgcggcttgcatgcatgcatgagtaccaagctagctaacttggttgggctaattaaaggctacatgatctgcatcttatatcatatgtcataggcaccagtggcctatatgtttgcatatatgctccagatatacaccatcttgagatgcttaatagtcttgggggaaagattaaaacagttgtttattgagagcatcacatcgtttggtttgaagacattcttcgcttctatatatgttatagtaaactgtaaaggtaggaaaaaagcagtattcccgtcactattcttataggccccatctttttatggatctcactgtggtgcattgtacatgtatcatgtatttattctatcatctagaattctcctctttggaattaattgcctttttcactcccttgaagacttagtttggttaattagctattactctatatccccaccaaaaaaaatatattactactatattcttatgtgtgcttgcctgcttatatatatatttgtcatctttttgtggtcaatttactgaattgttgttcataggtattgaattttactcttattgcctttctgttttcttcctaaccatccccagttggaattcctggctgtacatgatgctgtcgttgatctgttttgaccacttgaatctactctcgaatttacctctattattgcaacaccgaagctaagtttcaaacttcctgttctctttcacaaaaaaattgaaacatctcatgggacgacctctctatcttgtatttgaacaaagtggagctccatttggaaaaagaaggtatatatttttcccttgttccaatctctgaacaatttcccttgaaattgttgcatttgttccaaattttactgaaaactatgtcctttcttgatatgtcatcaaaattttgttgccattaatttttgttttgaaagatattcttttgctgtgacatgatctttcattaaactgcatcgcaccacaatctcagctagagactttttttagtaagatggaaaatttagggagacaggtgtggattccatcgtacgttaattggacctcaagtatccagcattcttta

SEQ ID NO: 57968 - DNA, 10347 bp, Oryza sativa
agcccctccggcaaggatctgatcaccaaactcttgccgacggtcaggagctagctagtatatggatccagtccggcacccccggtggcagtaatgtccctgaaacagcatataactattacaagacacatacaaacaagtcattgtatgaggttgagatatgattaacatattgaaggaaagaatgattctctcaatagtttttaagtttgtggatatactactatataacaagtgtacataatttttctctctttcttttttcaccaaggttttgtcctagtacgtacttcggtatcgcaatttaatgccactacaaaatgattatactctctgtagacacacacaacaaacctcaacaaaaacatatgctgcaatgaatatagacattaataaaacgttcttcatttatatagagacaaacataatgcactatacttagagaacaatggtggaatgtggattgatataaacatgtacatatatatatatatatatgaagtaacggacaatatatatatggagctgattgaaattaagttattcactacaggttggtgtcccggccggaatacaagtggatgatagcatcaggagtcaagagtgtcggctgctggttcacatcaatctacaggcatatgtttatgtacgcaattttaaagatcttacgtacgatatatatatattggctggggttaggtaataacggccctacattagaagagccctaggttaacatatggatgtataatatattccagcacattatttgtagtacgtactctgaaaattcaagatctcggtgacgccaatgtgtttgcacaatggacaagattttcctgtatttcatacttcagaatgcatatatatgcatgcacatagcctggcggattgcaagactgactagctagctatatttcttagtctcctttaaattttgaatatatatatccagttatccttcaactcttaaaactggcgagatttaatctgaattccacattaatttggttgtggtagcaaaaaagaacgaagataggggcgaaacttcacctatcagatagagaaaataagtgtatgctccagcgcttcactgagcaacatctatgacacccaccaccaccttgaatcccagtacttgtacaccatgtggatgccttgcatggtcaaatatattggtggaaggacctgtcctatccaattttgagagttgatgaatgagttttattgagtgttgaaatggatatacggaaattaaactgcaccagaattgagagatggaaagtagatttcttgtaataaattgttatagctttctactatctccattctcaaaaggatgacgtctagatagtgttccttttagattatcgatggatgaaaactcatgaattctgattatagagataaattaaatattatatataaattataaaggtccaaataatgcggtagacgaaagcttttcattttggagaaaatacattttttaaattgtggagtaaataatccgcagcaatagatgaataatctaaaaacaataagtggctttaaataggatgcatgcagttgaacctcaaaatcttgaattattaatagatgcaaaactaccatgatttgaaatgtgaaaaaaaatcatatcagtagatttaccatgaaaaactctttcatagaatattattaatcatttttatgaatatatggtttgagaaattaaattaaagataaacacgcgcattggtcgccgtgtcaatatataaccaggggacatttaattatttgcattatgtgtctatgacatgtgggttcagtgacaaatcgtttagaaccactcataagagtggcaaatagttaattattccatatcctaaacgtcatcctgttgagaacataggtggtagctagctaacaaggaacaagtaatgcgaaaagtcattcgcaaaaaaggtaaccccaataattaaaccaagtatgattgatggtccaggataaaaactattcgttagacttgatagtttacctggccatgcatcgaacgatcgagatcaagcaaatataatacatatgcatgcatatatatactacatgtaattcaaacatatggtcaattggatcaccgtcccagcaaacacattggcttgcaaatcgaaaaaaaaaacgaagatatttagacaagaactcacaccaatgaatctgtttctcgcattgcatgcatccatgaataaagatgagctcgtcatctccgatgattagaatggacgcagctagagacagagctagtggttgttgaggccaaaaaagcttctgctgtgacagcagcaatcacacattcacacttactaatcatgattcattgggcacctttacagccaataatgccagttttaaacctcccaattacaccattaactatatggcacaatcagagatcctctcgagacagctatcaatcaatggcgatcgaattaaacttaattgttggcactccatatatccagcagcagctgtagcagcagccagcagcatgtgatgtgagctactactgatactgatactgagctattgcgatcgcatgcgaagaagattcagtagaagttaattgcaagcttaatcagattcagtagcatttgagctgagctgagctgagatgatcatggggagagcagtggagcagcagcagggtggatgctgctcggagaagaagaagaagctgaggaaagggctatggtcgccggaggaggacgagcggctggcgacgcacatcgcgcggttcggcgtcagctgctggagctcggtgcccgacctcgccgggctgcagcgctgcggcaagagctgccgcctccggtggatgaactacctccgccccgacctcaagcgcggccgcttctcccaccacgaggaggagctcatcttggctctccatgacaagctcggcaacaggtagctagattattgctcgattaattgtttgctggattaatcatgaaacgattgatttgatcaatggagttcgtgttcatcgtccgtgcgtgttgccgtgttgtgcagctggtcacagatcgcggcgaggctgccggggaggtcggacaacgagatcaagaacttctggaacgcgcggctgcgcaagaagctccggcagacggagtcgtcgtcgtcggcgacgacggcggcgggggcggcggcgaccggacaccgccgcggcgaggctgaccggagtcgaccgccgccgcctgcatcgttcaacaccttctctcacgacgaccggacgactcctgctcctgccgcccacattgccgccgccgccgccgtcgaagcacccgcagcgatgacgacgacgggcggcgccgtcggcggcggtgttctcgtggacaacagtggtggtcaccgtgatgcggtggcggaggcggcgcggggacacgtcggcagcggcgacgacgatggcttcttggccgtgctgcttggggagtactacctcgacgccggcggccacggcgacggattcagcttcttgggcggcggcggcggcggccacgtgttcagctaatttgtaattagtttgcttgctttaatttgatcgtgtaatgatccatttcattggtttggggctgacaataattagcacacaagctcttgtttagttgtgtttgtcaaatcaaatgtgcaaaattaatctgaataaaattgttgatgatcgatcgatctctacttattcatttctcgtctctctcttgaaaatctagggagctccctatttcaggctaaatcactccgagagaaattcaaattccaaagagaagttttgaatgttaagctgtttggacacaattaattcaaccaaatttgaagagatgattgacaaaaaaaaaaagccctcgggagtgtcgagatggcgacatctcacaacatatcgcccaagaaactgatcctatatgtaccactttaagaatttaataacacgatttagacgaactaattatgcaataaaagtgtatatcagtatatgatatgctacgtgctaattaagtcattaacaatttgattaacaaattggtattgctactgagaaaggcaataactaaaatttaatttcctgcgcaaccagtttgatggagataccggggaagatactaataattcgagtaatccatggagtacaaaagataaactaattaagcaagcatgtcgagtggttggctactactaatactaatttatattcatgaatctatttacattttgtatatatactcaaataccaaccggacacctaatttcttgaattagtactacttgataccctttttaaaactatcatctagaagcttcttttcttaaactagaaagttcacgtgctaaattagccaaccctctatacacttgtatttgggccgacagcacagctagcttttatctgtagttgggctccacttctattagggccgaatgctagtctgggccttctatctctagcgctcttgggccgaatctgacgggagaatgcttccggcccatttcgaagtttgcactgaggtggtgagttggatatcaagattcgtgcaggtgcagctggttgagctgggtggcgacaaatcgaatcccagtcaaattgcacagatcttggagtggatctccctgcactgcattcgaaatttctagcggctcagggtgcagatctcgaggaaatttaacgtcggtaacagtgctgtcaaatgcatgggatcactctacctgcgacaagcgacgacgacgacagatagaaaacgatttacctgactacataaatttgttcttttttttaaaggatgggggagtattctgctaaacaaactaattaaccaaggaaaccaaggtgaaatccatctcataatattaatcataaggaatttcgatgtacttgtcacctccatcaactttaattcaattttctacctattttaaaccccaattatcgactcactagttagaaccaaatctcatttaatatcggtattctaatcttttcttactatccttaattttacccaaaagaaaataataatttatattatgacacagagagagtataccttcattcatagttttatgatgtgtctcatctagatctacattactatattttaaaacggagtatcatatactgctgcagtaactacaagctactataacaacttattgagaattctttcaagatgataatattgtttatagaagttcagaatgagacttctgtggtcaacgtttatagtaagcttggaataatattgcaagatacagatagtcagctgacacttgtgagatctaactctattataattggtgcactaatacccaagacttctgataactactagttaaactgtgaaatgtgtcagctagctataggttagcagatcgtcaatcaaaagaaaggtaatgattgtgatagtaaatctgccacccttttctagttccattgtaaattttacaaattagcctttgaatttcttattcatataaaaacaatcaataattaaatggcagccacatatttcctatagcaaaaagatatataacacgtttcatgagaaataaacttttatttattttagatattactataattttttttatctgtaacaaaatacaggcatttagctagtttatagagaagacaataatacctaggtatagtttcctagtactttcttggtgctgggctgctggcctccaggcttccaggaatccagttccttcacttgtataaataccctccctttggctacctcccttgatcgccaggcctacacattttcttcatctaattaagcctacacaatcaagtagagtactaacaagtagctccttgatcaattttccatttttttttcagtggcaacaatgtgtggctcatttgctccaaggtcatcgtctctgctgctgctgctaatcactctgctgcttgtcgttgtctcacgcccacaatattccttggatgctagcgcattatcaggtaaatgcacatattgttgtttacaacattgttcttgacattctgaaaatctctgaatatacatacatatgctgatctgttcatgcatatatgtatacgtacatagatcacctcgccgtcggcgatgcgccgccgccgccgccgcagcacggtgctggccggaggctactcagcacgcagaaccaggtgacgccgccaccgccggcgccggtgtcctcgccgccgataggccctgcgcctaccctgctgccgccgccgccgccggcaaaataaacggcggcgacgtatttgcaacctcacgacgaccagatgccacatgcatgtgtaccagaaacagattatgtcaaattgaattgatgcgtgtgtaatcaatgaatttatcttgcgaattgcgatcgatcgaaagaccattttctcgatcagctagcttgatgggatcatattcatatcctagctcaaaatttcatgaatcatttcgaataaaatcccccctcttctcatttgcgaggggctagctggaatcatggagtgaaatgcagttgcgacgactgacaggccgtcactttatgttccatgtacgatgaagagttgaacggcagcatgcgtcagcgtgtgaacagtctctactacgaaaaccatctttatgtacgaggaccctataaactacagacggatcataattagtcgtgtctgcaaaaattgaattacattttcgcatgcagttacaaaaggggaaaaaaatatgtcgtttcgaagatcggttgctagaacacgaaattaaccatgataatattgttataacatgccagataatgtccccgtttcaaaggtagcgaaaattcaactaagggcatgtataaaggtagagtctaatatgagctctctatattaattaatatcactagagactattctcctacaatagtagagacaataagatttctaaacaattaatgcactaaataatttttttattatacttatttccttttctctatcctcatgcaacaaattttccgttaataaatactaagagttgactctgagccgttgtcatgcgtagcaacaatgtttatccttattccctctctttcttccacgttattaaatttacttgcatgacaataaagagagtccgttattagacactattgtacatgcactaattccattgagaatgaggagttactatatacttgtgtgattttaattatggaaaaatcggtccgatttaaactaagagtatcaatacaaaattacatttaaaaattctcttaaataaaactttcaaatgtagttgtattatagtaattgaaatgtaactatattatagtttatttatttctaattcgcaaataactaagtaaaaacatgtccatacagcgatggctagcattattgccagcttgctgctagaaggtcgggctatatatatacggagaattttccacaccagggaaggaattgaacatgcccaacaatgaaatacaccagcgatcgctaatttcgtgattatttgtctgatttttgtgacgaaccggcgacaagtggaatctatagccgtgcccccaagctcgagcgagcgcgaatctcgaggcaattagcccgaccacctaggccggactactgcgccgatcacatggcgaaacctcggctggaacaaacacgtacgtacaacaatctggctggctgtccgatgcagcgtctccatcatcgttcgttcagtctatgctcccttatgagtatttccgcctttctaatataggttaatttttttatccatctcacacgtatcaattgaaaaaacttaaaaaaaacttcatttcttaaaccacaatacaattattctctattttatctactcctgatgcatttatccatttttttaaataatggaatgagtaacatcccggctacagccattattacaatctagcactttagaagagtatagttcaaaataaagcgaatcacaccaaaccaaattaaaggaaaaccaaacaggacaaggagaacattattccaatctattattgaatctccatccgtggttggcaaaaagttacataaccgtcatctcaagcttacgacatgcaacaatcaaaaactctccatcttcatcacacttcttttgtaactgagcccactgccggagccattacttttatatattctagtgtgtaatattagctgaaaaataaatttattttgggatcaatgggagggatgaaaaatgaacccactcagagacggaggaattaataagacaattttctttacacgtgtactagtacttttgcaatgcttatgcattcaacctatataatctgcctaaatgcctaattaacatttcagatgtaactacatactccctccgttaaaaaaaaataataaccaacattgagctatgaatctgaatgagccgaattcatagctaggagtcgttctttttttttttttacttacggagttgtgtattgcggcaagcttgctggctctgaactttttagcttgtctttaatccattctgcatgagtacttgtgcagattgggtagcagcgcgacgggcgtctcatcgtcagcggcaatacagcgcggcggcggcggtggcttcagcagcagctctccagccagcctccctcgtctccggcgaccgtaccgccgccgccgatgtgcctgacacggccggcgtgcagcagcctgaaaatttaaactcaatttgtgtggttagttcgactgttcatgttggagaattagttgggcctgggcctcccaaccagaatgggcctaatgtcgagcggcccaaagctagcccaacaaccagttgcatccgagagtaatgctcttttcagagcagtctctctcgcagaaagaaaatggaagagctagcagagaaatcttccagctgcagcttgcagataatgatgatcaatcaccacccctacagtgatatattgtactactactcatctgcagccaatttggcaacttgatctcattatctcgacttctttagttagtactgatccagagattcccttctactactacctgttgtgatcttttcaactaaccggcagtcagtcatcacaaggaaaaagcctggaagtctacatgaagtgcatcactgcatgatgcttcttctacttgcctgtcgatcaaaagttgatgacggaccagccaagaatgaagaatatatgcatatataaccggataagtttagctttagcctgaaagaagttaagagatgcatggatatgatgagaatgagagaccaataatatgtactctatgtactattactatactcaagcagacagaagaagagacaggctatggctgcttctctgaatgtgttacagtagtgtcaagcacctgaacattggagtaggttccatggctgctttcttcagagttcagggactctcctacctatagcaaagtgtagtagtagtagcacttgatcagactgcatgctttaattatgtcatcagatgctctagcttgatgctagctgtaacctcctaacacttttggaagtgactagaaagatctgacaaaggttactaaactggagtagagctaaacccagtcaaagaaactgttagctggccggcatggccggctttctgctttgctttgccatgccatgccatgccatgtactgtgtgcaccatactactcctactactactctatcaatgctcttatatacgacaagcgatcactaaagctagctagaagaagaagcatgggatctgcaggcccttgttagttttgggcatttgctagctgctatgtacacttgttttacttgtctgcatccatgctttgctttctcgttctttcttgtgactcatgagaattcagattcagggtcagtttggtgttttggttggagggatgaacatggagacggcatctcacttttgctagtgtttcgatctggtcgatgcgcaccgcccattttgatactggccccaaaattaagttaccacttatttgaactaggttttaatgcacattccaatataataatcccatcacttaaacttgattttgaattaggagagatacagatcgtcaaacttggagtcgttgaaatgctatatttataattagacatattattattgataaattaatactgattttattaagagatttgcttcggtccaacaaaaagtacctctaggtaccggtaactcacagtaccaagctagatccaatgatcggaaacgatttgataccgtgaggtaccagtatctcgaggtactttttgttggaccagagcaaatctcttttattaaacccaaaatggaacacaagtatcacccaataacaaaacgctccattat

SEQ ID NO: 57969 - DNA, 5056 bp, Oryza sativa
tcctggctatactatgacactcgtattttttttatataagtactaacagagttatttgatgtatagagttatatacagtggtttgtaatagttctgtccacactgctatgaggtttactctgttgcactataattatttttttgcatcacatgcaggtccaagctggtgtgcagattttgcgtgacaaacaggaaattgttgagacacagctccatcttgcgaagctccagccacccaagtctgatgccctggcatcagataatgttggatcttctcagacagattcgcaccagcatgcagtagctccacagcaggcagccattcaaccacagcatcaagccctcacctcttcacaaccactagcacttcctgcccttcctgctccaaatgcgcctcctccacctccaacgcttcaaagccaacctccatcacagtatccaggccatctgccacattcacaagtaccaccggttcctccttctgctccagttccttcggtgccagctttaccacgggatccctactatgctccacctgctcagccgactgaaaccatgcaccagcagtatcaggcccctccagttccacagccacaggcacccccagcgccgcctcagcagtaccaaaccccaccccaatttcctcaatattcacaaccgcctcagtctggaatggttaacccttcgaccccactcccacccgctgcaccccagcagccagaagaagccatgtcgtatgcacctccacagagctatccaccaaatgtccgccctccttcaccttatatgccaccgcctagtggacctgcccctcctttctatgggcaaaaccaaagcatgtatgaacctcctgtgggcaggccaaactctggcccaccaccgtcctatggtgctggcgggtacgggccacagggaggaagtggtttctctgaatcatatggttacagcggatccccttcacaccgtggcaatgcagggatgaagtcgtcaccctcaccttttgctccctcagggccatcatctgggggaagtggcaactatggcaggctccccacagcccaaatactaccacaagcagtgcctatcaattccagcccaagtggttcctctggcaacagggtgccggttgatgatgtagttgagaaggttgcaacaatgggattctcaagagagcaagtgagggcaactgtgcggaggctgaccgagaatgggcagaatgtggatctgaacgtggtgctcgacaagctgatgaacgacagcgatgtacagcagccccagaaaggatggttcggtcgataagttgtgatgcgcatcattggtgctcgatgttctcatttctcagtctgtgtataatactattgaatatgcttgcttgcgcacaacctcggaattcttcagatttttatatggcctggaactggaagaactgaacaggcaattataggttggtttgctgcctgccctcagttgcttacccttggtgaaaacatgcaactacagtcaacaggtgttgttaatgagtttggtagtgtctctctggatacccttgttcttttctataaatctattatatacatgtaatgacggtatattaaatcataaccatggctttcctgtgttctgtcaataaaaccatcttgagcatattgctgagccccatttgtgtccttcaaatccgtactgtcaaccaactgttatcaatcaagttgatcagcacgatgtgatttctgttcaccttcaagatgtcgcctgaacatatgaatatatgatctccaaatttgaaggtggcaaaactgtgccaaggtgtcatactagggtgacatgcactaatacacaagttgcaatccatcaaagcctccccacaatgtaggcacaggcccaactaggtccacaatgtaggcacaggcccgtctcccagttgggccgcgaggactggtggcccaactttaccaccatccaagctggccgtccttgtcgtttctggtttctgaccctactgttctgatcaagaaaaagaaaatggtttataagcatttctgccgactcgagctcaaaagcttaaaaaaccccggctttgtgtctgcctgacccaccacctgtctgcacgctgcaagccggatcgatgcggatgtgtgtactttgcgcagacacagtgcgccacgcgacgcaaacaggcaggcagcgtgccagccatgtgctgcgttgcctgcctctgcgtgcgagcagccgacgggggggacggggacacagccgcgtcgccgtgatggcgacgacacgctgctgccgatcgatacgcgcggatccggtgcgtgtgcgctgtgggtcgtcggggtttaccaaatcggtattggtaggattatcgctacctacgctttaacgttatcatgaacatcatgttattatcatgagatattcttcgagtttaaaaactgataaagctattgtatatgatacccgtgatagatatgcacttgatagtacagtagtgtatagtttcaactctaagatttcgtgtttaatcctaatacacttataattttcttttaaagaaaagttgttggagaatcgtttcatcctctaaatattatttttttaatgataaacacgataatagtgcggttttataaatcctcgctgcagctctcgctccgatcgatggtccctccctcccgtccgggtccggccagccagccatgggcgcagacgccgggtacagtgaaagcacacgcgcccgcacgactgtcatgtgtgaccttgggccagcgtcgtggtggtggtggtgatgaggcgtgtggaatggcgtgcgcatcattgctttttccctgtagagaattaacaaagggcatatatgttaccacaaacctcaaaggatgtgtgtgttcgcgcttggtgctttcttcgaaacgatacacgtcaacaagggactgttgtttatacagtcgtggttgtagccgaatagccgattctagttttaaactactccaaactcaagatttttcctttttaatttaaaaattacacggtacaacgcagacactcacaatacacgcacactcacccctatgaacacacacacataaatcctacccatatgagtatcttcgaaaactgaaccggcaaattctggagagattgacgaagtcaccataggcgcttcgctgtcgacgggcacgtcaactaccactaaaagcataacgccgttaaatcctaaaaaattcgcttccatggggagtcgaacccagaacctcatgtgctactgaggctctttatcctttttaatttagttccattcgcgtaaagcttttgaatcactataagattaaatatataaattattataatttctatttatatttaaggctctattcgactgcgctggctgttgcatccagccagccatttttaaacacggccacattcagacgtgttatatgtattggtttatatataaaaaaaaaacctttaaaagcaccttcgttagcaaatttagctatctcaatatactaaaatggctctctctctctctctaaatattttagttaacatatttgatatctactgtatgagtccttttatctagactctctaaaatgatggcgagacctacatgtcagtctctctagcccttgtcttcccctccaccgcctcgctctattcatctattagcggagccatcgaagcgggcacttccttctcctttgctacttgcgtcgtagctaacccacgccaccactctgtaatgtcacgcgagaagatggcgactgaggctactgattgcttcttctcctacaatggtagcaatgtcgtagactacctccctcttattcctaatttaccgatagaaacggtctgatccgttggtggttacgtgctatcataatgtattgtatggagtatctccttatgtgacttttttttattcatatcatctattcatcgagtaagattatcgttcccctatgttgtctatgtgtagataaaacaaattttagaaacactacatacgtttgtatacttaacaatattatgaattgccatataacaataacataaaattcaaattccagtcataataacattgtgaaaaatttccagttgtttaaaatttcatcgagggagaaaaaaagaacgcttccgcggtccgcactcccgacaagcacacctggaagcaacatatggcctctaggtacgtacaaacacggcaatcatccaaatagttatgttcccctcattcctggcacaacaattccacaaagtcacaaacacatggatcatcagctccatcttctggtcatcaatggctgcaattagctagccaatttggcacagtacagtgcactagcatcttgcttttttttttctctctctctctctctcagagaaacctttatgcacgcggtgaagaagtagtgggcccacatacagtgacaggtatcgggcttgttcactttgctactattatcaaccttaccaagttttggcattgtcaaattttggtaaggttgtcaaaattttgataagattgccaaattttggcaagatttcatatgtacttactaaaatttagcaataaactaaatgtagctagtttttttaaaaaaattgctaaataaaataagattgaaaatggtagcaaaatgaacaatcccatcgtaccttcaatccagcaatctcaaacaaccccggcaactttgccaagaggattatcacaattccagggaattgaggacaaaaagaaagtgagaaaacctcggccccgacaagattctatcagggcagtggacagtaagaatgcacttgatgaaccttttcttcctcttctgatcaagccttttcttctttttctcttctgatccgaaatgtaaagatgtccttttgtaaaatcgttgcaatccttttgtaaagtcattgcaatctgtcgtttctggctcacatatcagtgacattagacaagtactactacttttaaagatacggtgtcaagtagtagtaacgacaatagagtatatatggagattgcaataagccaaatagcatgatcccattatcaggctag

SEQ ID NO: 57970 - DNA, 9039 bp, Oryza sativa
tctacatcagtatgatcagagtcaagagtgttacactgcccctaaacaatggaaacaaaagaagcagaagaatggaatgaaatggaaaacctgaccaactaactaatcaagaattacataagtataactgatgggagaaatgagcagattggatgctcgtctcttctttgaagtctgaacccgttgatttggagcttcttttcagctttatttctgtgagggaatccagttataaacatttgagatgtcaactagcctgtacctgaagtaaattctcggtatgaaggaagaactctggtcagctgtacaaaaagtgctcgcgtcgactatggcagacgctgcaggaaccaatattcatcggttgggctgcaactttcagaaagcactatcacaaaatatctcttaatccctcccttgaaccaaggcattcttggggattagcatagaaatagtcctcttccttgggccggccagggatgacctttctttctgtcggctgacccatgcgatgctggtgtgccttcttcacagcagcagagaattcattccaggacattgcacctccttggaaactatccaaaagttcaacaagtttcaccctgtccaataggatggtcttgcggaagcccgtgtatctaaaatggatgaacaaaaagggctcctcagcatacagaacattgagttaagggcctcatcgtttgccctatggcttataagccaaagccaaaatttgaattttaaaacttgaatttgaatttgattctttttcaacatagttttttttcaactttggcttttcaatcactaagaacatatatacaaaagttttactcacatatcattttttaatcgctaataagacgttatggcttataatatgactagaccaaccgatggggacctaagtagttttaaagtcactgatttttttttcttttttgtagttatttgtaagaattcagaatgcacaggagcccaagcagttctttactaatgtcaaaaacaaaccatgagtgaactctagttggattagattccggagaagcaaacctgcgatggccttcaacaacccttgccatatttccatcataactggggatgaaaacatcgcttgctattgaaaccatgtagtccagtgctgccatctgggttgagtggttctggaatggctgcaattcctcaggagataaaagtttctccttccgtacctaacataagatcaaagtgagctactataaagcatccatgataaatctaaaggggacaccttaaatgggagaacctgctcaccaatctaggatatgcagccttcaaagctgccaaccgcctttcacctccatagatttcaccagaggctatataaatcagtgtatcctttttaaatcctagagctttaagcaccagagtaatttcctcgggtgtaaggggacaaagtccctgaaacctcttaacctcagagtctatctccttttctttccaccatggatatgcatatctacagttcaaagacgattcgttcatatctattaaagtagcaaatcagtacagcaagtcagcgttaactagtaatgcaaatcattacagacaaacctcattctagtgagctcttcggtttcttcatcagaacaaccgtgtgtgcagcccgaaaaggaaagcatatccatttcatatcgtaagtgtagaacaacaaattgcccacttttttgaagggtggagataagttttcgtccaagggcctcaatctgtggggtgaatctcaaagcctcaaagttgacacggcaacgcagcctttggagcttgacaggaagaccgttgtttgcaaggcgggcatctgttttattgaaatggatcactttgtgcttccttgcaagacgtaatacctgcatagggaatctgtcagatgacagtttttttaagtgctgttaaacacagccagaacaaacaaacttttattacccgctttagatagtatgtctcgttggaccagctcacaggtggcattgagtaaagtcttctcttagtttttaacttgagtttcataggaagttccttaacaatcatcagctcatctcttaacgaattaatgaagtgactgacgtcaaagatatctccaaattcactgaaaaaaaattaaaagatacttttgaaatagaaacacaacagaaattactgtggttcggctacattttcacttgcaaaaatcatagttcattctcaaatatggagatgaatgctgtttacaatagcaagggatgataactcatgttcacaacagcaaactaggataaaattgttcatcaaacagacatgctgttgatattacagaaatgaaggttatgtgggaaattataccttgagtcagcccaaaaagacctcttatccagttcaggcaccactaatgttagattcaaatagcgagctatggtcaccatatcacatatctgtaaaacaacattataagaaatttatattcgaatttaaaatgagtggatgagctagctcaagctacaatagctaaggtacaaaccccagctcgcatttgattgagtcctccattgcaagtcaccagtaaatagccattgctcttataaattcctgcaaaaagcaacaagatgccaatcagctctagtaccaacaaaaggactgagacaacaagatatgtgaattgtcttctagttatgtgtttctacaatgaagctgctagcaagctacaagcaaaaaaatcaatttggcaataataaaggagtagaagtttgcatcaatcggagcttgtttgacacatcgttgttgaaaagcttacatcatgaatttatgattcccacttcttttctttttatttgacagaaaacagtaggagaggctcctactgcgctatattactatatgattcccatttctcatggaacacacacgtctaataataaatatataataatcccttttaacttcaaagcaaataagttcatttaccaattcacatcacctattccagagcccatttcatgcccaaagcgctgggctatatgggagttttctataagtaaattaaattaaataaacaactactaattatagcatacgagcaacagaggttgaagatatgaacccacatttgggtcgaggttctgagaagaatctcattcgagctaccaaaggatgacctccgctaaataatccatgatatatcccaacaaatcatcgcaaatttagaaagttctcgcccaattcaaccccccgagatccccaaaatggcacaaaacctggtcaaaaccgccaattcgagcccgagatcgaaccgaaccagcacgaaacgcgcctcctttgaccaccaagcaaccgcatttgactcgccccaaccgcccgaatcagagaagccacgacctcccctctcccacacagatcgcgcaagctcgagtactactcctatttgctaggagcgcgaggggaggagaagcagagaggagcacgaagaggaggaggaggggcactcactcctgggcacgagcgccggcggcgacagcctcgccgcgacgcggtcctcgccggcgagcgcggcgagccccgtggcggcgccgcccccgccgccgcagtcggcgagcacccgcggcctccacagcccggcgatcgacgccagctgcaccaccgccgtccacaccacggcgctcgccgccgccctcatcgcccacctccacgcccgcctccgccgcccgccgtgccccgccgccaccaccatctccaccacctacccaccaacgaagctccccctccgcctcgccactagccgccgcagcagcgactcagcgagattaactagcctcctctttcgattagtttagtgggaaatccgccatgaaaaggattggagaaatggagggaggaggaggagagatggaggagaggtaggcacgacgttagcatttggagaggaggtgggtagtaagtaatagtagcccttaaacacgccggattaaaattaattaggtgattaaactaatccaattagtctctaatgacaggtagcactagctgactagcccccggtttgcagtgcgcacaatttgacagtttttatcattttgtcagtgtctcgtattagaaacgggcttaaaaaccgtagttgttttcatcattggcgtgtcgggtattaggaacggattagaaacgtatttagtggcttgattaaggtagctttctgagccatggctgatgatgcatcatgtgagctgagactgagttcgaaacggaagttggggtgagctattccatcgtgttttccgtgagcacaagcttcttgattagtattttttaaaaaaaaaatattttcgaatttataatagctaaaacttaattaattattctatccgtcccaaaataactcaatctagaagattagaaaattatacggcttcttctaaaataacgaatgtacatagatttgtccatcctaatataagacacatattattttaggttgaattattttgggaataaagagtacgtactaataactcatcttttttattaaaaagtaactcaatcccaacctctcttttaaactcagaagcttgagaatgaaagaacagttgcgtgatagaataacggtattgtatcgtactttcgttgcttttgcttggttctgaatcttcttccctctgattattttttttctttgtttctcccagttttcagtgatgaagaagctgcatctgcaagtcagtgtcgtggctgatctcgtcgttttaacactaaccgacggcgatctgcaggtttagtctagactctagagggacgtgccatctctcgagagcgtgtgtgtgatgaaatgttgctttttggatcttgctggcttgatttgggccttaatctaatgaaaaatcatcggtttcttctctgatcgtttaatttcaggataagataatgtgtggtttttgtagctgatgataagttgcaagggcggcgtggtgtggtagcgacggataatgaggcaaaccgatgatggacacggacagccctgctcgtgaccgacgtgaaggatttgattatacgtatcatcagagagacaagtagcaactggtcagatgttcttttcaccggaaattttgtagtggactccacaacagtgtcgtgcacatccatctgatcgacattgatcgagttgttctctgcgagttatgtacgcagatttgatttcattccattgaaaataagcagcttctttgacttcagaacacgcagaggtaaacagtacaaagaaaataatcaagaggggtatcaatgtcaagaaagcaacgtaccatgaatacatggatggacacgttcatgtattgacaattttgagatgaagcagtatcacacaacatgcagatctgagacttgctatatggccttgcagaagtagaactacaatataagctcagatttgtatttcattcttgagcttttatgtcatatatatatatcagtgaaaagttgtgttcatcgaaaggaaagaaaactaaaatcaactagctgcaatttcgacggggggacaaatgcttcagaatgagggtggaagtaggttgcgatcgaacacccagctctccttattccggctacctagaactttgccggcgagaggacggcatttatatacaatggactgagcacaacctttatatatacaagttatcaaggtgatatgatttcgtcacgcagttcagggggccgaggtcctcaggggggtgaggtcagccttgataaaccggaaatattccttctgcagcatctgcccgccattaacctggtcaaagctgcacctgtagaagctgaaaaagccaaggttcgactcaattagttggcgaaaatttcaaccaaatgcagcaggaaaatgcagagatagctatctgctataggaaaatatctaataaatcaaataaattagctaagaacaactttttatactgtactatcctgcaccacgtattgtcctctttctacgagtatatttgtttgcttatgaatttctaagtatgtggtattatgaagttaatacgtcatgtacagtatacttgtgcaatgactgagaacagcaaaggttgactgtacagctgcttagcctgctatagcatgcactggggatgtatattccattcatgtgttacgttgctgatataaaattcagtgtagaggcaagtacctgccatccaggccaaccatcatgacagtgttttgagcaccaaacgctactatgtaacgtgtgacttctggtaaatggaactgagcaaatgaccactctgaactgaaatacttcggcagaatccctagagaaatttagcacggttagtaacttaattcttcaagaaatgaacacaaatttttcaacatatatacagatagagaaaacaatagcctgaacaatcaacatattgagaaactaatgcagtacaagttttaaagagaacaatagagagttgataaataacacgtgttcttgctgtcatgctgagctgctgactacgtagctttgtacagtaattctttgcagcagtgttgcaaaagtccgaaaatgggtatcgaacagacaatgtaccgtcaaggcatcaagcaaatagtcataatatggttgattattcagaattctacggatatttaacgttcatataaattaatatatactccctccgtcccaaaataagtgcagttttaacactattcatgctcaacgtttgaccgttcatcttatttgaaaaacaattatgattagtatttttattgttattagatgataatacatgaatagtactttatgtgtgactaatatttttaattttttttcataaaattttcaaataagacagacggttaaaacgttggacacggatatctatggctgcacttattttgggacggaggtagtatttgctagttgtttgttattggagatatttaaatacattttcttgtactagccatttgtactgtaacaaatcaaatagggaaatatcatcaataatctgtaactaatgatgatactcagtaacaagatatgggtcatacatacacaatgttttcaaccttcttgttgactatgaaatgcataaactattttttgctgcacatcatgctatgatcgtacattggaatactagaaacaaagtggaaagcagcaccataataattatgctgcaaaacaagtggaagctagccaaggaagcaacgtgtctgctaacttgccctaacttagaattaattgggccagctgcaagctacaggcccatacacactagagaagattacttgtcttaatgcgttgattgagcggattaataagacgattaaccattaattgaccaattaattggtccagttggccactttggcgttcactgagcaaaatcctgcactgaattacaagtacatgacgctttccttttcacacatgaataaatggccaattatacaggcgtatcagctgacttttaccacactgcttcacggtaataacttgcctgattttatctggtcatgcattccttaaacatttcacaccatttttattttttttaagaaatcgtcaattaagttattaagttaaaaaagtttacattttcagatgcctttccagcaaaagctaacttgaagattcatcacatcatttcatcaatcatcagaagcgcaaaactttaaaaaaaaagatatggaaaaacagtcaacgtgatatgcagaacagcttcttgaactgacaaggctaatccgtacaggagttgaaaaattacgattcaatctattccagaagttccatgtcctgagcagttactatgaacggtgaaaacagagagatatactaacctttcatgaatgacaatgatgagctagcattggatccagtgttcgtttgaataagaggatctatagaactagaagagttctggtgatccatccgtggaccttcaagactgcgctgttcattactagcatcttcccctgcaactctcactcttaaactgaaaatatgaacagttcctttgtcactggacactgccaaccactgcacattgggtgatagcgcaatgctgtatatgtctgctttgtcaagccctctgcgcacctacaagttattcagattgatcattaaagattcatgccaattgtccacgattacatataccagaaacacttctaaggcaacaactcaggaagcaatggaatagagaagacacccttctgtttgtctacgaaagaaaaaaagaaagaacatgttgttcacctcttgcaggcgagtaccatccattgtgttgaatattcttatcaaagtacccttcatgcttgctgttgccagcaggaggccatccattgtcaatgccatgcaagaaatgtgagaatcatgagctgaaatcatccttgtcaccttcaacccaaaatgctcaacccggacatgcccttgatgcaccccagggcaggccaacactgaagtgttggaatgatgagagaggcagcacaatccttttggattggactgggtctcaatctgatggagcaacttcaaatctgtgaagttataaacgtatatcttgcgctcaagaacaatgacaatgtagtccttccccaattttacagcccggacatcagagcggaaggcaaactctccaatacaatggctccggtgatcatcccagatcattaccttgttcggtggataatgtgcgttggagccaccacctacaagagcaaggatgttgcaacggaacagcatttcaacaatcccaaatccaccactcttcagatccctcctgaaagtctccttaaaagggtcacaattaaagatcctgaagccattgctggttccagcagcgaagcaaccaaagtcctgattccaagaaacagacaacagcctgatatcctggtcatcgctgctaccagcttcagcctggcctgtaggacctgacatttgccatgtgtgaggggactcaaatgtcccaagcttgcttggggagggcaaaccccgtgatgtggagacttgtgagctcatgtgaggggtggacaagccagatcaatcaattg

SEQ ID NO: 57971 - DNA, 4606 bp, Oryza sativa
gacggcgtgtaccgcgccgtggacatctacctcaaggcgcacccgcggctggcggcggaggagagggacagggtgtgcggcgtggtggactgcagaaagctgacggtggaggcgtgcacgcacgcggcgcaaaacgagcgcctcccgctgcgcgcggggctgcaggtgctcttcttcgagcagctgcagcttcgccgcgccatcaccggcacgctgctgtcatccgccggcgccggggccacgcagacgcggctccacctccaccgctaccagcagccacggccggcggcgatggcggcccggcactccgccgacgccggcggcggccgcggcgaggcggcgtggcggtcgacggcgacgcaggacagccaggtgctgcggctggacatggacagcatgaggaaccgggtgcaggacctggagcgggagtgctccagcatgaggagggccatcaagaagatcgatggccgcagcgccgcggcgtcgccgcgccacagcgacgccggagacgacgacgccgcgtcggccgacgggtcgtcgaggccggcgaactggcggtcgcggtacggatgcaagttcagcacgcaggtgtgcgactcgcacgcgcgcaacgtcgtggcgtcgagagcgtcacggatgggaatgagcccataggcgaatcgtctgaattctgaacaaaaaatcgatgctcgagatgaaaatgatttgagaaatcatccaacgtttccaatcgaagatccagccagaaatcgccccatctgtatgatttcgcacgcttacgttgcatcgctcgtgtgcacgaacgccactgccattcgacacggaacataagggatccgtgtgtgttgtgtgtatgtacgaaatgccattttgtagcctgtcatctgttacgtttcatgtgtgcttgtcgacttgctgtttggacaaaagcagtcgcgtagatttgagttgtcagggtgtacaatacacgtgcaggtgttgccggcctcagaaagcacaagctacaaagttggatttacccttcgatccgtacatgaaatggatcttgtgccgtaaatagatccagtagaaatgtacagattgttgataacttgatatcgtcgtttttttttcctctggtgttctgaagatgaaggaacaaatgactctccaccctgagaagcatgcaaactgagagctgagcaaaatgggttggagcatggtccatggatggaattgcttcattaacatgccttctgtgttagctgtgtcactctgcatggtggcattatctctaccattcgattggactaactaaattgtaaactgaatcttttggtcatcgtaaagcctgaaatgtagcagaaagtaggcactctcgatctactttgcctgcacagtccacttctctacaatattcttgtactacaagtatttggtatagtgctatacttataacttatctggcatttctggcttattttgcaccgccactgatcgtgctccaaatgcatctgccgggttggcagatgtcccaactcccaaacacactccagcaacttttattttcctctcgagtgcccaaacctttgtgactgccttttcagtgctctgccgcaatctacttttgttgaaatgcactcttcagatataaaaacatgtaaacaatagtctgttggtgctatgtggcataatatatcacgacagatgggagacataccggtaaacaacgatgctttacccaacactcatgagccctaaacagataatgttagaatacagattgactttaaacggcatcatggattcatggctgtctgcgtttgttgtcggagaagcagcagaagaagttcagcgcatgattttgttcgttatgtggcttcaaaattcgaatccatggcctgctcccggactgttggcaatgccaagcccatgggccatggctattgggctaagaagctagcttagaacttttcttttcacttgcttcggtccatcccttgtgaggcaaaaagtaatggcttgtgtagttcaattcctgttggaatcgagagagaaaatttccacattccaaaggaggcttcagttgtgtaattcaacgaagtaggggatgtgctcctgcatattccagttatcctgtatattctgaactccaaatacggggtacttggagttccctccaggccactaataatacttcctccgtttcacaatgtaagactttttaacactacccatatttatatgaatattaatgaatctagacacatatgaatatttagatttattcacatctttattcacatctttatgaatatggataattcttaaaagtcttacattgtaaaacagagggagtacgagggcgaagacgaagctgtacgtgctgctgtttcagtttgtgtgtgcaactatgcatttttttttgtctgacgaaaccaacggcagcaggaggagttcagaactttgatgacctgacctactccctccattctacaataaacctcgtactagaatgttagaatgtgacacacgctaatagagtactctctctatttcacaatataagtcattttagcatttcttacatttatattgactagcaaaagtgcccgtgcgttgcaccgggtgattacggagtgtgtacactgacaaaaagtgttgtttggtttagacaactaatctgctaaaaaaattgtttgtttttggataaactagctgggtggcccacgcaattgcgcggctagcaccgatacagaattatctatttttaatatgattttatttataatttattcaatagatatttcattgtcttaagacattgaaagaccaaatcatatcatcccccatatttctaattttgtaacttttataaaaatcacatcagtgctaccccttacttttttgtcatcctttctttatttgtttgctcgatctaccatggcttatattcattctccttttaaaattggatattttagttttttgagtttattgtcttattgggttttatttttttatttttagaagtcccattaaaagctgccaatatacttctctacggcccatccgctgcttcctctctttattgtcattgggattttaaggggatcctccatagtcgacctgcaggcatgcaatttttactttctagagtcccaccaaaccgtctgtactcctctacggctcgcccgcttattcccactctttattatatttgagattttaaaattgaatgtgattatcattgaggtttgtttttttttacttttttagaaatcccgccaccgtcgtgaccgtgctgcttaacggcatgtccgtcgtcactccttttaattgtcattaggattctatttggggttttgttaatagtttttagatgttccatcagctgtcaccactctactcctttacagcccggttacttcttcgatatttattgtcatttatcattgttgtgttctagatgattttttttgaaatttccatatttttcatcccgatagattttatttataaattatattcctagttgtttttattctattttcagaatttattttattaattatttggaattttaattaatctcgttatgtgttccagatggtgtattctttaaatagtctttattttttattatgaattttagttatttttaaattgcattccaagttgaactcttcttttatttccttatttctaatttcagattttattttatttttttattttaaattttaattaatctcgtattgggttcttatatatggacttgtatgaaatgagggcactatattatttttctgctgctgcagcctaagcgtgctggcctggtatctccaccctatatatgtgcggcaatgtatgttggtttagaatcataactctctatactgtacaattctgcaattgatttttctaaacggacatggactcctagtgcggattgtatgatctataattagattgatatgattatcttttgtacagtaaatctagaccattattcttttagtaatttcaaatttgtattcctactcgaactctcttttttcttttttttctaatttcagcaatttatttatttattattctgaattttaattaatcacgtattgggttcttatatggactcctctttcaatattgcttatttttaattccgaatttcagttatttttcagattgtatttctatttggactctttttttctttttctccgattaatgcgggaatttctagcctccacagtgaacgtggtgccttcttttcgagctgtcttaataatataaaagataatctgctatatatttgcggaatatatatgatgtttagtttggatgatttgtagcatgagagaaaatggatggacgaacaatgcgactgtctttgcctaaaaggcgacggatggaaatttgtatgatgaacggaacggagtgtggacagtaaccaaaaagtatattagataatcaggatttagtttttcatgatatgagcccttcaaaaaaaatatatttttagaaattaaaagttgtaaatcaaaaaagaaaaaaaatgcccattagccctgacttttctggctcaagtgagcgaaccatgagtccatgatggcaaccactc

SEQ ID NO: 57972 - DNA, 1219 bp, Oryza sativa
aaactcacagagccggtgtgaatatcatgtatgtcgttgcatagatcatccaattctattcgtattatacgtcacgattcctatgtcatgtaagcatgatttcaaatcattcttcacacatgctcatacatactactatggataccattataataatccataacaatcagttttacttttgaaaagaacatgccaactgaaaataaaggataatcgacattgctgatttcgtctgtcatcaattcctgcccaacttgagataaagctagacgataaatcgagctcgtgtttgaaggcctcattgtttggcttatgcttattcttataagacaaattttaaattttagaactttattttgaattggaccttttagtttgttatcgaattttattttacaacatttgcttttgagtcactaaaaacatgtatataaaatatttacacataaatattcttttatttggtaataagttattcggataagcacatgaataaacgatacaatgggatgtgtttatttatccacgggcacatatgtacaaattaaattggctctacccattgcaacacaccggcatcttttatagtttatctataaatataagcattaaagaatattaagtgccaccttaatcatatcacgttacaatttcttcttatctttaccccagccaacttcttaccatatccatccctcactgagggacagcaaggtctttttctctccgttctatatctctctaaatattgcatctgtcccaaaataagttcagttatcttccttctacctaccctggtccacaaaatcttcaatacccttgattactcatcaccaacactacttcctctttatcatattataagtcattttactttttctcaagtcaaactttatagagaaatatagtactattttcaacataaaaaaaacatattaccaaaatatatagttagtgttagatttaataaaattaatttgatattttagatgttgctaaacttttttataaacttgatcaaacttaataaattttgactaggaaaaaagtcaaacgatttataatatgaaacggagaaagtagaatataacaacctagaatcggatgttggacagatcctctgtccagatttatattattataatgagtattcgctctatcttaatttgcattctaagatctaaacataaatttattttggggcaaaggtagtaatatt

SEQ ID NO: 57973 - DNA, 1112 bp, Oryza sativa
tttacttgtggggcataataacaattaataagatagtacacaagttattttttaactgtgtcttgaaaaatggcaagcatataaagcacgtttttcaacgccctcaacaggatatgagtgggtgagaatatatagtatgtacagtaaaaaggtactgttaaggacttttgatcaattgaaaaataactcattttcggatagccaacatttgtcacacgatggcattgctcaagtctttaatacatattgatataaactcctgacagatataagacatgcgcatgaaaacaagcaaaatggatggttagataaaagtttcactaaattgttacagttgttgataaatattctttcagtgggtaatatataaattgccggaaacaacataccaaacgaagaagattatatgtccctttggtcttgaaatacataaaattcatacttatcagaatgattgcatactttacttgggtgagtatacagatttggatcaatgttcagtgtgcaaggcatctcagtataagtgtgaagatgatgatggtggaactaaaaaaaatgtaccaagtgaagaagattatatgcccccttggtcttcaaatacagaaaattcacacttatcgaaatgattccatattgtatcgggtgagtatgcatatttggatcaatgtgatggtggaactaatggtacagtgaaagaagaaaaaaatgcctcagaaggtggtgtgatattttcaattgtctctcgtttggaacgtttgtttgcaaacaagaaacatgctcaactaatatgttggcaccacaaagggcgtaaaagggatggaatggaataataagacacccaactgagggatcttaatggagaaagatagataggaagtatataaaacatttgtgtatgacaagaggaatgtccggattgtactcaacacagagagcatgaatccatttggtgacatgagacgtcgccataacgcatagccagatattgttattatctacaacattcctctttgacactgtttgaactgcaaatacatcattaattcatgatgccatttctaatttaagggcctaaataacttgagaacaatattaatgtgtacttcgagcca

SEQ ID NO: 57974 - DNA, 791 bp, Oryza sativa
ttgttgtaagtatttgattaagaaaaaaattaaataacttataatatgaaatataacggagggagtactaggctgtgtttagttcagcgcaaagtttaaattttggttgaaattggagatgatgtgactgaaaagttgtgtgtgtatgacatgtgatgtgatggaaaagaattgaagtttggatctaaacacaactttagttgtaggttgtgattaaacaattattacactgacgtacagttccacgataatttagggcctattcagcaagcgccgcggctgtgcacagtgaatgtggcactgttcatgccggcagtcgcagcctgggcagcccaacaggcccttagttactaaatgaaattgtgtatattttgttgagataataatgagtgctatctgtaaacgaaatggcaaagaaaccggaaactgtacaagcaaaacggagtaactctggtaattcgctaagttacagcaggttattatcaatctcaatcaaatgataccaggtttatgatcacacgcatcagaagggaacaggagaaacgatcgaccgaggagactggagagtcgctgtaccgaaagaaaaagttgagtttgatctccagctctgcacgcgaacgggagagagagagagagagagagagagcagacagctccaaactcagttgacgaaagatctccaccgctgcgacagtggagagaaacagaagccgttccagaaacgccgacgaaaatgctcgggcgccgttcgttcggtcacttgttccgccctctgctcggaacgatcgacc

SEQ ID NO: 57975 - DNA, 1091 bp, Oryza sativa
gacgctataaacgtgtggtgtgttggttgttttttttttcatggctatatcctccaagggttgtagtgctgttctgataatacgaaacgcagtactatgttgtttattaaaaagaagcacatatctgattgtgaatgctcgctcgcacatttgtcatcgacttcggtattgtctgattgtctccgagcgactgggcgagagatgtagcggttggcgcaccaaccattgtccattgaacctgccaaccacgcctcggcgtcttctctcctcttctctcgccccgttaacttcagggagcgctacttgtacacggatgatcgacaagtcggaactactccttcacaagtcagaatttcgtactaccatttggcagcgattcgactactcctagttgcatacttgcaaccgagaggtacagtactcttctagctacagtatagcgagtgctactactccagactgcttctacttctctgtacttgcagggggtgcattgtggccgatacattcgtccaggttcagcgtgttgagcagatacgttcggtttagcattccagctgctagctccaagtcgccaacaccttgtcgtctcatcgtttgtcatctggtcaggtcgtcaagtcctgaactactgctgccgttggttttcgttcagacactgcatagctgcatactggcttgtcccaaaaagaatcaaaccttgtgtgtgacccagagtttgatttttttttatggaggggtacacaactgactatcgaccgagggtgtgtttagttcgtgaaaagaaaatttttaagtgtcacattagacgtttgatcagatatcagaaggggttttcggacacgaatgaaaaaactaatttcataactggcttggaaaccgcgagacgaatttattaagcctaattaatccgtcattagtatatgtgggttaatatagcacttatgactaattatggactaattaggctcaaaaaattcgtctcgcgattttcatacaaactgtgcaattagttttttctttttatctatatttaatactttatacatgtgttcaaagatacgatgtgatatttttgaaaaaaaaatttg

SEQ ID NO: 57976 - DNA, 673 bp, Oryza sativa
acctatcttcgttggcaccctgaaaagagtctatttttaaaataagtttttctaaatatttatttgtaaaatgagtttcagagcaaggacaaaaagtaaaaaacaaaaaaaaaatctagatggactggtccagtgaagaagatggctccccaatccgagctgccatgtgtggatctgcaacgcaaagagtaggctggctgtagctgtaactagctgcacacagcagagtacaggacacatcatattacctctgcaggctggactactgccgctgcacaggctagtatagcggagaggggttacgtctaatcggggtcgctgaaatttgttgtttgtcatgcatactccatggatacacgagtcgcagttgtctactccagccagtgtaccgtgtgtatatggactggagactggaatctggactgcttgtgtgtaccgtgtgtataacggaggatcgatcggtcattgtgtcacggcaaatcctgcttcaccaaagatcttctgctgctgctgcttctctactcacaagatcaatccatatcgtccccgttaaaaaaaacattaaacaagtggtactactagtaaacattagaaagagtgggatcatttggtttggtgtcctagcaaatacctttggtaaattttggcatcaatccaaatatctacaatgtac

SEQ ID NO: 57977 - DNA, 3812 bp, Oryza sativa
cattgttgacctcgttaagatggtctgctgcaagacttccaggaacaagcgccacctccaagtgtgaacacatatccacttgtggcttttatctcatcagcatcagatatccagtttgagtcactatacccttctagtactttggatacccggtatagtgaattccatagctcatagtaccctttagatagcgcattactctttccagagcctgccaatgatcatctcccggatttgagacaaaccggctcagcttgcttacagcaaatgagatgtcaggcctcgttgcgctagccaagtacatcaatgaaccaatgatttgagagtatctcagctgatcccttgctattcttcggtttttccttaatagcacgttgggatcataaggagtaggagctggcttgcagtcactatatccaaagcgactcaaaaccttgtccacatagtgggattgcacaagtgtaatcccaccctcatctcctctttgtagtttgatgttaagaataacatcagcctctcccaaatctttcatttcaaaactcttggacagatagtctttgacctcctcaatcacattacggctggtcccaaagatcagtatgtcatcgacatataagcacaagatcaccccttctcccccaccatagcgatagtatacacatttgtcagcttcgttcacaacaaagcctgcagatgtaagcgtggtgtcaaacttctcatgccattgcttaggtgcttgcttgaggccatacaaggatttcaatagtttacacaccattccctcctgaccttctagtacatacccgtctggttgatccatatagatctcctcctccagctctccgtttaggaaagctgtcttaacgtccatctgatggacgagaagaccatgagaggctgccagagcaagtagtactcgaatcgtggtcaagcgagcaactggtgagtatgtgtcgaagaagtcctcgccttccttttgggtataacccttggccacaagccttgccttgtacttttcgattgtaccatcaggcctaagctttttcttgaaaacccatttgcatcctacgggcttgcacccatatggacgctcaacgacttcccaagtaccattagacataatcgagtccatttcactgcgtactgcttccttccagtagtcagcgtcaggagatgaatatgcctcttctatggttcttggggtgtcatccacgaggtatacaatgtagtcatctccaaaggattttgcaaccctttgtctcttactcttgcgagtatctacaatgttgtcctcctcaggattttcctcaggcgtttgatcattgtgttctatcggtgcaaagtgctcatggggcatgacagtttctttactagaagtgctaggtgtatatttcataggaaattcattctcaaagaatgtagcatctctggactcaagaattgtaccaacatgcatgtcgggtactccagagtttactattaagaatctataacccacactgtggatagcataaccaagaaacacacaatcaacagtttttggtccaagtttccgctttttggctataggtacatttaccttggccaaacagccccatgttcgtaggtatgagagatttaatttcttcctttcccattcctcgaatggtgttacttccttatgctttattggaattttattcaggacatgacacgcagtcaaaactgcctcaccccaccattccttggaaagccccgcagtgtctaacatggcattcaccatctcagttagagtacggttctttcttttggccaccctatttgattggggtgaatagggaggcgtcatctcatgaataattccaaactcttcgcaaaaggatgtaaactcattggaaaaatactccccacctctatcagacttcaaccgtttgattttcctttcaagttggttttctacctcagctttatagattttaaagaaatgcaatgcctcatcctttgttttcaatagatacacatagcaaaatctagtgcaatcatctatcagtgtcatgaaatatttctttccccctttagtcaacacgccgttcatttcgcacaaatcggaatgaacaagttctagaggtgccaaatttctcgcctcagatgccttgtgaggcttgcgaggttgtttcgattgaacacaagtatggcacttggaaccttttaccaaagtgaattttggaattaaactcatgttagctaagcgcgtcatacaaccgaaattcacatgacagagtcgcgaatgccacacattagactcatcattctcgctaatatggttcacagcattatgattattacacatgtcattcaaagaaaagcggaacaagcctccgctgtcataaccttttccaacaaaagtcccatatttagatacgacacatttattggactcaaacacaagtctaaaaccttctctacacaatagagagccgctaactagattcttctttattgaagggacatgctgcacgttcttcagctgcacggtctttcccgaagtaaacttcagatcgaccgtaccaacaccatgaacagccgcaagcgacccgtttcccatcaacaaggaggaacctctcccgacctgataagaagaaaatagagaaatgtcagcacatacatgaatattagcaccagtgtccacccaccaatcaggtgaatgaaaaacagagagaactgtaggtaatattttaccgtaccccgatgttcccccgccctcgctaatgatcatgttggcagacttcctgtctttgcgctcaggacagtccttggtccaatgcccagacttgccacacacaaagcagtctccctttgcctttcccttgcttttcttcttaaaattggttgcagccttgagtttgacatcaggcttgactttcttgttgttgtgggatgcatgagggttcttcttctgtaccatattggcactagaacctccctcaacctttttgccccggacgtcctttgccctcgccttctcctcaacacccaaagagccaatgagatcaggaacactgaactcttgtctcttgtgctttagagaagtggcaaagtccgaccaagaaggtggtagtttggcaataatgccacctgccacaaacttgtccggcaactcacagttgttgttctcaagttccttagccagcatctgaatctcatgagcttgttcaactacagaacggtcatcgaccatcttgtagtcatagaactgctccataacatacagctcactgccggcgtcagaaactccgaacttggcctcaagtgcattccacatgtcttcccagaaggcatgtgcatgtacacgtccactatgttgtcagcgagtacactgatcaatgctccacggaacaggcaatccgaagcctcgaacttagcctcttcctcaggagaaagaggtggttcacttcgtttgccccgtgaaacatagaagcactgcatcgctgtcaaccacaatagtgcacgtgctttccatctcttatagtttgaaccatcaaaggcatgtggtttcagtgcagcagcaaagccaactaccgagaatgacctatcaggtttttggattggtggaaatttggtcataattcggcatattttaatcccaaataacaagataataaacatgatatttacaataggatttgatccagtgatagtggtgaatgtaatcaacatgagcatgcttaacgttgaataagcatcaacaatcacataatgacacaatgttgacattgcgatgaacattaacagtaaaacttcttatttgaaataatgtaataagggtatacccc

SEQ ID NO: 57978 - DNA, 4459 bp, Oryza sativa
tattacaaaagtaacatccaaacaccgagtgtagtttaaatgaattaaacacacccaataaaataaaagatcaactaagataaggagagcatatttattcaagtttatttggaatctctatccatagtttgcaaggaattgcatgaccgttgtctcaagcctacaacatgcaaccttcaataagctcgcgatcatcttcacacatttgcaactgtgcctaaaatcggagccaatatgttgccctggaaattacctgcatatatgagatagatgttgatttgtcaaaaaccatatcattcctagtcaaccacagagcccaatatatggcagaagctcctacaagtatgagtttgctcttcttcttgtctacccccaagagccaaccatcaaatatattagatatggtagtatgaagttataaaccaagagagaactgtactgctctccaaacaaattttgcataatgacactctataaaaagatgttgaatagtctcatttttcattaaaaaacatcatcttaaactgccattccaatttcgtcttgccaaattatccttggttagcacaacccctttaagcaagtaccacataaaaatcttaatcttaagtggcatcttaagcttccaaataatcttgtttctctcaatataaccattattaattaaagttagatacatcgacctaacagaaaatattccattctgatgataattccatctaaagctatcagaggattgattcaattgaatatgtacaatagaagcacacaattcatgccaatttgcaagattctgaccaactaatgatctcctaaagaaaacattgagtggaacagatctcataacattagcaatagtagaacttttccttcggacaatagagtataaagatggatatttgtctttaaaagccaggtttcctagccatttatcttcccagaaccttatttgtttcccattatttacaatccaagaatccatatctaagaaaatatctttgaccttcatgagacctgaccaaaaatgagaatcaccctgtttcttattaacttgggttataaactgattgtagagatactctcttcaatagattttaccatacaccttcctcgttaatcaacttaaacaaccacttactcaagagacacttgttttgtatttccaagttatgaacccctaaacctccctgatccttaggttgacaaatgatatcccatctagtaagtctatacttttttttatggttatccccttgccaaaagaatagtgatctataataatcaattttttgaagaacccctttcagtatctaaaaaaagatatcataaacatagttaaacttgaaagtacagagttaatcaaaaccagtctacccccaacagataaatgttttcctttccaactaagttttttctcaattcttttctcaatcattttccaatctctattattcagttttctaacatgcattggtataccaagatatttaacagggagagagccaaacttacaaccaaagatgttagaatactcatcataatattcctttgcctgaccaaaacaaaataattcactcttatgaaaatttgttttcaagccagacaactcttcaaacacagataaaatcaatttaagattcttcgcttgttgtaagtcatgttccaaaaaaatgatggtatcatctgcatactgtaaaatagataaaccatcatccactaggtgagggactaccccattcaatgaaccaacatctttatccctcttaattaataaggtaagcatatctgttactatattaaaaagaattggagataaaggatctccttgccttagacctttgtaagtttgaaaattattaccggtctgatcatttactctaataccaacatgtcccccttgaataaaagaagttatccactcacaccatttaggagagaaacctttcattctgagcatctgttgtacaaaagaccatttaaccttgtcataggctttttcaaaatcgatcttaaaaatcacagcacttttatttttgcgatgtaattcatgcatagtttcatgcaaaataacaacacattccataatatttctcccaggtataaaagcagtttgagtagggctaatcaccttttgagcaacactcattattctattcgtagcaactttggtaaagatcttaaaactaacattaagtaagcagataggcctatattgttgaattctcatggcctcagcacacttaggcaaaagaataatagtaccaaagttaagggagaataaaggcaaaagtaccattatgaaaatctctgaaaagatccaacatatcatccttaatgacatcccaaaagacctgataaaactcagcaggaaatccatcaggacccggagctttattatgttctatttggaaaatagcctctttaatttccttttcagtgaattattgtattaaagcttcattctctaattgagatacttgtgggatgtccacaaaattattttcatcaaactggagatcagaatcatcaggaggaccaaagaggcctttataataagtagtaatatgcgattttagatttgcatcaccatttatcaattgatccccatcttgaagttgaaaaattctggtttttctatgtttgccgttagcaaccaaatgaaaatactttgtatttgaatcaccctccaaaatatccttagttttagccctttgataccacttaatttcttcttctctcataagagtagataatctattcctacaaaaccatctaaaatcaatttcctcctgagttagaagaacagattcagcttttttatccaacaaatccaacctatccaaaatttccttttttttcttttttatacataccacttgtatgtttagcccatcctctcaaatgctgtcttaatcggggaatcttcgcctgccatcgctccataggagtattaccctcatgtacactagaccagacctccttttccatatctacaaagccatcatgtaataaccaaccaagttcaaatttaaaactatgttgtgcattacctgaagaggtggagtttgtatttaaaagaagtggagtatgatccaaaatatctctattaagagcaacccccgaggataaaggaaatttatgttcccactaaatggacatcaaaatcctatcaagtttctcataagttggatttgctaagttatttgcccaagtataaatcctacctaacatttgcaactccctaagacacagtctatcaataatagcattaaaaaaaagggccatctatcatcgtaactgccattatttttttcatcagggctacgtaaaatattaaaatcaccaccaatgagaattggtagggattcatgactgcacaaattaactaattcagcaagaaactgatccttaagttcattttgtgccggtctataaactaaaactaaagcccacttgaacttatcaactttgttacataaatggaacttaatataaaaatcaccttcatcaattaaaccaatatcaacgtttagtaaattgatgcctaacagaagacccccagacctacctctgggaggtttacaatgccacaaaaactccttaccagcacaaagatttttaagtgcagctagagtaaattctttcttaaccgtctcagacaatgctataaagtcaagctgatgttccttgggcaagtcagaaataaacttatgtttttttggtccttaaacccatcacaattccaaaagattcccttcatttgaaactatttttattatttttcttatttttcccccttttactctttttcttagagttaggagaaaatgccataggatttaaagtgtttttaagactattctcacagtcctcactaaaatccatgacctcttccataatttcactacataaatgttgtagtaaaaattatcctccaactggtcatctaatgactcagtatcaacattaggggtacaaacttgattaatagaagaacaagcatattcgcttatcctattattttctacacatttcaaatcattaattacatcatctaaaacaacatttttactagaaggtataacaccaagattatgatgatgtgcagatatttgatcatttgaaaaatgtgtaaaagaaacattattaactgaattacctctagcctgcaggttctccaagttcttaccagccttcaacttttcggccctttcaagaacaagctgatcgctatcacttgcccttcttttactcttccttgatggaaagattactgcctcagggatagcagagagctttgccacaagactttcctgaatctgggccttgtcacccattatagtctcttcatttaaaccatcaaatttttcatcagaaacagtcaagccatcagattcaggtattagatttagctgagaagagggagcagaaggaccacccctctcactaaattgaccac

SEQ ID NO: 57979 - DNA, 10175 bp, Oryza sativa
accctcaaccaacaatcaattaagagtaattgatgtaagttaccaattccttaatcaaatggattaattctcaaaactcttcatcccattgatatcccatagaagaatgaattcacatgaattcctagcataaggagccttggaatttatttgatttaattgatttaaatggattaattacccaattaaatctaacatacattacatagttatataatctgaatttacttgtgcgttaaaattatgtgaagattcccctttttataataggttttatcgttttatgttatgcataacttaatcgatgatacactttttgttattaagcttcatcaacttataagttataacaaaaaatttaatttttgagttagtttttacgttttatttatcatagtttattatacaatattaaattttaagtcatcaattagtgctacggcttataatgacccgttaacaaaacaatgagatactctgtatacactcaacttaatctatttgaagcggtgtatatttcacattacaaaacacaatttattccaaaaacgtttatattcagattatacggtaatcatgaatgctaaaaaaacaaacgtcacgttaggaagtttgtatcataacgactagattaagctgtgaccatgaccgtgaggatggaaaacacggaagtgctactgctttctctgtgaaactacaaacacgatccattctgttgttggcccatttcgcttattactctactcatcgtggtcgtgggggtaaaatatataggaaatgggcggtgaaaaaacgtcaccatttgcgtgaaaattgcaatgtaccggtgtggaaagcttactatacaaggttacggcggaggaaggtgtctatgtatcgtaaatatataatctaaattacttgcacattaaaatttgtataacttcatcgatccacgacacaacttcaccgtttgttcttcggctctaaaattttaactttaaaacataattttaagagttgactttcatgttttttatcatagtttattttacaaaattaaatttttagtcgtcaatcattgctacagtttataatcaaccattgacagaacaatgatatactcaacttaatacatttaaagctgtgtacatttgacattacaaaacacaatttactcagacaacatttagattcaaactatacgaacagtgaccatgaagactcctgaaaacaaacgccatgttacgaactttgtatcacgacgactcggttaagctctaaccgcgacggtgactatgaagactcctgaaaacaaacgcgatgttacgaacttcatatcacgatgactcgattaagctctaactgcgaccctgaggatggaaaacatggaagtgttgttgttttctctataaaactacaaacacaatccattctgtggttgtcccatttcgcttaattactctgctcatcttggtcatggggggtaaaacaagaaatgggcggtgaaaaaacattgccgattgcgtgaaaattgcagtgtgccaacatggaaaccatgcttactatacacggttacggcggagaaaggtgtgtatgtattatacatactagcggatatcgcacgcactgcagcgggaaatttagaaatacttcaaagaaaaattaaaggaaacaatatgtaaatcgtgtattcgtaatatctaaatggacaatatttgttctatagtagttaatgtgaaattacaattctatatgacgcttggatgcttatgtatcaaatataagagggatccaatggctattagttttctaggtgtcatggttcaatgcgcatggaacttttattggctatgctcatatttaaattcagaagttgattttctagaatagagtaggtaatctaatagaaagacaactatttatgactccaatatatactccatttgttttccagcactcgtcaattcacgctatccatgtttaaattttaaccgtttgtctttataaaagaaattataaatacaaaaaataccatacatcaaagtatgttacatccttttgttcgttgtagtctagccatcttaaaaacttggatacctgcgccttgcaacaagaaatttagaaatactcaaaggaaacttgaaggaaacaatatataaatcgtgtactcgaaatatctaaatgaacaatatttattctacagcagttgatgtgaaattgcaattctatatgacgcttggatgcttatgtatcaaatatgagaggggtctaatggttattagttttctaggtgtcatggttcaatgctggtacgacccaagtaggggtgttgttccgatcttcacaacgtaggatcaagaactcaagataactagctacaagaagccaagataacagtgcaacctaacaatcatacttgaagccaaccaccgtctctattacgacaacctgaattgagggttcgtctaaccacactctaagttaccaaccaacacaacctggaattaatcaaggaaaaatcctcaaagggaccaggagcaccaattggagggcgtcgaatgccgcttctgtaatcccacaaggaaatcacaagagcaaaggggtagagatctctctccgaatttgtgagcacgcagctaaacaaagggggttcatattctcattgttaaaagtcttccaaatgataaagcataggagatatttatactaggaacaaccctcatagatgagaatgaaaggtcttgggagtttactggacataggttagctcaaaggtcacaataagtgaattcccaagaagactctcgcgtttgtttggcttcttagcagtcctcaatgatttgtccattactccttattgggaagttgaaatgacgaaccgtttattggaggtgaaactataattgattatatttccaaccatatatattaagcatggagaaagttgactggatgggtcacacatcccttggaagttggagcaaatgtttggagacagtgtgctccaaaatcagcatgacgtaaatggtcgtcgtctttacgtaacccatcatcattttgatattctagctcgtcgtcaatgcccagcgagtcttttgcatgtgtaaacctaagtaatagcaaagtacttgatttaggtagtatataattctcgtcaatattgaaatatgtttcagctaggagcgagttcacttcttgttgtagtttctttgcgcggctacatgttatcagtccttgaaatggtgtaacggattggctctcattagcaacttagtcacatgattgtcttgtgtgttcatgtgacgggggctagggcatatcaaatgcacatggagctttatagctataactacacttagtgtgttgtaaatgcatatgacaaatggatggtcaagatcaaagcatgaaagggatccaaatgctactattttctagttctagatgatgttgctcaatacatatcaagcttttggttccaactatataggtatatagatataatccaaatttagttgcatgttacaattacgtagagaaatcccattttataatagatattatcatttcatcttatcttatgtataactttatcgtttgactatacaacttcactatttattcttcagcttataagtcataactaaaattttaattttaaaacttaattttgagagttgattttaaatttttatcatagtttattttacaatattaaattttaagtcgtcaatcagtgctacgacttgtaggaatcaactgttgacagaacgatgagatactcaacttaatgtatttgaagtggtgtacatttgacattacaaaacacatttacttggacaaattttagattcaaactatacggtgaccatgaaaactcctgaaaacaagcgttgcaaagttcgtatcacgacaactcgctaaaacacggaagtgccgctgctttctctgcgaaactacaaacacgacccattctgtggctagcccattttgcttaattactctgctcatcaaggtctggaggtaaaacaagaaatggacggtgaaaaaatgttgccggttacgtgaaaattgtatagtgtgccagtgtggaaaccgtgcttactatacatggttacgacggaggaaggtgtgtacttaatccgtcccaaaatgttgctacttaggatgggaatggatgtagtattataaatagggactatataggtatcatttgacaagaaaatcccccgtagacatcttgtatattttagaccatccgattgtttaaagattcatgaaggataatcaaaccctaaaaccccttccatcttcctccccccgacaccccctcttgcaacctccactcaacagtgcccgatctgcaccgcctccgccactgccgccccagcacgccacttggctcaccagctagtcagaaggggtcaacggcactagtgaggcctcctagtagtactattgttttatcttattatataattgtatggatcaattatacagctctatcattcacttcttagcttatgagtttcaggcaaaattttaattatagaacttaattttagagtttcttttgatgctttgttttgtcgtagtttatttttcagcattagatctaagtcactaaaaatacatatataaaaattactcataaattaggttttgattgttaacaagtgttaaagcttataattagttctggacgaaacaatgagataaatatatatactcatttttatttttatttttatttttgcgattcaaaattacgtacatttgatattaaacaaactcaatttacttggacaacttaagttttagattcagacgataaggcaaccatgaagacttatgaaatcaaacgttacgatgtttgtatcacgatggctcggtcaagctctgaccgcgaggatggaaaacacggaggaggagctgctgctgctttctctatgaaacacgacccgttctgtggttggctcatttcgcttaattaattgccgttctgagagttgcagcgtttttcttgtgctacaacttttgatatatattatataatagtagctgagcaatctgcatgcttcggcaaaccaacctactgcagccagtttacatgaaattcacgtgcaaatagcatgaaggatgctggaaagttcatgcatacgcaaaatttttcaccttgcgaggcagaaaaaaaaactaattacacagattgcatgtaaaattgcgagacgaaacttttaaggctaattgctccatgatcgacaatgtgatgctacagtaaacatttgctaatgatatattaattaggtttaataaattcatctcatagtttacaagcgaaatttgtaatttattttgttattagtctatgtttaatatttcaaatgggtatccgtatatccgatgtgacacaccaaaacttttcacctatggataaacacagcctacataccaagggttcagagacattctggtaatcacgaattctgttctgcaagtgtgtaacgttgcagctgcaatccaattcaattccggttcacatatgttgtacttatccaacctattgtttcgttcattcatatacctatccgaaccgcttattaacaaataaaagattatttatgaataaaacttttatatacatatatttttagcaacttcaaagaaaatcctataaaataaactacgataaaaaaaaagaaaagatcaaaattcagtagaaaatttaaatttaacttataagtataagcgtaagcgaaaaaattagtcgacgaatcattaatcacatcaggggcacgaagagatatcagttgatgcatcaaatcaacccgccccttgccatggtccatgcaagatcagataataaatatacaaatggcagaaacaaaatccttctgaggaagtcgagttcttgaactctaccgtcctggataactagccgtccagatttacaaacgagctcacacagatgcaactaagatttcaacacactgtgcagcttgcaatgtacatggttgttactgagggggtgtttggatccctgccacacattgcctcgccaaacatgcggctgccacgacagtttgactgatgtttggttaatacgtgagttgtggcagccacactttttgctagttcatttgcatgcttatttccgccacagctgtggcgattatttctctcgccacaatctctggcgacgccacaacttgatggctggtttgggctgtgaaccaaaaatcaacacgacgggagaaaatgctgcagctacatgagccatcttatattacacctttgctttgctgagtgggcgtcgagtagcagaaattacaacagattggcagcagcactctcattttctcctgctggttaccgaacctcctgacgccttcaaccgggcatgccgcccctcaagccttgcttgaagcagttttgccttcagggtgttctccttcatgcctactagaagccctgttgagcattcacctatgtcatggcccaatgatgcggacggataatcaagctgtcgcgatggactgtgtggattgcataaatcccccgaagtagttccatcacaaaatagactagctcgcgagtaatgatcaagggattcctgccccagacagtcggcatgagcccccaggttgttcttcgatgttgtgccattgtgatatccttgagaaatatgggggcaagggatctcattctgctcgtctgctggaacagttctagcgctggcctgtgagtcgatttcttgagttctagtggcatgccatggtctgctgctactggaccttgctttgttacactgtgaataaatttgcacgtcagacatatgtgaactctcaccaactacactatgcgagtattctgttcttctcttaggtgcatccatgttgcctgtgtagcttctgcgaggccctgtatggtcatgcatctgaatgctacttccatgcatgttgagctcaaagcaatgcaaatcactagcaacagaatcatcatcatcatcttcagctagctggggagcactagtggctccattaaaatggacagactcaagagattgccgacgtaaccgagcatttggcctactatcatgcatgtagttgtcattattcttaaagctaaccgatcttttggcaagaagaaaagcctcgatttcacttcttagcctctctgtaattgttgatttcttcagtgagtcttccttgacatcagtattttgcatttgcattctctcatcaagccatgcttctgatacatgaagcactgatttatcaaactggtattcgtaatttacatgcctttgtttcaatgccctgacttcctcttcatagtctcggattcccattgcgaattggtcacaaaggtcctctaacaggttctttgttttcttctctttctcaaggtccttaactgccttgacaaatgctgattttatctcagataactccttgccaaacttcctgtggaggtcttcagaatgtctcctaaggcgtctctcatcctccagttcatcttgcagggaatgaatgtctgctgcaatcttctctttgtctttatttttccggacaagtttgtcctcagagagttgcctcaccagtgaagcaacatcatggcgatatcctcttctctcacacttaagttcttgaatgtgttcctgtgcatgctgtaattccaattttagtccattaatcgctgacatatcagctgtatgttgttcttccaggctccagattcgatttagaaccttcaagagttctgttgatgtcttaaggttataatcagcccccctgaatctacccttgatatccaaagagcgagctggactgatcgcttgatttatactggaatcctgtaaaatacaagaaaaaagaaacattcttttgagaatgtgcttgttgtgctggttgttacatctgggaaacatatttagttgcatcaagaaatatagagaagtttcaagttatctacaatagacagcaggcaaaatactatgggactgacttcattgttctttctttttcctagcaaataaattcatacttctgtttatctaaataaagaatgagcagacaaaacgatgcacaaatgtattatttaattactatcaatcattcatgattatttttagtcgagaagcattagctagactgctaggctactcaatgacttgtcttgataaagcatactgttacactcccaaaacttctccatcagacacaaacatgtgtaatgaaaaacgcaacagaatcacaagatagaaaatcttacccctactaacacacattaccatatagtaccataagattttgttatatgcccacaaaccaaaatattaaagcagccaagaggatcacagcagataagaatatggatcacagcagataagaatatatacaaacataccccaactgagcttctgtaacttccaggagaaaaaggttgtgctgtacaattccttgcttgatttaacttctgatgattcgttgatgaatctgcaatatgcctaccaaagccacctgaattctgaggttgaatgtaacgaaaaaatatttagcatagaacaaatacaaaataaaataatcgtgttactatatatggtgcaataattatattcagcaatcaagactatgggaaatggtaaaacaccttttgtgcatttgctagataaatctcttcaaagtttaaatatgtctgatatattgttaacagctgtatgcttgaatattacatctcaacaccacatatgaggtcaaaagttaatatacagaacatgtgtgcaaacattgtagaaaggagaacatgcacacagacagagctaacatcatgtaaaggcagcttaacgtaaatgatgcctaatgtggattacacgagttgtaaatagctcacattccatgacatgccaaacacactccctaggaacattccgcaaactgaagaactagcatgttggtcagttagtacattgcaaagcaaaaggattcaccttttttccaattccaaggaacaaagtgtaaaaccctgatgtattcttcaaagcacaaaagatgagtactgagacaacattacaagtcagaagattggttgcaaagttagcagttcgaaaccttcaagaaaggttgtgtttacttttaataaaaacttgtaaccccgtccaatcaataagcaacaatttttactcaactctcaagcactgacagtgcaaattgtactgatagaataacagatagaacagatccatagttcatactagccagcaagcaaatgctggattgagagttgagaacagtagcggcattaataaaatcaatttagtgaagacgaccaagctctactatcaaaaaaaaatgcccactactaatggaagaaacagtcgaaacaaacaaaaagcagaacatcacaccaggaaacaggcaaaaacatggaaagacagtaaatcgagcgctgcaaatgtcttggttttgggctacatttcatcagtgctagtgcatccatttgctatgtttaagtaaataaatcatctactactagcagtaatcagtctccttcctcttgttgctgcgggccaacgaattacaattcagttgatgttacttttgccacatgaggaggaggttttgggctagttcgaaggaagacacctattaattaacccctcacctgatgcagctcgccgccggcggaggcgagcggcctcccgctcctgcgcctccgcgacccgccgccgcgcccctcccgcatgacgtcgtggatctcccacaggctggctcccagctgccgcgccgaggcggaagccgacgcggagctccgcctggcgggcgccaccgccgggtgcaccggagccagttcccccgccgccacctccacctcctccccctccagcttccacgacggcgacggcgtgcagggcccagcccgcctcctcgcggccctcccgagccgcacccgcagcggcacctcctcctccccgcggcagtcaccctcaccccgacgagcagctaccgccgcggcggcggaggtggaggcaccctcctgccccgcgaccttgccaagaaccgggcccgctgctcctgctcctgctcccgacgctgctgatgatgatggctgggcagcagcgggttgttccatggctatggcggcacgctgcgcgaggggggggcgctaggggcgcgtgagacaggggaatcccatgg

SEQ ID NO: 57980 - DNA, 48566 bp, Oryza sativa
ttgggaatggtgggggagctagggcctagggggggtttgaggtgaggtggagaaaaaggggggagggaaaggtgtctgcggcgtgggcagcagggtgtactgtaccccttttgtttcgttttgtttcccggtttgttgagtttggaactttttttggattggggaagaaagccatgccatatgtctctcttcccatccaaactcgtttccaaatcttatttgccgtgattttagcgtacagccgtttcatcgacgagctagtgtaaagcattcaagtttcgtcatttcaacgaattgaacaacccactagtagtattacatctgtcccaaaaaattttcgtttttcacacatcccacacgtcccaataaaaaaaacactcataccttatcgaatcacaatataattatttctcactttatctttgtccaacacaatttcttctactttcacaaactctaatgcaatgattactttaaaaataaacttattctagaacaaatatattgcagacaatatttattaaacgcctataaagtcaccgtgaataactttttactcccaaattcatattcaactatatgagtataaaagttttactctgatgacggagataaatatcatatgaccattttttaacctagatatttttaaagacttcactacatatttaaaatgttaggctgtgttcgggaggtgatgttgagaactcatctcctgtgcaagtaaaatggagcaatgcattttcttatgattaattaagtacttattattttttaaaaaatagattaatatgatttttctaaagcaactaacatatagaaacttttttaaaaaaacacaccatttagcagtttgaaaagcgtgttcacagaaaacaaaagaggtgagttgcgaaagttggggaaagaactcagtcttagtggtggtggtatccaatatgccgcaccacccctaccactaatatttaggcaaaattggttatatagtatcaaaagttcacatttttttgttttatagcaccgaaagataccggttcactttaatattacccaaaattcaccacattcccatttttaacacttccgttaattctcgatcttttccgtacaccttgatcgctatttacccagccacgcacataatatgacgtttctacccctcattatcatgcatcctacttgtacttgtgaggggtagaaacatcatatagtgtacgtggctgggtcaatagcgattaaggcggacgaaaaataaccgagaattgacggaagtgttaaaaatgggaacaaggtgaactttgggtgctattaaagtgttaaaataggaacggggtgaatgttgaattctcttatatgatcaatttgggaatgagggagtattgttctagcataaattttggcctcggccctctttacaactagaggatgccccgcgcattgctgcgggacttggttaacatcaatttgttagattggaggtacaatctcaagaagaaacggaagaaacaaatagctttcttggagaaattcttttcaacagccctatccaaaatttgtaaataatttaggtagcacatgtcaactaaagaggcgttcagccataaagctcttttatacagattgacgggctgaatacatatagatgtgtgtggagatggaccaatgtgttcatgtgggccgcatttggcatgaggaggcaaagagactcactgtggagatgcatgggccaatgtgttcatgtgggttgcatttggcactgaggaggcgaagagactcacctagtgactgatgggttaggctctatgctgtatttcatccaacgtctgagaagcgatctaatgcattcatccaatggttcacaatttgatgatgacgtggaagcatgaggtttgagtttttggccttaactttatggaaagaagggatttcggaaaggggcacggaattttcccgaccaaccctgaataagggatacgacaccagatggaaacgcgcatgtaatcatttggatgaaacaaatcatgaactttttttaatgatcaacaagatgattcattgaatagagtagaaaaaaaattacaaagctaatgccttgaaatgcaatagccaggaaagaaaaaaattttccacacaccgacaacatctacatatagccaaacacaaacagaaggctagtaccggactagtaccggaccagccatcgttaaacatgaccgatcaccgctagatcatcaaggaagctatagccgagaccgttcaaagccaagccttatcagttgagcaccgggcgtaactctagccacgtcttttggattgagggagagagggcaagggagaaatcaagaattctttttttttatttacggggagagaaatcaagaattaaatagcatgccaccagagaaggcatgtaattaatcgtttgtacgtgcgtattcacgatactatcaccctctgggcagtgtgaccctcgacaaagcgatcctcgcaatcaaaaacggatcgtgcaatgccagtgcctgcgcaaagactttggccccgttcttttctacgacaagaattgaatgaagattaaaattttcgtggcacgtttttcaaactactaaatgttgcgtttcgtgcgaaaactttatatgaaagttactctaaaatatcatattaatctactttttaagtttgtaataattaaaactcaattaatcatacgttaataccacatcgttttgagtaaaaaaacttaatcttcattttcaagaaaaaagaacaccacctttgtcgtgcattaccgatgcatatgagacatttaactccatgccacttttaagatgtggtaattaattatttaccacccgctgtctattacacgtgggcctctttacaatgcgtgagcggtacacggcaacgacaattgtattgtatctccatccaacggctataatctatccgtggaccgcgcgtggccacgtatgccgtaacggcacggtagcaggagtaggagcatccaacggctactttcagtcccagctacagcctaccgtgtacagtaaaagcacgctgagttctgcatggaaaggttccacctttcggaacgacgaagaatttttttatgggaattaaaaataattaataaaaatcatgtaaaatgcctgcatttcaaaggaatatgtagaaatggttaaggggccataattaggacatgcaagtcattttccattgtcatatctggtgtctaggtccctatggcacacgaagaaattgtttagaagagtttccagtagctgcaggctacaacttctcttacaattatccagtttttcttttaagctaagaagataggccatgcatatgcctgagcaccttgtttaatattgctttaattttcattattaatgttcatgttacgatggtattcttgaaatattctgacttcatttgaaacatgttttggttttggatattggttataattttcttctaattacccttgtgttaacaaccaaatttagtaattcaagtatcggaggtgaaggtaaaaccgaagcggaatccaagaaggagatcgttccgaaaacagagcaagaatcggctaaagtccgaatcggccgcgatcaggattggcagagtgcgagtcggacaaggttagccgattccgacaatatgacttgttacacgacatcgggttaagttaaagtgcttcatatggattgccatgcatggattgagtcctgaaaaggcaattgtatctattaattaggatattttatgtaatttccttaaagataagtttggacaaaagtctgccgcaaagacttatggtatcttagagtttgttagagataagagtcgtgtccaacatggacatattttgtaatctcgagtataaatagaccccgagccccatgtaatcaatctaacacacgttcaatacaatctcggcgcatcgccaccctttactttcgttttgtttcaacgagttcttgctttcgagttgagctgcatcggtttcgatcttcaactagaggtaaaacttgttatggcggcttgcgttctcgggattagtgcttccatctttatgatactctaatattgtttatgtaattcgtcaagttatcatatattttatataatctccggcaatattgttatttaaccctcagtcggctaacatctattgtgggaaggcagccgattaggttaaataccaacattgacttagattatataggatatccaccactctatgaaacatccaactgcttgattgtctagatattgttcttcttttcatacttaatgttgcatcagttaagtttgatctattaagtcgtgcttagaatctcaatctctagcctgcttttggttgctgattaaggtagtgtcggggtttcagccgatcatacctgatttagctttatatcttacatgcttaattgatatgctagatctgccctttatgttaagatcttactacaacaaagtatattaggcttctgtttgatatattttacttgctttaatatcttaatatagagtggtatcggagtattaaccgatacatgctagatctatctgatcggctatgctataaatatttataatcttcttgttaatatatatttcgatctaagtgatttatactgtctcggcatggcgaccgatctatcccaatcacttgatttaagtatatatcgataaaagtattatataccattgatatctacagccgatcgaatagatttagtttgatcgattcatatatgacatcggctcaaagataaatgatacgtcattggcagctagctgatcggctatcgtttatggatttaactgctatttttctgtctttatttcttgttgattgcaggattaaatcgactagtacgctcacgaacctaaaagcaagattttttggacctgcactgaagttaagcagatcttccaggcctcatgtttttcgcatcaacaccttgtaacatataaattctatcctaaaattacttgaaatcatacaaccttaaatttatgataatggagttgattcatatatacttgtactatgtgtgattcttttttggaatataagtttccaaactgttagtaacatttttttcttatatgctatagatgacttaatgaattttatgatatatcaatgaaagatattttccattaaaatgtagctaatagactacttcatctaataaagataaacttatattacttatactccctccgtcacataaattcgaggagtcaaattttatcccaaaacaatagggggatttatatgtaaccatgacaaaatcatttttataaatactaccacgataatgtccaaagtactatattattatttatattttcaaaaatatctatagtttaatgtctggtttaatacatattgttcaaaatgacatgagatacgaatgcattttttttcaaacttattcacaataactaattcatgttagtatacttatagcccatgtcagtgtggcatatgacaatacctctatcaattatgcctaacatgttagaattttccaactataagaaaacatatcatgagtagtttattacgcatgttacttgattgttcgtttgttgttaaaactattcagcaaaggaaaaaaacatacaattatatatttgtcatgcatatttcatgtttcaattgtacggagtacttttttctttcatgaccaacagttatatatttgtcatgtataacgaatagtacatgagaaagatattacttttttttaataatagatctaatctaatggtctaaaatattggtaatttaagtgaaaatcgacggtaagattagatattactccctccgtcccaatatattgcaacctaggatgagattagacccatcctagaactatgaaacagtttcatagtgggacggagggagtaccatatagtggcctatgagcggttgtagagtgtcacatgtcaatttaagagcgtctataataagcttaatggatttttagtatataataaatagattttaagaaattgaaattgcagaatcctaaaaataaagaaggtgattttcctaacttttcgatattctcgtcagctgaattcttaccggctgcatttagaatctgaagcaaacctgatgagagactgtaattccaccaactaatattcagtcaaagtcaaaaagtgccttgtgagatgcagtacgacttcatttaacttaattaatcctagattgcactttaagcctcctagctatagtagctgcacatggcaccgtggatcatcacttattactacaagggtttcttttgtgggaataagagcaagtttaatagtatagctaaatattagctccgaattatcaatagctaatctaatagccattcatataatagcccatttatataatagttatctataaaaatatactataccgttaatacccggacctacctctcatccacacacgacgtgttgaagtccgtgttgcagctggctataaatatgtagcctgctttcttttctcttcccttttcttctcgatatgtggttatagctggcttatagcctgctattgtacttgctctaagcgaaaacaaggtagaggtagttgagatcaccttctaggaggtcatgaactaagtaaggataagtgttatggtagatgtgactaccacctctaaatttatctatatcattcactattaaattaagaggcaattcatacaatatgttacatatagtacacaaacaccaatatctctaatactctcacaccagtcttgaattttgtgtggaggttgcctcttgatttagagcaagtttaatactacagctcgctactagctccaaatcatttataccaatgtaatagccaattcatacaatagttgtttactacgctattaatacttggtcccacctgtcatacacacattacgtcttggagtccgtgctgcagctggctacagatctgtagcccgcttctcttctctctcttcctttatctctttaaaatatgtttatagctggcttatagcctactattgtacttgctcttaggggtggctcatcatctctctcctcacttctctcctccatctcatcactcaatccaatgtggtacttttaggggcaaaatatgtagcattataggccctgtttggatccaggtgctaaattttagtccctgttacattggatgttgagacactacatagaagtattaaacgtagactaatgacaaaacccatttgataacccttgactaattcgcgagacgcatctattgagtctaattaatccatgattacttatgtgatgctacagtaaacatgtgctaattatggattacttaggcttaaaaaatttgtttctcgaattagctttcatttatgtaattagttttgtaattagtctgtgcttaatactccaaattagtgtccaaacattctatgtgacaggggttaaagtttagtcgctaaatccaaacaccaccgtagtgcttgccctaagcagctagaaaccgattctacccatgacataaataaaaccttttgcatgttcagcctttgcttaattgtgacgtgcatgctagctagtggcatagaacactggtactacctctctaaaagaaaaaaaaataatgcgtgcagcgagttcttaactcatcgatataaagctttaactattaattttttaaaacaatatattagtatatatcaagaactacgaaccaactttatgtaaaaagcattttcaaatatgagtctaacagtatcacaaggcacttcatgtaaatcagaatatctttttttcatgtagtatcatgtttcgaaaggttgggccataaggcctcctctaacaagggtgagtcagctagctcataaatctccacatcagcttttatatgatgtggaagagaaaaaagataaggagagagaatgcattatctcttcttcaagagctaagctcctaaagaaaatgtgagaggaattgtggaacccaaaatattataaacaatatgctatgagacaatcttagagaggtagactttttttctatcttttgtatgaggtggacaagcatagaaggaggcctaagctcttgcccagcccagttccaaggaaaacaaatactgcactgagcccaaacaaagccctatccagctcagttactcctctcgtgaaaaaaaaaatcagagagaaaaaaaggaaaccaccggaggcggacatctcgcgccgccgcgccgccgtcggcatggccgtctccgcccttctcccgcctattgcggctgcgccgcctctcgccggaagcacacgtacgtgagtctcctcctcccactgcatcctctcgctcgttcgaactgtctaagctgcgtggtgcactgcgtcacagcgtgtggcgccgaatgcagccgccatgggctagggcttgtggtatagctgaggcgctagtcgcggccgcgaccgccgcgtagggtccggcgagatatggggcagcacggggaggcggcgcagcaaagggaggcgggaggtggctagacacagcagcaggccaatccacaaagcagctgtgcattcttctgatttctgttcttctgatttctgaacaagtagagattaaactcgatccatccatccattcggcgagccagccaacgcattcatatgtatgatgacttggtcttcgatctagtgatatccatcttgtctaattagctatcgaactactccatatttaaccaactgacaatggaattagcatgtgcaagatgatgggaagaacaattcagtgagctactgtaattgttatctaatctaccggactacccctgtatactcgtctttgagcttattggccaattgtgtttagcagtatgcacacacatgcacgttgctgattaatttggtttataagtttagtttgtgaagcaacactaataatccgtcagctgcaatagatgcctgtaaacattaattgggacgttgctgacctgcttatatatatgtatgtaatctggctagttcgatgtaggaaattgtagttgatgatctctctagtgccatataatttcattgtgttaaaacaactttgtgtgttctttcatcattacgcctcatcttttttgtcctccgccctctctgtttgtgttattgaagtttcctgcattccttacatcaactgactggagttctcgcccctctttatttttcttggtttttcatttatagtttccttcggtgttccctaccagaacaagagaaggatcctaacgatgcgagtctactgcgctgctgatgaaggttagtctaatggtaactgtagattggcaagttgtagaagcggtcaaatgttttattttaggggcaaatgcaaatttgccactactttaaatcgttattgcaaaactgccactagaaaattgcaaaaatgccactagaactgtcattcgagtggcatccttgcaatattgaaaaaaccggtggcattgcaaatgccctattttacagttttttattctggagtgaaatttcttgtacccaggctcagatcttgaggtggttataaacttttgatgtatcttacactagggactactatttcaactcttttcttctttttttttttaaaaaaataagtagaagtatttatgtcctttctaggctaagcattgcacaccacatttactttcaaggtacaagagtgtgtgtaagttttgaactttcacacactgcgaatggctgtgcataatgtctacaaaatgtgctgcataagttcataatgagtcatcacagaactcagtttaggaaaatgtacatagcctgctatggaatattatggcacaaatttcccaatccatgcatctcgtacgtaagtaaaggactaagtctaagcaattcattatgggattaggagattgcagattgggctttattttaatggaagacaaacttgtgttttttttctgagtaaaactatagaactgatcgatacgagtgcattttgtgtttttgtgattttaagaagaggaagtcaatgacttgggagtcaacgtggcactatccatgctaaaattttacaaaagtgagttcattcttgctgttttcatcttaaacccttgtatttatgtgcagcaatcattggccttgcgcccttgccttttgatatcaactatatctctatagcttgctctcctttatgtgaacaggagaaatatcacccttactaccctcaagctgccgttatgtgccaacttgcagtgagtactctatgcaagcatacaaaaaatacggtgttgcaaagggtacaatcttgacagcttggcgtctatgccgctgtaatcctcttggtatgtaggttttttcgttggttcatagttcttttgatttcttcgacagtcgcagtctgcacctgcatcatatcatatttattaaatttcttttacaataaacaaacaggtggtcatggatatgatcccccaaggtggtttgatgaggaagagctaccaaagcaatgacagcctggtaattactagagaacgtgtatgcatgccctatggtcattttgcatacaattaagtgtgatatgagacaatgtagttccaggatcttttaatcgcaagcaaacatgcacaaatttctttaaacgcgaattagttgctattatggattgggtggccatcctttactccacttaattaaaacgaaatttttcaaaagatagatagtacataattgagtgtgttattaaagtgacaccaaacttcaaacggacaaattttatgtaattaattgttcatgaaaacctataaacattattcagctggtcaataacaaaagcattcgatgtgccatactaattaaaaatatgaccacaaaggttaatagcataatcacaaacagtttataaataattacacacttgttaacatagttgttctctaattgaatgaccaaaccccaaacttgaaatgagtaaactaattgatcatagaaacttatatacataacagggtttattaagaaggaagtatagctattaactgctgctagactgctagcaaaatctatttttggaagacatccatctagcattgttgcccctcatctcagggaagagtgttggcttttatctgttgtctcccagaggaaaagcagaaccaaataggttccttcttgtgggtggtctggtcagctagaaacgaggccaatgcaggggaccatgcgaaaatcagtgaggaaatttgctgtatatgaccagctgcaagaccatgtaacaaagctaagagcttgcctgatgttgctaaatttaagatgtacaacagatgcaagcttttggtagttgtcttgggctatcttctgaaggctttcgatgtgaaagatcctctgaaagacaattgaacattaagtttcaatgcaaatataagaatcaataacagggaagcatttcttaccatttttgtgcttcttacaggtgaaaaagttggacttgtatgcagctctgaagaatataacatgcatctttgccaactatccaccaaggacaactgcagttgtaaaattttcagccaacttccagctgtcaggtattggagaaggctttactcgatgcttagatatagtcattatggtacctgtttgtggtggaaaatggttggagtgaaaatcaagaaaatgaactacttagtactgaagtattatgagatatagtaggtatggagggaacaaggatatcatataccatcattcagaaattgtaacgatcagaaccataaatggcgtgaaatcaaactcccaaataagagcaagcagcataaaccaaattgtcaagagagcagtaaatatgcattattcgctaactaaaacgtaaagttgatagacattgtttcacatcatataggggatcatcagaattaatttgggaaaaaacatattatgcacgggaaccatttaatacttagttctgttaacttgtgcttatttctgattgacctgcaggtaaactatatagaagaaccatcaactatttatttaccaattgagcgaaaccgttcttaaacggataagcaaaacacatagctttcaaatatataatttaaagagtaaagtccatcaccggtccctaaacttgtaccgttgtgtcatcctggtctctaaactcgcaaatcgaccgttcagttcctcaaacttgttcgattgtgttattccggtccctaaacttgcaaatcactcgtttaggtcctccaacttgttcagttgtgtcaccccggtccctaaataggacggtctaaaaattttatatcaaaaaataattcataactttttcatgtgaattctaatgaagacaaactttatatcaaaattgaaaactttatatcataactttgtagttgaaaagtttttgaattaaaactgtttagggtcccaaaatattgttgcatgtttatagattttgaaattttaattttaatattatatttttggacaaaaaatgacttaaaataacaaaaaattcaactacaaagttgtagatcgtgtcgagggctacaagtttgatataaagtttgtcttcattagagttcacatgaaaaagttatgaattatttttaaatataaagtctttagaccgtcctatttgatctagatattcaaatccaagttaaggaccggggtgacacaactgaataagttggtggacctaaacgactgatctgcaagtttagggaccgggatgacacaatcgaacaagtttgaggacctgaacgatcgatttgcgagtttagggaccgggataacatagcggtacaagtttagggaccggtgatggactttactctaatttaaattctaatttaaattctaatgaccggatgattgacgaatccacattttagccattgcaaacaaacggataagcaaaacacatatctttcaaatattccttctttttgccgtgtcccctgcttgtcatcgtcgtcagaatcagatcctgcagctttgtttgccgcatcagtgccagcctcatctttcttctcgtaatcctatcagaaaataccaatccacttgtcaaatatctccacacagggcagccaaacttgctgcgtaggagataaatcttataccaatctgtttgtctactgtataccttggcggcagcagaggaatccttgaaggtgaacttgtcgaagatgttcttgaagttggcgaggaggccgtacattcttttattttagatggaagaaaagtttcttctatcttaaataaaagatttttgctgatttatttatttatatatccaatttatatccaatttatagaattgatacaccatttaattcatgtacttcatctgtattttaatgtatgataccgttgactttttaaccaacgtttgaccactcgtcttattcaaaatttatatgcaaatataaaaatagaacatttgatgataaattaagtcacaataaaataaattatatttacataaattttttgaataagacaaaaggtcaaacgtttgttaaaaagtcaacggcgtcatacattaaagtacggaggaagtgtcatttagcattcaggtccgcttgctcgtgatgtaccccacctccacctgcggcgagcacggttcctaggtcagaacaaacaagaggggggaggggggggggggttcactatttccccttgatctccctttgccgactactgtgttatctgctaaagtaaccatggaaagttcatgcattccgtggtttatcaggatgagattgttccgaaggaggccggcgatgctcatgaggatgcttaattgctaatagatatttcattttatgtgcacacttaatcttcatccgagcgacaacctaaaattatgtcctatttttttaaaaaaaaacatctctaaggagaattttaagaaaatttctctaaaaaaacttttgactttaatgtgatttttacacaactttctataagaaaatttcttacaatattactacctttgccccaaaataaatttatgtttagatcttagaatgcaaattaagatagagcgaatactcattataataatataaatctggacagaggatctgtccaacatccgattctaggttgttatattctactttctccgtttcatattataaatcgtttgacttttttcctagtcaaaatttattaagtttgatcaagtttataaaaaagtttagcaacatctaaaatatcaaattaattttattaaatctaacactaactatatattttggtaatatgttttttttatgttgaaaatagtactatatttctctataaagtttgacttgagaaaaagtaaaatgacttataatatgataaagaggaagtagtgttggtgatgagtaatcaagggtattgaagattttgtggaccagggtaggtagaaggaagataactgaacttattttgggacagatgcaatatttagagagatatagaacggagagaaaaagaccttgctgtccctcagtgagggatggatatgtaaagaagtggctgggtaaagataagaagaaattaacgtgatatgattaaggtggcactaatattctttaatgcttatatttatagataaactataaaagatgccggtgtgttgcaatgggtagagccatttagatttgtacatatgtccccgtggataaataaacacatcccattgtatcgtttattcatgtgcttatccgaataacttattaccaaataaaagaatatttatgtgtaaatattttatatacatgtttttagtgactcaaaagcaaatgttgtaaaataaaattcgataacaaactaaaaggtccaattcaaaataaagttctaaaatttaaaatttgtcttataagaataagcataagccaaacaatgaggccttcaaacacgagctcgatttatcgtctagctttatctcaagttgggcaggaattgatgacagacgaaatcagcaatgtcgattatcctttattttcagttggcatgttcttttcaaaagtaaaactgattgttatggattattataatggtatccatagtagtatgtatgagcatgtgtgaagattgatttgaaatcatgctaacatgacataggaatcgtgacgtataatacgaatagaattggatgatctaggcaacgacatacatgatattcacacggactctgtgagtttcatttacttggtatccacatcactcgtgaatcatgactctgcaatgaatgctacgcgtgacaggaatcagatacagacgacgtatcatagtttcaacaataacaccttcaattttaaaatcgtgagcgaggacgacgcagtcccgatcggacatgtggcaagggcaaattgcgcctgcgagggcgtcgcgggcccaatcacggcgccacacaaaggcatgtatggaaacagactcgggcgcgggcccgatcgttgcgtgtggcaaggggtacgtgaaaaggtgtaggtccaattaattcgcgcgcctctcggataagagggatactctggcgtaagaaaaaaaagagaaaaggatgtggcataaacataaaattaaaaccgattcaaacatggataacgtatcaaaattctaacggaagcatctttatttttttataatagtagagatattaaatgcttagaaaaattatattcatgaacacagctgatagcatcatcacttcacttgtggtgaacactcccggaggatgaagagggacacagatcatgctttagcggtgagtgacaggtggaaccggtctcacatatcagcgacagttgctgcaatactgcagacaatctgcactggatgaagagagctttcggttcaatagtagtaggcatacccatacccaacccaacaggattgagatcctctacggttaaatacacggtgcttttgtcactgacatatgagcccaataatcatcggacccacgtattagtgatagagtcacacgactttgactgcataggaggctgatcctacccaacaagctgtgcattgcaaagaagccatatggaaacacgagcccccaggcagaagcaaaacccaagaaggccagcaagctacaggcaggcagcagcaacttcacaacactagtgtcactcactcgtcacaggagtactagtagcacaggagtgtaacatctcgtcatggcgccccatcaccgtcaccaccactgcctctgcggcctctgccactcccccaccagctgagagctgagagacgatctcgcattgaaatctcgcggcggagtagccaacaaaagtcttcttcttgggcttcttctttcttcctcctcgcagcgagctccattggcatggcattgatggagacgtcgtgcatggttgccgatgcagcgcacgagatgggagaagtcgtcgtcgcagcagcagcagcagcagaaccaaagcaatgtgcagacaggtgcagcagagaaggggggagtgactagtgagagcaagagtcttcagagttgccactttgccagccagggccgttgaaaatgaattttatttcagagttctgattcagcaatggaaaagtgttagcagcagtagattgtcaaatgtgtttgtttggtggtgttggtattcaatctctgtacttgctgatgcttagtatattatggttttattaattgatctgaacattgcataattttatctttttgagaactagcattgcatgcttgatgcttcaccaatgcattggaacctacaaaagcaaaatatatttatcaggcccttcttggacgaataatgaatagtaagcgctcttggaaagtatactagtatttcaatggttttatttgatttgatatttgggcttttcctgctcaaattgataagaatagagtatatataatatgatgtagtaataactttataaattatgaagtagtactgtgtagtatcatgacatccattcctatggcatccatcttgttgcagagaatccaatcctcagcagtcgcagctgcatggagtattgcacattgcgtttgcaaggatggatagatggatggatggatggatggatatggacagaggagggacaagaagaggacaagtattactcctcctcgtcgacatcacaaactgcaacgccgcagaaaccaacgacttgtgtacccccgctcactaaacaacaaacactcgtgtcctgcctcccacttctcccccccataacctaacagcacacgattatctcatggtttttaccctccctctctctctcaacattatctctgatcaaactgctacaatgcaaagctggaagaggtacagtacccccaacccgcttatctccgttcatctctggtcgtcccaaatcagtgcttaggacctttagggcccatttgaattgcagggtagaaaaaacagaggaataggaaaaacataggattctgatagaaattgaagtgtaaaatagaggattgcaaaacacaggaatggtcgtttgattggagcgcaggaaaaacgtaggaatcggatgagagagagactcaaaggaaattttccaagaggttagagctcttgctaaatttcctctaaaatctacatgtaatgtgtcattccataggaatttcataggatttggaaagcttcaatcctttgaatcaaaggggcaaataggaaatcctataaaattcctacataaatcctttgattcaaaggggcccttaagattatagtaataagcagccgaggtggctggtctagattagtgagaatgtgaaaagttgagcttctactgctagtttattttctagattgtatgattaaagtttcttacaatccatataacaatatgaactatttacgaggctaaagattttgaaaaaaccaataattgttagaagctccctcggatatgtttttgtgtttacggcttacttatttgtttaaggtgtaattaattttaaattttagactttccaatgaagtgccctagctgttctgaaatttatgcgggtgcatcatctaggtctctcaacttttttttttattccctgaacttatcttaggcgttagatatgtccaaacatgctctaactcgtttagtgcacgctgacgtttttgagggttaattagcaacggtagtaatagctgactactaacagattatgacaaaatgaagatgtcaaaccagacagatgcatttgctccaacttctaaccacaagaattaacaaagactgggcaggtgaatcttgttttgtttctttaaaaatatgattctactcctatcagtagtatactagtatgtgtgatgtgtctgttctggcttggagaaacagctccctgccatagatttcatgtttacctctttttatactatgttgcaaagagacaaaaacactggcattctccaagtacattagctaagcactgatcatgttcaagttgtgggatatcctttgacagaacaccatgctttctgctaataaaaatcactatagcacaaagctcaacaagttcaggtacagcattggacaatacttgcacagcaaatgcatttggaggacacctttgcaaagtgacaattacatacacacccacatttactaccttttctagtagtataacagactggtagaaactgtccccaagatatcatacaccacccttcaacatcaatatatatgctcatcagaagaaattgccccatgcttgcaacaatgcaaccctgctggtaccacatcactgagctcacctgctggctggctgaaagggtctctttctgattctctgaaggcatacacaacatacatcattgacagctggacatctgaaacaatatgtgtccttcacttgcagagcagagggtgtggctttacaggctttaagcaacatttgggagcagtgacagcaggcaagaaaatataaaaagggagatgctgctttttaggattggtggtactatcaagcaagtacagagagttcaggcatgaggaaaatagtgttaacgtatccatccaaaaccaaagagagactctgagtccgggagtccctgatgcagcatgcatgctcctttacctgtctttgcacaatcacatgccattgctatgtagtatgacacagatgctgcatcagaagcaggcaaggattctggcactacatgaacagcacaatgctgtatgagtaattgggataaagtatggtacagtttagcagttagtagtttagtactataggacataagtagaagaacattatggataaacatgagcttcaaatagcatcaaaggaacttgacagaggagataagtataagaacattagggataaacaatgagtacagtaaaaccagagatcaccaaatgtttgcctaatatttcaataaaccagctcttcgcgatttacatggcatggtttgatatccatgtttttattttcagttaactatctgcatttccaaaaattctgattatgtaagtgctaataagagtgatggacagattgattttgtgcattggactaaaagagaaggcaaccttaacagctctgctgtccatcaatggttatacggcaagcagagcaaggactctgcttcaagtactgactcaacaacaaaggactctgcttcaagttcagatgtttgcatgtagtggtgtcgtaataaaacaaaacataaatcagtagcagcggggaccccaaacgcaaatgactactataaatcaagaaagtaacaatcttttaggtttgggacatctgaagtggcactttgtttgcaggcaacataagaataaagaaaacacaattcagcaagaattgttcttgtgtatggcatcatccctccctctattatccaaccatcaaatcaacaaaaatgaaacagggaagtttagacgccctttcaattagaagatatactcagcaataaatagaatagatctataaaacctgaaacactttctcgaatggcttccaatgacatcatctcttcacttggtaactccaaaccaggcaaataatgcaagaattcccgtggaagtgaaacaaaataaaactaggaagcaatgtccagcctaggctcaaaagagaaaccagtaaacagctgcagaggaaacctcttcgtcacagggctcttcagtgaccatttccacagcttctggtttaattcaaatgtgaggagggccggtgacccatagctctgaatatagataaggtcatccgccccacagcttgcaaaaacatcatcgaactcgccaaatccttggaaaaacttgtgaggcattcgagcaacctcatgccactccttgttccggagctcccagatgccaattcccttgatgataccaggcctatcttgcttgccaatgcccccaaccaagacaagcctctcattgaggttcatcaaacggccacatgtaagagggcacggcactggtatagccatgctcatcaaagaagtgtgagtaggcctggtagataggtcatacatgagaagacaatggcgatgctcgttgttattcaccaaaactcctgttgagtacaccagatagtagaggaccccatcacagatcacgcactcatcacctcctcgccatccaatcaatagttcagtgaagggagacacccatgtatttatctctgactcgtacaaatggatggtgaactcccattgataatactctgatggcacctggttgcaccttgcaacagccaccatgtactgatgagaggtcctggtcacagaaatggcgagagcactgtaatcagccgacttgccaccaggagcatcaacaagcctcttccagtccttagttattgggttgcacacgatgatgcggctcctatcctcactgtccatcagacacaccaacccggacgatgaggaaatcgaccaggtggtcttctcaatgcaagggaagtcgaatccataccacttacgcaggctcgggtcataggtgaaccccgagaccgcttcctcgctgcaggtaaacatgaagtaccaaggcttctgaggcaccattttgctccatgtctgcctccgggcatgcacaatctcatgccatctcttgcaaacagatccagatcttatgacacttgcaacaggcaagaaggagaggaccttttctaaaagatcatcagggagaacggcgtccatcgacacggccaagtctccactctgatcatcatccatgtctccagaaacatgcccataatctatgacctgagcaccaatgaaggaagatggatacaactcccactcctctgaccccattgccagcatccagcgaacagcacagtaactaacgcaagatcctgcatgtgcaagtgatgaaattaaatgttcatgcatcagccacatggtaacatctaatctagataccagagttactcaatattcaacacaacatcaatttttcagagcgttgagtatatatacatcttatacattgcctccatgagctcaaggaagcagaatgtaaatgccagataggtgaaagggatagcctatggtttttatagcagtaaattaatttcaactgcatccactccactaagcagtaaacaaatccgcaagaaactggaaaaactggaatgcccgttgattcggattaggttgcttacagaaagaagaacccccaaaagagaactctcaatccaagcaaaggtttattggcaagaaaacgtatcaatccatgtcaggatggatattcgccggagagcaagaacccaatcgccgccgccgctgtcgtcagtgatgaaaaaaaaaaaagagaaagggaatgcggacggacagcgaaaaaaagtagtattctttagaagaaaaaggattattgtgatgatcgtctgatttcttggcgggttcactaatcgcaaaaaataaaataaataaaaaataaatgaatttcacaagaaaacttcgagagtgacaacaccaaacctgaacacaagtttcttgaaaagggcagcgaaaccgaacaaaatgcgtcatttctcccatgaaacaaactcctactggctcaaagagaaagaaatccaaaccaaacgacaagaaacaaattggagggaagaaagaaccaatccaggtccggtccggacgggatctcccatctgcgccccggccgccccacgaaccggaggcggaggaggaggacgagagagagagatagctacagtgtagaagaagaatggataccttcaatccgattccggccaagattgggggggctcgctccgctggacggagcaccgcccgctcccccgccgtccgggcgaggaggcggcggcggtggcctccgaggctgctcgctggccgcgcgctggaggaggaggaggaggcttggcagccgcagccgcgcctccgggctccggctctgcagatcagagagagagagagagagagagagaggggagagagagatggagggagctgagagggaaagagggggaggaggtgagggaagaagaagagaaggaaggggcattttggtccctagacaattttcttttcagcttcttatgctcaaaaaataaaataatttttttctgtttgaaaatagagcattcaacatattactgtattggaaaatatatttaaaaatgaagtagacgttttttttggaaaaaaaatgttttctaggaagtggataaaataatgcacgacaataattcagtgaagtagcttgaaagaataaggactaagtcgagacttctaacgagtagaaaggttttttacactaagttaaaagtccatgcattaccacggatgtacaagagatgaaagaaaaataaaaagtataagtttatagcatacttagtcgattaggcatataatgaaagtcgcaacgttcacatatattgtaagaaccttatacctgtagccttacatgtcagtatatgttgtttaaccactactactatcatttaaagtaatatagaaataggtcatcaaaattttttctacattagtgataaatataaatagactacaacatgttagattttagcctttagtgacatttttattaaatatagaaaaaaatgcatgttacttttgatatacgctccccatgcatgtatgatgtatgcattatgtaatacgcgatatcttctttgggttgctaagagtctatgccctctaaaattattcctgtggtgagatgaaaaatctgaaaactcgacgctattgctcaaaatgatgaagataaccagttattgccaaaaactagggaggtcatgtagcagttgttcatgtgtttgaaccaacaggtttagatccgaggaatatatactgtgcactgaaatttttcgtgcatactctgtgaatataaattagtaaatatcacgaaaaattctaaaaaaaataaatatatacttctaatagtataacacatatctacaaagtctcattcatattcaagttgattatatgatattattctaacaataaacttattttgggacaaatgaaaggagataaaaataaacttattacgagatggagggagtagagaacttaaaaaatagattaatatatttttttaaagcaactttcctatatatttttaagaaacctccaccatttaacagttcgggaaacacgtccgtggaaagtgagaggttcgaagatgggaaatttctgcacgcttatggtttagggttagttattcctttttaccatttacaggaataactaagacatgtaaaatttcaagagtctaactaaggtgtgttcttttctcccccttttcaacttctatgctctctttttcacacgcgcgctttccaaactactaaatggtgtcttttaaaaaatatatatagccaagtcatattaattcatttttgactttttaactagtacatatatgctaatccactgtttcattttacatgtctaggagaagggttcctaaccccttaaaagaacacagagtcaagggagaagtgccgaatgcgacaacatcatggccctaggatagatgaaaaaaaaaccacattgttaccctagggaagatgtctcgtctatatgccaaggagaaaaatataccgatggacttgtaccacaaaactttggggattaagctataatcatgagttgtgtctccaatcaaattttctctcaggaactctcatcaacacttaaaacaaataaatatcataaaacgtgacgttttatgatcaatatttcctaaaaccccaaatgtattatgtcttgtggcacatacctataagttttattgtgaaaatgcttcataaaatctcacctttattaaaattccaattggtttcaacatgtttgagacaatatttttttaaagtagtaaagacttaaaccaacgaccttaatgaagaattcaacaactacaagtttcatatacactgtaattttaaaatattaagtaaatatttactgaacgtttgcaaaactttagaaccacaataaaatagggttatttgtcaccatcctaatatctaaggttttatgcaacttcaattgtatttaaaatacgaggcattatcgatacattcgtagttgggtagtagattgtttttatatatttaaatctaactaagattttcaggaatataaaaatattttattcaaaacttctctaagttatctttaccaattaatttattttaatatgctatatctctataaaattcctactacacatactctcggatatagtataataaattagattcatcggaactaaagaaataaaaaagacgcgaatattagggatgacctaatatcaaataattagaagttgtgaggtttcaaacccaggccgactagctcatcaccttgtggaactagccagaaaatcgattggcgtttctcagaattaaagaaataggactgttcatataattataggatggtacttaaaaaaacccaaaagacgtccctgaaattttctttaagaaaaaacttctgccgggcctgatatgtcgagtatcctaacgatcgatttggaacagggagggggtgctatgcatggatttgatgttccaaaggcctacaactacaaagatatgatcgagcagaccaaccaaacaaacaatggcgcaatcgtgactagtggtgttggatgaggcctattttatgattggtggagcaagcatgcacgcatggggcctcacctacctaaccagcaaccatctctatgtctatgtctctgtgtgtgtgtgtgtctggctgtgcatcactcacccacaggtcgcaacaaattaaaattgtttgtatatatctcatgacccatccctatccgatgcacgctttgctctgcctttgctgcttcggctgcctttgttggaaggtcatgatggaaggtgtgcagtagtatagctgctactacctctcctcttctctcctccatcgtcgttggcatttatccgtgacgtttgatcattttttttattattagaaagaattatgtacatataatttattttgttgtgatttttcattagtaaatatttgaatataacatgttttcatagttacgattgtcagggttatggataccacatatctaatagtagttaactaaatctcggcaggatccactacataccatgtcttatacggaaactgacctcgagggagttccggataaggaaagacaaccagagttctacatggaaacgacaaggactacttggattgtatccatattggtttctctagttctacttggacaagtggacacctatgggtataaatacaggccccctaggaggagaagggggacaagacaatcaacacccaacgggatcaacacccgacacgatcaacacccaacacaatcaacaaagaagcctacatacgccaagacacgccgccggatatcgacttcagggataagcacggctagtaccctacggtgtctccggatactgtcaggagagatgaaagcgctatctctgacctcgctgggcacggattcgaggaggaaggctaccctgttgtcgactacgagtcagatcgtcagaccgccatgtcgacaacagttagataggctaccccaaatattgtactggtgtgattatcatgaataagagcaataccgacttcggccaacaggatgtagggttattacctgaccgttcaggggcccgaacctgtataaaaatccctgtctccatcccttttacctcagtcttgcgtatatcctagcaccgacgatccccataccatgcaaataccagaattgcgacatcaaacgtcgacagcggcgcgccaggtaaggggattttggtgcttcaggatttcgacgagatgggttcaaaagatggattctcgaacaacaagctactcgacgacttcagctgcgggaagatccaacccgaccggagtatgtctcccgacgagatcggaaccaccgtcgctaaaaattcaatctgtcgagatcgtccaagtctcaagaccttcgttgccgtgtaaattctactctcaagacagacaaccatggtgcagcacgccgaccatcccgacgatctatggcagaggaactagatgtcagggtcaaccgattccggttgtcatcaggacacataccaagctgtattttttggtctaattcctactcggaccagaaacagagctctgatcggcaattgttgacggcaaaactgcacgtgtcagagctggatcaaagggagttttttcacgtgtacaggagtatcttatacaggacgactgtatggattggttcaaaatctactacatgtacataccggcaacaaaagttaattagtagattaattttttaaattagtctactaattccgtagatatatccggcatatacgcaatattttatatacaatttattgtacctatttttcagacttatacagtattgtcagatcaataatttgttatgtttacctagagcatgttttttatacaatatctgttgcgcgggtgtccccgatgttaaatcgactacgatctaacactgggggctcgctctgtcttcttctatataaatcatgcttgtttacggtctacataatatctgatatttacatctgctcgttatgtccagtacatactcgatattatctactatatgtctttgtcttctagaaaatatttttcaggaacaattgagcactcgagaaggttgtggtcgagtacactctattatcgagaacattctcgacaaatgcggagttatcgcacccgacctaccaacgaagaccgacgacctatctcatagcaccggccatggctggactactcgagaaaaggttgttaacggataattcctcgcgaacaccgtcggcttgatcacccgacatgattgcgaacggacatccggatatgctacaagttgggtgtgtgagtcatgctggccatatgagatgcacataaaccaactctagcgcctccattggtgttcgagagataattctacacgttcgctggttctccaaccagcacgtagcaatctctcgcacgacaacctcagatggtcgaggtacgactacagcaataacgcagcggtcctcgcaccacgacttcaaatgatcgagagacacctactcactggttctcaaccagtcaatcatagcgatctctcgtacatttacttctagtggttgagttacgactactacctggttctcgaccagcggtgtagcgattctcccactatttccacttcaagtggtcgagtttagactactgcctggttctcgaccagcggtgtagcgattctcccactacttccactttaagtggtcgagttacaactattgcatggtcctcgaccagcgatgtagcgattctcccattcccctgcttcaacaaagttgatatcaggtgcacaagatcgccaagtgttttacccagagatcccttacccagatgacacctagcgttgaaacctatcctactgtccctttacgccgtcttgacaaggcctccgaggaacctgagggaacttcagctggggacgcccagagccgataaggccttgtcggatccttcagagatgaaagaccatgtaagatctggtcgtgtaagagttctcgccgtacgtattaaccaagccgtgtaatcggaaatggattttccaacttcacagctgggggctaggataagtgcttgttcaaccgaggcaggtcaaaggtccaagagccttatcttctgagaacgattctccaacgacaaggctgggggctagggagagtgtatgactctacaaactgactgatcgtagttggtaagagagaagacgctcatatacaaagcactggtctgtacattcaattcactagtctgtcatattatagcatgtcaccctttgagcattcgctcgggggctatttctatctaatattcttttctgagtattgatttcaggaaaattctattcgacattatcgaagactccatgtctctatggttctacaccaagatcgactaaggcgagtatgacaaatgtcgacaaggctccgtcgcagactctacgccttctcgatcactcgagaacggttgctggatttcgacaaggaatacggaatgaagagatggtgtacccgctgagataaaatttcatgacttcaatccaaattctcgattgcagcaagacgggagacttagtcgtacgctctgtactttctcggtcgacatcagagattgacttagacaaaccctttcggtgcccgcacgaggctgataaaggaagtctaacgttatctctaaactcaccgagaacggtcacgtgagctcgataacagttcctccaaagtctgcggttgagaatatgaactcgttcatttgcatcgaagtcgggggctactgtcagggttatggataccacatacctaatagtagttgactaaatctcggcaggatccactacataccatgtcttatacggaaactgacctcgagggagttccggataaggaaagataactagagttctacatggaaacgataaggactactcggattgtatccatattggtttccctagttctacttggagaaggggacacctatgggtataaatatagggccccctaggaggagagggggggacaagacaatcaacacccaacgggatcaacacccgacaggatcaacacccaacacaatcaacatagaagcctacatacgtcaagacacgccgtcggatatcacttcagggataagcacggctagtaccctacggtgtctccggatactgtcaggagagacgaaagcgctatctctgatctcgccgggcacggattcgaggaggaaggctaccctgttgtcgactacgagtcagatcgtcagaccgccatatcgacaacagttagataggctacctcaaatattgtactggtgtgattatcatgaataagagcaataccggcttcggccaacaggatgtagggttattacctgaccgttcaggggcccgaacctgtataaaaatccctgtctccatcccttttacctcagtcttgcgtatatcctagcaccgacgattcccataccatgcaaataccagaattgcgatatcaaacgtcgacaacgataattttttaaataagatgaacgatcaaaccacatgacaggtaagagtcaacgacatcgtatatttagaaatggagaaagtgcagggtgatcactcatacatgcatgcttaattaattgtggagagcaactttgttgctgtccatgtgggcgatgctaaaggaaaccattggcttgctaataatgtccattaaagtgccttttcgtgattagtgaacttcttgtttgggattattgtattgtgattcagccaaggtctttaaactggttcgacggtataagaaatcgagaaaggtcggtgggcaagtggctatgggtttgttgatcactgttcttcgataaactagcaaaatacccatacatgctttgatatgggtaaaataataagagtaaattgtgtttagggccaccttttatcactaaagttttactttgaactaccctttaaaccatcttttcactttggactagattaatttgcctttgtttcattttgaaccacccaaaaactttttcgagcacataaatgactttaaccacatcggcacccataaaccgataatcttcccgacttacatgtagactattcttcgcaagattagatggtagatacaactagaaaagtaacttggggtggtccaaaccgtaacaaaggtaattttacctagtctaaagtgacaatattagttagagggtggctcaaagtgaaactttggtaataaaaggtgaaccaaagtacaattaactcaataataataataataataataataataataataataataataataagttgttatagacatgtttgcttatttgaatatacataatatgtccatttgattcaaataaatattagactattgtataatatttaaaaataacaaagactaattttaaaaagaaaatacaaatagtgatggtgacagaataaccaccactactaatatcttttataggagtatagatactcccaatagttccaaatgtaagtcgtttaagttgttttaaaatttatacgtaattctacagagcctcttttttgtttgcccttgctaaataaatgctaccccttttatgaataaataattctttttatgtagtataaacgaagggtaactaagtctactgttggaatcaaagtgagtgcaccatatctcattatgatatgtgtacatgtttggtttactactatttttagtcataatagatacagtatttggcactaccaaaatttgacaagataatagacaacatgtctcaaatactttttttaccaactttggaaattctagaaattaactttctcaactgaaacaacatgaaatctatctatctatctatctatctatctatctatctatctatctatctatctatctatctatctatctatctatctattatatactaaaagtccattaaacttcctagaaacgctcttaaactgccacatagcgtttctacaaatactcctagaccgccacatggcactgtttaatctcaccgtcgatttttatttaaattggtgacccaatattatagaccattagattagatgtccttttttaaaaaagtactttcacatctatattgtgggccggacaaagaaacaaaacgtaagtaatccgatacttacgtacgtacggagaagaaacaatgaatcttatctccccgttcaccggaataaaggaaaacatgtataccaacttagataaaagcgattaataagtaaaaaaaacataattaaagtaggtacgtagtgccactgaaaagaaatcgatgctccataaaatatgatattctactattttaaaataaaatatattactctataaacttatgcaaatatacatcattaaactagatcgtttacaatataaaaataaaatatcctatcaatgctctttaaacatcctatctataaattattttaaaatcatatatctaatttgtgatccagttggaccctccaattaaataaactattgatgtctatgttcataaatacatcataacacatgaggtcgacatataataaataatgttataataatatttgaaaaaataatgaattatcccttgaactattacggtagaccgaattaccctcataaacccgaaaaccagacatatttcaccctcaactattaataccggacgaattaaccctccccctaccccgactcaacgcggagtggttttgatcctgcgtggcaattcagttagcattttcttaaaaaaaatagtgggacccatatatcatatctcttcctcaccccttcatcatctctctctttcttctccctccacatctatcaatcggcaagtctaggggcaacgagcggcggaggcggctcctcctcgcccaccgccggtgggcgcctccttgacggtcgcgtggcttctcctcgacctgcaccagtgcgtgaataggatgacagcggcggggcaagggagctcaagcggcggaggcggttcctcctcggctgtctcggtagccacatgcgcattccagcggaggttgtcatctccatcatttccgttgcatatcgtcgtcgcgtgatgagagttgcagctgccgaaggcgagcacctgtgctggtcctcaatggccaggttcggctatgcccccgccatcaagaactcgcccaacaaatgcggcggcagctctatgtaccatagcgtgccgtcccaccacggttcttaatcaatccccaccaccaatgcctctctcccgacgagacaacgaggtggatcaatcaagcaagcaagagctggggaatggacgaaggaggagaggaagagcagcgggcgacggcgtgcttgccggccggccccagcagcaatgggaggaagaagagtgaggctggggaatgggattgaagaagagagggagagagagaggtgagagaggagggattgagagggtagagagtgtgacaagtgggccccacatattttatttttaaaatgcagactggactaccacgtaggaccaaaaccacttcggcttgattttttttttgggaggggggggggggtaattcatccggtattaataattgagggtgaaaaatgtctagttttcgggtttatgcggtaattcggtcgaccgtaatagttagggggtaattcgtacttttcctattttaaataattttacatcatattttaggtgtcaaataacacttgatgataatataatgctaatttaaagctacatatgtaaaataattgaaaacaatacaaattagttgtgtatttttaagtagatatatgatttaatttaatatgtttgagattaatattttttttgaatttttagaactatatgataattgggcaacataaatgttacataaatgtaaaaaaataattatgacaatatttcaagccaatgatcttgctataaaacaaccatttagtccatcatgagatttatggtcatatatgtatgtttttctctttgtcaaatagttttcataacaaatgaacaatcaaataacatacgcaatatactactcatgatatattttcttatagttgaggaattccaacatatcaggcataatttgatgattgtatgtcatgcactctattgatgtgacaatgaagtatacttcaatcaattagttattataaataagtttgggaaaatagattcattctccaaattaattagtaaaggtgtcttctgtcattatgaagaataggcgttgaaaaacacaagccgcaaaattatagatatttgtcaaaatataaccaacaatatggtatattgttcctttggagattttatcgtagtggtatttaaaaaaaatactttattcaggttaaaaaaaatcacatatagtacaaatagatatgaaagaactacattattccattattgttttattttttttgactagaaaaactgccagttctttgcccagcagtgtaattttatataactcaaaaaatatttacaaagttagagtaagaaaccaaacaaaaatataaagtttgtaaccaatcagaaacaatttgttttaagggatcctttattctgcacatatgcagaagaatttccttcacaaaaagagatctccaacttggaaggagggctgaatgttctggaagattaaaccattccactgcttccaaatgtgccatgctgccaaaaagaaaacctccaggaagcccctctgagcaaacttgagtttttctagggtgatcatctgaaagaactccaaattatgatccactgaattcctaagtgttgctagcatctgacactgaaaggtcaagtgaagaaaagatgaagccttatttctctgtgatgtgcattgcacaaaagacatgtgagatcatcatcttctttggcatagtgccttctatcgagcatatctcttattgttttattatcgtgacacatgttgttctcataaattcatataataaattcaaggttgtatggtttaatgtaatatgtcataattagataataactaaagcatgtttaaaatagagtgaagatctattttgaaaatataatctgcatataaacatttataataaaaagattaagcaatattaaataagtacccgcgcatatgcgcgggctaccttcctagtttctataaaaatcatataaaaacactatcgtgtacctctaccatctcaaattttggttatgtttgacatcaaacaaaatatgccatagatattgatcatattacatgactcggctcaatttgaaagagattattgagtggattattgctacggattatctacataatagtagagatatattaaatattttgataaacaaaattaacaatacttaataccagtgttctaaacaatatacaattaatataataaattttatttttgaaaaaaatattttttaatgcatggaacaaataatacatttcaataatctggtgaataatatacaaaataaataaaccacgttttaattatgaggctgcttgtctttgttctgggtagaaataaacgctttataactgaacagctagatggcatgcatgttgcttaattataaagcttgtagaaggccagaaaactatatacactcaagcataattaacacatctataccgcgataatcttgtacgtgctgtcacaataattcgctgtctaatctgcataataaatatataaacctattggcagtattgagagtttgtgactggtcgacaatgacaacacttcagaatgcttattattggactaccttgtcaatctttatgctatgtgcgtgcttattttgttgatcgccatgtttaggcaataggtacagctgccttacaaggatacgtacattacagtttaccacatagttatgttcgtttttttagttaggaactctacgcacggaaaacagagcgacatattttcttattattaattaattatttacttttttaaaaaatatatattaatatgattttttaaaataactttcatatataaactttttttaaaaaaagcatcgtttagcattaagaaaagtgtgcacgcggaacacgagagaagtgagttggaaaaactggggaagaaaccatggcttttaaatgaaaacgaaccaataatcgtctataatcaatcatttgatcttcggctaattagccaaaaaaacacaataaaaaataatttatgagttacacttttataagggtgttgttagtaatttaaaagccaataatacttaaaaacaacgaaaaaattaaactcaacttaaaattaagttctaaaatttaaattttgatagtagataagccaataggcatacgataagaagctataaccgttaaatcattgaacggaccgttaaccttaaaaatcgtttgagattaaacaaatcattaaagagctcatattaaccatatgaaatgaccttctaatatataatcaattgtttctaatggtttgttcaatcgtgtgacgaaacggttgtggcccatttgatagtagtagaaagttgtaagccaagagcccctacttcaggctcaagttcagatcaaattgatatcgcacattcacacctcaatcatttttaagataatcatagaaagcaaataaggttgtcaccacgctcataaactcaacttttgtgtgcggttaaattaggctctagaatggcatttagttgagctgaatccaacgctccaactacagaaatagttggatgataccgatatattaatgtgggtgatttgtactatatcttttttgacatgacaagagatgcatatctattgggaaaagcatatccagtgaccaaattgtgtttggttttggggatgaactaaagagatgagccacaagcagtttgtattcttgcaggtgtattccttgaattccctgcacgcacaccttgatgcggtggatgcaaaacaaagagacaaaataggtgcctttggagagttgcatagttataacagtcttggatgagtatagatatgtcaagatgttgtctaaacttttgcatactttttttggttgaaaaaaatattttaagaatgattgcaccaaaactatttcaaaaataaaacacgatttcagcgccagacatgatgacgctaaggttcgtctcgttgctagtggtatgagtataggtatgtcacgatgctgtctaaacttttgcatacttattttggttgaaaaaaatattttaagaatgattgcaccaaaactattttaaaaataaaacacgatttcagcgtcaaacatgatgacgctaaggtccgtttcgttgctagtggtggtgtggacacccttgcggccatggaacaatatagaagtgaaaggaggtcaacactaggagatgattgttgaccgttggtactaaggtatacacatgattttggtacaaaagataataaacatgtattttttatataggttcgggctttaacttataggtaataatgctactcttattgaccgaagctggtgctgtctttatatatcaatatctcacgagtactacaatatagaggatgacctaatctagtcataaagctctcacatgtgatcgacgaccagcgtagtctgctttggagcagtattgtattggattgtttagatatgtcttagcgtgtcttcgtatatcccctctcctcctagggtcttgtatttatactcttaagcgtcccttttcaagtagaactagggagccaagtatgaatacgatccgagtataccttgcagtgactaagtaagattttgtttctcttttcttatccggaacaccttccgtatatgaagctttttttttataggacttgtattaggtgggccccactgagtctaacacaaaagtattagagattggtttggttcgtggcttaacttgaccttaccaatttttgtcaatgccaaattttcacaagtttttgcatgtttactcttggcaagacaaagttctatttagattgaagccaaaatagcctaaattaactattgaaatggcctatttttctaggcttttgtcaaaatttggcttcaaaccaaatagacactaaacactattaaaattaccaaatattggtaagaccaatttaggctgcaaaccaaactagccctagatatgccttatccaagcaagtaacaatcatctcccaatctaaacacccatggatctggcagcaaggaagggacctcgaccaggagctcaacgagggcggccattgtccagatcatgtggtgccactgccgcctcaagtgctagcgccgtcgtattcctaacgcctaccaactcattggtcttccacatcactgtcgtccttgtcaatcttcatcaactccaatgccgttgcggcctcatcaagctctagagtttctggtcacaagtggaagagacgtccctctaactttacgtcgaagctcctctcattcctggtcaagtcccctattttagagaatcttttaccactatgttgaaagatcaataccaacgtgtcagcactgacctcttgttgatatcggcctccaactctcactctaggcaccacggcctctagctataagacattagacctctacgtcatttggcaattcatttttctaaataagttttttgcacgagccgttgttaaaatacgtcttttttttaaagggtgaaatcgtcaatatatcagacactccagacacgtttgtgacattcccaaactcctggtgaatacaacctgtccccatgtgctagcacacttgcctactaacatagagtctagcaaaaccacgatatatcaactcgtttgtagctgctacttctcctctcatgtcactattccacatgtctaaactctagaaaggggatactatgttggatggattgttgaccacctatgaggtttgctgctcattcctatttgagattgcttgtagatgcggcaaatgtacatgtagccctgtcaaatcctttgcttatccttgtttttggagtaagagttgactgtttgtataggggcaccacacgtacttgccgcagtattgaaattcactacggcactcatgttttcaatgcccatcttgaccaaatttctttttcaatctctcaggttttcaatgccatcttgacaaaagcttcttatttattcgtgtacgtcgggccgataaaaggacaaaagtacatggtttggtaaattaattttatttgttaataactgatataatttttactcatagtttgattgttgaaaaaatatattaaaaaatacttagtagttttctcgtagcaaaacacagaaaattacctaattactctcatgtttaagaactgaatcaacctggcagcagtgcagcgttgttcttgtggtggcaaacaagtaggatatcaactgtgccccagaataatcaaaggcatgctagtgcactaatgagaatggccactaataaattaatgcccactacaatgtatatgtgccatgtgccagaatgcacataccacctttcgtttttgtgtttcatgagaaagctaacatggtgctttttcagtttttttagcttgcatgtgagtcagatcagatgtagaccagacctaaaatgtcagaccatgagaactgtaaatctctttcaagaggaatcgagtcatcaaccaaaaaagaagaacaatgcaacggccaagaatgcatagaaccgcacatttttgtaagtggtggctcctccgctggcaaaagaacctaatgaaattagcccattctttcacccaaataacctacgtggaaagaaaaaatgtaaggtatgcattaagccattaagcgcggaaatttcctgtgctaatgggtaaagtacaaacacgcaataaataattttaaaaatattttatttttcgcatggaagaaattcctggcaaacattttccttttggttggcatggcataatccactcactagtcattgacaccacatgctttaattttgcgatgtctcaaccatcagccagtttcaatcctatgaaaaagggaatggggaaataaattgtagggttttttttttaatggcaacagttgtgaaattggccatcaagaacacttccattagttccgtaaggagaggctcatggacaaagagttaaatggatatctatatcaacttgaagtcactgtcctcatgtcattgtctcgagtgacactaatcttagccatataggatcctcctcttgcttcggcttctaaagcgatgttgagacttgtgagactgactagtcatcacatttttgtatgaatgaagtatatttaccatgccttttaggattccttgttaaattcatggatcagactgctatggaaggttcgggtagttcctacagtatatgatagaaagggtatggttgggagtttttctggtagttgtagctttttcccaaaatcaataactctctcaaacaatttagattttaagaaggtatagttatagaatccacgagtccacaaaatgaactagaagctaggaccagcttctcacttcctagattcctaccagctgcttctctccaaacatgcccaaagtcattcctgactatatatcagaagtgtgcaatttcaaatttgtatttttaagtagcatgcgccttattatttctagcagatataggaatagcagtaatttaaggctagtatggtttgtggcctaaactgtccttatcaacatttagcaatttatactatctatatagtttatgtccacgaacttttaaaactcaacatgcaggtgcgccacatcatcatccactagcaattattatctagattattttaaatcacatacaagtgcgtcacatcatcactcactagcaattattatctagagtattttaaatattatgatatatcatttacaattttattgtatctttagaactcaatatgcaagcagtgtgccaatgccaaatcattatctccacattatttcacattttttacaacatatacatctatcatttctataatgtataacatgcattcatcaacacatcccacggcgaaacacgtgatatcaactagtttcaatagtgtttagtgtctatatagtttgaagccaaattttgccaatcctaaaaaaataggccattccaatagttaacttaggttattttagcttcaatccaaacacaattttaccttgtcaagattagccatgctaaaacttgctaaaaattggcatcaacataagttggtaaggtcaagttaggccacaaaccaaaccagcccttacaaacatcaggatcaattgacacttcctggaaacttcatgttagttgttgtactaacatgtagcaaagtgggctatccaacatgatctagcaaagattagcactagagcaagatgcataaatatagacaaatattcagatggatagatcatggccaatcattttgtttaagacactggcatgctctgctaatggaggccctccatgcttaccggaatctcgagtggtccagagtgtttcatagctcacatttgcagcaaaagagcatgggaggcgtggcatcaagtgctgacaatataggagtgtattccagtaacaggctatcttatgatgtttgccatgctctctcatatttttattttattcccctctgtattgtcatagagaacaacctacttgccatttgtctaagaaacaagatgagtgcaataaccatgatttggttcattggcaaagacatcatgttccagggaagaaagtaagatagcataacgcaatactattcgggactgtaccttgttttaccttctactatcttgcatgtctgaaaacttttcgaagacctgactgggtcctattgttatcatgatactgcgccgttccaagtcgaaacctgaaaaggtggatatgccttttcatgattaactccagaatccagattcatgactaactgcagtcttacaatttactggacaagaatgttacatctcccaccaaaaaaatatatatattatataatcaagcgagcaacagttcggcatttttacgctattccgatgtcatgtgagcaatacctcccatccgattctctttactacttatttcttttcttaagctatattattagagctaactcacttgtcccaaattacttttcacaagttgagatatataatcagatcacagctcgatcaggcagcttatagataaaaaaagcatggcaaaatactggatgcagagcaatcacctgcatgcgttgcacaaagttcagctcccactcccctgccacatgtcctgcatcaaaagcaacagacaaattggagtgagaaaggacacatgaagccagcacatgacgaacttttggtttcagatcatacctggccttagtggaaatagcagaaatgataatgtgcatatggtatgtatggagcagcagcagctttcttaaccagaaaaatagcacacaaggaaaatattcaactcccttatgacattgatactccgtgttaaactaggctacatgagcattacaaggacccaacacaggcatgatcttacattctccaatgcatagtaccacaacactcatgtgtacattacaagtagtacattcatacaggcatggttacaaacagctacatggaatccataaacacaaactcaaaacttcagagatcatcttcagtggactttggccgttgcttgcctggttggtctgtgtacccttacctttggcctcttcttgcgcgccagcttacgctcaagcgtcttgaccttctcgctcagttccgtgataactcccatctgatcgctgccagatgcaagaaggttttgcagcatctctttcagcttctggttttcttcagcaagtttgttctcattgtcactctttgaactataaggagtcgcataatctgaagtagtttcttcagcaaccttgttctcatctttcataccatcaggagttgcagaagccaaggaagcttcttcagatgccatgttctctgtctgaacactagcatcttccttcggattatcatctcccagctcatcgcattcaacttcctttggcacctgcatgtccgcacgacgcctatcaacgcagcaactctctttctgcacatcggtttcgcattccggtggcgcatacatttcggaatcctcatgtcctgtgatgtcaccatgttcacatgataattcacttctctccgtctctggcaaaataggttcatccttcaattctctaggagcactttcatgagtatcagcttccattcccagtcccacaagagggggctcttctttcgcagaatctcctgtcagattgttagcggattcattttgcttaccaacaagtactgactcatattcaccagaaacgtcagattgctttgctgcttctggttccttcaggacattttgtcctgttgttgattgcaattttgatgttgtttgcagcaagggagactgcacataattttctgtgtctgcataggtaacatcaaccataccaatctctggtgtagcatcagattcttcggttgcatcttgtgtggtatccacattttcaacttgttgctgcatgttcacatcgctagcttcttctggctgctcggctgaattggacataatagaggatcctgaaggagcttgatcatgatcctgcagctcttcattcttcaaggatactgatgagtcccccgaatcaacaattgtagtgtttggttcttcacactgatctttttccacaggagcatgctcaactgcagcttctgtcacctgaccttcaactgggctgacctgtattcatggcatacaacattgatattttacaaattcaatactgttgtatgggtaaagttcaccatcaaagaaataagtacaagcaacttactttatcagctgacacactactttcaacagatgttgcagccatagtaatcatactgttgtcagcggcagcaggagaaatcattgaacttgatctctcactagttgtgcactgttgcagctcattggagttctctgataaagcttcatcatgtaacggttccatgtggtcccctgatggtatttcctgtcctccaacggggggtacatctttttcctattgacatgaagagtcaaattagttcatgccaaaatattgtgtgttaattaaaggactgcatttgccttgctaattagttttttactaagaaagtagattgaaatgcaacttactctttcacacgatttgtccattgaaatggcatttgattcttctatttgttgcttctgctcagtggaatgtcccaacaaagctgcatcacccatcacatccattgatggttctccttgacagtcacactgtgttgcaactttcccctattgaagatgagttacgtcagataccccacgagtaaatcaaatcaatctgttacatatcaatttgcaattaggccctccaaaggaacagatagaaattaacttactccattattaggcgcttcttccttagtagtatttgactcttctatatgatcactaggatctgcatcttgtgtcgtatacattgaaactactgatgaaactgcatcaggcatcaacagcttggagttgattgtggacaggccttgttcttcatccactcctgcagctttttcctgctggcaaatatttgttgaaattacattgtaaattagcatgttgtcatcatgtaaacagtaacaaaattaaggctccattcgaatctaccactctaactaaactactcccttgtctaccatgagcacatttcccgaaccgttaaacggtgtgttttttctaaatactttcaatatgtaagtttctttaaaaaatcaaataaatctatttatcaagcttgtaataattaatactacctccattttaggttataaaacgttttgactttggtcaaagtcaaaatgctttaagtttgattaagtttgtagaaaaaaataataacattttcaacccaagacaaatttattatgaaaatatattaaattaattatttaatgaaactaatttggtattataaatattactatatttgtttataaacttagtcaaacttaaagtagtttgactttgaccaaagtcaaaacgtcttataacctgaaacggatggagtacttaattaataatgtgctaacgacgtctcgtttcacgtgccgctgaaattatcagccaagatgcaaaaatgaacgcagcctaagttatagaatgctatgaagggagaagtgagacttactttctcagatgcttctattgctgagactggatctgtattttgaaaattattctccattgcctctggtttctctttttcaccatttgtgtgaatagactcgccagatgattgcttgcataaacaatcaagtttctcctgcagactaattagctctcgagcaacagacttcctagcctcccttacagttggatgcaagccctgtatcaacgattagcatcaccaaggtgaacaaccaaccaacatgcaattgtccataaaattgtaccacagtaatttaatcagaaacataaaatcaatctgaacagaaaaaggtggtacctgaatggtgtcaagcttcaggagtaaattcatgatagtctcattgatagccacttgctctttaacagtcagttgcttggaagaagcttcaatgccttgcaactgctccttcagatctttcatctgttcatttacattcttgatcatccggagtttctccaaaggttgccatcttcgcacattatatccccggtatgcagactgaatacaaactgctgcatctacttctgagaaattaatgctgggagttgtatcatagtcttttgcaggctcaccttgaattttcgcctcaccctctgtgtttttgtcagatccctgcaaattcttctcaccaacattttcctgagcatcaaaatttactccagtagcttgcaccttctggtcagccagactcatgggaaattgttcctcctgcatttgtttcacagaagcagcttgcacggtttcattgccatatgccctccctttattcatttcatcatgtgctttttctttagcttcagatacagttctctccttctttggatctgactgtttagcgtcctgtttttgcatatggatctctttaacatccttcttggctatatctgcatccttcctggttggtggactgggagaccttgaagaaccacttccagatttcttcctgggcaaaggatccacccgcaaacatacaggaggcaattttgaattctttgcttttgatgattcttcattgcttcttttaccattttcttcttccatctcagtgctgctggccttcttttcatctctctgcacacttgcctcaggcttcttgtcatcgctttctttcacaggcataacaggaataatcctgtaattaccaccagcgggtttgttttcttcattgtctttcctaggcatcactggaattgtcttgtaattttccctggcgggcatcttctcttcgctttctttcttgggcataagtggaatattcttcatttccctgccatcttgatgctcagtacctgcagactgcttcttcactgttgatctttcattatgatgagattcatccttcacagatggcttctgatcattgtgaccattttcaaaccatgacaagggaataatcttgatcttgggcgatggaggagcttcttcagaaacctttggactttcatccacctccttcagttcttttgcttcttgccttttctcattatatcctgctggcatccaaaatattggccactgaaattgtttagccttctgatcatcctgatcttgttgcttcacatccccaacccacttaccactcacaggaatccaaccattgtagaactgaggtggcaattccatgctttttttgttctccttatcattcatgttgccagaaggaagccatatagcctggttttggtaatttggatgtcgaactatatcagaaccgctggcatccctctgctcagtgtcgggattgacttcaggcctctcttcttcaattttaatattgctcctctcgccgccatggcaactatggtttgggcatccacagcaatggctcttgaacttgtcatagccgtatgctgtctgatcaacaggatacggcggtggacgtgcaaagtaagaagggtaggcattcgggtgttgtggaaaaggaccatggtaatacagatgaggtggtggaatttcttgaggggatggtagcctgaaactgtagtaaccaggaggatatgtgtggttgcagcagctatgaaactctggaggatgcaggtggttcatgttaggccaaggtccatagctcggcggtcgacaggacgagtccattgccatccgtggatgactaacttcccaacacccagaaggaggataatgtgcgtaaggagcgtgatttctgtaatgtgaatagtatggatccatgtactggtttgcaggatacatcactaactaatttagtatatactagtttgataaatacctagacctgccgaacaggttctagggctgatacctgaaaaaatacataagaaatatattactaccatgctgtgtagccatgaaggacctaaattcgcattatcaaaagctattagttgaaaaggatgttttactttctgaccataaataagaactagcgaaactacattcttaagcaccttctgatcagattttaaattaaaacacactatatgctatccaagctatcagtcgattattcactattctctctcgtgcggatttattggtctgtaactatcgcagtttttatgtcatttgttggtacacaatactattgtcttgtgcaagatggtttagaaaaaaatgtccctaaaattatcgagaaacatcatgcacaaaatagaaacatggaaaagcgattccacagaacaaattagcattaaactagtgtatagtaccaaattagtttcatttcacctagtactctataagaagtttatcacaaataccaagaacaatattatcagttgctcctatcatgtgtggttactggtcatgtaaacatcagtcatcagggagcattcggtctgtcaaacttcaaataattaccagagcactcccccatcacttatctacaagattctgctaccttcttccattttttttaaaaaaaaaaacaccaaaaaccaatgttctgtcacgggaatgccagaatttcagaaaaaaaaaatctgggctaatcgcagagaaatccttttgaacgcgttcgattccatcaatcacccggttttctcgtccccaaaatgcacaccgatgccaattgccatccatcgtaatcagtcacacactagtactaatcagaaacaacagatcgtttggctcatgatactacctaccaactcacgcgataaagcacaacaaccaaaattacgcaaaaaaataataataataatgcgacgcgaagcaaaaaggatcggaggggactcacagagcagagctgcccccgatgtgcggtgcggccagaagataatccgagacgaacaaccaccaccaaaaaaccttttggatctccacggggccgagtgaggtcagctaccggcgcgcgatgcggtccgcttttccctagttcgtcgtcgtcgtcgtcgttggcgagcgcgttgcttcttcttctgtatgaggaggaagacgagcggatccgccatttatgcggcgcgggcggcgggcggagggcgatcgggagatggagaggagagcgttcgcgagtgttcgcgaggaaggtgacgactcgtcgttggcgctcgttctggacgcttccaccaccgtctccctcgactcgaggaagatgaccgacctgtggggccgggccgatacctgggcctggactgcaggaatttcatggggcaggcctaacacgtttatttaatgggccggtaaataggagcttaaggttttgcataggaataagtccattttgcctccctcatctcttgcgcttggttgaatcgcatccctcaaccgcaaaaccgggtgtaatatatcccccaactcccaaaaccgttgcaaatcgacttcccgggcggtttcggaggcggtttttgtcccacgtggcatctttgaccccgttgaatggctgagtcatcaggtgggacccacatgtcagccagccggctgctggtgctgcgtggcgacagggtggccttttcctcctcgtcatcgtcgttctcgcccgacgccgaactcgagctggcggcggcgggctggcggccacgttccgcatcccgccgcagctagagtgcacgcaacaggctgggagggggctagcggcggcgttctgcatctggtcctcttcgtcgctgtcctttcccgcctccccaatcaacgccgcctggtccgcacggtggcgagcaacgatgacggcaggaaccccatgggtgtcaacacggggtcctcgatggtctagcgatcgtcgtggaggcagtgtgcggaggcgatgatgtacgtgccggagatggagaactgtgccaccttgacgctgagcgggctggcgacgtcgacggtccacgctgtgccaccttgacgcccagc

SEQ ID NO: 57981 - DNA, 8353 bp, Oryza sativa
aatcagatggttcagctcccttgcacgctcagtttcaacctaatggtttttacttattggcagtttggtagcagagaagtatactctatgatagtattagaagatagcatcatctttggcaggtccagtagtataatgtgacaacgattcctcgatggttcattgtcattgtgcgtgtataatattgtggaatccaatgtgtgttttgtcagtgcaagtttcgcggataaatggatgatggtagaattttgccagtcattttctgccggtgtcaaaaaattctcttgaatgtgaagtgtggaagaatgtcttctctgctagtctgtcctctcttcattagatatgatttgccttagggcaaaagtctgtaactcaatgcttgtactattaaacctctttaatcttaatggaagatacaggtgggaatctctcccctccggtgattatttcaaaagaaaaaaaaaatctcttgttgtttccaaaacttagggagaaacaacgggcatgatgaattcgtaaatataagggcgaaaggatggtgagttttcggtttggtttagagaatttgaaaaaaaaaatcagaagggcatcgaatttgcatttaatctcatggtgaaattcaaaatttttgctggaaaaaaagacagcttatatatagggcccaaccgggttcgaaccggtgacctattgatctgcagtcaattgctctaccactgagctatggacccattttgacatcgaagatctttataaattcttacattgagcgtactccaaaataacttcgcaaagtagctgaaccaaaacaaaacatttcgatgtctctcctctctcgaccatgataaattcaaatgcaaccaattacacaattcgaaatttaagaaacacgaatcaaagatcctgaaccattacacccgagtacccgatggccggaaaagcagatcgcattgtataattgtattagcacacttgattattttgcaccattggcgacggcaggagaaggcagcaagaacttgagcaggatatcgttgaacatcttgggatcctcctggtgcgccaggtgccccgtgttcggtattatcttcaccgtcgccttctccccaagcatccttcaaattcaaattcaaatttaatttcattcgattaattgttaaggcaaataggaaactgacgaaatgatcatatggtaattaagatcaaggcttactctttcactttgtgtgctttctccacagggaaaatctggtcgaactccccccagatgatcaaaatttcctgcaaattcagattacgatcattacatctgaatgttcagtcaatgcagtgtgttatcagttggtgttttcttcttctctgaactgaaaattttacgcacttgagggagaggagaattaagctgcgagtcttgttcctcggtgacgatctctttgatcagccggatcttctcctctcttttgtccgcgaaatatttctgcaccacacgcagtttgcaaatttgcaaatcaaaatttaacgaaaaagttatctctcgtttcttaatttctatctgcatccaatcttctcggtgatatcatacagttgaaacacaatttctgcaaatccgatcgaattgaaagagtcagggcatgaatgcaagatgctgacgtcacgctcacgccatggagacgagtcctaacctttttcgtgtgtaaatgcaactatttatatttggcgggaaaagtgcgatatgccggtgggtgatatgatttgccaccaaatttgtcggtagaaaagattttaattggacgatgtttgtatgattagtcatctactactagtctactagcttttgggacaactcgccaacaaatccaaaaattcctagcttagctaagagtccactacactatcatggcatccactgcagaatacgtaatgagaacggtttaatcattcggtggacgtctacccattcaactaaataattatgaaaaaaattaaaaagaatgataagatagatacaccactctcaaatttaaattcaacttctataaattataatagaaaataataaatttgttattaagttgtagttatatacagaaaacaaatataaaccttcatgcctgtgagatgatatatctcatattaatttatctcattatcttttaaaatttttataaatatatttagtcgacatgcaatgaacgggtgaacattcacccgggttattaaaagagttttcgtatacgtatacggtgaggtacgtatacgtatgtatgtacgtaggtacccggaggaggtcgcggacgaggaagtcggggatgtacttgggcgggcggtggacgcagagcgccatcagccgccggaacgccttcccgtccgccggcgccatcagctccgtcacctccgccacgccgcccttcgccgccagcgccgcgtcgtcctccgcccccttcgccaggtcggcgtcgcacagcaccaccttccccacctccacctggccgtcgccggccgacgtcgacagcgcccgcgccaggtgccgcgccaccagcccgccgtagctggtgcccacgatgtgcagttcccggcgttcgccgccgaggcctgggaggtgcgcgccgccgctggtgaggagcgcggcgatggcggctgcctggaacgcgtcggagcgcggcgcggcgctggtggtggaggcgccgaagaagaggagggtcgggaccaccaggtcgaagtggcgggagagcgggcccacctgcgcgccccactgccacgtcgggtccggcccgaagccatggacgagcaccaccaccggccgccgccccgccgccgcggcggcggcggcggcgccattcttggaagggaggatcaggagagaggagtgcgcccagaagtggagcgtcgtgccgtcgtcgtcgacgacggcggagcctggccggaggccggcggaggcgaacatccgccggaacatggcgctgatgagagacacggcgaaccccatggccgccgctctctctcgagagctctgagctgtgtctgtgactgaacgatcagtttggctccatgaatatcgaatcgtcgaaatggatttaaaattggatttataatcacctgctagctgtaaatgacttagtggagaataataaattcaaattctacacaatatttttctccccttttttctcaaaaggagtttgaaaattgcagtatattctctttgctggcttgctgcaaccacttcaaagaaaaggagagttcatgcattgctactactacaagtacggtgctctgataagctctcactacctaacaggccccacctgtcagagagcgagactgtctaacagtagtagttagagtgggtgctttagctagctagtgcgatgattagattagctagctaaagcttctagaaggttagtgagttgggccggtgaaagcggaagcccaccagaaatcagttagatttggatcttctggtgttaggcccggcccattatgtaggatggcccaattggagtggtgggttgggcccaaatgctgtcgtctctaggcccggaccaggaagctctgcaacagcttaatcgatcacccaaaaaaatgattcgaatcattttccagcatctccgttgatcaacagcatgttgaattaaagatgcttaaatatttacaaaagttaaggtactaatattagcggtagttgaaatgtggaattaattagccacgtagtcgcagtcaagtataattctgcagtaggtgtgatacactgatacagtgatacaacatgcgtaagcatgctgatcccagcagtacatatataaatccggattaactagctgatgacaattagtagacatattagtcacatttcacgcatgcacggatgtaaacagtagggttaattaagcacagttaattaagccactaagcagaatacatggcatgtagatacaacaaattaggtggtgtaattagcatatatatgcacctggggcatgcaggtctctgcaggttaagttcaattgttaatgaccacatgggcagctactttgatttaactagtgtcattctcagctgcacctgggcggctagctagatcaatcgatcaaatcgatcgatcttacgttggaccaaataaagctgtaaagcaaaacgatgatttggagattaattatttaattatatattggctaaaaagttactaaattttctgtagcatgttggtataattatcttgtgctgcatatgcatacatgccctttctgaagaatctatcagctacccatctatgcagtgttgtgtgatgcatgcacaccatgcatgcttgtcgattgcactagctagggggttaaattagcaaatgatcttaagatttgctaatccatggatgtgtgcgagttaattagtggcggaaaaagaattgtttcaatgtttcaaaggagtaattgtgtatgatgatgaagacaacactaattaatcaaatcaaggtgtagaggctgaattagaactctgaataatgaatttgacctcaattctacaggagaggaggattctgtatatcccaaaaatctagcaatttcatacatatttgaacaaatatataagtacagcagaattcaaccgaattacaaaatcaacttaatttgaacatcatcacttaggatggctggctaggtagcttctgattcaggctggctggctgcgagctgagctagtaatcaactagctaatcagtaatcacactcaagatgatcatcaattactcatcgagctctactcgtcgaataatctgcacggtacagctcgcaatcccacgcatcaacgtcgagcaatccggggacatcgacgagcaagtcgaggtcatcgagcgcgaggaggtggaccatgtcgccgtcgccgtcgacgtcgccgccggagaagcagtagtcacgggaggagtcctcgccgccgccgttgccgccgcaggcgctcacctcgctgatatccgatgaaccggcgttcggcggcgactgtgtggtggcggtggcgccgccgctgccgcctccgtcgagcagttggcaggagaacatcgggagccgcgccgggataggaggaggaggaggagatgccgcctccggcgccgccgccacggtggccgcattggccgtcggttctttctccatgaccgtggccggcgccggctcgcctttagctccggcggcggcggactgacgcttcctgatgcgggaattccagtagttcttgatctcgttgtccgtcctgcccggcatcttcgccgcgatcaccgaccacctgcagcccacacatatcatccatgatcaaatcaacactgataactaaatcgaaagttcagctagagaatcggattaaccatgaaaatgaacacggatttcggtactgaaactgaagagaacttttacttttacggtacactatactgcaaatatatactagcagtatatacaatctaacggtgtaaaagtcctccaactgaattgctacctgttgccgaggagtttctgcagggagaggatggtctccgcctctcgatcggagatgggctccttcttcaggtcaggcctcaggtagttcatccacctcagcctgcagctcttgccactccgcctcaatcctgcacaatggaaggaatgcaatgccaaccttgtcagatcaagaaaccaaatcacctgtctagcaatcagctgcagagaaatcaatcaaattacaagctagacagactatcgaagcatgattaattaagttaggtgtcaaatgaattcttgcctgcgagctgagcgactgagctccaggtggagacgccgcggtgggtgatgtgggtgtagagccgctcgtcctcctccggcgaccacagccccttcctctccttctcctccgccgcgccgccggcggcggcggcggcggccgcctcgccgtttctactactcgtcggcttccgcaccattcttgagcttagctagctagtactactcctgctgatgtctactgtgtgatggagaattcagagagaaagattagcagctggagcttacttagtatgtgatgattggatctgctgaagaatagactgcttacttaagtgagcctatgcacacacacatatatatagtagatgcatatatgtgtataaataatataattaattaattgtatatacaaatatatgtgtagctataggctactgcacattgccctacctgtaggagaagctagggaaggggggcaggagtatctgtacttgcatgcatgtatgaacagacaaaacaaatcctgtgttggcattgtgttaacctgatagtcttattatattctatgtgtttgtacccaagtatggtcaaggtatcccatgaatttgttgtactcctacattaatacatatggaccatgtgtgtgtagttctaggtatatgtattgtgatgatattctgaacatatccatcatgaacaccctgtgcatgagcaagactgcacgcaagtactagtacttggcttgtgtaaaggcattctaggtctttgagctagcatgtgataaattgtttgtatctgatcgagtatttcttttatcatgtatatatagatatgtacacatgcgattagctgctctgaattctgaatataggacttatactgtgtgcatgtgtaggcaggacaagattgtggtggctccaattagcctaatttggtactaaacctctcattaagtacttgttcttgcaagatgattggtcaaggtatcgctgaatccaacatcgcaactgctcatctctactgttacggcgccattactaccaaattacaacttggtatacagcatctagatgcatgcatgcttggcattaattgattagctgcagggatggccctcgaaaacataattaattaaggtgacactgaaaatagcttaagatcgagagggcacatggttttagtttctgaaaaggacgggatatattattttagaaaaaagattagacaaatttcaattattttagtgtactaatccaatagcatggcaattaagagattttaatatttctgcatgccaatttttttaatggaacatgcaagtcatcagcatcgatttatgctttatctctttgtttttgtgtgcatagtgcaggaaattatgcagccatgagccatctatctggtgcaggcttgcaggacatgatacacagcttggtaggagatcacatcaaggacggcaagggtgtggatgagtggatcccctgtagttgccttcaaatccaccaggtggatttacttaatccaagccgtccctttaatttgatggattagattaaaccaatcccttctcccatggttactactagcctattttctttcaaaagaaatataatgtagagtctataaaaaatataaaaaaacattatctagtatatagtagagaacatgttaccttcaaactttctgataataattagataagaacaaacaaaacaaaaacattgcaccagtagaagcttcatgttctgtcaattattaggatgaatgagtttgatacaggtctcaataccgttaatttcataacaactcaattaaaaggtttaaagataattattttttacaccatgatgctcttctgagactattgatctgaatggacggattacgaaaaaaatagattgaattgtttctgttataaatgtgtaattggaaagaggtgatatggctacatctagcccgtagaaacaaagtaaggggtcagattggaccaaattcaccggttggagttggaagccaattaactccacggggatctgcacccgtaaagtcatgtactatatagcttacagagttggtagtttttatctagtaagttcaatgcaaacaacaatgaatgattagaagaagtacaactccatcccatataattaagtaaactaaatggtctatctaactacagtgcgttattgaatttgtgcaactaaccaccccgaaaggactcttgactatacataggtaccctcctagtcaaaaaatatgagaaattatccaatggatgatcatatagatacagaccctatagtaccaaaagaccacactagctggccatctgtttgtcagctactacccctgatcaaaatgctgtcaattttaaggtcacaaatgggctggacagttggatatattagctaggacccaactattcccatctactgtaagttggtgatccctgtaggaagagacagaaagcatacaccctgagagccaaaattctttggcacattcagaagatgaggttcatgcataggccggccatcatgtctaattaagctaggtcaataacctacttcatcagcactactagaatttccaccatgcaagtcttg

SEQ ID NO: 57982 - DNA, 10142 bp, Oryza sativa
cattgaatcaggccattgaaaatctgaaatccaaactggagagcattgctaaggagaaatcgttgcttaaatcatggtttgctgacctagagcaagtcgtggagcgaggaaggagaattttccccgaatagccggaattccgtcagaaaaaatcatagcttgcatttagcgaattagaacttttttttcttcttctaatacaccatgatacacacttgagaagtcctaccatgcatcagcattgtacttttcctgtctgattcttttccttgctgaggcgatgcatggtggtgatgtgctgattgcctgcgagtcttttgcgcggaacgtatttccctcggcaataaaatggttctaaatccatgtaacttgtatatgagcaagcaaaagcgatcatggttgtttgaatagtgctttagcacagacaaaagtagaagtataaagtcttatactattattttttattcagttacatgtcagcttataagccgtagaagccaataccctgttctgtttagctcatcagctgattaactgataaattaatacatggattaattaaatatgatatattataaggatttttttaaagtacccttgagcggatgtgagccatccgttagaatggattggatgggtgagatctaattatactacaccttgatagcaggtgtagtatgcgtagtaaaagggcaattaagaaaaaaagaaacatggcattgttgtagatttgtagttggcgcgaggttagtctgtaatctattagttttcatttttcagatgagatgatccaatcattagtttatcacagttttagacttttagtgcacacataaatatcgtacagtcaagtaatgatgctgctgtatatggagattgcatccaactcagactaattttgtaattgctgtcagtggatttataatttacaaatcactgaactagtggactgtagttctgttctgatgaaaaatccataatcttaacaagtagagtaacaatattaatccactcaacagaaaatgtatatagaaatatatcattttaattttaactaaagagaagaatgtaatagtaatatagaagtacatatcagtgaacagatgcatatcaggctatcagcatatgctagtgaagtacatagatacaaatccaaacttgtcaattgtcggttatccatttgggaggtacagattcatccagtagatttgccgattcacgcgagctgcgaggcggaacgacgagaagcaggacgtcgggcgcgagatggggcggcacggcggcgggcggcggctgcctagcgtagagtctcaggagaggaagggcgcagaacgcgacttgggcggatcgaacctggcctgtgttgacctcgcgggagcaccgaaataggctaaaatgccctttcccgttaatgttataaaagtctaaactacccattacaatcaatggttagatttgatttttactacactactaccttctctagtgggggcaccgtaaaaggaccatattataaagttaaataaaatatcatccgcactgtgtttttttaaaaaatagctgataaaaagtttttgaatttttgtttgaaagtatgacatgaatgatcatgcattaatcaaccaaaaggaaatgaaaacagacaaaaacaatatcatttctacataagtggttatggattggtcatgaatttcttatatttgacaatttaattatttactaaccacttgcaccgataaaaatggaaaaaaatgactaaaatcaagagtagttgaaaatgaaaatacttttttttacgaaaatgatactcgatcatttgggaatttttgtagcctaagagggaatataaccccttaggagggtcttctagtataacgaatctacataaatgtagattcgttgtattggatgtgttatattatttctactgcttcgtagcaatattgtcgtacactcaactcaagtgatgtattttccatctgtcaaaacgctgagcagcccagcgtggatacggaacgctaggtaagcaagcgctccctgcgtctgcgtgcgccgaacgaaagtcggaaagaggaaaaaaacgctaaccacgactccgtctcttcccccaaacaaaaaccaggtgaaaaaaagaaagccgcgttccccactcgccgccgcgccaccccgcgacgccgctgccgccgcggattccttcggcgccgccaccgccgcggtaaggtaagccccgccgcactcccgttcctctcctcccctcccgaagcctccgtcaccgctcgcggtcgcggagataagatccatttggatgaacagttcatctacctttgttccaccagttcagtataggtgatgcccccccgcgccgccagtgagcatcgagaggaaattttagctaagctgtttgtcactcgcatggtgtagcttgcgttggtcactatattaccctttttttttcattgcgaatggtgtggagtgggtttaaaactaggtttgagcatttgagaattgacatgttgcagttcctaggatactacttgtaagagcatttcttgggttttctctggttggtatggtacctcagttgagtggataacttgggttgattttgttatctaagtgcttcgtattcgtttaacaagaacttgttcgtatgctcctcatacatcatggactcattgttcatgctatagattactgaaactggatttgaggctttgagctgatcttgaattggggtgcattcatgtttggctgcagagatggacagatttgtgcgagtttacagtggcggggagctggtgaagggtccaaacggggtggagtttggcaacctcgccgaggagggtttatggttcaaggcgaagcctgcattcgatgaactgattgatgccgtgtacaagaagctcgggtgggtgcctacgatgctcagcattcgtgcgcagggaaggttgaacgttggtggtggtgctcatcggcacttcatcatggtgcctatcgatgatgacatgtcatggagtagctatgtgaaagctgttttcaatgggactgagtggaactgcctagagatttttgttcaagcaagaatttgttccttgacagagggcatatcctcagagagagcactaatggctatcaaaccgctttatgcacaacgtcaaaatggccaaccgcagaatccagaacaggacatgtcgtttgttatcccttcaacggtgaatgttagtccactaaatggacatcctcagaacacacggcaacgaaaaccaagaaagagcaccaggaccttctctgatgatggttgtccagatcagaatggagcttcagaagcagttgataccacttcctatgatttaattgggcagtatgatgctgatcatcgggctcgtgctttagcatcaggccaggtagatcaaagagtacctatagcatttatattacaatcttttgtcgtgtaacaaactgttgatttgcaatttccaatgtttggtacagcatttgactgagctcaaccctcgtacccgtgaacctcttcgctttgacaggaggtatgagcgttaccttaggcccgctggcctgatgggactggcaaacatttgtagggctggtctgccctccattgatcgggcactcgtctctgcactagttgataggtggagacctgaaactcacacttttcacatgccttgtggtgagatcacaatcacactacaggatgttgcaatgattcttggattgccaatcgctggccatgctgtcactgtaaacccaacagagccccagaatgaattggttgagcgataccttgggaaggctcctccgccggataggccacgtcctggattgagggtttcatgggtcagagctgagttcaacaattgtccagaagatgctgacgaggagaccatcaagcagcatgccagggcatacatccttagcctgattagtggtctgctgtttcctgatgcctctggtgatttgtataccttctatccctttccactgattgctgatcttgagaatattggttcatacagttggggttccgctactctggcatatctctacagggcaatgtgtgatgcttgcaggaggcagtcagatggaagtaatctgactggttgtcttttgctccttcaattttggtcatgggagcattttccaattggcaggccagacctggtgaagctaaaatacccaaatgtggaggagctagaggatgagagggatagacccacagttggtttacgatgggttgtgggggtgtgcgcccgtcgagcagctcccgcacgttgctatgagcacttcacgaatgagtttgacttgctaacggatgaccaggttgtttggtgcccatatagggaggaacggatgaaggaactacagctagcccctatttgtacccaggattctcatttgtggctaacccgagcacctctactttacttctttatggtggagatctacatgcctgagagagtgatgcgccaatttggcctccatcaggtgtgcccacctccattgcgggacactagtgcggagcttcactggtatcttcaaaacagaactttgctgtttttattcttattatttcttgtacatgactgtgtgtcctggtaaattatagaatcatctacaggtagccgaatcataaaattttctaatgttttgcaggtgccgtcgtggaagggttcataatgactgggcacagaagcacaagtcttttgtggatatgtgggaagcaaaggagcaagatgttgtcatggaagaccggccatatgaccacagcagttatatggattatttgcggtggtacagaagatcaacacgtattcgcctgtgcacaccgaagaggataagtaatggtcacaagggtggggcatctggtgggagtgcaatttctgattctgaagatccttttcgtgcttctcagcttcgttacacccccagggctcatttgatccactcagtggtaagacatcctacttgtaaaataaatcatgctactaccatgcaggtgtgatcgtgtgagcttcattcaggttaccttcttttgatatttactagccaaatacccatgcgttgcattgatctagaacaagtatatcataaattctgaacttcaaaagctgcatataattttcaattgaacatgaatcactaaataattctattgcaaaccgcatgcacggattacataattattttgtgaagatttttcaactaacaagaacacgtatgcatgtatctatggtgatgatggttggatgatagactcgccaccaccagcaggatactttgatatatctctgaaattcccatcgtttgccccagaccgacaaactcactgtccttgcgaaggaggcagcttctcaaaaaagttgctctagaggcaaatgccgtgcttttgttgaccaagtcaccagaacatgtgtagaagttattggggaacttggtggatcatcactttgcgacattgtggatctggttccatgctcatcgactgctgcaacaactgcagctgaaccagaggcagagcaacagagggataaagaggaagatatacatcattccatggcgcctgatcaggaaactgagtctggcctcggttctgagaagcgatctcgatcacggactcgccgcacacaggcagacaggacagttcaaacaagatcaaccggaaagaggaagaggggcagatcaggttcgagatgagaattgcacggtgagttatttagcttggtttttctgctctttctggataatcactctacatttcctttagttttatcgtgtccatgctgcttgtttctttcatggttaagccattttaaatttctcatggactgttatctgcttgttctgcttgaaattacagccccgcggtttatgtaccataagaagctgtgggatgaaggaacggcatggtgctcaaaccagcttatcatttcatgaccctccacagttgaagacgaacaccattgaagacaaatttgttcttctagacagttgtaggatgacattaggaaatttatgcttgcatgctatacagtaattatttcagccattttgctgtcgatggtaatgcaaagccactcccagacatggtcaaattctgaactatggtcactcccagacatgggtgatgtttgttcctggtgtaaatgagctttgttcagatggcatttgagctttgttcagcgagcagcctttggtttaatatacacgattcagcatttcagctaaggtgattgtcagttttagctgaatcatcatgtatggttaaaactatcatcattcattcattcctgatccattcagttaccaatggagagcaggagtggaaacggagttttgttctgttattctgtcagtgaaagcattgaactaccagttgcgtcaggaaatgtattcagagtttcaaacaaaccttagctttaggtaaaccgaagactactcataagtcataatcggtctaaatttaggagtaaagtttatgcatcataaacgaattgaactgcccataatcatttataaatttaaacttcttgaagtgtccacaaattaattctgaaccatctgtgtttgttcttcttttgcatgagacgctctgatgcctaaaagtctaaaacccctccttgacaaggtcagtgtccacgtccctcgccgccgccacgctctctcgtctgcctgaacacgctcgccggcgatgtcccgcccgcccccctccgccgcccgcgtggccctctacctccgccgcgcccgcctcatcgactcgctccgcctccgcctccgctccccttcctccccgccgccgccaccgccacccgacgaccccgtcgtcgcgctccacgccatccgcgccgccccgacgccggcgtcggcgatctccgtcttccgcgccctcccgccgccccagccgctcccactcttccaggccctcgcgtcccgcctcgccgccttcgccgcgctccccgacctccgctcccacctcgcctcattcctcttgcccccgccgcctctcgcgcgcctccgcctcctcgccgccgcgggcgaccacgcctccgcgctcgacgccttcgcctccgtcccggccaagccgcaccgccccgccgaggcgcacaacctcctcatggggctccacgtccgcgcggccgaccatgccgccgccgtgggggccttccgcgccatggtccgcgagggcgcgctcccgaacgcccgcacctacaccgtcgtcatcgagcacctcgcctccgcggggttcgtggaccaggcggtcgaggtgttccgcctcctcccgtcgctgcgcgcgcggcggaccacccggcagtacaacgtgctcgccgaggcgctcgcgtcggcggggaagttcgaccagctccggtggctcgtccgcgagatggtcgccgtcgacggcgtcatgcccggtccgcaaatgcgcgccgccatcgccgccatgagggaagcgggacacgcggagggcacggaggatttcgtcgaggagctttcacccaacgaaagaatcggttacgccgtggacgacgtcgacggcgagggagatagcgacgacgaggaggaggagggcgacgacgacgatggcgtggacggtcgtgacaagggcagaggcagagcgacactgaagccatggctggacccgcgcgagctcgcgagggcgctggaagggtgggagccgagggaggtggccgagctggaggccgccgggatcgtgtggacgccgcggctggtgtgcaagctgctgcgcgcgttcaagaaggcggagacggcgtgggagttcttctgctgggtggcgtgccgccccggcggctacgcgcacgaccggcacacggtggcgaggatggtcgccatcctcgcccgcgccggccacgtcgagctggtggaacgcctgctgggcaaggtgcgggccgacggcatcgtcctcccgttcgccaccgtgcggctggtcgtcgacttctacggcctctccaagaaggccgacgcggcgatcagggtgttccgggaagccgactccatctgcggcgccgtgtcgaggcccaacctggcgctcttgtgctcgtcgctgctgcggacgctggctaaatgccggagagcggcggacgccatggagctcctcgaggagatgatgtcgcgcggcgtcctccccgacctgcagacgttctccggcctgatggagcacctcgccggcgccggcgagctcaagggcgtgcaccggctgctcgggctggtgcggcagtgcgagctgcagcccgacgggtacatgtacagcgtgctgatcaaggtctactgcaagaaggagcgcgccgcgctcgcgctgaagctgttcgacgaaatgcgtggcgccggggtcgcccccgacgcgcccaccaaggcgctgctggtgaagagcctgtggagggaggggaagctccgggaggcggcgcaggtggaggagaggtgcgaggaggcggccggcgacggcctcccggaggcgtcgccggggcacgtgtggacggcgagcgccgccgacctgaagaaggtctccgacatctactacggctgcttcactcagcctgcagcacagacagtcagtactccatagatgattccctttggtatcaagatagcaaaatggccatgtcaatctgattgttcatgacaaacgggaattaaactgattttgattttgcgagaatccaaactgctttctacaaaattgttgcaaactgacaaagcagcagagtatcaggcaaatcggaggaatgtatggcctggtttagttccccagcttttttccctaaaaacgtcatattaaatctttgaacacatgtgtgaagcattaaatatagataaaaataaaaactaattacacagtttgtagagaaatcgtgagacgaaatcttttaagcctaattagtccattattagccataagtgctacagtaacccacatgtgctaatgacggcttaattaggctcaaaagattcgtctcacggttttcagtcgagttatgaaattagttttttcatttgtgtccgaaaatctcttccaatatcgagttaaacatccaacgtgatacccaaaagttttctttgcgcaaccaaattactataaacacaccctatatatggtagtataatataggcttcgcagatggatggtttggggcccagtacaggaggaggcccaaatactccacggcccagcagcccagcgtctcctcttctgtgatttgctcatttcgttccccaaacagggcgccccagtgtagcgcgtcaccgtcgtttggagaaaaaaaatttgcgaatccaatttcgaatttcaatttgcgcgtcgccgtcgtctccgcttctcctaatttcgaattccaatttccaagcaatccatcgcctccacctcctccaccgcctccgcctccgcctccaccgatcgaggccgccgtagcttctcgatccgcggggagctcgagctccagcacctcggcgggcggcggccaccggaattgccgcggaatccgcgcgcgtcgccagtcgccgcggcctccccgtcacctctaacccctcccgccgccgccgtccccttctccgcagcttcgggagccgccgcggcgctctctcatctcgtcggtgcgtggaccgcggcccgcggcttcacccacctcttcctgaaacttcacgcgcttacactcatcgtgcccatttcgcagccgcgaggttagattgctcgtcgtttgttcactatgctgcaatggatgggtggttcgcggaggaaggtgtatgccgtgagtaccccagatctccctccctccatctctctctgttgtgcttcctcgcaattagtttgggcttggtttccatcattttttactgaaacagtgaaacggttggcgtgtaaatcatcagagcaatcgctgcatttagcactatttgtcgtgacaaactaacattcggtcatgtttgggcgtctgtgttatgcatgtttgttcctgaattgggagcagtccaggaaatcaacgcagagcaggtaacttagtttcgatggcgccatcaagttatgttgttctgctagttaacatccttatgttgatagaacaatttgtgctactcttgaacaatgctccgtaggcagaggcagtactcttgagcaaaag

SEQ ID NO: 57983 - DNA, 11423 bp, Oryza sativa
tttgcttattggaatggatacgtcaagttgaacaagctgtcctgagcttgaatgatatacaacattatagtacttttatgattcaattattgtaagaccgtggttctaaagtgtgtgacaatactaggtaacgtaaaaagttagtacataaatagacgtgtttcctgtccaaattactcaacttcggtctgtgttttgcagccactactttgacaagctggcatctcctcgttacattttgctctcttcacgtggcattatgtatgaagctctttgagcacaaaccttttgatgcaaggactgtcatgggatttggtgtgctcaatggcatttcaattggtcttctcaacttgagtctaggtttcaattctgttggtttctaccaggtaggcattgtttttgctctgtcctgatcaaaacttaacaggctatcatctggtagtgttgtacttaatgtccttctaattgttggtacccctgctgctattttttcactcacaaacaacggcttaacaaagagggtttcagttaaacttattgcatgttgtgagatgcagttatcactccaccttgcacactaaccactgcaccaaggtcatgctaaaatgctgaatgctctttgttttcagatgacaaagctggcaattatcccctgcactgttatacttgagactcttttcttcaggaagaagtttaggtttgtatttaatacttcatgtcctttattcagtttgataattatgaagtttgtatttaatacgtcttgtcctttatgcagcttgagaaattatcttctgattttttttttatttttggctttactgtgcagtcggaatatccagctctcccttagtgttctcctttttggtgttggagttgcaactgtgactgacctgcagcttaatgctgtgggatctgtcctgtctttgctcgcaatcattacaacctgcattgctcaaatcgtatccttttgacagcaagtgatattttcgtttatgaaacgttatatgtttgccaaataatctgcacatcaccatctaaagaaaacagtccacatgtattgcacatgtagctggtttattactaggatagatgttatagtgtatatttattcatatatacttcttgtgcacaatgctgaaatcctgaagcaccatttcatttgagtatagtattgttctatggtgtctgatttgaatccttaattagctatcagatgacaaacacaattcagaagaaattcaaggtatcttcaacacagctgctgtaccaatcatgcccataccaagcattgaccttgttcatcgtcggccctttccttgatgggtttttgactaaccaaaatgtctttgcttttgattacacatctcaagttgtggtaagcagtaaactgagttttggagacttatgttgaacgtagctgtgcttcatctgactcggttctttacggtatctgcagtttttcattgtgctgtcatgcttgatatcagtctcagtgaacttcagcacttttcttgtgatcgggaaaacctctcctgtaacttaccaagtgcttggccatctcaagacatgcttggttcttgcctttggttatgttttgcttcacgatccatttagctggagaaatatacttggaatcctcattgctgtgattgggatggtatcgtactcatacttctgcacaaaagaggctccaccaaaacccactgaagcctccccacaactcaaccaggtacctagtttaatagttttgtcttgtgtcttaacactggatattcttgtcatgttttgagcagaaaacattctctatagttcgaatatcaaaatctgatgaatgttgtggattgtgatttaggtaaaagaaagcgaatcggaccccttgatctcggactctttgagcactgctgaaaatgggggcaacgcaggcgacgacgaggctctgaaggtacctatgtggagctccaagtactcaaaggcatgaagaaactgctctgatgatactagtgtatggttctatacagagttcagcttagtaggcagatagtactagggttggaaggaagccaaccctgagtgtaatgaacgatgtctgttccatttttggtcttttttttttctttttgcttaccatgtggtgctgtcagtaaatgaaatctcactttgaagaggaaattatttacctctacactccagatggcagattggccttaaagctagacacaaaagggctagatctctttgtaatatttttcatgtgttcaacttcagcatctgcttcagcattgtaacaacttgccagcaggacataatatcaacacgtagtttacattcttttttgtacccgagtgccaggtggattcaagtttgtggtgaaagatgatttattttgttaaactttaattatctctagtagcatgagatgaaaagaacagcgcgggccgcaacgtttcgcttcggcaaatttgcaaacgaaaaataatttgtgaataaaacttttatatacgtgttcttagcgatctaaaagcaaaggctgaaaaataaacttcgataaagaaaactccaaatcaattttaaatttaaggttgaaaattcaaattttaactgatacgcataagcataagcgaatagacaagaaattcaagaatcacatgcacttcaactagagaaattcttctctcttttcaattggatgttcatatccagaaatatgtgtcctgtgtatacatagttatctgaatgcaaaatatctctgagaaaagattgtgaaagttgttatgaacaaattttcagtatgaacaagtataatctctatctggttgcatcagtcagagtaggatatgttattgttcttactagtactcacatgaattaaaatagctatagataaaactatggtgctgaatttattccgaatacacacaaaatctaacatttctactcaaatcaaatagcaaaaccatcacaaatctaacattttattggctcaaacaaggagaaaaaaatccagctgcatcaaaatctagttcccatggtggaacagctggagcgccctcgccgccgtcatcccgccggggacctcgacgaacagcaggatccccaccgtcgccgccgcctcctccaccgtgtccacgcccatgtccctcagcggcgcgaacctcgccggcggccgcgcgtccgtgccgagcatggccgccgagaggacctgccacccgttcacctgcttcctcatcgcggtggtgatggcgccgctcttgctcgccgccttggggtgcatgagcccggcgaccagcctcgacacggtctggaaccgcgtcgcctcgtgcaccatcaggagcagcgccgccaccgcgtccatggcgcgccgctgcgccgcgccgttggcgaggtcggccggcctgcgcgcggcgagcgcgttcaccgcctgcgccatctgctgcgggccgagcgtgacgacggtgagcctgtccgtgtcgccgaggaggtcgcggtacgagccgccgaagccgacgtaggtggcggcggcgccgccgggggcggcgccgaggatgcccggggtgagctcccaccacctcccgtcgctgctccggaatccctccaggtagaggttgtcggcgcgcgtggcgagcgtgagcgcggcggtcggcgacgcccggagcacgacgtggaaccagcggcgcggcggcggcggcggctccaccggcggcaggacggggcggttgcgggagaagtgcctcgggttggccaccctgctgcggatgccggcgatgaagtcgccgtagttgtcgccgctgctcacgtcgaacgtcacggtgaagagcgggttcaacgccatggccggaagcgaaactgacaacaaaagtagagtgatttctgaactttcggacaagatgatgaattgatgatattgcaatctcaatgagttgggatgggagatttataggggaaatttgcttgcgtagtcaaaaagaaacaattctttgtgcttactagtcaaaacaaaatggaatttttgctttgcaaatgcatgtacactgagatacagatgaactcatgaacagatcagaatatcatatcatgcctgagatttttgttccgtcaaacaaagaagaagaaaaaagaagactgagcttagactgagtcgcgagactgcctcaaactagaaataaagatgagcaagataaggtgctggtttattaatgcaggggtcagcggctgctaatgtatgacacagtccacactgacaggcgtcacagtcacacaactaatatactgctttcgctataatggcaatggataattggatatgctgtagaaagatcagttcaagaaaatggtcataaagttctgttcagtagtatggttacctggttcagacattcaggctgtccaaaattcagataaagaaccctaatggagtacaagttatcctttatatcaacattgtcagatcggctcagtagcaaaagacaatgcaaaactagcaacaatcaacatctggttgcttcaaatagagtaggatggcttgcagaaatagtactaactgaaatagcaagggcaatttcagatgaacaatcttgattgcttgcttcaagagatcgcgacgccatgggaaggggagaaggtccaggaggaggacgcaggccacaagggtcagggatcttgcctgctcctgctgaatagcaatgccagtagcgttagacctgaaccttccattacattacagtcaccactcaccacgcatcgcaagagcgactccggccaccgctcttcgacggctcaaccatcggtggccacgtatgtgcccaaccttaccaaatggataataatgtggccctcaaaccaaaggccgcaaaataggcccattagcaacccccaaaacaaacctcgctacagacagatgggctggtttgtataatgggccgacacgggattaccacgcacgtgctgaatgtatataaatgagccggcccactaagcccaatagactcacccagtagccattatagccagtaacaagctttttggcgggagaagcgtctccgcctttgctcgttcccaatttacccaacgagagagattggtggaggatggtgtgacaggagcacagtatttctctcttcgttttcatcctaatcctacactcgtcttccacattttacatcacttttttttcttcgcatgaaatatccggcttttataagggcctccatgtaaactattggctgaaatgtactattcgggagggacctacactgaattaaacacaaaatggaagggtttttttttttgcaaaatttccacgccgcgcactgttcctatccgacgtggcacgcgcaagcagccgcgccatctgccaccctttatgttttttaatataaataccaatgtttgtgtattagaaaagaattatttatgggtaaaacttttacatatgtgctcttagcgacttaaatgccaatgttgaaaaataaacttcgacgaaaaaaacttcaaaatcaactagccacatagtcgtgctttgtgcgacttttgatcccgtttaaaaacttttgtattagtttaacttatctttcaagaagacaaaagtgaatttatttaagcctcctgttttttttcttcattgtctttgccccctctctctatttgtatcatgtgtgtaagagaagacactagaaacctccaatatgcttgtccgtttgtgttttttcattaatgcattatgcatgtacccttttgatctaatggcatttgtttatctaaacctctttatctgacaatcaatatgttttgatgatgtagcacatcattgagcaagaaagcttgctgcttagcttgtactatataagatttcaaaattaagttttacaatttaaattttggcagcagctgatattgtatagagaaaatgacggggcctaaagaaaccgctgtaccaaacaaaacggatcaactgagggagaagtacgagggaatagaaaagattaagtcaagaaatatgggagaagataaaagattaagccacgtatatctcatcatgttgtaatacgtgggtaaaaaataaagaaaatgatatccctttctcgtggatggcagagaaagaaagggaaactccatacgaaggcgtgacacgagccacacaactgttagccgtcggccgaagtcatgcgtgctatgccaaattaacgcagagacctgtctcctactctcctacacacgttacttaatctctcgaggaaggctgaattatgagtgacgtgacgcagcatggttcatgatgaacatctattttctctatcctaaaatataaatttttttagctagacataacatataccaatacatatgaaacatacatgtctctccatccaaccaaaattttattttgggacgaagagagtagctactatacttgggattgataaattgggatatggctctaagcatctggctctttcaattccttattattctctccgtttcaaattatttcacttactaggttaggtttgttcaaagtaaaatattcaaatatttaaccatcattttttataaacttatacagtttaacactataacatttatatttttagattcaacattcactataaaaaaataattttttatggtgttaccctataatttttgctggcgaccatacgcgaaaactgccaacaaaaacataacaaggggtgaggggctacggaccgccagcgaaaaccgattatcgttggtggccacgctaagttgtcctccataaaaaaacaactatatttttcgaggcagacctcttaaatattcaccagcatttttttgctggtggttggtaaagaggaccgctgcaaaaaaaaaattgaggcgaatatataaaatccaccgcccctaccgcccaccaaactcgcctctctcactcatctatctctcaatctctcttcctctctcccttctccctcagtctctcctccccccttcttcggcctcccgtctccactgctgccggctaccgtcgccaccaccgccattggctaccgtcacctctcccgcccaatatctctgctgtattggccaacagggagggcctcggtagcggcggcagggtgcggcctactcctcttcgccgctggccgccgtgagctcggggctagatccggccgccgcgacgatgggggaggccggatccgccaccgcgacgacgagggtggctggatccgccactacgataacgggttaggccggatctgtcgctgcaacgacgtgggggaccagatctgccgccgcgatgacgatgcgaccgccacagggtcgcgggaggggcgcaagcgctggatcgggccgcctgagggccgcggtgaccctaccctcgctcccctcccctccttcctctccctgatctggccgtagagagacggcagcttaggagtaaaaacggagcggatattatccgatccgatccgctccgaatccgtccgatgtgaggatatggtaagggtttttagatattcggccagatgcggatgtagatgtggattttgtcatgcggatgcggatgtggtatgaacgatatccgacggatgcggattatccgatattttaatcggattatccgatgtactgtttggcggataatccgcgaatttcaggccacacaacaactttcaggcccacctagctagcccaatagcccaacccggcctaacctaatcctctcctcatcccccagatccgtctctggctctctctctctgtgccgtccctcagccgtcagttgaggagtcggagagagtagcacggcggcacagcgcgacggcgaccctacgcggtggccactcctccccaacacgcgccaggccgatcctcctccccaacacgcgccagccgctcctcctcgtctagcaccgccgctcactgctgtgtgttttgtgctgtacgcctgtactactactgatgtatgcctgtatgcagtatgctgcgtgtagcactacataggggtgctctactgctctatgcttgctgttgctgtatgcctgtatggcttgcctcatgccgatgacttttatttttacattttaagcaacgtagtgaccggtgaactattgaattgaacacttatatatatattatgtttttggtggatcatggatgtatcttggattattttgactagtgaactattgaaatactattactattgaactgaacgcagtaaactaatgatgttttgccatcgtattggggctaattatattgccgccctcttgttgaatggattgaatacaaacttgacatccgataactttttgtccgtttccgaaccgagtctgcaccgaatccgacgtccgaaataatccgctccgcatccgcatccacacgtcatccgcacccactccacatccgcttaaaaaatatggtttaggctatggtatagctattatccgtccgaatctgctccgttttcacccctagacagcggcagtagccaagggggtggcttcggtgacaatgacaataacctccaaggtcgtcggggatgacgaagaccaatgtgtatgtgttgatgtttgtatgttgaaaatgctgtgagaaattaatctagatgtttggacttttggatgctgtgagaaattgatgtttgcatgttgatgtgaatcaggattggatttgaatctgatctcttgatgtggatttaaaaattgaaaatgcagcaatgtttttgaatgtggatttttttttgctagcggttagaaggcaactgcatgtggttattttcaatcttttttgcctcaaaatcaattatcgctggcagctagcttaccacagctgccagcaaaattctcttattgttggcggctgtcgatcaagagcgtatttccgctatggacctagctggtgagattcttcggaagagaatgggagacaagacattatacaggttcgggccgctatggagcgtaacaccctactcctgtgtgtcgaattaaacttgtgctgttacaagggagttggctcaagcttctcaagtggcgttttttttctcggtgggtaaggtcctccttttatagttcaaggggataccacatgcaccgccttacacaatccatcattgggtgggggcccacatgtcttgggtcaagccgttgtccttgccttcaaccagaaacaaggtggttgctcatcctcaggtgggcccagcgccgtcccccgcctgacacgggggacacgcccgtcattcgcccttaattcgttggcgactttggtggactccatacaggagcagcacgctcaccgacgtgccgatgggacaggtcttatctgcccccactccgcctgacaccgggcgggacgtgggtacgctgctatccgtcccgtccgcctgttggccggtcacagaccgatcaagcccgattgacgcacatcaatcggacggcgcctcacgtccgcccacgccacattaaatgcggcgggggacggttggggcgatgcttatttaaggcgcttgagagcacccctctctccgcccactcggccaccatgtggcagccgagcgggggccttggggcagcttgcccgagggccccgaggggtgcggcagggcatcccgaggccccttggccgcttcatgaccgcttgttttcccccccgaggggggggggggaaggccgtgcggctacgtggccggacggaagggctctttctctccatcttgcgtacccccgggcccatatcaccaacagcggtcctcgtatggctgccgccagcaaagataattttctctgacggcagccttaagccgtctgccagtgaaaacatctcttctctggcggttggtcaccgccagtgaagatgctttatcttcactagccagcaaaaatgtgttttggccgccaaaaaaaaaaccatttgtgtagtagtgattataaatatttttataatatataattcacatgttgttaaactatactccctcctttctcgtaaaggaagtcgttttggacagcgacacggtctctaaaacacaactttgacttcttgtttttataaaagtatttattgaaaagtgatatatgtatacttttatgaatgtatttttcaagacaaatctattcatatattttttacatttttaaactcaataacttaagagttattcatgatttatattactaaggtttgacttaaatattgtcataaacgacttcttttacgagtacggagggagtatatattttttaagaattcatggtaaagatatatatgttttactcaatacaataaaaagaaaaataatttgaaacgaatacgacatcctccctgttatactcgttactactccatctgcagagaattagcattgtacccatgcatgccgtgcatagaacgttgcgcatgtctgtatgtagcgatggaccgaatctatctatatctacgacaaacaggcacaataatttcaaccattggattgacaaatctttacagaattaggcgaaagtcccctccgattccccccagtccccacccattaaacaacatcattaatctctcctccaccattaggaccctttgaatcgcaggaatggaaaaacagaggaatagaaaaaaacgcaggattctgacaggaatatatattttaaaacagaggattggaaaatacaggaaaaacacaggaatgaccgtttgattggaccacaggaaaaacgcaggaatcggataagagagatagactcaaaggaatttttccaagaggttggacctcttgctaactttcctccaaaatctctataggattacccattccatagaaattttaaaggatagtataggattcagtcctttgttttaaagggtttcatagaaaatttttccataggattaaaatccttcaaattttctacactttttttacaaatcaaaggagccctaagtatcagatcatttttagcttaaccatcttccaatcaatgcatgtagactactggtagtacttttccatctgccgctttgcaagatttaagaaacaccaagacatatactccctctatactaataaaagaagtcgtttagaacaatgtttaaatcaaaccttgagaatataaatcatgaataactctcaagttattgagtttgaaaatataaaaattatatgaatagatttgtcttgaaaatactttcataaaaatatacatatattactttttaataaatatttttatagaaataaaaagttaaagttctgttttggagaccgtgtcgctgtccaaaacgacttcctttacgagtatggagggagtataaaccgtcgaagtttttttctaagaacttaatatattagaagcacaaaacgtgaacggatacatcttcctctgcccagggggcagcaagcagaagttgtttcatatgtagcctcggcatatatactgacgaggaatcca

SEQ ID NO: 57984 - DNA, 24122 bp, Oryza sativa
  unsure (1)..(24122): unsure at all n locations
tacttcacgtacgctcaacggaggcttcatttgctgaatggcatcaattttctcgggattcgcctcgatgcctctttcagaaactaggaaacccaacaacttgccggcgcgaacaccgaaaacgcacttctcaggattcagtttcgtacccgccgcgcgcaagttgtcgaaggtctcctgcaagtcggacgcgtggtcgaaagccttgcggctttttacgacgacatcgtcgacataagcctccacatttcgccccaactgcttgtaaaggaccttgtacaccagcctcgcgaaggttgctccggcattcctcaggccaaaaggcatcctgaggtgacaaaaggtgccaaatggtgtgatgaaggctgtcttggggatgtctgccgggttcatgtggatctggtgatagccggaatatgcatccaggaagctcatgagttcgcagctagctgtcaaatccacaagctggtcgatccgtggcaagaggaaatcgtccttcggacatgctttgtttaggtctgtgaagtcgacacacatgcgccattttccgtttgacttccgcacaagcactggattcgccagccactcaggatggtcgatctcttgaatgactccagccttgagcaatttttggacttcggcttttgctgcctgttggcgatcagcagacatcttgcgtagcttctgtttccttggcttagcatctggcttgactgccaggtgatgcatgatgagatctgtcgaaacacctcccacttcatcagagccccaggcaaagatatcaatgttcttcttgagtgcctctaggatgttctcagcttcttctttgcccatgtcgccccccaacgatacgagctttgcggggtcggcatcatcaatctatatcttgattatcttgctgtgaggggcgggctttggcacatgcttcgcccggtcatgcggttcggcctcaacattgtgcactgctctgttgattatggccagatctccttttgaagcagccaaaggctgaagccccctgaccacgatcactcctgccgggccgggcatcttgagcttgagataattgtgatgagaaatggcttcgaacttgttcaacgttgcacggccgaagatggcattttagttgtatgggatgtcgacaatgtcaaacaatacttgctctgcgcgtctgttttcccccgtgccgaaggctaccatcaactgtgcttggccgagaacttgaactgcttctccgccgaatcctcggagcgatgctggtgctggggtaaaggcttgggtagtcaaccccatcttggcatatgcttcggcaaagatgacatcggccgaacttcctccgttgaccaggactcgccggacctcgaaaccagctatatcggctgagatcactagaggatcttgatgcgggaacattaatccttcggcatcttctggcccaaaagagatttgctggttcagatactgcggagcccctgccgaagcgatattgtggaccgttcgcaggtgcatcctcttctgtcgcttcgacagttgtatcagtgggtcggcccttgtaatcacttggatcactctgcgctgcgcatcatggcgttgttcggccgggggtgcttgttcttgagctacttcacgagttgcttcgaccgctgctccctgttgcgtccttggatcttgcgcgttgctacgttgccgaatgtttcggcattgcttcgtggtgtgtgaagagcgtccatggaaggcgcagtagaggtcttttcagacctttttgcggacaggttgttgatggttgcttgcttgctgggcgtcaaactccttgcgaagggcttgcactccttcgacagccatcacagccttgcccgcatggttggttctgaacttcctccaggtcatgggggcttgaccttgccttggcagttgtccttagatcgccggctggggctggcgaaccacgagaggaggtggttcggcaacttgaacttgttgttgggcttgagcagcggcgacggaggccttatcgtactcggcttgtattgcttgccgtcgcttgcaatcctccttgccccttgcgaacccgtcaatgatgtgaagtaggtgctcaagcgtttgcggctccttgttggcaatttttcttgtgagttcgccctcgagtagaccagctgaagcggcgtttatgatagacgcatcggttatgtcttgaacttggcaccgggcttgcgagaagcgacgcatgtactcccttatcgactcccccggcctctggcgaatgctgagtagatgctgctgcgtcttcggcttctcataggtgcctcgaaagttaaggacaaagacatcgcgcaattgctcccatcagtaaatactattggttggcaaattgaaataccaagagcgggcgatgccgtctagggcgagatgtattacctttgccttggtattttcgtcgccatgagccgcttcgatcgcggattcataaatggagaggaattcctttgggtcagtttcgcctaagtagcgtggacgggtgagaacttgaactggggtgggattggatgggtcttgattcccccactgagcggtagccccttttcgccccctgccctgttcacggcaccttgctgcgggtacggtgtggcgaagggcaaaatcacgacttgcgcgtgtggttgggccatggcattcggctgcccggccccgattggtgatgtttgctgagccgccatggatgggtcgaaagttggttgtgaccatgtcatggtgacctggtttggtgcttgctttgctccgaagcctggcgttggtgtttgcagccgaacggttggcgcctgagcaacattgatggagtcgaactgcagtccttgactccacggcgaagcccccagacctggctgattcgaaggcaaccaactaggtgcaccatgacttgtattcccctccgggtgagccgaaggggcagtacttgaaatgttgtggggttggctgagctgttgaaggaaagcttggagctgcgcctgcagagccgaagccccttctgccattgtatgtggcacttggccaggcggttgaggatgtacttgggcagcaaccggttgagcttgcagttgcacgtgaggggccggatgcgctgctgcggtcgatggctgcccggcgaagtacattggcgcttgtgcggcttgtggcggaaggggctgggtcggcacttgtggatagacttggggtgggacatagcctgccgaatactggaggattggtgccgaagtgaccttggaccgccttgccgcctcgtacgcttgctgctgttcctgcatttggcgaagcatgtcttggagtcgtctcatgttctgtcgcatggcttccatgtcggcttcggtttgtgtctcggggtcaaggttgacttgggcttgcgcagcggcgagcgcagttggggccactgccggctacgatggggcggcttggggcaccagcaattggcttgtcgaaaggatctccgtcctggtctggagtgccctcgccaccgcagccaccttcgccatgtcagccgcgttcggcacctgcacagaggcagtaggggccgaaggcggtagtgatggcgcaggtgcggaagcagatggcgctcctccatcttcggcgacaggcgccgaaggctctgctccctcttcggcggccatatccgtcccggcgtcgctttcctttcgcctcgtaaccttctccttcacaaccttcttcggtggcattcgctctcagtggtttcgctcggaggtccccacggtcggcgccagctgttgtcgaaacgacaaccgcatacgtcaaagacgtggtcacccaacagtggttggaaaagaagtaaaatgtattaatttgagaatttttcttcggatccccctattacatggccctatgagactatttatagcccccattacagattcttactactatggttttggttatacaggggaatttacatggttgcccttagaaagggacatttacatgggtacatagtgtaattgaggttcatgggcccctgatggccgttgggcaatcgtcggcccaatagcccctaggcttgatgggccggaaaagcttcttcggtcctcgcgggggagaacttgctatggcgaagtcgtctcccttcggcatatattcttcgccctgcatccttcgcccaagaggcctttggcttggcaaagcacccacgtgatccctcacctctcgccgtccctgttccatagtcttcgccatggggggacttcgccctgactaactttgacgtctcgggcttgaatccccactcttcgcatggtttcagcaggtttggtcgaagggcctcatgccataccgccaacactaataatgcgagttgcaaacaaattaataatgattttctaattataggagcaattggttaaagggtgacttgccttgctcaagatcttcacgaagcttcacgaatcttcgagaaatcccacgatcgacaaaaatccggtaaccgcaactatacgcaaacaatcaaaacctaaacaaaagaccaagagaagatcctatttagactaaataatagtgacattagatagatctcaaatttacggaattattggaagtggaacggaggttaatcggagttacggatcgagagatatgatttttggaagtttaattggattttctggacatggggatatatttgtggaataaggaaaattgatttatggaagggaaaaaaggatttattaaatttatggaagagaatatttgtggattattggaaaagatattctcgagaatattttgactcattgacaagtggggcaaacaagaaggtgagagcgtaaattgagagggagcagatatggactttagctcatgagggatggacactgggcttggagggagggactagaagtggacttttcttgtttccttaagccgagaagggaggccggccaatgggccaagcccacgagcgcggagagagagaaggggacggctgactgggcaggggttgactcggtctggtggggtcggcagatgaggtggcgtccacgtggatgccacgcaagcgcaagggaaagaggaggccggagaccgcatcggacggccggcggcgcgcggagcgtcccggcgaacggcggcgagacggagcgaggcgcggacacctgtggcgagaggaggagatggggaatcggttcaccggcacggattagagagaggaggcacgacggcggccggcggcggcagcgaagctcgccggatgtccgacgtggatgcgcgagggaagggccaagagcgcgcggggccaggcttagccgaaacgattcggcattgcgacgcacacgcgacggcacggagaccgatggttgccggacttgggctcgcggtggcgctccgcggcggcggaaggggcgacgcggcgaaaagggggagagaggaggggagcggccaaggcgatgtcccggggaggctgctagggacgcggggagggtgatggcgatgggattcgtagggagaaggaccgacggcggcgggagactgcacacggcggcggcgagaggggaggcacggcgccggagcggaaggggaggtcggcggccgagggaaaggtttggggaggtcgagggggtcccgaggaaggcgatggcgagccggtttgaagagagggagaccgacggcagcacgcggccatgcgcggcggcggcgagtcgggcgacatggcgccggagttggagggcaggccagcggtcggggcgacggtttggggtggctcaaggggactcaaggagggtggtggcgcgaggaatcgatgagcggggagccgacagcgacgcacgactgtctgcggcggcggcgggaagggcgggaagggagcaaaagaggaggccggcggcggaattggcggtttggggtggttcattggagctcgaggtgggtggcggcgaggggattcggcgcgggaccgaccggcggtagcgcacgactgctcacggcggccgcggaagtagagcatcggcaagggcccgatttggaggacgaacgcacaaactaccatgtcccagtgctgtttaggagtcgctagaggatgtagatgagaggatttggaccgggagctcaccgacgagcgggaacggcgtcggcagacggatggcgtcgcggcgaggcagtcgcgacggcggggcggcacgacaccgagagggcgcggccggggaacaagaggggagaggtggcgcccggagctcctcgtcacgcgcccacgcacgcaccggttcctccgatgctcggcggcggacggcgacggcgagatcgggtcgagcggcaacaaggcggcgacggtggttcggcggcaatggcgcggtgggtgcgaggcgagtgaaaacgagagaggaaggggtttggggcggcttgggttttatagtggaggaatgtctgtttgtggagggaggaaaccgacctcgtgcgctgtcaaggatgcaagggcggcaagctggcggtcgacgcgtgcggccaaggaggcggcaggtgatgacgccggcggtgtcgggcaaaggtggaaaaaggagaggagaaaggggctctgttctttgccgttttttttaggagagacgaaggagggggagggcacgagagagacgctgcctccgtgatttggatggttgcggcgtggggttgcagggccaggcagcgcaggcgctgacggcggcgggcgaccgggcggtcggctttgaccggtcgcgggcgcccaaagcaatggcggtggcgggaggatttgcaagacggcggcggaaatcggttggcgagagaggcaagccgagagagagagagagctcggctcggcgatggttcatgcgcacgcgcgtgcgccgcacgtgcggagcgagggaggggaaggcggagagagagaacggcccgagagagagaacgggccgagagagagatgggccaaaggaggacatcggtccatccaaaagcagaggaaggcacaatagactttttcagaggggttgaattgttgaggtttagggtttagattcgaattcaaatttgatattcgaactcgagggtttagggaggaatcaagggagactcgaggagaagtcaaggaagagattcaaaatgagattttgatatttttgggaacggggacaagtatttggcgatgagttcaaaggaggaggttgaatttcggaaatatatttcggaaggttgaaatggaagatggattccgaggaggcgatttttgatggcgatgagagggatcaaggacggatttaaattgagatcttggcacgacttagacttacactcaaagaacgaaaattttcgagaatagggttttgccgaattagtttttaacgtcatacgaaaagcggagcgttacacctatagaatttgttggttgaaaacagtttgatagttcggaaaacgtgcgcgcgtgaaaaacgagataaatctttagcctttcctaagtggccgaaccgtgcctaaggtcctgtttagattacactccaaaactttacaccctgtcatatcaaacatttgaacacctgcataaagtattaaatatagtctaaaaaataactaattgcacagattacgactaatttatgagacgaatcttttaagcctaattgctccatgatttgacaatgtagtgctaagtaaacatgtgttaatgatagattaattatgcttaataaatttgtctcgcggtttacttacggattctgtaattagttttttattagtgctcgaacactccatgcgataccctatataatatccgatgtgacaagagccaaaattttatacccctgaatctaaacaccccctaaatatcttgttcctccacaactttcccctgcaagacaagttcaaggtggttgaggaacaagacgttttgtacagttttcaatcaaattggcagcagttcgctagctgttatggaatcggtggtggaataggagaagatgagaaagaggaaggggaacgactttgcctctcttaagccttgaagtgctcgatagttccttatgtagcgagcatgcatgcgtcaaatagacacatgatgaaaacggtatggaaacgaatggaaactacctctatcgattccattttcatttttcggggggaattaattggaaccagaaaccttggatgttgagacggaatcaaatattgtcgaaaccgaaaacatagagaatactaactgacacggatactgtaacgaaaatttattgaaatacaacccccccccccccctcacctcaaactgagcttcaaactttatcaagtccaattacaatctcaagtctcaacattcaacggtacatcacaaaacacaattaattagaatgctaacgtgaattgggttgggctattattagggtatatggacatggtatggaccttttctcctatttgggagagtttctagctgctatagcttcttcaagaagttccagctcctaaacagtttaaattctcctagattctaaaaatttggagttataaaatctagaaaataaactagaagccggatttctcagctttatgggtatgatccgactagtcaactcaagtcggaatatgactctgcttcttttttcttatttggagctctttctttatttattcagaacttttgccatatgtataaggcttgattcaatattggacttggtatatagtgggtcgcgttgtacacaagtatagggtatcccatatttagaacactaacctatacaataactgaacatctaattttattatagcactttttaggattagtctatatatattgttttagtgtattcaaactaaatatttttgaaatgattgatagtcaaagttgtaatagtttgatcccaacaacatcaagaattgtgaaattggaaggagtataaaaaataacgaaatgaggaatctgggggtagaattaaatttatccacttgatggattgatggatgcttcttagataatgagcttgatgccaactgtctgaaacatgtgttaagcttctctatttaatttgatggtcaagctggtggcttcaaaggtacaacctctaactctatttatatgtcacggtgtttcttattgtatacctcctccgttccttaatacaagggattttatcattttgcttgtactgtttgatcactcgtcttatttaaaaattttgtgcaactgtagaaaacgaaaagttgtgcttaaagtactttggataataaaataagtcacaaataaaataaataataattctaattttttttgaataagatgaatagttaaacagtgtaagtaaaatgtcaaaatccctcgtattaagggacggagggagtatgttcaagtgattggctaagtctgtcaaagctacggtgtttcttgttgtatatatatagattcatatgtcaacttacaatgtgttccgcttcgagtcgagctaatttctggccagagtacgcaagtgcgcggggtctcgagcagagatcaaagtggtgccatctggaggtcgatcatcgctgtaagcttgctcggtctcgatcggcttaacttcgtattgaggtacgtatacgctctgatcagcctttatactcttatatatgtctatcgacatggattgctggtgcctcatctggagatgtaaaagatcttcgagtttatctcttatgaaacagctgagattaatcaaagtcttcagacttcagagaaccattaggccataaatttatcttctgcttgctctcgctcgatcgagaaatgtactatcctgccaagctctttcagaataccaagataaatcacatccccagttctctcacatcttaaatgttgacgttcgttcgttgactcctttatggaaggtgcatgtcatcagcgatttcttcttcaaggcgttctgtcgtcggctatttttttttaacgaatcacacaagacggtgcgatgttttattaaaattataagattacaaccaggaaggtcgtaaccagaaaaaaaaaagtataccaccatcacccacacatcaacagcgccaacacacagaaccaagagaaggttagcactagaccggccaccgctaagcgtgaccagctgccactatgctaacaaagaaccacggccgagatcgcccaaaacccaacccttacaatcaacacaaagccccgctctatccaagtcttcaggagttatggagagagggtgagagagaagaatggaacacctctcccccttaggccttccgacgtggccaacttgtagagactagtacgccgcttacaagaggatgaaatctagagggagcttgcaccaattggttgtggggtttcggctaggggatgcctagacgacgtctccaaggagagaagcgacggagaacactaccgccgccgccgtccgtcaaggtcttaaagagaaccgagactgggctttcgttcggcatccacacatgagggatgagacggcacgacaacgccctcaggaggggaatgacgctttgagcgtcatcattgccggcccggccgaggctaggctaggttttcacccgccactcatcacctacaagtccacggctggcgcccagatgctccaccaccgtccaacctctgccaacatgtgggtccactgcaccagcgcccaccgcatctaccggcagctcctcctcctcacaccgtgcccggctccgtcgccgccggccgcgcctcgtcgcgtcgtgcctcaccgcgccaagctagtctcgtccatcgccggctgcgcctcatcgcgccaagctaggctcccattgccgaccgcgtctcctcgcgccaagcccgcctccaagcgccgagccggcctccgctgccaccgaccacggctctacgcgtcaagctagcccccgagcactcctcctgccgctgccgcgcaaatacagtcatctgccatgcctccccggctgtcgccgttcgtgcctcctctcgcagtcgccgtcgcccatttccaggcgttgataccgtgtccgcacccaccatgctgccattgcaacatcctccattgttgccgacgacgcgtccaccgccgccgccaccactactggagctgccccagccgctgccaccacccctgcagctgccaccaccacagcagctaccgccgtcgccgccgccgccgccgccgtcgccttccaccgtaggcagccacgcccgcggcttgccgtcgcaggtcaccatcgccggtcatcgttcggccagatctggcctgccacggtcgccacatcgccgtggtcgctagctgccgccatcaccagacgtcactgccgccatcaccagacgtcactgccgccgtcgccaccaccagcggacggccaccactagaagccgccgccgcctcaccacgctgccccaccgccggccgcctccccaccagatctagccgcggcggcccagatctgggcggtcttcacaccgtcccgtgctgccccccactgccggcgcgacgagagaatgaagccccgccgccgccatccttgcggccgctcgggcggcggcgcggcggaggaggaaggagggggggcgacgcggggttgccgcctcccgtgtcgcccgtgagggaggacgacgcggaagaagttgtgtaacacagtatattttgaagtttctcgtcggttatttggtttcatggtaggcaactagcctctagccattaattggttactcctagtactgcctgcctgttaattctcttcttgcctgtagaagagtctattgtcgcaaggcaacatgccaacatgagacctgaaaaggaataagtcaattgttggcagggttatggataacacatatccaaaagtaatcgactaaactcggcagaacccaccatatattaagtcttatatggaatcatgccttgtatatatagaaggagttccggataaggaagaacaaatagagttcaagctggaaacgataaggactacccatattgtatcatatttatctccctagttttacttggacaaggggacatatatgggtataaatacaataccccagaaggagagacaacacaaaaccaagacaagcctgaacaaaccaatacacaccgctagacatcgacatcggagattagcctagacatacccaatctagtgccatcggaggccgtcaagagggatttagtgttatctctgatctggccgagtatgtattcgaggaggaagactaccctgtcgtcaactacgtgttggtgtttatgtcgccaagttgacgacgactagataggctatcccaattattgtacttgtgagattctgatgaataaaagcaacaccggcttcgaccaacaggagtaaggctattacctgattctgatgaatgaggggcccaaacctatataaaaatcattatctctgtctctttaaccttaatctcacatataccctgataccaacgatccccacaccatgcaaataccgtagtcgtgatctaaaacatcgacaatttggactccctcaactataactccaatatgattcatatccttaaaccgtaataccggatatcttgacccctcaactatgaaaatcggtgcaattttattccctcaacagttttgtagagcggttccgctgacgtggcgctttgacttggtctaacccgctaagtcacactatgggactcgcacgtcaatgtcacacattctttattctcttcattccctttcccctcctcactttcctctctggcggaagcaacagggcatggcggtgatgacgggaggctgttgtcgcgtcgccaccgtcgggcaggaggaagcatgagcgaggatggcatggctgtcagaagggaggttgtcatcgcgccaccgtccctcccatcactgtctccgcctcccctccgctacccccttccgctcgccaccgtcgaggaggaggcatgagcaaggatggcggtggcgatgcgaggggatgccattgtcgcgtcaccatccctcccgccaccgcctccacccccctcccttttccagttgttgcctccgctgcccccttccgcttgttgccatccagaaggagggagtgcgagcaaggatggtggcaacggtgaggaggttgttgtcacgccgccgtccctcctgctacagcctcccctccactgctaccatcctcaaccccgcatggggaaagccgccgcgcctgctttgccaacggcgtgccgttgtcgccccccccccccccccccagcggccgccccgttctatctcatcccacgccattgtccctcccaccactgcctctgccttccctcagctactgccctcaaccccgcgtgatgaaagcctctgcacctgctccgccaccggtgcattgtcgtggccctggcggccaccccgctccgtctcatctcgtgccacctccccgtgctgcccgttctctcctgccattgcatccgcctcccctccgctatcgccgcatggctgattccactacttaattaaaggagtcacaatggacttattccacctgaaaatgcaaggctcactacacattattggcccatcacaagttatcgatccctagcacaaatactggtatcgttgctgggtcatcaagactttcctcttctgtggaacatgtcgcatcgtgcgataggcccgggcgccacgccgccagagccttgccgacctacgtgccaacgtacctttgtggtttgtgccatcctcacccgacgggctgcacctaacggtgtaagataggccaaataaggttattcatttatttggcctataaatgaattcgtgaattaacccatatatgctattcggtgagaaataaaatagaacaatattaaccggcaatatgtacggaccgccatactagttataaactgaaattcaacaaaactgagatacaaagtagataagccttcatcatatacgaatgcatgggttatggactactagtatctaaattaacatccaggttgatatatacaagtattgcctgtggccgcgtgcaggaacccggaagaacgtaataacacaactctgaatatggtggaccctcgtgccgtcatttcatcctggttcgttacgttgcgcgaggacgtgtacgtcttgattcgcatcgaatcactggtgtcgtttgttacggtggcgttcattctgatgtttaccatggacatctaccgtgcccggtctcgcggctctggcaccatgtccactttggacaaggtcgatcgtatctctgaccgcatagtgctgtatctgttgggcaccatgcaagctgcgcctttcagcaatgagctcttccctgtctggtcaattgtgctggtgagtcttcatgctagcatcggctatctctccaggtacggtatacctgaccgggtacgacatatcactgagctgggaaatgtgatcaagtttctgggagtagcgttcttgaatcgcacccgaggctccatgtttgtgaggcccctctggtcgatttggtgtgttctgctactgcggtccatgtaccggttcatcgcacagagccttgcgctgttatccctgtggcatggccgcagttaagagctccttccagagtacatgcgtaacaactttgggaggggaggattggcatccggtgtccacaacgcggaaacgatggacggatacaaatacttggtccatggcgagtccaagcagaagatcaaattactgaggcctcgatatgctctctatctcaatgtcaccgatgaaaacttgctggtcacactggacaagatttggcgatctgacgggccggtgctacagtccgccaacagcgttcacggagacgactgcaaggatctgtgcctggccttttccatgtcgaggtttctccggtgcaggctcgaagacgtgaggctggacgcagacagcctctccatgtcgcggaatctgatagtgacaagaatattgcatgtcgaccagaaccctgcgagggtgttcaggataatggagctggagatttcgttcctcaaggactacttctacaccctctatcctatcgtcttctggcaaggccttgcttctctctccttgagtgttcttcagtctctcgcggccttgggactcgccctctggctcgcctcgggcgtcaatagggtcaagaaagatcttccggaccccgtcaatgtcgtgcacggccataatgtggaggtgacaatcacatgggtgttcatgtccttcatgatgttcaaagagatctgggagatgatcacttacttgctatcagactggacaaggcttctccttgtgtgcgagtatacgcggtccagatgcaggtggataagaaacgccacgatggagaagctgttaagttcctttctaacgttaagttcctttttaagtcgtaagatcttttctgacccttggcatggatacatcgaccagtacgacttcttgcagtcatttgattacagcccgtcgctctggaacctgatgtaccgtgctactctaggcgtcatcaaagagagggtaaaagggcaaaagcctggcaccgccatcaagatcccagaatgtgtaaaacctgcaattcttcaggcattgcgctcaatggatctcgctggcttgggcggccgcgagcttccccgagacgtcccatcgttgagcgccgcgagattgcttgaggatttccgatgggcgttgcttgacctgtacacgtgctcccaggtcattctggtttggcacatcgcgacctccatgtgcgagatcaagctcgcccgagacaggggcattgacctgagcaaaccagggctcctgcgctccgccttcacgtacctgaaaatttttctctgcggctgctgctgcactcctcagccgtacctcgttgctgaaaatattctcggtgatgatcaactccggactagctacattgttgcaaacagcttgtcacgatactgcgcgcacttggtggtttttcagcctgacctgttgcctgacagcttggcgcttctgatattatgaatgaccgcgactccttgctgacaaagtatgacaagctcaatgggttgttctcacccgaagctgctgaactgaaaaaactgaacgggaccatcgtagagaaaggcgcggtactgggaaggcaattgcttgaaacaattccagacgatcagcagcggtggcaaatcctggcgggtgtatgggctgatttgctcgtgcacattgcgcccagctggaacgctgaggcacacaagatttgcctcgagtacggaggggagctcatcaccttcatctggggattgctctggtactgcggcatcgagaagagcagcctgtggcgagatcaggacgatgcgcctggagatgccaacgtccagcctcagcctcagcctgcagcagaagaacctcagggtggccacaatgtcgaagatgatgcgatggtggaagatgcccaaaacggaattgaagctcgtgaagcaggcgtgcagaatcaaccagcggagcaggtgctgcagcaagctgctgaagcagatgtggagattgcagatgaagcacgagaagacgagcctgagcctggcaacgacatccacgctcagtctgctgctgacatggagattacagatgaagctcaagaaggggagtctgagcctggcagcaatgtccaaacttctgctgctggtgtggagattatagatgaagctcaagaagaggagtctgagcctggcaacaacgtccacactcccttcagtgctgacgtggagatcgcagatcaggctcaagaagaggagtctgagtctagtaacaaggcccagtccgctgctggcgtgcagattgcagatgaagctcaccaataggagcctgagtctggtaacacaacaggatcaggtagaacatcagaaatacctgttaaaagacgctggagatatgtcctgggattgagatgcagtgatccggaagggaaacagtgtccggacctcgcagctgatgagctgatgtgtgaacacacatcaagccgatgaagagcagtgcctctcatagtcaaggttgagtacttgagtgaaactgtgaaagccttgtctgcaaaagcaagaaaaaactagaagattattcaactcatgcagtgtgatatcttccgtctcccgaatgcgtgcagcaacgtactttacaaatatataactttctttgtacattgtgcttatgttcaattttgtttgcagagtatttatgttcaaggaaaaaaaaagagagtttttgtgttcagtttatctttcgacagcgtttatgttctgtcgacagtaatactgcagccatgaatgtttcacaattctcctcaggttttcgttcaagaattttgtttggatgtctatggttgccacattcttggttgcacaaatcatttgggtgtcaaatgccttattgccacatgcttgtggttcccaaactgtgtatggattctgcaagcatttctggaaagagagacaaactacaaacccaactatcctacaggctgcactaaattgcagataagcgcagataaaaatcaaactatgaatcataatactagccagcatcattttgagatcacatccaaaacttttctctccaatatgcggagataccatggcagtacagtaatcagtactcagtaggtacattgtttcagtagatcaggagccgcacctggatggctcgccggcccagaaggaatctgcgccggccactcgcgacacggcggagtgcacactgcgcctctgctccatccgccaaaccagagcgagccaggctgcccgacggaaggtggccggagaagccgcttctgggaggaaaccctccagggcagaccagagcaacggcatctccagcgagaatgacccccggaactggatcggaatcccttctccattctccctctgccaccaccacggcgacgcctcctcctgtaatcagcatgatagatgcattttttggtccattagaatgttctttacaggattggctacttggcatatacttgcagaacagactttacaagcatttaaaagtgaatattggtataatattctcctaaatcaaacacatcaattcttttcatctcccatagcaacgtgcagggtactaccagtctaaccacatgattagtggctctgatcagtataactagtagtaacaaaaaagtaggtcatgatctatatacaattgcacccatgcatgatactccacttaccctctccttggaaaaagtaactttaataatttgaccactaatgtaccctacacagtggaattgatttttgtttctccctttctctgtcagaacaattcagttgaaactgtattttataatgttgggtacatggttttcagatttgtgctgccttattgggatcctgaactagccgcagcttgtgcagcatgggactgaaggtgaacaaattctagatatcctccattctgcctaaaaattcataatgaatacatagtctaaaaacgaaacagatcaacagcaaacattgggagcataagaagacccttttaacgtgaactaccttctgacatgatcacttacgtgggagcccgtggttattgaaacccgcatgtcattatgtcagtgaccatgccacttgacataatgtcagaggagatgcatcaccatcatctcctttgcagtatttttctcatttgatttaccgatgatgacaaatgcctttttgctagctaacagtgcaaagtgttcgattggtgcacacataggctaccctttaattccttccaagatagtatgatcttattcttacctcaacctaacgaataaaggcaaaataatttcttcctcttgttttttttttaacctttcttctctcctttcttccaactattttgctgcttagctagctagctataaaaagcagtggttcctccttccactaacttgtgaaaagcattgtctgctgccttacatttgcatagatatgttggctgcaagttttctttttatgtgtgtatgagcatcatgtgcgtcatccatgaccattgatgagcattcaacactatgcattgcatgtggagccactaaaacatactcccaccatttcgttaatccaaacaatcttttgtcaaaatgacccattggatttgtcatcattaccttaaccactaaaaccataccattttttctagaaggatagacttgactaaggatagcacgtgagataaactacttaaaaggtgtcatttgtttacttaaaagatcatgattaatcgtagcaactcacccagtacagtagtagttagcctttacaattgtctgaaagtgatggatgtaaaagatcggttacaaactcagtgatcgactgatccaccattgtctggtaatcttttctggaatgacaccaaaaaacattgaaaatcccaggtgctttgagatgttggcactgaaaagccatcccactaacggaccaacctgaataaataatgtgatgtagagtcttaggctgctgccaaaacaaaaggaacagagaaaatagaactagtggcgaaagagaagaaaaatgacaccttgcccccagttggcctttataatcttcaccagctgcaagccttggaagattcatccatagtgtactcacagcagccaataagcagtagcttcatccagccgaaatcgtcgaagatcggcagtttgaaccttggtgagccatggttcttggaagaggccgttcccaacatcggcaacaagccataaggtgtggcgatcttggaggtctgttagtcagcctgaatatactattgtttcttttgcctgatcattctatctctgttcataattggtgagattcagggcgaacaatgccatcaaggagaaccagaaactcagggaagaactcaggagaacggaaaccatagtatcaatttataccaaacatcgctggtggatggaggagcaagcttccaggtcttatgagatgattaggttcaccgagtacaggccttcacagattcatcgtgtagtcaatgaccgagatgcaatttttcttggaattggtagttatgggtctgttcttcagtgcaaaattggtgagaagactgttgctgtaaagattcccaataacagagacagccgcaaacctctgccaagcatgcgagagtttaatcaagaggcaagtataaagatatattctgcaatatatcttttatatttctactaatctaagttcatttatagtagctccatgcaaaataaaaggttcatttcatagtaattgctgacaaaagtttaacatgggggattacagttgtctctttgatccctcaatccattgaattcagatcagtgcaattgctattgtgagtttttgactgcgcaatagcaattgcagacaatcttagccattcattttgctacccaactgctgaaaatgaccacaaaagtaatttctccacagtttccggctacagtattttactctgattcaaatgttagctgcaacctcacctatttttcctgccttactttctccctgattgcatgcctactaattgaaatacagttcagaaattccatgggtataaatgcaagaaagtttatgcctacctgaattgttcatatattaattttcccgcaagttagagctaccgtacaatattcttctcattttctcggatagaagagctctgaaaatgcaggttgccatcctcaaaaagatccggcatcaaaatcttgtcaccctcataggagcatgtccagagagacagatactcatctacgagttcttgcctaatggctccctgaaagatcacctcactgaaagtggacaaaggaggaggttcacatggaaaagacgagtgagagctgcctccagcatatgctccgctctcatcttcctccacaacaccgagccctacccaatcgtccatggtaatctcaaaacgagcaacatcctcttcagcaaagacaatgtatgcaagcttagcaactttaccatgtcccatctgctgcaatacacttccaaacctgtctcgttttggggtggtgttaagggatttgcaagaatgttgattggttctgacacccacaagactcagttagatgtgtccgctctgggcattatacttttgcaacttgttacagcacaagaaccaaaggatttgagaaagaatgtgctcagcaaactaggagatattatacgattccaaggaaagagcatggagcagcaacatgaggtcctaaaaagcattgtggatcctgacctgaagaaatgccagttagatgacgccgcagagatgctgttcctgggattgaaatgcagtgatccaaatgagaaacatcgtccagacctcgcagctgatgtgtggccactcatcgaggaaatgaagagcagtgcctctcatcgtcagggttgagtgaagctgaggaagctctatctcttgaagcaagaagaataaactacaagattactcaacttgtgtggtgtgaaatctcccctctcctgaaatttgtgtggcaagcaaagtgctccacggatatgaaactttctttgtgtattgtgtttatgttgagttttgcaaagttgagtttatgttcagttcacaatagtcaagcctgaattcaataatttagtctgagatgtttgtggtttccacattcttgaggaaacaaattatttgggtgccaaacgctctggctgccattgtggctacccctacccatcatggcctgtccatttttgcaagcatttctgcagtgcaagatgcagagccgggatgtttattattccattatctaaaaaaaaccatttctggcaacgtatacaaattaactacaaacccaatactcgcttanctncaggccattgtttagttcacaaaacaaaattttttcacccatcacatcgaatgtttggacacatgtatagagtattaaatgtggacaaaataaaaaaaccaattacacaatttgcgtgtaaattgcaagacaaatcttttaagcctaattgcgccatgatttgacaatgtggtgctacagtaaacatttgctaatgacgggttaattaggcttaataaattcgtctcgcagtttcctggtgaaatctgtaatttgttttgttatagactacgtttaataattcaaatgtctatccgtatatccgatgtgacaactaaacccaaaatttttccccaactaaacaaggcctcaaagaggacaaatccaaactgcatgattttcgtactatcctagagtaaattacagatagccgcaaatcaaaataacaattaattgtactagcctacatgatttaccccccttttcttttcgtctcatcgagagaagccagatccaaacaagcgtcaatagcatggcagtgaattaattaatggaggaaaattagtagggttttgggtacacctgggaatgtggccttccgatccttccgctagtccactgctaggttgcccccgccgacgaggagatggccggagaccagagttggccggagacggggagggaaagccttctgggagggaaagtcggaaaccccggtggcatgatagcgccggccggagcaacggaagctccaggagagtgatgcccgggagtagaacggaatcactcctctccaccgtctcctccgcatcgccgcccgtcggtcgccgccgccgccgcggcggccgcctcaccggcagaggcacattgctgcgagcccagcgatgaaggcggcggcagaaggcccacgttgccgggccaactcaggcccatatattgattggatgggcccacgcatattcgtcggctgcactctcataggccttaattacggcccgtgattggaagaccataaatttcctaaggaaaaagtacacccgaggtccctcaacttgtcatcgaattacaaaatcatctcccaaccgcaaaaccagatatatgacatcctcaacttataaaaccattcgctttacgtccttcggccccacatgtcatgatgccacgtcagcatcttctctcgctttcccctcctctccctttctcatctctctctctctcactttctcctcttagggagcacggccggccggcaggggaggagcgcgacgggcgcgcgacggccagcgagggaggagcgcggctgagaggagggttggcgcgatgggtggcggtcggcgacgcggagcacgacgacgacttggggccgccgctcgcttgctcctgggggctggaagagtagcacgcagccacgcactcagagtggaagcggtgggtgtccggcgacgtcccgaggcgggcgaggacggcggtggcttgcctcccgctcctctccccgccgatctccctcgccggcccgcgggtgcgcgcggagaggaagaagggcagcggccggccggcagaatagccggtgaacccatccttccctccatttctttgttagcttccgccatgtctagttgcattttattgatcaagaggtgattttggcccattctgtttctgcgagctcacagcctcacacccgctcaaattcttcacaatctgtaagtgtgtgtgtgtgtgtaaattcttgcaaattagaagctgaattgctgctaatagcctgcatcgactcgtaaatttatgtttttttgttggaacagatgggctgtggctagtggccgcagtacagctatgggggatgccatcctgctgcagaccaaccacattcgacgttaacaaggtgccaaccatgcggggacctagtgcaccggcggcgcggcgcactgaggacgacgaggggcggcggcggcacgcggcgcgcggtgaaggccggccgtgcgtcggcggggtgcggcgcacggcgtgacggcagccgacggcggggcgcggtggcggctaggcggcggccgcgacgcggacacgcggcggcggcgcggctaggacacgggctcgtggtggctggcgtgcggcgggccggcggctcacggcgccacgccatgcggggcggcgtgggggcggtcaagcgggcatggcgcggtgctgcgagcacgccgcggacggcgaatgcggtgcagcgggctagcacggcgcggtgcggcgacgccggtggccgggtgggtgcgggatacggctgagcggcggctcggcgcgggatgcggccgagcggccatggctgctcgctgctccgcccttttccttttttttttctttcttcattttcttttcgggccgcagga

SEQ ID NO: 57985 - DNA, 2575 bp, Oryza sativa
actttgtcgatttcttgaatgatttgctttggtattttcagagctgtcatggcatagattggcatggagcttggtactgatagtactaactctcttcttcctcctgccgagaggagctttttcttccaactggctaatcgtgccttgattttgtcaattaggtattggcgatggacctttcggagcctgcttatcatgagtggcatccctaggtatcgcattgggaatgtcccgcgggggccagtaaagttgtgtagcatttcatcaaggtcaatttcaccacagctgattgggatcactgagcttttgtgaaggttaaccagaagtccagtagcactcccgaagttattcaagatcgaaatcaggctgtccacatcttgtcgtgatggtttgatgaagattgccgtgtcatcagcatatagggagcatctgaagcgtgcactgcggtccgctaggtcactgaggaggccctcatcagttgcaatcttgagtagtctatgtagggggtccatcgcaagaataaaaaggtatggggataggggatccccttgccttagccctctatggtgatcaattctttctccctcaatcccatttagtgcaaccctggaagaggaggttgagaggattaaagccacccagtctcgccatctagtactgaaccccattttttcaagcagcgttaggaggtactcccatgagaccgagtcgaaggccttggcaatatcgagcttgaagaatagggtgggctgcttggacctgtgcatcttcttagccaggttggagacatagaggaaattgtcctggatgcaccttgttatgatgaacgcactctgagcttgtgatatcactttgttaatttgtctggataggcggattgccaaaatctttgcaaggagcttcgctaaggagtgaattaagctgattggtctatagtcgcccatagtgcaagcatcattctttttggggatgaggatgagtgtcgctctgtttatactcccgaaatttcctcccgataaggagtggaatttgtcaagcaattccatgatgtctgacttgataacctcccagcaacatctgaagaaggtgcctgtgaagccgtctggcccaggtgccttctcagcaagcatccgtttgatagcttcccaaacatcctcctcggtgaagggggagtcaagatcttctggcgtcacctggggtaggtgaagctcctcccagtttagggtgcaagagcgagggagtcgctggcccatcagagaggagaagtgttcgtgtagggcacgctctttggcttcatgagtttctgggatgacgttgccacggtggagtttgtgaatgaagttcttccgatggcacgcattgactttcaagtggaaaaacttagtgtttgcatcaccctctttcagccatgttagtgtggatcgctgtcttctccttgccttctctacagcagcaagaccaagaatctgtagctttagatcttttctgagggagatctccaagggcgacaatgctctgttttcttgtgcaatgtccaaacggaggattagctcatttacgagatggaattggatgcgactgtcacttaggatgcgattgctccaggaccgtagagccttggctgtagctttcagcttggaactcaagcgcttgacagggtgagaagcgctaactggctgggaccaagccgtctggacggtgtcaaggaagcccggcggtcttggccaaaagttttcaaatctgaaagttggttttcgcagcagctggtgtgttggtgagagcaccagggggcagtggtcagagttggaggaagagagagcttgtaggttgtggttagagaagagcatatcgccatctgggttacaaaaaatccgatccaacttctcgagggttggggcatctctctcgttactccaagtgaatcgtctattttgcagtcttaattcacggagttcacatctatttatcgcagccttgaaccgccccatcaatcgacgatcaaggttgaggttattcttgtctcttgcctcataaatcaggttgaagtcccccataatcagccagggggtctgtcctgatggtgccacttcgcacatttcctggaggaagttttccttatcagcgtcatccgtcggtccatagacgttggtgaggaggaatgccgtgtttgaggaccgttgggtgagacggactgagagggagaaatttctgatgttgatatcactgtgctggaggatatcatccatcccaaaaggtagctgctcctccacggctcccatcagcaggaaggtagctgaaattattcagtcttggacccccaatttccgaacacattctttggtccatgattgccaattttgtatgttggaggcacatgatggatatgcggttggtggttgccacttcgcggattgcttctctttttgccgggtagtttagaccccgcacattccaacacatgatatgttcactaatcattgcacaacgagacaaccattctaaaaaggcagcgtcttataatctcagcatttgaaccaatacattgccacagcagtagccaaatactagttactat

SEQ ID NO: 57986 - DNA, 1517 bp, Oryza sativa
atatatatatatatatatagtaaatttgtttggtgctccatggtgcccgggcaccattgttgaaattgagtatatacccaattcaaatgagtatgaaactttttcaattacttaggtattaacattaactactttactaactagtttaaagcaagtttgaactgaatttgaacttgtttttgttagattttgattctaggtatatagcatccatacatataattagttaggtatgtaatcatggattgtgaaataaagttaaatttgagttgttttgttgataagtataggtatgaatcaaattattataattaggtatatactcacaatttaaaaattttgaaaaatttgagtgattttgtgcattagataccatggtgcccgggcaccatggtgccccatatgagtgtcatatatatatatatatatatatatatatatatatatatatatatatatatatatatatataaaagttttatttataaattatttttcgtttggcttcttccggataggtctctaggtttacgtgggatttttctggagggagacaccacaaattgcaacattagtactgttggattggatggatacttgtttggcatcgatcaggttggccacttggccacagtgacatgaaaaaggtgtactaatgacggacaaggacgtgacgtggacgcctggggggtcgtcattaactcgaggttaaagctcggaatagcatcgttgggtgacgaggcgatggacctctccgcgctgttcatgatatatttcaccgtcgctgactagtggccccccccccacccacagtctcgttccccttcgcctccggtctccatcccacccgcccgtgtgggggaccgtgtgcagtgcgacccattgggttcggactcgggctcgacatgattttggccggctgcggcgtcgatcgtccatcatcgcccatgccgtcgcgcggtatttgcgagatttgcccctcaacatgtggtaggatttgctccccggaatccggctaaaacctcccattaattgtcgagccatacgtgacgttgttcaagtgatgattcgtagttactctgaaaataatcaatttctgaaaataaatctggatgagtatctatctaattttacgtgtggaagttagtttttttttaatgaacgaaggaagtacattacagtttagtccgagccatctctttggttggcctgcttggcatttgcggtacgtgctgctacggtgtaaacgtaaacgtgaaggaatggaggttgcgagtgagtggtcccccgttcgggattgttgccggcggcgggcgcgccacgaggatcggtgcgtgaaatcgggagcggtctcgtcacttgttcctgcttgatcaattcaacaaaacgggagagagaggctgcagtgcagacggggcagggcttggctggcgtcgtcctcggccagctgcttgcgacctggaacccaattcaccggcagtggagcagcatatcaacctcctgtacgccttcctgca

SEQ ID NO: 57987 - DNA, 738 bp, Oryza sativa
agaagggaagccaggccggcgaggaagggaaaaaagacttgggctggaaacggcccaaaggacatggacggaattttaatttggtttttaatttaaataattgattaaatgaactttgtattattgaaattaccactcgagcactgaaaattcacgagaaatttcaaagagtactttatggccaactatgatttttaaagaaaaatttatttcccacattaattttactttataaattgcttttaattttaacataaattatagaaatgatgtactatttgatttttaacctcgaaagaaaatcaaggcataacattcattttcagaattttatagctacatgttcctagaatttgagtgacaatctatattacctggggagctagagatctttggagaagctcccataaacataacctttgtaaaactgaacaactctcgaaaagcgctcttaagcggtacctctatttctctataaaaaaccaaataccactgatgaagtatatattgctctcgtcctaaaattaaaaaaacaaagctttgttttttctaaaaaaaaagttccattttccaacttatattctctcattttttatgtgcatatttcccgaactgctaaatgatgttttttctctctctctctctatatatatatatatatagcatgtcaaaatgaaaagctatccccagaaaacaaagaaaacgaacttaggcttgattggctgaagctccatgtca

SEQ ID NO: 57988 - DNA, 958 bp, Oryza sativa
attcttagcccaagccagaatgcacgtgggccacaaaatttgatggcccagcatggatcgacgcccggtggcccatgttgcgcggtcgcgtcgccgccctccccccttctcccagacccagcgtggcggcgccgccggccgcccccacctcaccttccgccgcctttgcctcccgctttctccaagcgcggcagcgccgccgccgccgccgaaccgtctttctccttgccctccggctcgctctgctgggtcgacgaaaagcccggcccatctgcatcgttgaaagcaacacctccacccaaactacagccgcgcggaatctgattcttttttttttctcggaaaaaaaaaatcaattcgaagctcacagtagctcgcggcggcggcggcggcggctcgggctccgacttcgtgggcgatggcgggggcaggaggagggggagtgcgcgacatggacgcgctggagggcgtgcgctcaatcgtgttgaagccctcggagtccctcgacgaggggcggttcacgaggatcgccggcgccgacttcaacgacgccggcctcggcctccccgggctgctcgcgtcgctcgccaccaccggattccaggcctccaacctcggcgacgccgtcgacgtcgtcaaccagatggtacgttactaattactgcaccctttgcagccttcctgccttttgcatgcccgtgagggaggcgaagcggatttgggggttactgtagcttgaaattgttgtgtttctagatccttggagtttcttaggaattgcaatttagacgaggcccattgctgtagctgtgttggtgtaattggagctgaagaggtgaagtcatgtgctgaatgatgcgatagatgtggttgctataaaatcggaaacttgcagcttattattcatgctaggattgacgctctactgatgattatctcgataattcctgtcagatga

SEQ ID NO: 57989 - DNA, 6682 bp, Oryza sativa
cggcgacggcgagatcgggtcgagcggcaacaaggcggcgacggtggttcggcggcaatggcgcggtgggtgcgaggcgagtgaaaacgagagaggaaggggtttggggcggcttgggttttatagtggaggaatgtctgtttgtggagggaggaaaccgacctcgtgcgctgtcaaggatgcaagggcggcaagctggcggtcgacgcgtgcggccaaggaggcggcaggtgatgacgccggcggtgtcgggcaaaggtggaaaaaggagaggagaaaggggctctgttctttgccgttttttttaggagagacgaaggagggggagggcacgagagagacgctgcctccgtgatttggatggttgcggcgtggggttgcagggccaggcagcgcaggcgctgacggcggcgggcgaccgggcggtcggccttgaccggtcgcgggcgcccaaagcaatggcggtggcgggaggatttgcaaggcggcggcggaaatcggttggcgagagagggaagccgagagagagagagagctcggctcggcgatggttcatgcgcacgcgcgtgcgccgcacgtgcggagcgagggaggggaaggcggagagagagaacgggccgagagagagaacgggccgagagagagatgggccaaaggaggacatcggtccatccaaaagcagaggaaggcacaatagactttttcagaggggttgaattgttgaggtttagggtttagattcgaattcaaatttgatattcgaactcgagggtttagggaggaatcaagggagactcgaggagaagtcaaggaagagattcaaaatgagattttgatatttttgggaacggggacaagtatttggcgatgagttcaaaggaggaggttgaatttcggaaatatatttcggaaggttgaaatggaagatggattccgaggaggcgatttttgatggcgatgagagggatcaaggacggatttaaattgagatcttggcacgacttagacttacactcaaagaacgaaaattttcgagaatagggttttgccgaattagtttttaacgtcatacgaaaagcggagcgttacacctatagaatttgttggttgaaaacagtttgatagttcggaaaacgtgcgcgcgtgaaaaacgagataaatctttagcctttcctaagtggccgaaccgtgcctaaggtcctgtttagattacactccaaaactttacaccctgtcatatcaaacatttgaacacctgcataaagtattaaatatagtctaaaaaataactaattgcacagattacgactaatttatgagacgaatcttttaagcctaattgctccatgatttgacaatgtagtgctaagtaaacatgtgttaatgatagattaattatgcttaataaatttgtctcgcggtttacttacggattctgtaattagttttttattagtgctcgaacactccatgcgataccctatataatatccgatgtgacaagagccaaaattttatacccttgagtgtaagcgcccggtaaatattttgttcctccaaaactttcccttgcaagacaagtttaaggtggttgaggaaaaagacgttttgtacagttttcaatcaaattggcagcagttcgctagctgttatggaatcggtggtggaataggagaagatgagaaagaggaaggggaacgactttgcctctcttaagccttgaagtgctcgatagttccttatgtagcgagcatgcatgcgtcaaatagacacatgatgaaaacggtatggaaacgaatggaaactacctctatcgattccattttcatttttcggggggaattaattggaaccagaaaccttggatgttgagacggaatcaaatattgtcgaaaccgaaaacatagagaatactaactgacacggatactgtaacgaaaatttattgaaatacaaccccccccctcacctcaaactgagcttcaaactttatcaagtccaattacaatctcaagtctcaacattcaacggtacatcacaaaacacaattaattagaatgctaacgtgaattgggttgggctattattagggtatatggacatggtatggaccttttctcctatttgggagagtttctagctgctatagcttcttcaagaagttccagctcctaaacagtttaaattctcctagattctaaaaatttggagttataaaatctagaaaataaactagaagtcggatttctcagctttatgggtatgatccgactagtcaactcaagtcggaatatgactctgcttcttttttcttatttggagctctttctttatttattcagaacttttgccatatgtataaggcttgattcaatattggacttggtatatagtgggtcgcgttgtacacaagtatagggtatcccatatttagaacactaacctatacaataactgaacatctaattttattatagcactttttaggattagtctatatatattgttttagtgtattcaaactaaatatttttgaaatgattgatagtcaaagttgtaatagtttgatcccaacaacatcaagaattgtgaaattggaaggagtataaaaaataagaaatgaggaatctgggggtagaattaaatttatccacttgatggattgatggatgcttcttagataatgagcttgatgccaactgtctgaaacatgtgttaagcttctctatttaatttgatggtcaagctggtggcttcaaaggtacaacctctaactctatttatatgtcacggtgtttcttattgtatacctcctccgttccttaatacaagggattttatcattttgcttgtactgtttgatcactcgtcttatttaaaaattttgtgcaactgtagaaaacgaaaagttgtgcttaaagtactttggataataaaataagtcacaaataaaataaataataattctaattttttttgaataagatgaatagttaaacagtgtaagtaaaatgtcaaaatccctcgtattaagggacggagggagtatgttcaagtgattggctaagtctgtcaaagctacggtgtttcttgttgtatatatatagattcatatgtcaacttacaatgtgttccgcttcgagtcgagctaatttctggccagagtacgcaagtgcgcggggtctcgagcagagatcaaagtggtgccatctggaggtcgatcatcgctgtaagcttgctcggtctcgatcggcttaacttcgtattgaggtacgtatacgctctgatcagcctttatactcttatatatgtctatcgacatggattgctggtgcctcatctggagatgtaaaagatcttcgagtttatctcttatgaaacagctgagattaatcaaagtcttcagacttcagagaaccattaggccataaatttatcttctgcttgctctcgctcgatcgagaaatgtactatcctgccaagctctttcagaataccaagataaatcacatccccagttctctcacatcttaaatgttgacgttcgttcgttgactcctttatggaaggtgcatgtcatcagcgatttcttcttcaaggcgttctgtcgtcggctatttttttttaacgaatcacacaagacggtgcgatgttttattaaaattataagattacaaccaggaaggtcgtaaccagaaaaaaaaaaagtataccaccatcacccacacatcaacagcgccaacacacagaaccaagagaaggttagcactagaccggccaccgctaagcgtgaccagctgccactatgctaacaaagaaccacggccgagatcgcccaaaacccaacccttacaatcaacacaaagccccgctctatccaagtcttcaggagttatggagagagggtgagagagaagaatggaacacctctcccccttaggccttccgacgtggccaacttgtagagactagtacgccgcttacaagaggatgaaatctagagggagcttgcaccaattggttgtggggtttcggctaggggatgcctagacgacgtctccaaggagagaagcgacggagaacactaccgccgccgccgtccgtcaaggtcttaaagagaaccgagactgggctttcgttcggcatccacacatgagggatgagacggcacgacaacgccctcaggaggggaatgacgctttgagcgtcatcattgccggcccggccgaggctaggctaggttttcacccgccactcatcacctacaagtccacggctggcgcccagatgctccaccaccgtccaacctctgccaacatgtgggtccactgcaccagcgcccaccgcatctaccggcagctcctcctcctcacaccgtgcccggctccgtcgccgccggccgcgcctcgtcgcgtcgtgcctcaccgcgccaagctagtctcgtccatcgccggctgcgcctcatcgcgccaagctaggctcccattgccgaccgcgtctcctcgcgccaagcccgcctccaagcgccgagccggcctccgctgccaccgaccacggctctacgcgtcaagctagcccccgagcactcctcctgccgctgccgcgcaaatacagtcatctgccatgcctccccggctgtcgccgttcgtgcctcctctcgcagtcgccgtcgcccatttccaggcgttgataccgtgtccgcacccaccatgctgccattgcaacatcctccattgttgccgacgacgcgtccaccgccgccgccaccactactggagctgccccagccgctgccaccacccctgcagctgccaccaccacagcagctaccgccgtcgccgccgccgccgccgccgtcgccttccaccgtaggcagccacgcccgcggcttgccgtcgcaggtcaccatcgccggtcatcgttcgaccagatctggcctgccacggtcgccacatcgccgtggtcgctagctgccgccatcaccagacgtcactgccgccgtcgccaccaccagcggacggccaccactagaagccgccgccgccgctgccaccaccagacaccacctccaccgccgccacctcttcgccttctccgtcgccaccacctctggaccccactgccaccaccgctagccaccgccgcctcaccacgctgccccaccgccggccgcctccccaccagatctagccgcggcggcccagatctgggcggtcttcacaccgtcccgtgctgccccccactgccggcgcgacgagagaatgaagccccgccgccgccatccttgcggccgctcgggcggcggcgcggcggaggaggaaggagggggggcgacgcggggttgccgcctcccgtgtcgcccgtgagggaggacgacgcggaagaagttgtgtaacacagtatattttgaagtttctcgtcggttatttggtttcatggtaggcaactagcctctagccattaattggttactcctagtactgcctgcctgttaattctcttcttgcctgtagaagagcctattgtcgcaaggcaacatgccaacatgagacctgaaaaggaataagtcaattgttggcagggttatggataacacatatccaaaagtaatcgactaaactcggcagaacccaccatatattaagtcttatatggaatcatgccttgtatatatagaaggagttccggataaggaagaacaaatagagttcaagctggaaacgataaggactacccatattgtatcatatttatctccctagttttacttggacaaggggacatatatgggtataaatacaataccccagaaggagagacaacacaaaaccaagacaagcctgaacaaaccaatacacaccgctagacatcgacatcggagattagcctagacatacccaatctagtgccatcggaggccgtcaagagggatttagtgttatctctgatctggccgagtatgtattcgaggaggaagactaccctgtcgtcaactacgtgttggtgtttatgtcgccaagttgacgacgactagataggctatcccaattattgtacttgtgagattctgatgaataaaagcaacaccggcttcgaccaacaggagtaaggctattacctgattctgatgaatgaggggcccaaacctatataaaaatcattatctctgtctctttaaccttaatctcacatataccctgataccaacgatccccacaccatgcaaataccgtagtcgtgatctaaaacatcgacaatttggactccctcaactataactccaatatgattcatatccttaaaccgtaataccggatatcttgacccctcaactatgaaaatcggtgcaattttattccctcaacagttttgtagagcggttccgctgacgtggcgctttgacttggtctaacccgctaagtcacactatgggactcgcacgtcaatgtcacacattctttattctcttcattccctttcccctcctcactttcctctctggcggaagcaacagggcatggcggtgatgacgggaggctgttgtcgcgtcgccaccgtcgggcaggaggaagcatgagcgaggatggcatggctgtcagaagggaggttgtcatcgcgccaccgtccctcccatcactgtctccgcctcccctccgctacccccttccgctcgccaccgtcg

SEQ ID NO: 57990 - DNA, 3485 bp, Oryza sativa
ttcctgcagccctttgtgaggcccctctggtcgatttggtgtgttctgctactgcggtccatgtaccggttcatcgcagagagccttgcgctgttatccctgtggcatggccgcagttaagagctccttccagagtacatgcgtaacaactttgggaggggaggattggcatccggtgtccacaacgcggaaacgatggacggatacaaatacttggtccatggcgagtccaagcagaagatcaaattactgaggcctcgatatgctctctatctcaatgtcaccgatgaaaacttgctggtcacactggacaagatttggcgatctgacgggccggtgctacagtccgccaacagcgttcacggagacgactgcaaggatctgtgcctggccttttccatgtcgaggtttctccggtgcaggctcgaagacgtgaggctggacgcagacagcctctccatgtcgcggaatctgatagtgacaagaatattgcatgtcgaccagaaccctgcgagggtgttcaggataatggagctggagatttcgttcctcaaggactacttctacaccctctatcctatcgtcttctggcaaggccttgcttctctctccttgagtgttcttcagtctctcgcggccttgggactcgccctctggctcgcctcgggcgtcaatagggtcaagaaagatcttccggaccccgtcaatgtcgtgcacggccataatgtggaggtgacaatcacatgggtgttcatgtccttcatgatgttcaaagagatctgggagatgatcacttacttgctatcagactggacaaggcttctccttgtgtgcgagtatacgcggtccagatgcaggtggataagaaacgccacgatggagaagctgttaagttcctttctaacgttaagttcctttttaagtcgtaagatcttttctgacccttggcatggatacatcgaccagtacgacttcttgcagtcatttgattacagcccgtcgctctggaacctgatgtaccgtgctactctaggcgtcatcaaagagagggtaaaagggcaaaagcctggcaccgccatcaagatcccagaatgtgtaaaacctgcaattcttcaggcattgcgctcaatggatctcgctggcttgggcggccgcgagcttccccgagacgtcccatcgttgagcgccgcgagattgcttgaggatttccgatgggcgttgcttgacctgtacacgtgctcccaggtcattctggtttggcacatcgcgacctccatgtgcgagatcaagctcgcccgagacaggggcattgacctgagcaaaccagggctcctgcgctccgccttcacgtacctgaaaatttttctctgcggctgctgctgcactcctcagccgtacctcgttgctgaaaatattctcggtgatgatcaactccggactagctacattgttgcaaacagcttgtcacgatactgcgcgcacttggtggtttttcagcctgacctgttgcctgacagcttggcgcttctgatattatgaatgaccgcgactccttgctgacaaagtatgacaagctcaatgggttgttctcacccgaagctgctgaactgaaaaaactgaacgggaccatcgtagagaaaggcgcggtactgggaaggcaattgcttgaaacaattccagacgatcagcagcggtggcaaatcctggcgggtgtatgggctgatttgctcgtgcacattgcgcccagctggaacgctgaggcacacaagatttgcctcgagtacggaggggagctcatcaccttcatctggggattgctctggtactgcggcatcgagaagagcagcctgtggcgagatcaggacgatgcgcctggagatgccaacgtccagcctcagcctcagcctgcagcagaagaacctcagggtggccacaatgtcgaagatgatgcgatggtggaagatgcccaaaacggaattgaagctcgtgaagcaggcgtgcagaatcaaccagcggagcaggtgctgcagcaagctgctgaagcagatgtggagattgcagatgaagcacgagaagacgagcctgagcctggcaacgacatccacgctcagtctgctgctgacatggagattacagatgaagctcaagaaggggagtctgagcctggcagcaatgtccaaacttctgctgctggtgtggagattatagatgaagctcaagaagaggagtctgagcctggcaacaacgtccacactcccttcagtgctgacgtggagatcgcagatcaggctcaagaagaggagtctgagtctagtaacaaggcccagtccgctgctggcgtgcagattgcagatgaagctcaccaataggagcctgagtctggtaacacaacaggatcaggtagaacatcagaaatacctgttaaaagacgctggagatatgtcctgggattgagatgcagtgatccggaagggaaacagtgtccggacctcgcagctgatgagctgatgtgtgaacacacatcaagccgatgaagagcagtgcctctcatagtcaaggttgagtacttgagtgaaactgtgaaagccttgtctgcaaaagcaagaaaaaactagaagattattcaactcatgcagtgtgatatcttccgtctcccgaatgcgtgcagcaacgtactttacaaatatataactttctttgtacattgtgcttatgttcaattttgtttgcagagtatttatgttcaaggaaaaaaaaagagagtttttgtgttcagtttatctttcgacagcgtttatgttctgtcgacagtaatactgcagccatgaatgtttcacaattctcctcaggttttcgttcaagaattttgtttggatgtctatggttgccacattcttggttgcacaaatcatttgggtgtcaaatgccttattgccacatgcttgtggttcccaaactgtgtatggattctgcaagcatttctggaaagagagacaaactacaaacccaactatcctacaggctgcactaaattgcagataagcgcagataaaaatcaaactatgaatcataatactagccagcatcattttgagatcacatccaaaacttttctctccaatatgcggagataccatggcagtacagtaatcagtactcagtaggtacattgtttcagtagatcaggagccgcacctggatggctcgccggcccagaaggaatctgcgccggccactcgcgacacggcggagtgcacactgcgcctctgctccatccgccaaaccagagcgagccaggctgcccgacggaaggtggccggagaagccgcttctgggaggaaaccctccagggcagaccagagcaacggcatctccagcgagaatgacccccggaactggatcggaatcccttctccattctccctctgccaccaccacggcgacgcctcctcctgtaatcagcatgatagatgcattttttggtc

SEQ ID NO: 57991 - DNA, 1013 bp, Oryza sativa
attacgttcttccgggttcctgcacgcggccacaggcaatacttgtatatatcaacctggatgttaatttagatactagtagtccataacccatgcattcgtatatgatgaaggcttatctactttgtatctcagttttgttgaatttcagtttataactagtatggcggtccgtacatattgccggttaatattgttctattttatttctcaccgaatagcatatatgggttaattcacgaattcatttataggccaaataaatgaataaccttatttggcctatcttacaccgttaggtgcagcccgtcgggtgaggatggcacaaaccacaaaggtacgttggcacgtaggtcggcaaggctctggcggcgtggcgcccgggcctatcgcacgatgcgacatgttccacagaagaggaaagtcttgatgacccagcaacgataccagtatttgtgctagggatcgataacttgtgatgggccaataatgtgtagtgagccttgcattttcaggtggaataagtccattgtgactcctttaattaagtagtggaatcagccatgcggcgatagcggaggggaggcggatgcaatggcaggagagaacgggcagcacggggaggtggcacgagatgagacggagcggggtggccgccagggccacgacaatgcaccggtggcggagcaggtgcagaggctttcatcacgcggggttgagggcagtagctgagggaaggcagaggcagtggtgggagggacaatggcgtgggatgagatagaacggggcggccgctgggggggggggggggggcgacgacggcacgccgctggcagagcaggcgcggcggctttccccatgcggggttgaggatggtagcagtggaggggaggctgtagcaggagggacggcggcgtgacgacgacctccccaccgctgccaccatccttgctcgcactccctccttctcaatggcaacaagcggaagggggcaccggaggcaactactggaa

SEQ ID NO: 57992 - DNA, 1541 bp, Oryza sativa
caaacattttgaaacggagggagtagttattttacaattacacttaggctgtgtttagttcacactgaagtttgaaagtttgattgaaattggtacgatgtgatagaaaaattgtgtgtgtatgaaatgtttgatgtgatggaaagttgaaagtttagaaaaaaaaactttagaactaaacagggccttacatgctagatttttggaagaaagttttaagacaaagctagcaactgctcgcgcggcggctgcgggcgggagcccacaccgtggcgcgcatcaaactcgcccgctaggatcttgcgtcggcgcgccgttggacacttggacttggaagactcagctagcagctggccgatggagagctggtcgctggctacttggctagctagccaatctctccctcctacttgcaagctgcctcctccgacatggaattttcctgagcgagaagacgaattgaaagggggaagcttgatgacttgatgggcactgggatgggatgttctgccgatcacaatccatcatttacgtcgtgcttgctttgattgtcaaacagtgccagacgatgactctgctgatcgatcgcttttaatttgtgatctccaggctgtatgtattactgtacactacagcgctcatgctctctgtagctctctcgtcttaaagtcagcttcaaatctacaactggataactgcttacagagtaactgagagtactgtgacagcaacaacatcgaactggaaattcaaggcgagattgttagaatttatatcagatatgtatatatacaaaattagatataaattaggacttgagtgttaaagatatagaagtagaattaagactcttaccctaagctctctcttaaatagagtggcgcataccacacataatgtaatcgtatgataatgatagcgtaagaaaaagaaataaatggccagcaacgtaatcagtggaaggtcattgataccttgatagttatagttaccatggatagaggaggagcatccgtaactagtgctctcggatgtacttcctccgtcccaaaaaaaggcaaaccctgagtttccgtgtctaactttgactgtccatcttatatgaaatttttttataattcgtattttcattgttgttagatgataaaatatgattaatattttatgcgtgacttgtctttttaatttttttcatattttttttcaaatcagacagatggtcaaacgttgggcacggaaaccagggtttgtctttttttgggacggagggagtaggtttcgtagtaactttgtgcatcgttgttgtcataaaatttgaattttctaagggatttttcctgtgtttggttgtggacgggagttttggtgccaattttatactccctccgtttcgaaatgtttgacgccattgacttttttaaacatgtttgaccgttcgtcttattcaaaaaatttaagtaattattaattattttcctatcatttgattcattgttaaatatatttctatgtaggcatataattttacatatttcacaaaa

SEQ ID NO: 57993 - DNA, 620 bp, Oryza sativa
gactcggccagcttgggcgagcggcgcaatctccttcccactcgtcgcccgccatgctaagagagaagagagagagagagagagacgaggaagggagagaagagggaaagagaaagctgatgtggattgtctgacatgtggggcccacgcaggtcccgcgctgactcagctgtcatgtcggacaaaaccgaggttaaaaccaacgaaggacctagaatgaatagttttgtaagttgaggggtaccacatatcatgttttgtggttgggggacgattttgtatctcgatgacaagttgagggaccttcggtgtactttttccttctgagatattacaacaccaagtgggctgggcctccctgggccacagtacagtggactatggccttggttgacattggattttaggcatggatcgtgcaaaatgaatggaaaaagtacgaattacacccccgaactaccgcgatcgtccgaattacccccttgaaccataaaaccggacattcttcacccccaactaggcaaatcggacgaattacccccctcgaccgaatccgcggtggtttttgtttacgtggcgtacacgtggcagtccagtcaaaatttttttcttaaaaaaat

SEQ ID NO: 57994 - DNA, 12961 bp, Oryza sativa
ttttgactctggttttgtccgacaatacaatattatgaaatttttcatctcacgaaatgacaacaaaattaacataatgataatatattagttaacaagaaaaccattgcaacgcacgggcattatgctcttttacaaaatgtaccaaacttatgatattatgacattatttcttgaggcaaattcaagcatgcaattttttttgttgtttttaaatttggctgtttgaaatggcatttggctcgagatagggacgaaaacggcttggaaacggacggagactatagtttccataacttttttcggaatcggaatcggagcaggaaacctcaaatatgaaaatggtattgaatatgaaaacatagcgaaaacggtaacggatatttatcataatagaaaacccctcactgaatttttcaaactaacgaagagtgtagctcattacttttctaaaataataaatcgacatttctatattttttttatcaattttaaatataatacgactagttgtacggttcacttaccataagaaccaaagctatattcatctatacctgtaattagtatggcatggccaaataatgaaacagtaactaggcaaaagaaaaaacatctaaagtaccgtactaaaatcaaaatcttcattcaactaaccacctcaatactatgaaaaatctgaacatagagtagagaaggctaaagctaatcaactgtatatgaaaagttttcgtttccagaaagtttccaaaattgtttccggaaagtttacgatgccggtttcctacgaatagtagccttactgtatttgtttttatttccaagaaaaaaagttccgaattcatttccgttttcgaaaattttcgaaaaaaaatgtccgactgacactttccattttcgaaaacatgtccggaaaatgagaaactttccaaaccgtagctcgagagaaccaaaataatcttctaacaaatttcgagcatataattcaaaacagctacgcaaataatagaagacattgcacaaagaaggctgctccatgttcgtttactaatgtctcatccagttattttgaaacgggaagtagctttttttttttaagaaaacgggaagtagcttttagaacttaactagccactttgtcgcgcgttgcgcgactttggtggccctataaagccctgtatgtatggatcgtaatgtatgagattgtacaatgatgtctaacactcttaatgttatgttgccatttagaaagaggttacataagtgtgatcctccatgttgctttattcctcaaacagaggcactgaaggtgccattcctaggtgagtggaagtggggagtgtctcagatgttgtgaacgctgcttagaaaattgccatcactttgaaccaccaaattggcacaagatcactgttggatgcaaaaagaaaacatgttatcttataaaggaattaacatgatgagcttggtggtgaaactttagtatttaggagattgacgccacaaatgatcgagaaaggtgccatggccgagttttcatgtacaaaatgttatgttgttgaattgtttacatctaacagatggtaaagaatctagagttcactgccctgtttataaacatatgtacaatagaaaactgaaattcatgattgcctgttgttattataaattattctaaataacttgccttctatattttggacagactattaaccatggcacgtatgactctatttacctgtctagccaatcattgagcctaaaacatcctaccatattcattttatggtgttaaaatgcagctctggaagaaaaaagatcaattcaacttgtctctataccaagttgctgcttattatagaaaagtttattagtgtgttctgggaataagctgatctggtattgcaaagtgcaaacgttgttggttatagccaaaaaagaaaggcaccgagtcgatattgcgaattgtaatggcatttttctaatatgacatatttgtaatggcatgactcaaattaacccaaaaaaggaatgtatcacacaacctcaaatgtgcttctaccttaaatatgctccttcaccatacctgtgagtggtttctccaatctgtctgagtcatcacacaagcaacaattaatcatcaattcagtaagagaacaaatcaaattcaatagaacacgtaagcacacaacatggagctacacaggcaagaatacttcggctgaggaccggtacaggtaatgagctgatggaataaattcgaaatgacttctgtacaatctaattgatacacaagtgctaggcctggaccacaatattatcgctagaaatcaagtaatgaatgccagcaataagattttcagtctaaatgtggaactatgtactggcatggcatgtatttttagaatcttgatgaaatccttgatgactcacaaccttaaaagggtataaatgaataaattgtttttgttttatatgcctgagcagtacttggaccatatttcagaactttttatcagaatcaactcaagagaagaagtagaaaatgtatttaaatatgtgtattcagattttttaatggactacttcatgatgtagataattagacagtaaattaagatatatcaataatgttttttaacttgagtagagttgcttaaatactgcctgcatgcataccgttgaattctgtatctcgagagatcctttgctcatggcagtctgaagactatatataaattgaatcgtacatgacatttcaaggttaaaacaaaatagggggtgcgtttgatcaggaccttcagttaccttgtttcctaactccatgagatccaagaggcaggacttttccttaaagtatctcttaatgatttctgtgggcatgacacttgagctgatatggagtacaccatcacttatagcagacaaatcacaaaccaacctgacattgtcaaccagctgaacatttcagctatcattcccaagacaggatccagcgctaccatgaagaaaagtaagtaatggacgaagagctcgcaccgttttacctcccttgcttctgcactgacgcatcactgcctctgctgttgattgagggctccacgcggcactcgaccatgccctgtatatctcattctgcttcagcggtcgcttgccttcttcttccgattctcctcttcttgattccataggtcaagctatggtcagatcgaatcaggaatattggaggctggtggctagatggagggcccgataacctcctcctacctatgctctccctagccgcagggattaggaggaggcagcggagatcgggaggaggcgacgcagctacagtgctgttggggaggagaacagctacgaccttagcaggcggaggcagggccgctaaccggctacgaagacgaggatgagagtaggcaagcggcgccccagtctcgccggagtgcgggcgaaggtggacggggagaaggaactgaggtggcggcggcgaggggcgacgagaattggaggcggctttggcaggccggcgtccacggtaggatgtagggggcaaaatgaaaatagcgtaagtacccagggacgtggaaggactagaagtagatagaagtttcctaaaggatcaataagatatttcgccaatcaaaggatcctacggtctgtatcatccggaagcgaaatcgggcggcccgcatttattggatgacgtggcgcagtaatttgcaagaaagcttgttgctttcactattttagatcttttctgtgtttacaaagaaaacacctttcgtgtataatagccccttaacataaacctcccacaagttgtaggcccctagctcgtggctagcctcttctccttaatataagagtttagggtatggtttagggtttagggtttagggtttaatatatattgttagtatattgtaccgtaaaagttctctaatatgggcatagctcctgtttcaggaaaaatggtaggctttggatacccaactcagcatgcactaatttgtattctatagtcaaacacaccatcctgttttatatgaacacacatgatgatattgcaatgacctgtcctaaataaaatagatgtcttagttacgatatccagctcctaattaattaatttacacattatttgtagctcaaaccagaagcatatgcacatgatcggctgccacggttttatacggtttatgatattattaccactgttatagattaacaaatggtcaagtatgtcgttggcaagaagaaaggaatacatgattatttagttggttttgtctagaggtggagacggaagacagtaggtgcattggcatccctcaggagtgcacttgccagtagatattgcagcgacttgcgcgtggcagtaaggcacaacattggaaaacaggggccaggtgtgatggtgaacttgcatgagtcttttggggttctgtcatcgactaatgccttcatcgacatatctgcaagcaagtgaaataaccaaatatttatgtgaaattcacattcaacgctcatgcctttaggcaataaaaaggaatttgtctatgtaattaatttttttggggcattatgtcatgcgaatcttttaaccgtaggattcaaactgaaccatctagatctttgctgcattctcttcttatcccgttattttcttcctaggtcaaccgctagatagaatcaaggtcgttaccggacacaaggtgcgtgctatttccatcctccccactccctccaccctgcaccccaccactctgtaccctatcggtgtcacctttgtagccatcaaactacagcaccccctccctatcgccatattctccttacaaccttgtttcatcttgatatcgctgttggatccatcgcagtcaatgaccgccagcgaacctcttctttgtggatgccccctacccctggcctcttcccccaacacagctttgtcagcgcaacaatcacctctcatcgtcatcacctattggttgtcctgcatcaccctgaacaaccaaccccctcccccctttaaagtagggaactcctcccaccatccctcatcccccgctgccaacaccacccactccctccttcaccctaaccccttaccttgaccacttgtgaggttgtcaaagtttatgggagcctgttggaagattaatccggatctaggtagtgcaggtatcatagagcaaatcgcaaggtaaaaaaaaaatcatgattttgaccccaaatttttgccaaatgtaatatagcaaatccgtaaagaaaaaagactatctccacccatgtagatttgtcatcctagttatggaatacaatagatgaacaatagggaagtttacatgaatagtgtgctacgagggaaagggctagtagcaacatgtagaatagcttcatcatcctatgcacagaatgtgatgaggtgttgacggcgagtgagctagcgattgcaatccggcgatgatggggtactgttgggctaatcgcggttgtgaaggtgattgctatctaatcgattcggcgtgtcttttgtagcttatctttttattattatggaaacatactacacagtttcttaataatttggaatagctgtgattgcaaattataaaagtttgttctttatgttgtaattaatatcttacatatataggctaatcatggttgtgaaggtgattgctatttaacttctatagctgatttattattattattattattattattattattattattattattattattattattattattattattattttggtagcataatttggaaaaagttatggttgcgaatgataaaaggccataaattatggcataataaacatcttctatataagctatggtatttaatcgattcagcatcgattgtcatggcctttaaagtgatattcttttatgttggaaatcgtactgcacagtttcttaataatttagaaaacttatcattgcaaataataaaaaggttgtcctttgtactcttgtttttaaagacaaacttagataacagtctcacagtttatcaatgttgtttgatagcctttgatgcgcttgcatgggctgcagcatatagcaacaggccaagcaatagtgcgctataccttgcattggctacggctacacagtcgaagcaatgccatagaaatgtgactactgaacatgtcaatgttcattgttgatagaactgggagtacggaagatagtctctttaagatggctaggtcaaaatataagcaaaggaggactcaacaagatttgaaaaaaaaaacaacaatcaggtcctcctctgtcttatgcccacattggtggtgactggtgacatacttgatggcagtgggtgctacatggacacggcgagctacagaagatgttgccttgacgcattcccaaatagggtttcacaacaatagaggttaaggccatgacaattcatgaaaaggttcatcaataccatagatgagtacatccagagctaaatgagattgttcttggagcagaaccatcaaggtcgacaacctaatcgttgatattggtgatagagacaaagatttcatggcaagttgcataaaaaagcaccaagaagcttaccttattagggcctccatagcctaaggttgaggaatccaagcatatagcaaacaaaactcaactgcttcttgaaggtttgccaccaataaagaggaagaaaactatcatccttgcgaaaagcctgctggagaaaagaaagataacttgcctaacttcccttaactaggtctagctttctcctaactcacggtgatagagaattacccggtgttttagagggataccactagagaagaaacttcgattgccttctccatgaaacctaggactagaaggccaacatcgccgaccttcacgctcaaactaaaagaaaaacccaactaaattgattgacctacaaagagagagtttgtcggacttctctccctcacctcgccggcggcaaggtcacccgagcctgtgaggaagaggggtcgaggaggcgtagtagttcagtttggctctttcgtccgagagttcacgagagttctcatcactcgtgttaattcgcatattctttatggtctaatcaacacattcgatccaactcttttataatctttaactgattaaatcaaacgattctaaactttagaaaggagaaacaaaatgagtacgtgcagtatcgctaaaaaactagtagggcatagtttcatgtttttcatgggtatctaatctgagccgttgatctccaatcgaacggctcagggtaacctccctatccacaatattatccctcttctttctttccgatacgatagcccacactctcatccacactgctcttcccccccgcgcgccggccatggccaccgcgacgctgcccctccgcctcctcgcctccaaaaccctagccttcccctccgccccgtccctcccggcctcgcgatgctccctccccgtcgccgcgtccgcgccccgccgctgctggcggctcctcgcttccgccgaggagccggcgcccgcacccgtggaggccgaggccgaggcggaggtggtagaggaggaggaggttgaagaagaggaggctgcggtgccggagcctgtggaggcgcagatcgcagccgcgggcgccgggaaggacgccgacatcttcgccgttgtcatggtggggctagcttgcccttgccgccaatatttcagatttagtcctgctcggctcactgcaaacaaacaaaaaaagaatcacatttgttcatgctacattacctcgaattctttaaataatatcattacacaggcatttggcgctagttgcgttgcttcttgcggtgaagtgagcatttgatttcaggcttgtgttgcttactctatgctgcataagaagcttaggattcacgcgccaataggaatgcgcgcacgccgattattagtatgtacaggacacaccattaagaaaacggcgcagagaattacagtgttttcgaatgatacaatactagtcttacagagaattgttcggatgcatttctgaaatatgcaggagtgcatctgaggagggtttctctgtgttttgttttgtatgagcgctgtgaataataacgagggagctattttgattatttttcttctgtcgcagattgggtcgagacagtacattgtgatgcctggaaggtatatatacacgcagaggctgaaaggcgccaatgtcaatgatcaggtctggtgcttccactttagaggatgcaggaggatacttgttacaccctaactagaaatttggcctatttttgctagttagttggtttgtattaatccataaatttaaaaggtatatgatgctgaggtggcttctagataaggtgattgtaaattaggaaaaggcaaatatatagtattggttatttggttattattctttttcatccatgagatgcaataacaaacttcaaaacaacgaggaaggttgtacattctgaaattatggaaagtggtagtgacctacttcattttagaagtaaaagagtcacttccctgtaattataacacttcaatcccagttcctgatttcacataaatatcttattcagaacttttcgataagttttgtgtagcctgcatatattagcttcgttccttttctaactaaaattactcctctgatgcaaagcttccaatcccataggacccatacgttggcttatgttgctggcatttttagtattgttttcccagaaattctcacttctggataatgctgatgtgcagataatattaaacaaggtattactggtatcaactagagacaaggcttacattggcatgccagtggtgaccaatgctgctgttcatgcagtggttgaggaacaggtatgtcctctgtatgttgtcgggttaatcatggatattcaaaattacttgaccctgatgtctccccaatatttttatatcagggacgggatgataaagtgatagtcttcaaatataagaagaagaagaagtaccagaggaaacttggtcacagacaggtaagtttttccaattaccttcttcaagaaaggtagaattttattgataaatactgattcagtttttacagcgaagcaattagagttcttttagattaaaaatctctgttgttttgcagccaaacacaaggttaagaattaccggcataagtggatacgaggacttccctgctgacccgatacttgagtatgttccagcttaagagcaattgtaagttctgtagttacaaacaactggtagtacattagaatacgagtgctaccttttcttgtctggaagaacagtttttgaacaaaatttgctttgttcatgtgttcgagtgctgccagtcatccagttgttccatcctttgtttattccaccatctgttttgttcattctgatattgtgtatcctagccaactgtattattttcactgtgcttaaaaaaagagagagcattttaccacgatacggatgttttagctttggtttgtgtaactttatacagtttttgtgactactgatgctaatttcactgtttttggcatctgtaccaatggtgcttagtttattgaacgggctatgtcctaatattttgggatcagttacagtactatgttcaatgcagttctggtcatgatttattcgagtgttctaagagaagttctgcaaggccatatataaggtgtttgtgtgcaaccttgtactgcttagggcacataagcagctggttaggacttaggccatataagcatctacaaggcaggtggctgcatggattctgcttaccactttttagaaccttggttcatgaagaactgcagaagttttgcccttttgaatccttaccaaagataaccagtggcataaggcgtataatcttttggcaaactatgactgtttcagtagtccttcacccctaattgcatattacagttctgaattatagtggttttcagacatcttttgcctaattgaaacccttgttgaagtaaaaatttgaccactgtaaaggttcataaactaaatataatcacactaatttgttatatgctagccaattttcttgatatataagacttgttaattgtcaacatggttgtatgatgctatagtagattgttgaacaacggaaaaaaggtcgtctcttcgcggtgcttccaggtgtaaggaagtatcaaattcaggtgcaaggcatgggtgttaaggcaaggtaaggtgaccccagcacgccttatgccttaaggcgtcgcttcgccttacgcagatagaaaaataggaaatgaagggctttttcattatatttatggagtccaatcactaaatggaagccatatatctattgatccatccccatccccaatcccatcggtgcccgtttctcaaccacctactcgcctctgctccaccgccgccgacggtgagtgagagtgagacccttgcttgggccgctacctccgtccctcttcccctgctgccgggcggtgctggctgtcaagggaggtggttctggctttgtcggtggtcaaggacgacggtgatggtgatgtaggccactcccccttcctctgctgccactgctttatccccttgtttttccctttatcctctagttttttcctgtaaggttgcttgattccttggcaactgtttctataattatgattttatgatcatttgatgcatgatcaaaaatgctggaattgcaccattagcaaaaggtgctttcttttttattccccaagaaacagaaatactggcaacattgataccatagcgtctagtacaacatcagcatccactgctcgctgctacgtcacaagttccatatgttaatccactggctccatacatgtattttactagagagctagctggagaagatatgaaattacttcacggtcaattgctggtcttgcagggcattatcatcatcattagtttttatcttttacaaagtcctgcagattcagtacgctgtcaatttattttttgcccgagctgctgtggcaaagtgcaggtgatgacggcagctcaattggccatacatcgtttggcgtcaaaccaatgcaagtgttgaatcatttccaacatgcaggtaatctttaaagatctgtgacagcaacagaaaactgctaggattttatcagcttgtttggacccttgtagcatcataccatgtgctgttaaacccggtcaaactatgcagcctaattcctcaatacttcagtaactactgctccctccacgttttgattttgttcaaagtcaaactacttaaagtttggctgactctataaaaaaatattaatatttacaacaccagcatagtttcattaaatctataattgaataaattttcataatatattagttttgggttaaaaatattctactttttttttataaaattagtcaaatttagagtagtttgacttggactaaagtcaaaacgtcttataacataaaacgaaggaaataagttattagcctgggatgagtgtatcccgtagttgctaggtatatatgctaatataaaaaaatgaagttaatttgagtaggtatgtcaacttaggaatcatcccaaatactccctctattccaaaatatgaacctaggatcgaatgggatattgtttagattcatagtgttagagcagtttatccagattcatagtaagtattaggaaatgtcttatctgattttaggtttttatattttcggacggaagaagtacatagataagtacagtgatggatccataaaattggcatgctgatcatactcaaaccgtgtgatatcttctatgtatatataaacagtctagtgatgtgcacatttattccttccgtcctataattttacttacactttgaccactcgtcttattaaaaaaatttgtgcaaatataaaaaacgaaaaattgtgcttaaaatactttggataataaagtaagtaaaaaaataaataataattccaaaattttttgaataaaacgtgtggtcaaacagtgcaaataaaaactcaaaatcctttgtattatgggacggagggagtaccatagatccgaaataagccaaataacacgatggacagaagtttggatgaagtaaaaagaaaagaaaaagatttattggcagcatgccttacatagatatgttggaggggactacggatcggtcgcccgatccaaatgtgcaaaaatcggcgccacgcatgtgtgcaaaactactttaaaatagattttctcttaaattatttatccaaatcatgatccgattgcacaattaaatttgttgtaattaaatcttcaaaacaagaccacacatgtttatattttgacggaatttttttaccctattattgaattatttttaaatattgcacgatgttccaccaagtatattagaattgtttcactaagtagatcgaaaatgtttcaatcgtttaaatcggatgttatttcaccttatgtaaaaacaatgtttcagtaaatagcggaagcatgtttcagttcactgcaacattagatctatacatagtgaaacattgtgagtacactaggtgaaacatttttggtggaaaaaaaatgaaacgaaatcccttagagggcttccaaaatatgtgggttatttattgcaatggagttttgtgtgtggacaagtggcaggtgggggcagggggcacgtgggtgggcctaggggcgcgcgcgtcttggagggagggagcgcccgatttcggctccctcccctgagcgctcgatggcgagcattttcgagatatggtaaaacagtttttgagaagaatttgaaaatgaaaatacactttcacactactagaaaaagtattttcgcaggcggacaaaagtgatttttgcaggcggagggtcggaccgcttgtagcacaacgacagtgaaaa

SEQ ID NO: 57995 - DNA, 529 bp, Oryza sativa
caggcggcgcacacacggcgcgtaacgtaacgcctcaaccccggtgtggcaaaccacgggttccgttccggagaccggcaaaatcacgagggaaacgcacgccctcgccctcgccctccgccgcgccccgcgcaccgcgcccgcacccgcacggcgcgcggggctccgccgacacacggacaaaaccgccgcctgttcttcccgcgactccccaccccaaccccacgcgaaccgcgagagccaaatgccgcccccggtgtacgtactccgcgcgagtcgcctcgcctcgcgtgtacgtacgctcgcgagcgccacgcaccccggacccggtcacggcacggcccaccccgattgaaaacaaacaaacaaacatgacatcggcttggctatcgcccgcctccctataaaacggcctcgtccccgcgttgccgactcgccatcgcgatcgcgcattcgtttcccgctccccatagctcggctagctacgtcgcatccgttgcaagagaccaccggatccggagaactcaac

SEQ ID NO: 57996 - DNA, 1176 bp, Oryza sativa
atccttcatcatgattcaagttttatatttgacacggatatttatatttacagctaactcaagatatgcctggcccaatttttcaactaactcaagatatgttcggcccaatatttcagttatgctcatagtggtagggtgagtgtgcacgtgttaggagagtttattgtttttaaaaaacaaaaataaagcgagtaccctcccaacaaacatgcagccatcttggaagttaggtccagacaaattagtcttctccttcgaaatattttttgcttcttcttaattactactccctccgtctcaaaaaaagacaaaacctggtttccgtgcccaacgtttgaccgtccgtcttatttgaaaaaattatgaaaaaaaataaaaagacaagtcacgcataaaatattaatcatgttttatcatctaacaacaatgaaaatacgaattataaaaaaattcatataagacggacagtcaaagttggacacggaaacccagggtttgcctttttttttgggacggagggagtagttcggtccagacaatgtaaaatatatttcactaatatatgacgctagagaatcaaatggcatgatatacaatatcatttactccctccgtcccaaaataagtgcagttttagcactgttcatgttcaacgtttgaccgttcgtcttatttgaaaaaagattatgattatgattagtatttttattgttattaaatgataaaacatgaatagtactttatgtgtgactaatttttttaatatttttaataaatttttcaaataagacggatggtcaaagtgctaaacacggatatctatggctgcatttattttgggacggaggtagtagatatgatgatgtactatcttcacgtaaaaaatcagctccagggtgtactttagaacgggcataattgcagagtaagatacatacaagtggctgatattgggatcaggataatataaacgtgcaaataattgtcatgttgaattaatatatatcaacggcccttccaatattgttccttttttgtcataatcaaatttggacggatactgatcagaaactgcttagatataaatatcaattagttaacgtatcagtcaagcaaaactggtttatttaacgcatatgaacaggaatctctctcgaaaggggtaccgagctc

SEQ ID NO: 57997 - DNA, 794 bp, Oryza sativa
aatagtggaggatgttctcatcattcccacccccttcacaagggccctgctctgataccaaatgataacaatttggcccaggtagggtcagccgaggcccaataacttaaggttgcctggaccccaacagttctttaggcacacccactaagggaaaggcccaatctccctgaaagactagtccaataggggaagggtggctctcccttttaaggtggcttcctcctcccaagctaagcaaggtgggattattcaaagtctcacacggtcgccgcccgactttggcgtctttgccagcgggcaatagtagaggatgtcgtcatcacgcacgatccggtgacggtgacgggagcgggcggcggatccggccacggcgatggcgacaaagacgacggtgacggcgatgacgatgggaaggcggtgacggctagtgttagggtttcattttttcatttttttttgattttttatttttgcatgtgggcgacaaaagcaccagcacgcgaaaatccgattttcgcgtgcaattgcaccgcacgcacgcacagatagcgattttcgcagacgaattgctccagacgggctgaagctctgcacgtgaaaatatgttcgaccgcacttgaaaacattttgtgtagtagtgatggtgacaagggtaaattttagattctattagtaattggatatcgcacgagtgcaaagcatatatataagcaaacaccggtagaagaatggtcgatctgcaacctttatcctcagcatatatagaggaaagcatattaaaatgttgtggg

SEQ ID NO: 57998 - DNA, 37660 bp, Oryza sativa
ggcgtcgtcgtcgtttctgccgccgggctacaggccaggcgatttcttcttcttttcccccgcaatttccttcttcctctttttttttttccgcgcgaattcattgtttttcctgtcgcggtggcgcgcgcttccccctctatttaaccgcgagggaggccgcgaattaagccttccgactccggtcccgtgctccgaaggtggggtgcaaggtttgtgcccctgcgtgctctcgctgatgtttctagtgcaaattcgttggggcctggctaggttgcttttttagtgaattcgttatggtatttgctgaatcttcatcgtgttctggggagagtttctttggagaagagactagttgcgattgattctccatgttgacagatgcgcggcgagacgaattggaacgctttcttcttttagatggtggtgggcgtgcttagaaatttgtttgttgttagtgagttcggtttttgtttgcgttgacagtatcttctgttctagttggtggactgttctgattttgtttggggaaaaaaaggagatctttgtgcgggtttgagccttggtttggaggagcatggatccagctgttgaaatactatacgcagattttgcggttttatgagcaaaaagtcggaatagtctctgaattcattatagtagtgaactcatattcttggatcagttttgaactgatgtgctgtgcaaaagtatgatactgtttttaccttgattactttcttctctggagagaactttacagcgttgaggttgagataccgtcctggttactctccttttcttttttttttctttttggatataagaagattctggtgtttgaaggaatggtagactcttagatttgctatatcacttacagttgttttcattaaatcttcaaatcatcctccctctttctcagaactttgaaagtgatcagggcattgattgagcatacataattcaactattagagagttttagagcagattgatggtctagctccttgtttttgaaagatgcacaaagatgttttagtaattgtacattttctacatttgagggtattatctggataataatgaaaccaaattcaaattgcaacaatgatagaaatgaattttgaattatggtatctatgcagtataatattgcagccctattgatcctttgatggcatatttgctactttttatcctcttgaatttgttaggacctgctaatattccccttcctcgtataaagctgtaagctttggtatgcatgattggaattttaagcacacatttctgtagcagaatatatgctctatcactgtcttcttgaaagttttgcttcttttttatttgagctgtgccaaatctctttgtttttttggaatataggagtgttggatactaaaatttagctactccccccccccccccccaaattgtagtgatagaatcatagccgttacagatgactagcagtgttctaagagtgtcttttaggtatataaaagtgacagattcccctacttgttgccatgctattgctagttaggccacattactgggtgggtttcaccgaataattacagctgtggtgaccatatgggtgattggataaatgttggttatctatattagaacttgattactagtatttacttatttggttgctcacatagtcacaatccatgttgatcagtctctaatattgacttctattttcagtttgctgagcacagttgctgaattttagggttatctgcttcaagcataagtgggccattgcttctggcttttactggtaataaacataggcttcaacttcaagttactctatcttaaggaattaatagttcatatataagtgcattatcgagcttgaattggcctgttatcattgccgtaacaaaggatcagggtattttttttgtttgtagctatttcacttcaattgatgaaattttactttagatttgttgatgcaaccagacttcctatattttgttaatacacttgctatacagtaagtttgaatcctgtttttatcatctgaattttagacaaaattttggagtactctcttttttaagagtacaacgaaaagccacacaaacatatgcccctcaaatgcatgagaggcatgtagagatcctgctatcatatgaacttttgtatcttctcttcatgtgtgtagcagcatataacatcctaattttctttatatgtgtttgttgtcctcttttttttttgtgtgtatgagttgtattatcatgatcattgatcatatctttgtccttttgttatctgcagaacgtaactcacttggccaaatgaaatccatggtagttggttattctgaagcatagaattgttactgctttgtgaacgaataacatctatctatctagagcactggaagatggatcatagagatacttctgggtttgtcagtggaggttgcaaagaatcaacgaactgcatcaccctaggatttctaactttttagctttgttaaccattatttaatctggaagtgaggttatctggtacttggcaaaaaaattggctgtgttttgtctcctgagaaattctctagcaatggaccccagacttgggcggtcagcgtttataaatttctcaaatccaaatgcctatgtgggcaagttccctgtcatctccacagtcagccatcctacagcttctagtcaaattgatgtgctagctcattgcagttcatacaacctgcctagagggaccaagagaaagtttgatggcttgtcactagggctgggcaactcatcaagctcagaatctagcaagcaaagcatgggtactggctgcaccatatcttctgctaagggtagtgatgatggttcttctattgatttggatttgaatcattttactctgggcaatgaaggtacttccaggcttgataagcgggcctgtgattctaggagggctttggataagcctgaattgaatcttgagctgtctttgtcatcccagtctgctattactggtgcagacttcactgcagcgactgaatataatagcccaagtctgcagccatactatatggacttagtgccaacagttgatgaaggatctacatctgctcgccgaccatctggttgtcaggtactgtctttccttaataagactgcaaagatgagtgaattttctccaagggaggttttcccaggtagctctaaccagagtcaaggtccggctccaatgccaacattgcttcaactgccaaaaagtccagtagcctgtacttccggtttatctcgtccacaacagcgcagcagtagcacaaaaaactgtacatacccaggatgtatgaaaggagccagaggttcttcagggcgttgcattgctcatggtgggggtagaaggtgccaaaaagatggttgtgacaagggggctgagggcaagacaatattttgtaaggcccatggtgggggaaggcgctgcgaacaccttggatgcaccaagagtgctgaaggtcgtactgacttctgcatagctcacggtggtggccgtcgttgtagccatgaagaatgcaaaagagcagcaagagggaaatctggtcgctgtattaaacatggtggtggcaaaaggtgtcaacatgcaggctgtacaaagagtgcagaagggcgctcaggcttgtgcattgctcatggaggtgggcgccgctgtcagcaagatggttgcggaaaaggagctcagggaagtaccaacttttgcaaggcgcatggtggtgggaagagatgcacacaccctgattgtaaaaagggtgccgagggaagtacagcgttttgcaagggacatggaggaggcaaacgttgttcagctgaaggttgtactaagagtgtgcatggcggaaccctttgctgtgttgcccatggaggtgggaagaggtgtgtggtagaaggatgcacaaagagtgcaagaggccgtactgaccgctgtgttggccatggcgggggcaagagatgccaatcttctggatgtgataagagtgcacagggaagcactaacttttgcaaggcacatggaggcggcaagcgttgcttgtggggtcacgaaggatctgaccatggagctggtgacactccttgtgagcgccttgcaagaggcaagaatggcctgtgtgtttatcacaatccgcaggtggatgaaaatcgtgtccatgggggtttcagcgttgtcagcgatgcactttctcagggagatcgaccttcaaacactgaaacaagcaggtgcagcattttctcgcatcctatggaggctcctcgtcgtgtggcagctccagctgacgagggtcgggtgcatggtggcaacatcctgtcaatgtttgcaaatggcatgagtttggggaagcatcccgccaaccaagcagaggctagcacctctgcacctcgcaactcgaaatccaccaatggcatggtgaccggtaactctgcggtgcggggcagctggctgtagagccttgaaccgccttctgctctctccatttcagtaagcatatgcttcgaaccatctgacaagtgccttctcttcttaatccttcgggtgtgaaaactatggtgtgattgtgtgaactgttgtgtcctgatttgtttagcagtgttgtgaacttgtgatatattattaatcgtttgtgctttgtaaaatgtaataatcacctgtgtgagataaataaaagggggaaggttacacattagatgctgaatttcaggtcttgtactgaaggtctgctgtcacctccaaaatttgtcctgtgatagtcatgttctaataaatctatgtgactgacatgtttgaaattatcatgctcttgctgctgcggtacacgacagttgttgcgtccccacttcattttctgatcttaatgaaacaaaatctcagaacctaaaagatatttcctgcatagtcagactatttggagatcaggatactcatgttatgtatgctctggcctgagcaggcttttgagaattcagatgcacatcaggatcggccaggcaccttagatgcagatgcagcacatctctgcttccatagcagtagatcagtttcctctcactgcaaacaaacatgccaggaccccccacaaacagcaggacaatgcagtgccaagaaaacagatgattcagcaacagtgatgacaataagattttaggcatatctagctaaaagatagtactatttcctgcatattcagactattgctaaaagatactaataatactattgttctgccaataatgcctccgaatgatttgcctgtcaattatgcggttgctgaaacctgttgttcttctgatctcaaacacctgacctagccatcataagattgaattcgaccgctttgataagtgtcatcaaatactacaagaaacaattatggttattattaactctgcaacacgctgctggctcgccacatctgcatgagccagccaccaactgtgtgatgatgcattatgctgtcttcgtcagtgcgacatggctgtccgttcaatgaaacaaacaacaaatcgatttggcatctgaacaatttagagccacacgtttcatgcaactttctccccctttttttttgcagtgtactgtttggggagaatctgttagtgatatgtcctagaggcaatcatagagatgattgtatcacatactatgtttacatatttatccgatattgttcttgaaatagataactccttattagttaatgaatatgtgatactttcatgagactctttatgttgtttgttactatttctaaaggatccctgatcaaatatcatatgtggaacaaatatatttatataatcagcacatgtattaattgatgatcatgtctcatggatcatggtatagagataccaaattaataatgtggacacatgttgttggatagacccaacatgagacactgcaagagccatatgtgttgtgtcatcagtgatctcattaagtgttggtgttgaatccttagacctgagattgctaaacgctactccgtaattgggtagttataaaagtagttttcgggtatgctatgaaacatgtagtggaatatgaataatcaagatgggatttgcccctcctatggagagatatctctaggcccctcgatgttgtagattatggaagtgcatggccatgccaaaggtgattgaggagtcaatcacaagttatataatctatcaacaggttcgagtgaatgattgagctattagaggatggcacatatctatccttgagcttaatcgatatagtgaggcaaaggggttcatacaagtatacactagaggttcagccgatatgatctttatgtatgtccggtgggtcaatacgttctgctaggggccgctgttgacgcgtggaccgaaaaggagttttcgggttacagccgagtatatatgaacctatagggtcgcacgcttaatgggccggaataagggaattggatagagatccaatatgagcttaattcggataaggatccgaataggagtcctacgggccttggaggcccgagtgatggatcctatatattcgtgaggggtgtgaccggcggaggtattgcatcacgtgagaaaccctagccgttacttccctccccgagcaaaaccctagccgcgcgcgggtgctagcacatctgcgcgtggcgttccgtctctgtacgtgtggataccggtagaggcgccgctggtttgcggtgctgatcggtgcgagagtacggcgaggagaacgcacgaggaggagaaggtcgagccggtgcgatcgacgcgcgctacttcgcgagagttccttcgacttctcaacgtctttttccgctgcacagcgcgtcgagtggtagtgatctatgatctaatacttgcatggttcccggtttacgcgatagaaaattttgatttatgctatcatagcctacgcgtatcccaacagaaatgttacagcagcatggattcatgcagcatgaatttctgtcaaaaattgatcggcagggagtaaatttctcgaacagcttttgtaccaacttgaagaaaacactactacagtagtagaacaccacaaaactactatagatgctggaaatgctagaaccggcacctataacgtttttcctgtcctcctaaactctcagaggagtcaaaaataaaaatcggcacctataccggtttataaaaaaaccaacacatataatgtaagcgctggttttttaaaagacgacacaaataaaaatactatgagtgttgggttttttatttacccgctccaaatttagagccccacaagcacgcaaaaaaatcagcatggagaaaaaaaaaatcatgtttgacccatgccgtgctaccctgcccattaatctctatcccttatctcctcgttcgccccacccccgccatccctctcttccacgtctctctcgattcctccatctccctcctttccatcgcggcgagaaggaagcgacccacctctcctagccaacccaacgatagcggcgacgaacaagctgtccggtctgactcctgccgcagttgaccatggcctcggctctctttgctagatttgtcggcgacagttgtatatacgccagatcccaattcggtgtgcatcctggtgtacctatatggattgcacatggaagtcttgaaaaatgctggccaactaaaattgatcaaacatagtatatttgacttaggataaaactaaaacaacagaaatatttaatttatgataaaactaaaacgataagaaaaattgaaagcacatttctatcgtttcgcatatgtttatttgtactgcttattagcaataataataataataataataataataataataataataataataataataataataatttgtgaataaaacttttttttccaaataagtttattttttattatctcttttggctcatcttttaccgatcccacacataccaataataaaaaaaagaacactaaaacactctcactttatcgtatcttaatataattattgtctactttatctacttctgacgtatattttttatctacttccacaagctcttctaatgtaatgattatagacaaaataaacttatttgggacaaacgggtgaagagaaaaaaaatgaaattattctggaatagaaggagtataagagaattttggataatcataaaatgatgacacggtggggtcccacatccacgtcgggtggctgctaccgaccttgacctgccccagctcctcgggagtcgggaaggcaactccgcctcttcatccttcgccgccgccgccgccttcacgtgctccctctcctctgcgagtcggcggcgccgatctccatttgtcgaggcgagcagagcaggggagccgggaggggagggcatcctggtgaggtgagcatccacatcccctttctgatgaatcattcatctctctcccacctggagtagttttttttttgtctggaattcgctcgcgttcgttaaccctagctttctcttgtagatctggaagaagctctcctcttaattaacctgtgtaaaagtttgtttgttcccccaaaaagtttgcttcctgggattactacgaggaggaggagaggggatagatagtctgtcagatgatgatgatgccgctgcgttgcctctccgagctggcccgccgccggcctgatcgcgcggtgagattctactcattttctttcttggatgaatcattcagctagaagcacgtcgctgtgtctttgtactgtaattatgcattgggtctctgtaattgtgcgttgggtactagtaataatcaagtaatgatgtattgatgcagtaccatatcacatcgaagggatgagcttgtgctgttaatttttaatttccagtcaaaaacgaattgcttgttttctggtgctgtaacagtcaaaaccaaaattttcaggttgatgcaatgagagtggggctccgatgtttgatgagcacttgcccgttatccaaagctactgatgatagtcaaaggttatatgcaacttcttcttgtgctaatgtgccagaggtagcactgagtgaggcgccactgtcagacatgcttgtcgattcgttcgggagattccacaactacctgaggatctccttgaccgagcgctgtaatctgagatgccagtactgcatgcctgcccaaggagttcagctcacgccaaactcagagctcctgtcgcatgatgagataatccgagttgccggcctgttcgttacttctggtgtggataagatccggttgaccggcggagaaccaaccattagaaaggatatcgaggatatctgtttgcatctttccggcttgaaggggctgaaaactcttgcgatgaccacgaatgggctcgttctttctaagaagctcccaaggttgaaagaatgtgggctcaatgctctaaatattagcttggacacgttggtccctgcaaagtttgagttcatgacaagacgtaaagggcactcgagagtcatggaatcgatagatgcttctatacaacttggattccaatctgtcaaggtatgcagatttttgcatacctgaaatttctgcagtttgtcttctttttaacataccacaaactggagctatatccgcatcatattgagcatttatcctcagtttaattggttctttttccctttttctgctgccaggtcaactgcgttgtcatgcgtggaatgaatgatgacgagatctgtgattttgttgaaatgacgagagacaagcctgtcaatgtcagatttatagagtttatgccgtttgatggtaatgtttggaatgtcaagaagttggttccttatgcagagatgatggataaagtggtaaggtacacctctgaaaagttcacttcccttatacattttacctttctttcttccgcctgcatctagcatcctagccattttatgtacatgtggttttattattattattatggaagctacaagtaatttttcttacttgcaaccttggggatcagcgccaacgttttaaaggtgtagagagacttcaagatcatccgtcagagaccgcaaagaatttcaagattgatggtcatgctggaacaatttcgtttattacatcgatgacagagcatttttgtgctggttgcaatagattacgactattggctgatggcaacttgaaagtgtgcttatttggcccctcagaggtatgctaaccagacactttgtgaaaccttgacttgtatttctgcaaattttcctatcatattttgggccaatatgtcaattttctactttggattccatgagggacaatttttgtgctttcactgatgttgtggcctcttattttgaataccataatcagtgttaatgtgtcacgcataatcatgcaaacttgaaccatgtgtactcattgattttccttcacaattatgaactatttgaacatagatcaatacacatatttctgtatagtgctaaaaatgctcaggatgttccaagcatgttatatcatcttttttgtcttaacacaatctgaatgagtgattggatgggttgaatggtattcatgtgctttgtttccttctgttgcttttggaatttctgtttaggtgtgctgtgccttagatctgaaagtgaaagttaagtgggggcagatccagtgtccatgatatattaaaccttaatcagagtaaaatttgaccgactttctgcaagtcctatttctcattatttaaattcactgtatatttcagaattcaggttgttaattccagttgtctctttaaaagtgaaatctccttgtacagttctatttttcttgttgtattaatatcattggacaagaatggataaaaatcgaggaacaagtcttctttgcaaaatgctaaaaaaaaataaatgagtacaaatattctggtttgtacaggtgagcctgagagagcctattcgagctggtgttgatgatgctggactcagagaaataataagcgctgcggtatgtgtagaaattcacttggttgacatcttctgtatgaaagacagtaatctagaccatttattcttattgtcgaataacaatcttgcaccaactatttcaatccactcctgttcctttcatagaacacgataccaaaaggtttttaactgtttttctctctctcatctgagcagtttaagaacatatgaattcaattaatttgtttgagaagaaaatgatttttatgttaaaagactgcttctcttgacaaaaatttaaaatcagcatcgcaaataagtaccaaaagagaagtagagtctcctggcttctgggatttccattgaggaaggaagggcatgcatttttggtttggaccacattgggtagaagataagcagaggcgaactatcctgttcctggtataaactgcacattatatccaaggttacctgggatgttgggatacttttaacgtttaccagcacccttttgcctccattggaacaggtggatcttgctctgcctacacctgaggcaattgttcctttggacagctagtaggtttctattgatattagttactctacttgtccatgttcatagctagaaatagctacattttgggacgagcatagcatatcattagttatattatcatgtttagtcgccaacttactttacccaggttaaaaggaagaaagctaaacatgctgggatgtttgatattgctaagacggcaaatagacctatgattcacattggtggctgaggtatcttcttaacactgcttctaccctttgtttaataaagaaagaattgatagtttctttgaagattatccattttcttcactcaacattgttctattggatccctctgtgtgttctattcataatacagaacaatgcaaattttagaaccaaaatgctggttccctgttataaattagaggtagaatattgtcatgagcaacaattgctttgtggttgctcaggaatctagtgaagagcatctgcaatttcattaactccatggctttgaattatctctagcttgattaaacatactgttgtcagttcattatgcttgtattcttgtctggcactaatttcttttaggttacaaactgtaggtgcaacatgcaatatttagaactggctacaattttaacttttatggactaagcattatccatgcttgtcttgcttaccaattacaacttgtttcagatcagttttaccagctgaaagtaccttggctcctccatacgatgactgcgatgaactatcaacatgataaaacaaaacaaagattacatgatcttaccttgatatgatggtaaactgaggaactcaaaacttcaaacggcaatacatacagtttgtacaagatataaaaatgttactatacttgtgaaatagtagcagttacaaaacctcatgcagttgaaagttaaagcatctgtacttttcgctacttgtacgagaaagttgtaactgttgtatgatgtatgctcctcataaatcaatgctaatgtgtaactaattattcttttacggcatcttatcggttaatgaaacgaaatttattgtcttttctttctgggaagctcttgttttgtattcagcagaataacggcctcttgaaatcgcgggaatgaaaaagggagagaaatataggaagtgtgcaagtgtgcttccgcacttgctttgaatttggtactactgatacaacaaaaattactctttgagaaaacaaaaaacaagtactttattttaagatagtaaaattcaactagagttgctttagaggttggttctctcttgctaaaaatattgggaagagagtaaattttttttaaaaaaaaactatgataaacaaaaataattcaactatttcttttaagagggtaaaaattcaactagagttgctttgtggttggctctctcttgcttaaaaaagctaaatgataccccgcgtttttctacggtatgattatatacagacaaacagattttaaaaagtacacacgcttaaaaaaaaatctgaactctttagttataaggccggggagaccatcagaccaatagtctttaaatttcaattaaaagtttaaggtgcatgaacgtgacataatataacttcaacaataaagtgcatgtcaatagaagaaaattaattgctctggagaattaaaaatagattgggaaagagaatatatactactactttctaagtagtggttgtgtctattttcatatcatctttaccgctgatatatgagccctataatctatactgttacaccacctttcagtgagtcttgagtcttctcccgtttaattattggctctctttagattttaaaatcacttacatatttaataaggaaaattatagtattacttggactaaatacgtgcttattaattgatttaataaagtagaaactcaatttattttaacttaatttgtttttcgttgcaatgcacgggctctatgctagtggagactaatcaattctaggatttggaaattaacgtggaattgtacgtagcactaggaaacattagcttatgtagtttgccggtttccatatttgaccaaaaacatgaaaagttacattatcatgtcttggtatgcaattaagcaaatttcactggccaaatgagtgttgaaattgtggacatatgatctgattagtttggatggtgttagagtgtgcagcccagccaatcaaccgtgagccacctaggtcacattgagcctactccaccacaggccgtcacaacttcatgtaccgggcctacaccacccaaaagactaggttctgagcctacacaacccaaaagactagtctgatgggtgaggaccgtccccaccttttaagtcatgtgggactaaacccaacaatctcaattaccgatgtgagactagacccaacaatctccccggaagtgctaatgggcgatcgatcgcccggcgacaagggtagcgatcgatcccccttccccctccctccctccacctggtttccttttttggcaccgcattactttcctattttagtaaatttatgcacctaaagtttatacacctcaagtttacacatctaaagtttagagaccaaaagtttataagtcaaaagtttatatatccgattcaaatttgaatttgaattcaaatattttttttatatatagtatttctatgcatctaaagtttatacacctaaagtttatagacccaaagtttataagtcaaaagtttacatacccgattcaaatttgaatttgaattatatccattcaaatttgaatttgaattcaaatattttctatatatagtatttctatacatctaaattttatacacctaaagtttatagacccaaagtttataagtcaaaactttacatacccgattcaaatttgaatttaaattcaaatattagtttatagacccaaagtttataggtcaaaagtttacatactcatttcaaatttgaatttgaatttaaattcaaatattagtttatagacccaaagtttataaataaaaagtttacatacccatttcaaatttgaattttaattcaaatttgtatggtgtagtagtaagagaagaaggggaggtaaagtagtaagggggaggggcgggtgattgcttggaaggtgagggagcgatcacccgcccattaggagtaccccattctcccccgtcacatcaaccctgatgtccgtgtggccccgaagactcaattaccgatgtgagactaaacccaacagatggagagagagagagagcaatgtcaattgggatatgacgaaacccaaaatcaaaccaaagcattatttaaaatgcaggaattttataggaatcgcataaaccaatgacacaatttacaatgtgataacatatattgaatatatttgtattacaagttgataacatacgtacatagatgcacgtgcctatataatacaacagtgtccagtacactatataatgtgcagcacaacataagaaaatatgatatggcttagtcgaaacacacacttggaagggcatctaacataccccgtactgtacgtcggatgcaaaaacgtttacggcttggtcgatcggtcagctcgcgtccaccaagaagaaccgtaaatgtaggggctatagtgcagcgtagtcgggtcggagaggaggaaaattaagttgctaatgagcagcatatccggattcgtggtattaggaaatatccctttcaattttaagctcttcaaattttcggacggggagggagagtagcttagctgcagtaacgtacgtagtagctgatgccatggatgtagctagctagagctagtactggtcgggccagaggaaggcgcccatggcgaaccgccgcttggcgtcgaggtcgccgtcgacggggagcccgtactcccggagcaggcagtccacccgccactccggcatcgcctcgtactccgccttcttgtaccgcgggtagtgcagcggcatccggaacgacgacccgccacacccgccgccgccgccgccgtgctgctgctcaccgccggccgccgccgtcgtcttctcggccttgggctgcagccccaccacgcttggacccaacgatcccatggccaatgtggctttcttgcagctaggactaggagtctaggagactagctaggactatatatgattttcttttttttttttttggtgtatcttgttgatggttgcaagaggctgctcatgtgtggaggggtatttataggagaggaaaaatgtggtgtccataaagaggaggtggtgctactcgctatgtgtggcgatcgcgcgccgttggattgaaaatggatggtccaaattgagcgtgctcgcataatacaccgaataattatcgagttttagtgtttgattgttggccccgccctattgtttggctgatcataagcatataagcgaaacgacatatatgtaaataaaaaataatttataaataaaacttttatatatacgttcttagcgatataaaagtaaagactgaaaaataaactactccctccgtcctataatataagggattttcagtttttgcttgcaacgtttgaccactcgtcttattcaattttttttgcaaatataaaaaataaaaagttgtgcttaaagtactgtagacaataaagtaagtcacaaataaaataattaataatttcaaaaaattttaaataagaggagtggtcaaacgctcaagcaaaaactcaaaatcccttatattatgggacggagggagtacgataaaaaaaatctcaaaaccaactccaatttacagttgaaatttcaaatttttgctgataagtgtaagcgaaaagatgaggccatgtatcatggatgaaccaacgaacggttgagatcgagcgtgccagcacaataggaaacgcgtgtatcaaagatgaatggtccagattgagcgctcttgcataatacaccgaatgattgatgggccattaatgcacaaaccatatggttgatgacacgtatgtgcaaatcaaacaacccatttgaagttatggacaacgcaagggacatgtagggagggatgaattgcatgattggtttgtgttcaattaagaatctaatgcgaacaacaagagacgtgagagggaaatcaggggtttgattggagaagacgacagcaaatgcctcttgctgctgcccagattcagtagtttctgttccaacaaatcattccagcagagggtattaacttgccgaaaacgcaaatgtacgtaggtgtagctagggtttaattagttaattaggacttgttcgttttgttcgaccagatctgacaaaaaaaaagaagaaaaagttcaggacacagcatggtttgtgtgaattggttgcttgaccaagatacatacgctactgaggttcacagaaaactcatgaaaaactgtagcaattcaatcataccaaggtactccaacatgaaaatcagattaaacttattgaataaatatacttttaatgaagtaaacttgttaatagcagcaataacaattacagtaaatatgtaggagttgttgggtattagaaatttgcctttctactgtattttacgcgtcgttatttgattttctttattcaacctgattttttattcattttactatcactttgcttgcttctcctgcaaaaacggaaggaaggaagcccacatgtctgaaaggtgaacaagagtcaaaacacaacggcaatcaggaaacagattgcaataactcataataattggacaacttgttctagtagtcatcaacaaatatgatgattgatagttacttggggtgttcaataagcagaggtgttttcttcagagtttgagaggcatcgatagcctttcattggtgttttgcttgtgaagcagaagaaagacgtgtgtgcttctgctaccaaagcctaccttccatgatttttccttccttgatcaccttgcttctcgccttctcccagtgaatccgcattatttaacaaccttctagatgccgttaatgcccgtctgaacaaaaattgttacgggaatcatctcagtgagagggtgtgtttgacaagaggagaaaaagagaaggtcgaggagatacgtaaaacgaagtggatcattagtatataattaattaagtattaattacttaaaatttaaaaatgaattaatataattttctaaaacattttttctatagaaaattcctttaaaacacacggtaacacttcgggaagaatacgcgtgaaaaagaggggtttttcctatcattgtgctgctgctgaacgcaaatcgctcccaaagagtagctttcatgcagtagatggaagttgccacaggataaatgggtgttttctctgctccatagaagcaagtattctgaaatggccaaatgggagtactgacctagcatttgtttcaacgttgatcagttcacacctcttgttgcttcctgtgaacactgaccagcacatctctgtaattgaagtgccaaagcttgatgggccccaaatgcttagccaaggccgagacaacggcccaagtaatctggataaaggcccaaacttcccaaacgcctacaactccaaatgggtaatacaaaggccgagtttagttccaaactgttttttcaaatttccaacttatccatcacattaaaactttcctacacacacaaactttcaacttttccgtcacatcgttctaatttcaaccgaacttccaattttagcgtgaactaaacacacccaaaagcatcacattattcagtactatgaaattcactgttctaatcctatgtagtagtaagtacatcacattgttcttttttcttgctcctactccactaggactcattcacattatttctgtagtgtcctggtcgatttgatgccttgtcaatttttttgttttcgcattggcctttctccaagcaagttcttgcgacgatgatttcgactgaataatctgaaccgctcaaaattttgtcatctggagcttgagagtttcttgggtccaagattccttgcctgttcttgcacaagcatcacagttgtttttgctcgtaccttcctcctctcatgagtcatgaatggtgacaggggtgcattgaagaagcattgacaaatttcactgctgcatccatgtattcactctgacaagctcttggatcctcttggaaaacgaaagtttacagcaagcttcttcagcatgtgctacactgctagtatcacactcttggagagcttgttcagcatgtgcttcttcagcatgatgctgaagagcaattgcattggttcagaaaactttgttcggctgtttgtgctgatcaatactagtagtagtccctccgtttctaaatagccgacttccctaaatatttagaaaacgtcgttaacttttataaatatgtttgaccgttcgttttattcaaaaacttttgtgaaatatataaaactactacctccttccctaaatgtttgatgccgttgacttttttaaatatgtttgaccgttcgtcttattcagaaacttttgtgaaatatgtaaaactatatgtatacataaaagtatatttaacaataaatcaaatggtagaaaaagaattaataattgcttaaattttttgaataaaacgaacagtcaaacatatttaaaaaagtcaacggcgtcaaacatttagggatggagggagtatacgtatacataaaagtatatttaacaatgaatcaaatgataggaaaagaactaataattacttgaattttttaataagacgaatggtcaaatatatttaaaaagtcaatggcgtcaaacatagagacggagggagtactaaatctagtgtgccctcatttgtgctgattaaatgcagatgcagggaatggaagaggaactacaccatgcaaagcaattgcagagaaacaagcccaaagaaaaccaaacaagcaaactactactactactcctgtttgtgtttgctagtagtaggacaccacgtatgggacaaagcatgcaaacacacaagaggctcaagcatgtactcctcctatatccccttgcctgcaagcttccaaaccttggccatggaaccatatgcacataccaaggacatggagatgtacacacacaagatgacacaagagacacatatttactactcccatttcttcactgcacattcattgccattgcaaactaccagtgctagtaccagtaggagtagattattgttgcttgatagtagagtccaacaagtgttgcattggcagcttcagtcagtgaggcacccccatactactactgctgctatctccatggcagctttagaatccaaaacagtctaaacaatgcctttaaagcggggccagatcaaaggtaaagctaaagtccaaaagggcatgcataaaaagctaaacaaaagctgtaaacatattactgttacgactgggaacatttttaattgcagtaaacaatggcgtttctgtaggatcaacagtgtcatgcatcggtctctgtgcatgaatgatcctcctcagtcataaccatttcacacctccctacaagcaatatttcttgatttcttcatattgtgatttgtgatgtagcatcagggctcctttggactaagaattttttttcctatgttctatctcttggaacaaagtaaaatgcataaggattgttttcatatgctctcaatcaatatatgaattctaacatgaactcatcttttttttcctttgctaatgtccaatgtatactctctctctctctctctctctctccccgcatgtgatttccttaaaaaaaattgtttcaattcctgtggaactatccaaacaaaatatcttaagtgttgctatgtttctaaaatcatgtactccctccatccctaaatataagggaggagtatcgcagcgtcctactatttctatttctgtgttataggaatcctgcgttgaaaagagccctcaaagttgatatagcttattgttcattttccatggctactacactatttctctcatgttccaaatgaaatttcctgtatctttagaaactgttttgctaaatggagaccattttgaaacttgcatagattttatattttcacaaataaattatttacattttcaaatatatattataaataaagaaacaaatacatttagccattttcttaattattatgccaactaatatctttatatctaaaatcagaggaggcagatataagtagttactcctcctagtgatttaattgtatgtccatgcagatgctgctggtgaacagtgtgagacataaatttgctggcttttgatgaacagtttgatgagcatttgggattggaaggacatgttcacgttaagagttgatagtgatgaagtgacctgcaaaatggtgagtttggctggaggggattgtttgcttttaggagctaaaaccttagcttaaacttttgcatgagacatgtataatctttagctcataattaaagaaaaaagacggtttgtgtccttttccttttgttcaacaactagattagttaagcagtagagtagttagtagctcttctttttttttcccttctttttggtgctgaactgctgattgatttaccgtacttggcgtttaaaacaatgagatgagacaaaatgacaattaccaaaccctgttattagactgatggtgaaatctactactccctctgtttcgaaatgtttgacaccgttgactttttagcacatgtttgaccgttcgtcttattcaaaaacttttgtgaaatatgaaaaattatatgcctacataaaaatatattttacaatgaatcaaatgatagaaaaagaattaataattacttaaatttttttaaaaaaagacgaatggtcaaacatgtgctaaaaagtcaacggcgtcaaatattttgaaacggagagagtactagtagtagtactattaaaaacctgttttcagtgccaaaacttttctcctgtttctttacaaaaagaaagggagaaagacattgaaatgtgctgagcacccgcaatggtaaagtaagttgctctctataaaacatgtacatctcagcaatagactagattaatagtaaaccacctcaatagtatgtctacttgggtatctatagctctctaatatattgcctcgtttttctctatagactatcttcaggttagtagatagctttgctctctctcttcatttaatctcttccaagtagaaaaatatgctaacatggatctcttgtaaagagtttatagataattattgtgggtgcccttacagtgccaaactgccaataaccttgatttgttttccggttctcaactaccaacaccacaaatagtgtagcttcaagttttgttgcagcaattgatagtgagcatctggagtactactcctacactattatacacaactcaagaggagtgaaggaccatgaaggaatcaatcagccactaacattatcattagagttcttttcttgggtcctgcatgacaggaatgtgcatgcagtgtcagtgagccaattatcctgctgcccatacacttgcacattcacacattcacacacacaaaaaaacacaaaagatgaatgaatgaaaggcgcatgtctggctttgttcagctgctgtttcctccccttcttttcccccatctctttaggcggattcggtgcgtgattgccccattgccattgcaatttttgccagccacctggtcagcaaaagatgggggagatgatggggctgaagcctgcatggatgtttcattttgattccttgattccttctcctttcattcatagaaaaacaatcatacatgcacatcctttggtgataatgaatttatattgctatactctacagtaattatttgtgggagtagtagtacaagtcttgctcaatctggtaattctatctacagtaatttactcccattttcacttcacttgccctgtttagtttcaaagtttttttctaaactttcaactttccatcacatcaaacctttcatacacacataacttttctatcacatcatatcaatttcaaccaaacttttaaacttactaatgaactagacacagccgtactggagtgaagtctaccagacgagtaccagagttgtgtatgtgtgtgagagaagaaatggtcatgatagcatcagttccatcagttcaatccaagtgaatcaaaacctgctttttgcatgcatgcaggatgcaagtgaggaggaggaggaggaggaggccccccctggtatgcatgcctgccccaagcaaatccagataacctaggtgagctgaggtgactgataaaacagcatataatgtgatgtgtgtatgtagggactgtgctgcctgcccagctgtggtggcctgaatcatctcatcctccccaccttcatccaccatgctctgtctcttgccttgttgcctcctagtacctcttggcatgcatgcccacttgtaatccggattcacaatcctggtactccctgcgtctcaaaaaaaaaaaaaacattctaggagagaatgtgacccctcccagtacaatgaatctggacagagtgttgcctttttctggaacggagggagtacctttttgtttttagttgtgtttagttcccttcaaactttcaaaaattctatcacatcaaatatttagacacatgaatggagcattaaatgtggacgaaaaaagcaattgcacagtttgcatgtaaattgcgagacaaattttttgagcctaattacgtctaatttaacaatgtggtgctacagtaaacatttgctaatgacggattaattaggcttaatacattcatctcgaagtttacaggcggaatctgtaatttattttattgttaatctacgtttaatactttaaatacgtgtcggtatacttaaaaaaaatttagacagggaactgaacacggcctttgaatggaaaaaggctccccactggtttattgaaaaccgatgactttcgatcaatgttgaaaaccaattaatactgatcaactttcacagaccgacaactaatttcatgaaaaacaatcggttttatgaacctgcctagtaccggatcaagaaccgattggtatgtcgaattccgtggaaatcgttgataaaccaaatcaaaactgatgaaattagaataaatcttgtcaaaagtttgaaattcagtttgaaaaccgagcaatttgtatttttttttcgttgtctaggaaatctggtttccatcgtttttataaaccatacttgtataatccatcagttttataaccatggctgtgtttagtttgtgtgccaaaattattataagtatacggacacacatccgaagtattaaacgtagactaatagcaaaacaaattatagattctgcctgtaaactgcgagacgaatctattagcctaattaatctgtcattagcaaatatttactgtagcacaacattgtcaaatcatgacgtaattaggctcaaaagattcgtctcgcgatttacatgcaaattgtgcaattggtttttttcatccacatttaatgcatcatacacgtgtccaaacatttgatgtgatggaaaagttagaagtttaaagaaaaaagtttaaatctaaacacggcccatgcttgtagtaatagtacatcatgcttgtataatccataggcaggagaggaaaataaaacagatcataggagaataagggaaagggcaaagaagaatataaatcgtacttggattgccgtttcggatttgtacagtggcaagtaaacaataaactccgtggcctactgcaatgttattgtcacaattatatatgcatggctaggtccttgagttcaatcatcagctagctacagtactgtacccccttctttagcttttgtgatagaatgatgagatttatatcagatcatggatggatggatggatgcatatatgtctgtgatatctccggcttttgcttttgtgttggatcgatggcacaacaacatgctggatggttgtatagatctagtctatactgcatggacagctagtgatagtactctcctctttgaggtatggtttgaggtaaccttccctccctccttgcaaaggacacgtcaggccactagattctcatgtttgtcttccaaaaaaattgctcatgaatcatcgtacaatttcctttgcacttttttattccctccctcaaaacaaattatcttttatacacgatatgcttatttattttaggacataactacttaccatgtactcccccgtcaaaaaaaaaagtcaacctcgtattaggatgtgatagagtataggagtaattaatttctaatgcatacccatatgtgtagttattatttacaattatgtgtagttattattatattgtaaatacataattttattaaattatttttagtgacaattattaatatggcgttcacaaatgagatatgcaactttaacatgttttactcacacccgttctctaataattgacacggtcactattccaagttcatactttaaccacatgccttttaaacaaaactagcaaggaaacccgtaccgatgcacgggtaatttatttgttgtttataaaaaagaatataaaaaatcgtatctcaccatattcaactgtaagaactataaattacattataatcataaaagaaagaaatacttacaccatgaaataaaccataaaattttatatactaaatgataatgtatattatattcaaacaaattcactttatcctggttatacgtaaactcgtctatcaccatctttcacaaacatacgagttaatatgagttttgtttttttcttttactatacatctaagtcacctgcgcatgttcatgggtaatatacgaaggaataatccattgtcaaaattatttatgctaattttgttaacactttttatatgagaatggcataattacataaggatataatatgtttccatgtgacatttttttattgtaagtatgtatattttctttttgtgaatagtagtatgtgtattcataggatagtgtgcacacatttatatgagcgcttacgattgccttttacatggttagtaaaaaaatactttcaaaatgtctggtgggatggcatgaagcggtgccacagcgacacgacttcttcgagaagattgccatgagtgcctcaaattaaagaaaaaaaactatcagatagagcagatcgtatatgaactcttcttttttattcttttttacatatcttgtgtacatacgtacatacgaagggattaaatggtttttagttggaatagatctaatgtaatggttgaaaataatggagctatgtgtatatcaattgccaaatattttgttttctaataatttttcttatttttttctaatttattagagttgtcacgtggcatcttaagagtgcttgtaggagtgtagaaatgttattactcacactggcaacctactcactgtcaactattgtttgttgtggtttagtggcatactcttcttacctatcatttgttgaagttgcccacttagtatagtcctatcttcggtgcttgatgacacacgtgcttattggatatcagctaattattaggtgcactgtgcacgaatgactcgtaagcaatattcccactaatacagaacttatatacttatgattagtgggaatatacgattgtattagactattttgtatttataaagtatattatatactacatattaagggttttagtatgtatgcaataagttgtaaagtacttatcggattggctactctcttatttattatgagcacgtttcctcgattgttctaggaatttttataaaagaaattaataccttttgataacaatatctaagtccatctaaaccattatattccttataattaaattgatatcatggactacattgtatatatttaagtgcaacgtgtgtattattagaaatatattctatataaaagctaaatctatttttggcttcataatatttaatatttaattaatcttgcactaatgacatgtgtcgtttcgtgtgtccaagataagctcagctattgagctagatcaaagtctaattaagttggagatagaagacatcgacatggtgtcaaaagaatatataagatctttaattttcaaatattatagaatagagaaaacatataatacttgaaaatacgttcatgataatttagtaatatcattttgacatattattatattttacctagggagtggaaaaatttttagaattgttagtcacaattagagttgtttttattttaaaaatgaaagcctaatttagctatcatataatctattttttattttatttatatttttcatggatgtttccatgaaatgcgcctaattagaaactctaaataacatatattttgcatagtaaatatagacagtttggttttccataataagtgagatagaaaaaaaaagaatgatgtgggcccagcgtcgtacgtacgtatcaaaatatggacgtactttttgtttttttggaatacctatatgtgcacgtacaataagagtttttagataaatttaattgtatttttataatagatttaatggttagaactaatgggtccatcggattctaaaatttattagagcgccacgtggtgatttaggagtgtttttaggggtgctatgtgacgttttaggagcgtttataggaaatttaatagacttttagtatataatagatagatagattgtacatacttcatttgatcgtaatacattcatttagaagtaatttatggtcaaagttattgtccgtcgtcgacagcgatagttattccagaatgggccgacagtactttttattgaatatagtataatgtatttggctgcattttagttcttttagctagaaaaaatattttacaaatataccctctataaaacttattgcaggtatggacccactatcttggcaccagagatgttggcgctgaggtaggatatcacagagcaacattttaacgtcgtcctctcccatttaagaactactccttttttctgcaaattttatagacttgttgtcaaatttgaaaaaaaaggacgatatatattaatgtatcgtaaattcctaatttatttccgctagtttatttttatgtataaaaaattaatatgggaagaggacatggctcgcaccctcctctccagtactattgattcgtggttaaatttgaaataaaatcgaaatctgacacatgatatgtattttttttccccgaaatttcactgcaaatcaatattactaggtgtgagaaggagtgtgggacccacattctcctccctttataaattagcgtgaatgaattaggatgcattggtttgtagttttcctaaaatttgatacggagtagcaaattagtaataagattttgaggaaatctagatgggagaggtagacgccaaacttgctggcgccaaaatccacaaaccatgccgtagagataggatctgcaataagtttttttaagtctatttttaaaaatatgtttactaaaaatactacaatatgaaaaaaaaagacaagtttgattgctcatgttcaaggacataaacaatcaatataaaaaaaataaacttccaaggataaatctggaaaaatgcttattcgaattgatccatgaaagttgttttttttggaagggaatatgttgtatcttactccctccgtcccattttaagtgccgccatacttttctgtgctcaactttaatcgtctgtcttatttaaaaattttaaaaaaatattaaaaacataaatcacgcataaagtactattaatattttatcatctcataacaacaaaaatattaattataaaaaattttcaaataagacggacgattaaagttaggcacaaaaactcatggttgcacttaaaatgggagagagggagtatctgaattgattttttttatgtgagggacaaatacttccttcgtcccataaaacataatctagaactggatgtgacatattaacagatgtgtgatttagtactagaatttatcacatccattactagattgatttttcatggaacggggttagtaagcaagaacaacatgatattggttgtactgggctgttttggtttgatgacaaaatttgccctacaaagcactttaaatagtacattgtagatatttggattgatgccaaaatttaccaaaggtatttgctaggacaccaaaccaaatgatcccactctttctaatgtttactagtagtaccacttgtttaatgttttttttaacggggacgatatggattgatcttgtgagtagagaagcagcagcagcagaagatctttggtgaagcaggatttgccgtgacacaatgaccgatcgatcctccgttatacacacggtacacacaagcagtccagattccagtctccagtccatatacacacggtacactggctggagtagacaactgcgactcgtgtatccatggagtatgcatgacaaacaacaaatttcagcgaccccgattagacgtaacccctctccgctatactagcctgtgcagcggcagtagtccagcctgcagaggtaatatgatgtgtcctgtactctgctgtgtgcagctagttacagctacagccagcctactctttgcgttgcagatccacacatggcagctcggattggggagccatcttcttcactggaccagtccatctagattttttttttgttttttactttttgtccttgctctgaaactcattttacaaataaatatttagaaaaacttattttaaaaatagactcttttcagggtgccaacgaagataggcatcttggtccaacgtgacagtgctaatcacattgacattatcctatagccttcacgtgaaagctaagtgactgatatgaaggagttagcgtcaatgtcattggcatcaagaacctatctataattattttttataaaaaagacctatttacaatacatatatttataaatagattctcagtgccgtgttattagtgtcgtgaatctatttgtaaatgcatttttaattaaatagatcctcttttattacaaataagttattttttaaaagaatttacaaaaagatcatcggcaccaataacgtgtgcaccgatcccttttacatcagcattttagcttctacgggcaagctagggatcatggcgtcaataacttgatgccctacaaaaattcatttataagtctatttataaaagaagtttttcaaaaagtctaaaatgtaaaaaaatcattcatgtaagtacgtccgacagttgatgctactagtactgttattcaacataaaataaatgattttaggctacttagggcccgtttagttcccaaaattttttcctaaaaacatcacatctaatctttggacacatgtatgaagcattaaatatagataaaaagaaaaactaattgcacagttatgggggaaatcgcgagacgaatcttttaagcctaattagtctgtgattacccataattactatagtaacccacatgtgctaatgacggcttaattagtctcataagattcgtctcgcggtttaccgacgagttctgaaattagttttttcattcgtgtacgaaaaccccttccgacatccggtcaaacgttcaatgtgacatccaaaaattttcttttccccaactaaacacacccttaccccttaaacagactaatctaaaaattcgctcttataaaaaatttgaataagatgctaatcaggtagtagaatggcataatcggaggaaggactaattgtagtaagctgcaaaacccggcgacgttgtagctcgaggaacatctgatccaagaaaacggtagtagcaggttaattaacccaataatctgggcagatcttctatttctatttctattatatactaaaagtccattaaacttcctacaaacactcctaaaccgccatgtggctcctacaaacactcctataccgccatgtggcgctctaacaaattatagaaattctaagaaaacaataaaaatccgaccatcgattttcacttaatacggtggacccattgtttcacaccattagatatctatcttataacaggaaaaaaaaaatcacaaaacccatccgtatcccctccatcacgtacataacgtacgtacgtcccccaccttctctctctttctttccatttatttataggtagcaaatttttatgttaaaatattaatattaaataattagaatttcttataatatatttgattttaattatgccatgtgttggagtgttttatatatatatatatatatatatatatatatatatatatatgtatatgtatatatatatgtatatatatatatatgtatatgtatatgtatatgtatatatatatgtatatgtatatatatataaaagaaatatatcatttgcatataaactcatatcctttatatgataactaaatattaagacatatcatgcaatcgtaaatgatctaccatctctccttcactttattatccttatttctagctagcagcttagtatataaataattaatatataatttttattatataataaagatttgttaagcagatccccataaaatatcatgcagatatttctattatacatcctttatagtgtttttagctcatcacatggcacatctaataaattataaaaagtactataaatgctgcgaaagaaacatttaatcaatgattttcatttaaatagataaacctattatttttaaccataaaatctatctatataaaacttttaaataaaaaacgtctcctccccttcctcctccttcctctcatctacattattctagaaacttgcatatgtaaatttaaattacaatgtcaaacaaaaattagaaattcaactattaaatagtgttttgtcaagagacagcatccctgctttttttttacatgtcatccgaattgacataatagaatatgaaataattgaaaaaaaatcacatgcactcataatttatatgaaatatgccttttaccatggaatcattatttttttaccattagatttatcttaataaatagacaaaaagagaaaaggcccaatcccaaccctcctgtcctattacattatgtccatacatatgcatgtctgcgccctcccccctcatgcacgacacaacctcgcctcatcttttccttctctcccattgtcttatttttatgcttattagttagatagaaaacatattttgtgatagcaatttttaaacaactataccacctaaactaatttttttatctgtgcacctcattagattatttgcagttaactttcatgagtcgaatccaaattaactactaccttcgtcctaaaatgtaagcatttttagaccatattttggagactagctattgatcagtcataaatatttaggaaaagccacaaagaattttaaatcatattattaacaacatgttgcttacattacaacaatgtaaaacacttttaagtagttagataacacatttgtggaaaataacaaataccgacgaagaatatttgtggagaaaatatactttgaagtatgacagtgctatccgattaatattaaacatgcagcccacaatacatacgcattcacgctaccttcctagtttaattaaacttggggcgatcaacacgcacatcctgtacccaagtggagcacatatatgggcccagttgtgtgcggcatcatcatgcgtgcatatgctgctgctgctgctgctgctgctactgctgctgcttgccttggtctcgtctttggagacgaaaaagaagagagaggaagacgttggcgaggtgacctacctgtggcaagaaatgcatcgcaatgcagaggacgaccaagaagaataaagtcgagatccacctaggattcgtactactgtacacctgctatacagtacgtactccatctcctttttgtgtgacggcttgaaaagaaaagaaaacaaaacaaaagcgacgccatggctgcccatctcctccttctcacttctccctcgtgcatggtcaccatgacaacgtacgtaatgtactattcctagtaatgtgctgtggcgtactgtactgaaaataggtcatctaacttagtactgttttctaattttaaatggttgacacatagatcccaccgcttatgggttcatatgtcagcgatccacgttagagaataataagtcagacgagcctcatccgtaatgtaacaggatcacgagagcactctcctaccatgtatactggccattaaaaaaaaaactttcgactataaatttattatcggtacaataaatttcttacctcgtgtaccggctagcaacctatatccggattcgtagtcatactaatgctacattttgaaacgaatgaataactatagatttaagcacggacgatatctaaatttgaacctagtaactcaattactagtttttttttaaaaaaatactagtaattgaatttattttttttattactgcatatgtagtgctagtgcgggtgctcttcctgcagttggccacttggccaccgcccggtcaacctggcatatttcttttccttcctttggctttgctcgcctagcagaaaaaaaggatcaaaaggcaaaaacaggtctcatcgatcgcaaccgatcactccacttttaattatttcatccattatctcctttagttcgtttctcttttcttttccccctttgacctccatttctttttcttttttgtgtttcttaattagactagccttcaaaactttccttttttttcccctctcttttttatctagtgccctgcctttagaattccagttagggagggatcattttgactggaaattctagctggtgttcttttcttatcacagttggtttggatcagcataacgttctccaccagctgtgatagaaccaacaattttagggcccctttaatttgaagaaaaatataggaattttggaagatttctgtcttataggaaaatttactaagaagccatttgaaaaataaaggattggatcatatccaatcctttgaaattcctatagaatagataatcctatagagattttggagaaaatttagcaagggcttcaacttcttgataactttcctttgagtctatctctctcatccaagtcctgcgtttttcctacggttcaatcaaacggtcattcctatgtttttcctgtgtttttacaatactctgttttacatttgcattcctatcaaaatcatacgttttttctattcctacgttttctcaatcctgggattcaaaggggcccaataagatcaattatcatagtttgatagtttagtgaggtttatttacatactcccaagggtgattatgtacgctcaattaacaactagtacgattggcgtcgtcggccgatcgatctgtgtgcggtccatatatacggatgacgccgtttgcctgcacatgcagctcgatatgcatgtatatatatgatgatcatctccatcgatcgatcgatcggatcgagcacaaacacaatgaatatgtatgttgcatatatgcagcatgactccaatgtaaagctgtgcaggagatgatgattttggctgaaacacatgcctgcttgcctgcatatgcagcttatagctaactgccgtgctgccttcttctccgggcacacgctgtcccgcccttgcgcacgctacattgtcgatctaaccatcgatctcgatcgatcgatcgatcttggagctagcttaattaggagtaattagctataagcgcgcgccaaaggccaaacctggagcttaattaagctgcaaatactcctatatgtactaatctaattaaccagagttactttaatttcagtctttcagatcaccaaccatgcatatacatgatggttgcatgacatgcatcaaccctacattatttatattaatggttgtggttatgtacatgtgtattagatgtatgcgtgctgaataatgcttagagtccacgcatgcatgtactagcgccagacgtggggctgtttggttgtatatacgacttcaccttaccgaactttttgacatatataaattgtgacgacatgccacaagttttattgataagaattaattatttacatatgttaggcaaactttagtaaaaaaaagtgtgggtctatgacaagtgggaataaaaaaaagtgtgagttagattttatggcttaccaaaagtcactactatatatagaaatggttttttttaagacaaccccttatttttacaaggggctaggaagacccgcctatgaaaatatgtgtgggttatccagtcaagccccacgtgtggaaattgattttcacaggtggtgggtataatcgaaatataaaaattccacaagagatcgaatcatgacgacaaaaccaagacattatatttgcctaattatggactctcctcctcgatctagtataattacaatgtattagggtagccatgacgatcgaccggttaggcagccggtcaatttcccttccctatgctatagttgccatgcatgttgttacaacatgtgtacatctctatttaagagagagtctaagataatatttgactctaattctattctaacatatattgttacaactaaaaaatctaatttgtaactgattttgtatatatattcaacacaaactataacagtgataaatttgatggtataatactatacgtagaccgacataaagatactcatgtgaaaaaaggaattgcattttggtagaaatacagtttgtttggcatctacatccaacctaaacaattttaactccagttagttaaaccacatagttatctagctaaacatgatgtttgtgagtgcactgacaccgatatctactctagattttgaatcatgataacctagggatacaattacacaacctaatcatcttgtcacatgccaaattagcaattgagtactagtatatatctttaagttagcaaccaaggtagaactatcatacatgtcgttaccagcagcatgcatgcagcttgtctcatgaaattggccatgatcgagcatgaaccacttgtagagttgtagtgaaattaatcgcacttaaattgagtagtccaatcacatagtccagccaattacaggtaatttgcacatgcttgcttgctgtgaaagggagattaattgagacgcgaaaaattgcttgtctgtacgtcccgcttcatttattatgatcgattccctggtcaggagggaacaaaaccaattgttatgggattgtagggcctctttaattaattgtttcatatgccaaacacgatcaaataaaaaaatggcatcaccaaaattttagtcattgggttgtttttatagtcaaattggcacgccaaattatttagcttaagtaaatgccaaaatgtaactttttttagaaagacagtataaacaagctctaaacacctgtaatacacacggcaatgtatcgatcatatgcacacaagttttctcgtatacacatcatgcacatcaactaaataatatcaaaaaagttctaaaaatgttgtacatatatacttagtagtattatatctatgtatagagtctcatcttcaaactcattatatataccatttgtttcatgttataagtcgtttgactttttcatagtcaaacttttttaaattcatcaaaatttgtaaaaaaatatagtaacatttccaacgtaaaacaaacatatcatcaacatatatgcaatattaaatttaatgaaactaatttgatgttataaatgttgctatttttttcaataatttgatcaaacctcaagcaatgtgacgaagaaaaaggtcaaacgacttataatataaaacagagagagtagggagcaaaaaaaacgacactattttgacagatttatactcttaaaactgttaaaatttttttatcatttttgttacagctaaaatataatgaatttgaggttaacattggacagataagtgtaatactatttttttttgagaattacacagtacaacgcagacactcacaacacacgcaaaccctagaattacacagtacaatgcagacactcagaacgcacgcaaaccctacccctatgagcatcttcgaagactggaccggcaaatcctggagagattgacgaagtcaccacaggcgcctcgctgtcgacgggtatgtcgcctaccactgaaagcacaacgccatttaatcctggaaaattcgctcccatggggagtcgaacccaagacctctactgagtctcttgtaaccactaggctacaggccctttcgcagataagtgtaatactattgaaatcacttctataattttttttctagatttttagttgcgtacacgataagacttgtgtgcacatacacctattcttatgagcatcttggaaagattgagccgacatatataactaatttggcagcaaatcaaacgaagccattgtcaattcttgctaaaaatttggtaatgaccaatttttgctgtgccaaaaaaaaatgctaacggcaatgagccaatcggccaaacaagcgtatagcaaatttgcactgaggcctacctgttacataatagtacccctacatatatattctccaaactgttccatagggaccataaaaatagtggaaagtgggaggacctgggtacaatttatccccactggttggtaaggtttgtgcgtcataaattcgcccgccaaaaaccagatgggcgtgcgggtgcggcctcgtttacgcgttgcagtggttgctggtaacaaacgctgctcgtgtcaaaaaaaaaaaaaaaactctgctgccatcggtgacgatccgggccgtccatttccatttgcatccacgtgtcgagctttgccccgccaagattttgtttaatttgtctcgtgtaccgcccccatcccgtaaatgtccgcgcgccttaattgcggccaacccatttcaccaaccgcaaca

SEQ ID NO: 57999 - DNA, 5804 bp, Oryza sativa
ccccttccgggggggcccgagccatcagtgagataccactctggaagagctcggattctaaccttgtgtcagacccgcgggcctttcctgcgcagcttaggtggaaggcgaagaaggcccccttccgggggggcccgagccatcagtgagataccactctggaagagctcggattctaccttgtgtcagacccacccgcgggccaagggacagtctcaggtagacagtttctatggggcgtaggcctcccaaaaggtaacggaggcgtgcaaaggtttcctcgggccagacggactgggttcggtttcctccaaagaattagattacattgaattattttgaaacgaattagcaattgaaccgctctgagccggctgaaccgggcggtttttgggcgaaccggacattaaaccggcactagttggaccggtagccatactaatgggctgtctaacggcccatatggtgcagctgggggttattttggcaaaaatatgaagaattggtgcacctagtgggaatcgaacccaggtccgctagctgaaagtgccaagcgctagccatcagactatccgacagcatgtgatcatgagcaaatatgtagtgtacttgtatattgagaatcgtggttcgatcgtccgggtcaccggtcagaccggcggaccgctgaaccgagaggtcggccgggtcacccgccggtccggttttttatactatggttctgagttctaaaagctcctttggttgtctcgtagcccatccacacatgctactgacgctacaagacttattatagtggagtacatcccatgccaagggaaaacaaaacccatactgacaccactcctacatctcacacactgccactagagctgtcactacccccacccccacgctgtagaacagtaatggtttcactcaggtagcggacgcggtggtacaggcgatgggtgaggcgctccagaaacataacttcattctcactagagcgaacaatagtcagcagttctgcacagagcttctcagcctccaccaccctaccacgcaagcgcgccacctgatggcgcagatgctgcacctgagggtaattgacatcccttatctcaatttggcgctctgctgctaaggcgtgtatagccatgagtgaagcagtttgctcagcttcagctactgtggtcttagctgcctcataataaaggtagggaacacgatcagccggaccaaggttaacctgcacccctacaacatgcagtccagtggaactatatatatgcctcccagtaatagtcagtggaccaaggtcaagcatgcgtacaaactcttctaaaaagactttagcaggaacctcaatgtactgcgtcatacctggaaaaacaatcatacaaacaatttatattatttaccgtagaaagctgacatgtatcatcctgacctaaggctatatatgaccagacctagaaactatcaacctatagagtctcacattttactgtaccagttcaactagacgacaactacccatgcattaaggtctcctgtcttaatatgcattaattttatctcctttttcaatttatattattgtcaaataataatctaattctaatatggaacctggctctgataccactccaactgtcacgacccaaatatatatatatatacattttttttttgacagtctgccatatccttatacgcatatatactagtatttatatatgtctacaaggatacaaggcaagatgcaatgtctaaccatcacaactggagcttggacacctacaacagtggttccgtttattattattactttttttaccagctacactgcatattacatcagttggttcactgaccaacttattgtcactaggacaaaaccctatacttagcatgcaagtatgccctctggatgtctctaaagactaagtagaccacactccccactgggtctgtatgtcatcattcccctctgacatctcatattgactagtttctgcgcacatcaaatagtaataatatatgagtatgttatacatactcagcaagattagtacatatagctatatatatatatatatatatatatatatatatatatatatatatgtttataaagacagaagaaaaatactattacccatagatattaatagccaataaataataaaggacattaaatatagtaaatgaattaaaaatacactgcagaggtattaaaataatcgttataatctcgttccttcactccgtttttcccccaattagtgataccctcatctgagaatcacgccgccggattccctacttgtgtgaggcattcctcatctcacactgatatcagccaacccgatatcgttatttcaggtatcggccgtctcaggctaagtaacataatcacgttatgattctcactgatgaaatcatcaatccattattcgagtgttaataatgtttattgttagattgttagtaccaccatcttaatataatgttggtaaacaaattcagttagaggtgattaagtaaaatagttgatgggctcagtcttgcctggtttcctgctgttttaccggtgccctagtcaaatatgcaaatctttcatattaatcaatgtataaatttgcatgcataatagctactaactgcctactagagtatagctagttgatgtgactatactagagggagggaaccaactagtactagtagatgcttgcatgcatgcatgtagctgctgctagccactaaaactcgatgcatgcatgtagctgctgctagccagagcattagtcttttcactaacagttatattttctacactaatccatctacttatagctagacattagatgtttattctagccatgcactcaataaaatcaaaggacaaggttctatgtattacctgagaggcttctattagctctaaactctcaagtgtctcacagaactcttgccacagccagagcagggagaagtactactgatggacaagagttgtagggtcacgtacggcttaaatagtgcagcttccttcagtgtgaagcagacacctatccaagccatgatgatagggataggattcaccctccctcttccttacactggaagggttcgatcctatccattaacctcggtgatatttatctgtcctcctcccaaaacaattcaagaatgtttgaacggttccctgctgctactgctattactactactactactactattattattattattcactactactacatttttcatttttttcctagtttcgtcagtaagaggccgcccagtccgccgtgcgcataaatctttctactttcaagtgtgtttgtctctcttttttgggagtttaagggaaaccgggatcaagtatgaccggtaaacatttggtatcagagccaagtcgatcacgtgcggaagtccaaggcgcaatagctgaagtggcagtacaacttcatcgagttcaaccgtggaggaattctcccttcggctcagctgcatcatcacgtcgttggcgacgctcaggccccaatccctgagtccaaggtagttgacaagctcttgcgggttgtgcctgagcatctctcgcacattgcttgctccatgaagaccctcctcgacattgacactctatcactctatgaggtaactggccgtctccacgacgacaaagagcacaagggtcgctcctgagcctattcatctcgcaaggccccctcaagcccctagtcccacgcatagtagagaaaaccgtaccggacgtcaaaccattcaagcccatggtatagtggtctagcgattgaaccggcgattcacacaattcaaatgcaaaactaggacaactatattatatgcatattcctcgtacttcatttattactacttaaaatgttactccctccgtcccatccctccgtcgtagaatataagcatttttttagagttggacacggttattaagaaagtggatagaatcaaatatgagagggttgtggttggatgaaaagtgcaggtaagcataggtgtatctgtagggtggtcccggtggtccccagaccaaaaaaaatagtgattgatcccactatatattggattttagaaaaaaaaagaagaagaaaatcccttacgcagtcattgcacggcgcatgcggaaaggcgaaaaccgaagcgtcgcggcgtgcctcagagcaagtataatagtgagctataagcctactataagcttaggtggaggagagaggtagtgaaaaattaaggatgttggctctcatgcaagagctagcttatcacaagctccaagacaaatacattaaatgtataagtgagagatagagggaggagaagaaaattatagctaaccttagagcgggtacaatagcaggctataagccagctataaacatattttaaagagataaaataggagagagaagagcagcgggctacagatttgtagccagctgcagcacggactctaagacacagtgtgtgtatgacaggtgggaccatgtattaatagtatagtaagcaactattgtatgaatcgactattagagtggctatagatgaattggagctagtagtgggctatactatatgttggctttaagataggctaatagtaggaagttggctatattattatccttgctctcaccttactcgatgcctcgacccctttttttcgtcatgccgcccgcattagcaacaagtctaccaccaggttaggaactgtcgatccaaggagtcgagaaacggaggtcgtcaggtcggagattccgctcgttcgctaggcgcgatcatggagtgccgaccaccgccgcccaccggcctgccacccgctgccacccgctgccatgccgcttgcgcccaccacgatggccggcagcgatgcccattccatgaggtgtgagacgagatcgcgacagccgacgctctcgtcgtcgtcctgatcgatcatcagcaaccaccatcagcgatcggtggctcgtcccggtagacggcacgatggtaatcttcttcaaccttttcaaacttttctagccgtataagcttttttaaatcaaaattttacttatttactaattttatgtattaagatgtgttattaatatatcacgacatatttttgggtatattctattatgtctacttgtattgtacattgtactactccctctgtcccaaaatacaaaaagttttagggttggacacggttattacaaaaagtaggtagaagtgagtggtcgagacttgtgaatggatgagtagttgaggtatgtgagaaaagtgaatagtggagggttgtgattggttgggaagagaatgttggtaaagaagttattatattttgggacaaatcctgagggctaaaagttgttatattttgggggaaaaagtacgaattagccccccgaactatcgaggtcgtccgaattacccccctaaaccataaaaccggacattcttcacccccaactatacaaaccggatgaattacccccctcgatccaaatccgcggtggttttggtctacatggcatacacatggcagtccagtcagcattttatttattaaaaaatgtgggacccacctgtcatagtctctcatctctctctcactcatcctctctctcgctggtggcggaggcaaccggcagcggcggtgcacacggcgggcggcggtgcacatggcgggtggcagtgcgggacgagcggtcggcaggggcgcgcgggtcaagcgggagcggcggcgcgcaaagcgggcagcggcgcgggacggacagtgggca

SEQ ID NO: 58000 - DNA, 1023 bp, Oryza sativa
atggatgatgtcagcatgacatcatcatcttctccttttccagttttttctaatagatgaaatcttcggaaaatcataactaaataaccgtagatccgtttcaggtggttcaagttgctaaatttttctaaaatcaagatctacatgttaaaaatatccacatgtactgtttatgcttgtttttgtattgttttgttgatttttattcttttgctttagtttccgacgttctgaaggagagcgtttccgttgaggaaggttcggaagtgtttgcggaagctcaaggcaagtcacacagatcccaaacaaccctttgagcatgttgaacccatttaaagctattattttatttcaactatgcattgttttcgaatgtcatcgggtggtgaacctttccccgttaattaatggccgaagatgatcttattttcctatgggttataatttgattagtatgaaccttatatattggattggttcagctaaatgctatatatgtagggatgctctagagtcatgcttagaaacattagctaactaaaggggttaaatctaaattattttattattaattagggttatattcaatggtagctcacgatggtaaatcgtgtgatgttaattaattgataattaaaacctggctaaggtgggttgtgagcatatggttttgatggttgtgctcatgacaattaaggaccggttcgcgagctactgttgtgatacatttatcgtgccaaccacaagccagcgtgggcaacggctttatcttttgtatagcgtgattcattatagtgcgccagactgagaagtggcgagaagtccatgggggtcgctggggagtccataccttgtttataagggggtgattatgatccaggaaaggtgcgctgtaatgggttatgttgtgcaaggggatattgtcacaactcctttccgaggtaccgtggtggtattgaggcacatggtgacatgatgtggggttgtgtcttgtgggtacagtggtacacctctggtcagagt

SEQ ID NO: 58001 - DNA, 8709 bp, Oryza sativa
  unsure (1)..(8709): unsure at all n locations
ggcggagttcagtgcaaggcgcggcccaagtagtggcgtggtccagggcggccgtgcaggtgctgtggccggcgagcagccgaagtctccatcagtgccctttagttttcttttgttcgccggggacgagagagggtgctgatgtggcatcctattacgtggatcccacgctaactcagccgccacgtcgtataaagccgaagtcaaaaccaccgaaagactcaaatcgaacggttttgtaaagttgaaggatgtcagttttgcggttgagggatgattttgtaatttgatgacaagttgagggaccttaggtgtacttttttcatttcctaatttatatactacctgaaaggctgaaatgaataggaaaaagtacaccgaaggtcccttaacttgtcatcgagttatgaaatcgttgtccaaccacaaaaccagatatataatatccctcaacttaaataaccgttcactctcttcatgtcagcgtggctatgtcatcacctctctctttccctcctctctctctctctctctcacttttctcctctttccccgccgcgccgtgcctccctcccggtgctcgctctcctcctcctccccttccgcgtcctcgccgctgccgcggggtcccacttctccccctgcggtctcccgcctcgcgggccgcctccgcctctccccgtccatggccgccgtcacgctcctcgcgctcggcaacggcgcgctcgacgtcacgggcgaacgatgcaggagggacggcgaacggcgcggcgatgagcgcgacagccccgacgacgaacgcggagatgaacgggcatcgacggccggcgacagacgacaaggcggcgacactggagaagggaggaggccggcggggcgacgaaggagaggagaaggtccggcggctggctcgcggccgctcgctcgcccgccaccgccgctctgctccaccgaccgcgcgcttgcctgccgccgacccgccgtcggcgcttcgctccgccggccgctcacccgctgcacgtgcgtgcccgctgccgcttcacttcactctgcgcctgacactcaccgacgccccgacccctccgtcctcggcgagctcgtgtacagcatccccggcgccaagaacgtcctcgagatgcccctcctcgcagctcaggcacgtacatgaactctcatgcgattatccatttaatcattgtgtttgttgctcataattgttagctaaataatgtaatcttgtgcagtttctgttgttgcgttgcatacagttggctgtgttagaatctggcagcagccggtcagtagtggatctagatcaatcgggcttctttctgttatgcatgtaacaaactctgtaattgaggagaataaatagaaaaccagaaaagcagcaaaggtattacgctgcgccaaaaactctgctcgttttctctgttcttcagttaaactgttcacgttcgacaaaaggttcagagattgtgagagtgagagtgagagttcgtgagttttgattcagtgtttctgtgttcctaacaataatcatctacgagttcttgttaatggcgatggtttaggtgactcaagtgcgatgggttcgtgctcggtctcgccatcaaccactgcatgttcaacggcgtcggcgtcatgcagttcgtcaactcggggtgtgccgctctccgtcccgccggcgctcgaccgcgccctgctccgcgcgcgcgaccccccgcaggtcgcgttcctgcaccacgagttcacgcagatcgacgacggtgatgacggcggctcgccggcgcagaacggcgccgagccgttcctgcacaggtcgttccggttcacgtccgagtcaatcgcccacgtcaaggcgctcgtctcggtcgacggcggcggcggcgggcgcgcgcccacggcgttcgaggcgctggggatggggcatgcgtggcggagcaagctcctcttcgcggtggacgggcggccgcagttcacgtcgcctcctccggcaaggagacgcgaggcccagccccgcgctcgcgggcactgccctccggccggcctgcccagaggagaaaagtgagagagagcgagagattgtagtaagggagaggaaagagggaggaaagagaggtgatgatatggcttactgacatgtggggcccacgtgggtcccacgctgactcagccgccacgttggataaaaccagggtcaaaaccatcaaatgacctaaaataaacggttttgtaagttgagggatgtcatatatcggaggacgatttcgtaactcgatgacaagttgagggaccttgggtgtactttttccaaatgaatactccctccatattttaatgtatgttaccgttgattttttgacaaacgtttgacctttcgtcttattcaaaaaatttatataattataatttattttattgtgacttgatttatcatcaaatgttctttaggcatgatataagtatttttatatttgcataaaaaatttgaataagacgagtgatcaaacgttggttataaagtcaaggcgtcatacattaagatacggagggagtatattgtttccgtaaaatggcacttcatggttattgataggaacaatcagctatctgaaaacagtggtatcatatcttactataaagttatcccccactaacttcttaagcttgatatgaagatgcctcatcatcattcactaacaagataccacaccatcatccactaattaacaagatgtcacatcatcatgcactaacactcatcacatttaaacatcatgcaaacatgctatatctttatagtttttataatttaagagcttttcaaatacaaacatgttaaattatcatccaacataattcatataatgtttcaatgtatatctttattatgttttatgatatcttatatatttatatagttcatcctcacttagttagtgcttaaatgattaatctatggtctaaattatctttttctttttttcctctaattaagttatatcacatcaattgtttttagtctttagatgattaatctacggtccaaactatctccctacttttttttccctccgtaaagtcataccagcttactttttacgtttgaatcaccattctacatactatttaaatttaaattatcataaatcacattaatttacttaatctgatgttatctagttatcttatacgttatttttttattattattatcatactaaatttccgcagcaatgtgcggggtttcacctagtttaataataaatataagtatatactacggcagctggccaacgtatgatgaccctacgctaatgatgcagcaatctgccacaagctgtttcaagtgctcaatggaaactcgaccatcaagctgcaaagtgcaaaattgctgcttcgttcctctttccatagcttacggatcggaccgtttctcaaaccatgcatgtgctaaataagagagagatataaatgcatgcacttaattaggacttcccaaacataaagatcacatatatatagacatcaattctaatgtttaatcaagtctatggagaaatactaccaaatgagccaaaacttcccatatataaattatttttttagtaaagtccatcaccgtccctaaacttgtaccgttgttttatctcagtccctacactcgcaaatcgaccgttcatcctcaaaattattcaactgtgtcatcacggtccttaaacttgcagatcactcgtttagatcctccaatatatatatgtatatatatatgtatatatgtatatatatatatatatgtatatatatatatatatatatatatatgtatatatatatatacacacacataccagctatgctgccgtgtacgtacataaccagccggctgctgaaattactatacaaccaagacgacgtggacgccgcggtgttcaaggctctcctgtacttcatgtacacgggcacgatgcccggggggccccgccgcgcaagacgacgacggggcgccggcggcggtcatggcgcagcagctgatcgcggcggccgatagattccacctcgacaggttggagacgatgaggttgaggcttctctgcgaggagttgtggactagctactaccggtgtctggcgacattaatctgcagcgtagccagcgactacgtctttgtaacgtcctgccttcccccaggccgggcccgcttacatttgatagctttcataggtcatagattgtcctcacagaccaacacatatcttttctgcacactttgtcctcactcgtgtgcactcgggaagaatttcccggtcggtcacccatcccaaattgcttcaggccaagcaacccatcccaaattgcttcaggccaagcatgcttaaccctggagttctttggagattggcttccggaaaaaaaattgcaacttgttgatataagtattctattaatcctattaagccctaggccgggatgttacaccctcccccttaagagagatcgacgcccccgtcgatcaaccctaggccaggaacgtcctctcttggccacgtccatgtgtccagtgccagcgcatgtgccatgctgtgtaaccactcccggtctacaccagccatgcgcaccatgcctgcgcaactgcgacacacgcgcccgtgaaaccgcgagagtcggctctgataccattttgtaacgtcctgccttcccccaggccgggcccgcttacatctgatagctttcataggtcatagactgccctcacagaccaacacatatcttttctgcacactttgtcctcactcgtgtgcacccgggaagaatttcccggtcggtcacccatcccaaattgcttcaggccaagcatgcttaaccctggagttctttggagattggcttccggaaaagaagttgcaacttgttgatataagtattctattaatcctattaagccctaggccgggatgttacagtcttccatggtttaaggacatgttttcaaagttttgtggtggtgccttttaatttaggcttttcgagtaacgggtgcagcttaattatgtaaagttatactaatatgtatgacgtcgttgattttttttaccaatatttaactattcgtcttatttaaatttttttttgcagatataagaatattttaacgtaggtgccacgtcagtcaaaaccgccatccaaatcgtcttgggacttattttgcatcgtttttgatagttgagggaccagttatatctggttttcgggttgaaggatgaaaatcagattggttgacgagttaaggggacctcagataagcttattccaagcaaaaaaaaaagctaagaggagagggcccacgcgcgatggataaaaccctctcacgtattggcgtatgtattttgttcgtgcgaaaaaaaaaaaagaagttcaaaactaatcgcgcgcagtgatcgtacaagcgatcgatcgctcattatatatccttttcgcgcatatatacatggcaccgtagaaaaggaaaggaaaacccaacacggaaaattaaggaaaacccacctcgcacgcgggtattccacaccgagtccgagttaattacgttctgccccgagcggcaacagtatttatatcgactgcaacacacgtcgtcgtatcacacgtaaacccggccgctgaaatacaaaccccaaaccaattcgagtgagttctccgacatgatgacccgtcgccaggatgcctactaccgctacccaaccacgtcgaccatcgtcgcgtcggcgccaatgcccaccggccaccacgtcctcaggatcgacggctactccctcaccaaggccaagttcgccgccggcgaagaatgcgacgagtcgtgcagcttcgtcgtcggcggccacgcctggcgcatcaggtactaccccaacggcgccgtcgtctccggctccggtggcttcgtatccctcatgctctcccttgatcatcagcccggcgccgcattgccggccgccgtcgtcaaggcgcggttcgcgttcagcttgctcgacatggacggcgagccggtgccgtcgcgcacctacgcgagcgacggcgtggtcagcttcagcgctaattcgtcgagcacgttcggggcggagaggttcatcggccacggcgagctcgaggcgtcggggcacctcaccggcgaccgcctcgccttccggtgcgatgtcaccgtcgtgaagcgcgacgggcctccgacgatgtcgaccctctgcccggtggagcacgacatgttcagatgcctgctcgacaccggggacgacgcggacgtcgcgttcagggccgccggcggcgagacgatcgccgcgcataggcgggtgctcgagcgacgggcaccggagctggccaagctctgtcgtcgtcgcggcggcgcctcctgcttcatgggactcgtcgggaggcacatcgacgtcggcgacatggacgccgctgcgttcaaggctctgcttcacttcgtgtacaccgacacgctgccggagacgatggccccgcgagaggtgccggccatggcgccgcagctgatcgcggcagcgcgtaaatacggcttggactgggagaggttgaggctcctctgtgaggacaaggcgtggggatggcgcgtcgacgacacgagcatggacacgacggcggcggctgctccggctaccggcgatgatccgaagcgtagccagcgacgtcttccatggtttataaggaaatgtttttaaagtttggagatgcgtagttctagcacagacagatactccctctatctagaaaataagtgctaccatgagtttctgtgcacaactttaatcgtccatcttatttaattttttagaaaaaaaaatctaaaaacataaatcatgcataaagttctattcatattttataatctaatataaaaaaatacttactaatcataaaaaaattttaaataagacgaacgattaaagttgtatacggaaacttatgattgtacttattttgaaacagagggagtatatgaaatactagtagaaaaatgtacctctacttacttacatagtcataaaataaatagtttatatcttctaaacaaaataaaagttcacttcagttttcagttcagactcaccttaagctctaaatgtaacgaaacggaaccaataaaattaagggactgtctactcctcgacagaaaacccctcctaatatcttgcaaatttttgttcattggattgatttgagattcgtgcaaaccccaccaaaccctaaccaccttttcctttttcctccctgccgccgcacaacgctcaagcgctcctcccctcctctcagcaccgcgcgcctccttcactgccgccgccgcctcactgttccgtcacccggcctcgccggctggccgaaaagtgtcaacgacgccggcgaggccccgnccgctggcccccttcccctcccctcctttgcctcaagccggcggcggtgcgctgtatgtcgtcttccccgtcgccggcggcggggcgccatcaccggctacctcctcctaccactctttcagctttgcccccgtcgcctcaaccggcccgccgcccgctcccgaccccgcggcttcgcgccgccgccgccgcctcgccacctgcccgatccgccgcccaccgccggactgccgcctcccacggccatccctctaaagccgacgaactcccctctcttccccctcccacccccaccccaccccgggatcctaattcgtcggccctctgccggagtttgggttcgccggcgccggagaagaagaggtggtcgccggagttggagaagaaaagcacgaatcgtgaagcacatccaatgatccaaaatttgcaagatttgagattgtgttttctgtggacataaatttagcatttccgtaaaattaatattgttttttattgtttttacattcaatatctctaattctattgtatgcatgttacatgtaaggttaatcaaaacgagaagatgataataaatatttttttatctttaattaaagggggtaatgctttatattttagaatggtgggagctaaggctacactttactgctataagatcggcgtcttctctccacacgttctatccataagtgtcgtggcgacgtatactcagcttctcttcctcgctcgaaagggtgtcgccatgcgcgcgttcgagagcttcaccggtcgtcacgacgaccgccgcctcgccttcatcaaggacggcgtcgagctgcgagccgggctgccaccagggccggctgggacagtaaggacggtgcgactgtactgagcctccaaaaattaggagcctcgaaaatatgtatactatgatatcaggcctgataggcttagaaaaaagacagaagaccaatcgacgatcgaacatatcgtgacggcttgattgtattttaaacttatttagtgtgaaattcgttaatgacaatgagtttttaaatattatcttgtaattttatggtaaatgtagaccttcattttttttccacaccgaaccactaaagagtcagtgccggccctggccaccgccgccacccgtcggcgaccctgagtccggcggcctgcgccgccgcttgctctccttgctggacgggacggacgtcaccttcagggtcggcggcgaggcgttcgccgcgcatagctccgtggtcgccgcgtggtcgccggtgctcagcccccctccccc

SEQ ID NO: 58002 - DNA, 8537 bp, Oryza sativa
tgggccggctgggccgaggagagagagagaccgggttttgggccgactttcggcccaaagccaaaagaggacttttaaaacctttttcaatttaaattatttcttaaatgcaattccatttattaaaaatacttccttagctcaaataaatcccagaaaaatctaggaattatagaattaagcaaagtatttaatgaaattttatctggcccctttttatattggaatttattaattaaacttagattttcttttcaagacttttaaaataaattctagaaattccatttaaacaacaatttatataatttgaattttcagggtgtgacaaacctaccccccttaaacagaatctcgtcctcgagattcggaagaactggcgaacagatgcggatgagctgacttcaattcatcttctcgttcccaagttgattcttcttccgagtgattactccactggactttacaaaaacggataactcgattcctggtttttctctcatttgtttccaagatacggattggtttctcaacataggtcagatcctcttggacttctatctgttcaagattagcttcttcggtaggtacccttaaacactttttcaattgcgacacatggaacacattatggactcctgccaaggattgaggtaactccaactgataagcaacctctcctcttctactgacaatcttataaggtcccacaaaacgcggtgccaattttcctttggtgtgaaaacgatgaacacctcgaagaggcgtgacacgaagatacacataatctccttcttcaaaactcaaatctctgcggcgattgtcggcataactcttatgtcgagactgagccactcgcaatctttcttgaatgattttcaccttttcttctgcttcccttaggatatccgtcccgaaaacctgacgttctcccgtttgatcccacaaaagcggagtgcggcacttccgaccatacagtgcttcgtaaggagccatctgcagactagcttgataactgttgttgtacgagaattctgcatagggtagattcttatcccaacttccaccgaagtctaaagcacaagctctcaacatgtcttccaaaatctgattcactctttcggtctgtccgtctgtctgcggatgataagcagtgctaaagttcaacttagaacccatctcttcctgaagtttcttccaaaaatttgaagtaaactgactgcctcgatcagacactattttcttagggacgccatgcaaacacacaatccttgccatatacaattttgctaagcgacttccggaataggttgtttttaccggaataaaatgagccactttggtaagtctgtcgactattacccaaatagagtcatggcctgatgacgttctgggcaaaccagtgataaaatccataccaatttcttcccatttccattcaggaatcttcaaaggctgcaacaaaccggcaggtttctgatgttctgccttgactcgctgacaaacatcacatactgctacgtattccgcgatttcacgcttcatacttgcccaccaaaatcattctttgagatcctggtacatcttagtactaccagggtgaatggagtataaagtatcatgagcttctttcagaattgcatcttttaaatctttgttatcagggacacagattctctcacccaaccatacagttccgtgctcatcctccaagaaaccgatagcttttcctcttctcatattcttcttgatttcttgaatatcaggatcattaatttgggcttctctaacttgatcaattagagtgggcttcgcttctaaggctgcaacaaaacctctactgacaattcccaaatttaatctttcaaattccttgcataattccaatggcaactgtcgtccttctgtagcattgcaatagcctttcctgctaagagcgtcggctacaacattagcctttcctgggtgataatgaattcccatgtcataatccttacttaattccaaccatctccgttgtctcatgttcagatccggctgagtaaagatatactttaaactcttgtgatcggtgtacacctctgtacgagtaccgaaaagataatgacgccaaattttcaacgcatgaactactgcagctaactcaagatcatgagtagggtagttcttctcatgcggacgtaactgacgagatgcataggcaaccaccttcccatcttgcatcagaacacaacctaacccaagtttggatgcatcgcaatacacttggaaacccttctttggatcaggcaaaatcaaaataggagctgatattaagcgacttttcaactcttgaaaactctgttcacattcttccgaccacttgtacttcacatctttctgaagcagtcgtgtcatgggcttagcaatcttagaaaaattctctataaacctccggtaatatcctgcgaggcctaggaaactgcggatctctgaaactgtcttcggttgcttccaattggttacggattccacattactaggatcaacggcaactcctccggctgagatgacgtgaccaaggaatttcacttcagacaaccaaaattcacacttgctaaacttggcatacaattgatgctctcgtagcttctccaatgcaaggcgaagatgttcttcatgctcttctttggttcgagagtagataagaatatcatcaataaagaccaccacaaacttgtctaggtattccataaacaccttattcatcaagttcatgaagaaagcaggggcattggtaagtccaaaagacataacagtacattcgaacaacccatacctagtggtaaaagctgtcttaggtatatcttcctctttgattcttaactggtgataccctgatcgaagatctatcttggagaaaacagtggcacctttaagctgatcaaacaaatcatcaattctgggtagcgggtacttattcttgatagtcacatcatttaatgcacgataatccacacacattctctgggtatggtctttcttttcccaaaaaataactggagctccccatagtgacgaactcggtctgatgtatcctttctgtagcaaatcatctacttgcctcttgacttcagccaactcattggctgccattctataaggtctcttatggatcggagttgttccaggtaccaaatctattctgaactctatatcccttttgggcggcattccaggtaaatcatctgggaacacatcggaatactcccgaactataggaatctcttccaaagttatctggttcagtcttgaccttaaagactcagaagacaatgcattaacagttacaactcgaccatcattgctggtgagagttacttttctgttggcacagtctatcacacctttatgtctggctaaccagtccatccctagaatgacatcaaggtctttggattctaacaagataagattggccagaaatggtactcctttaatttctattctgaccgaggggctacgttgcaaagaaagtgcttgattacctggggtactaaccatcaaaggacgtctaagatcttctacttccatcccatgatttcccgcaaaactcatagataagaatgaatgtgtagcaccagaatcgaaaagtactgttgcaggaactgagttaacagggaacgtacccaaaatcatatctggagcatcttgagcttctgcagcagcaacatgattgacacgggcctttgatgctggtacagtagagttgctctgagcagggacaaccttcacgcgtcgaggcttcggacacttgtcagcataatgtcctgggtctccacagttgaaacacaccacgggcttgctaccttgctccctcttggcaggttgttgctgtgctggagctgcaacagggcgtggagcttgattgcggatgttattgccagcattgttgttgaagaactgacgctgcggacgaacaacagacgaagaacctccctgtggcataggctggggtcctaaagcaagacgcggcttctgattactcccctgttgtgccttgaagtgagcaatccggcgtttcttctgctccatgcgattatacttgtcctcctgacgaatagccttatccaccaatttctggaaatcagaataatctccagtcatgagtgggtaagaaagctcatcattaagtccttccaagaacttctcttgacgttcttcatcagtgcgcacatcttccggagcataacgagcaagacgattgaactcgtgcagatactccgtaacagagcgagatccctgagtaagcgacctgaactccttcttcttgagagacaccactcccgatggtatatgcgtctttcggaaagcagcagtgaattcaagccaagtgataggttcagcagtagtcctattcaggcggaagtgatcccaccattcagaggcagggccatgtaactggtatgatgcaaatgagaccttctcctgatcagtgcactgaagcaaatccaacttcttctctatggcatgcagccagtcaccagcttcaacaggattagtggtactagagaaaacaggcggccttacacgaagaaattctgctaacttattctgaggaggtgcatggttatttccttggttctgctgattctgaaattgttgcatcatcatgttcattagctgtgtctgttgagcaagaacttgagcaagagtgggattctctccattgttattgttattggggttgttgggaccattcccgttgctgcgagtattcaccatctggcatggacaggataagaagagaaaccgggggaaaactacttaggacagagaattactttaacttttattgatcttaactgagttttattattacaaactgaagactctcacaccactaaactcaccaacttcctaacactcaaaagcaaacaaacgcacgcacttacatcccaccactgatgtaaatcacatgcaagacccacacacacaaccaaacttaaagcaagcaaactaacacaacgatctaagacaacgacttaacaagtcactctagttcttccaagcatcggaggtcgattgaaggctcattcggctcgtcttcatcatcttgagttgctacccactcaatcttggaatggttgcgcttggattcttcttcttcatcactacttatgatgatgactggaggatctgctagggttggggcaacttctttctccaccacacgaacctttggcgccaattgatagcgagggacaaatagagctctcttccttgcggtgagacgaatcctggccttctgcggtggtgcttctcccttcaatgcggctagttccttctccaaacgatccaccttatcttcgagcttgcaaatcttaccacgattccgatcttcccgatcttgagctgctagcacactctctgcacgactttcatccatagcccacagcatctcaaccaaatatcttgtggtagcatcattctcaattccttcagtctcaaggtaactgccacgatcacttccctgaggttgacgaggatggtagctgtcacgaccggaaatcacccaacaggcgttcccgacgtgcgtgtattattccttgtcccaggaggcaaggtacaccaaaagttgatacaatacagagtttaacaagcggaagcgtatataaaattattacatgggcaacgaaggcccagcacactcaaagacaacgaaaaacagcggaagactagggcgacgaccacaggcgcttgacggcaggcacgagctagacaccaaagccttcatcttccaggaactcctcatctgggcttgggaaaattaagcaagactgagtacaaccaccgtactcaacaagacacacccaccaatgcagaataaatgcaagggagtacaagggaattataatataaagggttagggttgcagtaaacagcatttaaagacatttagttgctcaaagctactttgtaaacgcgatcctagaactaaacaatattattaatcaaggccgtgaacccgcacgaacctgccttaacccaaggcctatgatgattcagaccgaactggcaacccgaccctgggtcccagctcgtcctaagccaacccaggccaaccattccatattttagttgttaagcaagttttaagaattaaaacactaacttgggtacattgctcggcttgcccataaccgagggctcggctattcgaatagattttactctgatcagaggtgtacaactttacccacaagacacatcttcctcacgtgttgccacgtgccacataccaccacggtatacggacggaagacgtgacatagtttccaacccatcctagccttagacaagagtaccgacccaatcccacctacggccgggatacccgggacaggcaggcagaactgagcccctagcagcagggcaccaaccctctgccgtatgacatctcgactaccgggccgcagctcgtgtagccttcatttgccctggagaatgtccatcgacgcccgacttcatccatctccaatccgtgtacttttgtctatgactagactgagccacaaactaagccttacccattagacatgtggaagtacggtagtgctttgcaacagaggcccgaagaccggtccttaaacggccgaggtgctactatcaaaaccatgcaccccgagcccagcctaaaaccattttggggattttgaataaagggggatggtgtgagtccaattccacaataaaccaacaattccagagtatccaggtgatatgaatatttcccaaagtctatagttgtaaaaccacctaaggttacctaattagattgcgaagcatctacctaaaatcatactagggataccatgagtagagtgtccactagttgaggttttgtttgtctagggtgaacaaggtagtaataataacaataacaataataatatggtcataacaaaggtaaataggcatggctaagtaaaatagtgataacgcgggaatttaaataaagtgataatgcaataatttaaatcaacataattttataaaatgggattcaatatgatcaagatgatgtgtcttgccttgctcgttttcccaatcgacggcttcgacttccacgaagagcggatcttccgaagctgcagcgtctacacgaccaacggaaaagaaaaaggctttaacactaaataactccacataacagcagaaacaaagcacaaaaatgggttctttacatcttaaggaaaaattagagacttgaacggtccaattccgagttcaaatggccaagatatggccatttgaagtttatatgctctttaaatggatatttgcgaatttcttcatttaattttcaattaaaaatcctatttattgcgtcagccgagggagcggggcgcgcggaccgggtccacgggagtggggcccacgcgtcagccccacggtccacggtggaccgggcgcacgcggctggcggcggtcggcgccgtgggtcccacgcgtcagccgcacccgcgggcgcgggcggctgacggccgggcccacttggcagccgcgagggcgcgcccgaaggcggcctcgccggcacggccgacgggaggaggacgcgcacccgcgccccgatggtcgccgccggcgaccaacggcgcggcggagtggcacccgagagagaggagggaagggggaagcgaacggaacggtcttcggctcaccccggtcgacgagggcggcggaaacgacggacggagcggaggaagacggcggcgcggttcgggatgacgatgacgacggcgctccggcagtcgacgggcgaagcggagcggcggacggggtcggcggcaacacggcgaagcggacggaggtgtcgccgagtaaggaggaagtccggagcggcggcggcggcggaacggagctcggcggcgatggcggagagagaggagcacggcgcgagcacgaaaccgacggcgagagcgagcggcgagcggcggaaacggaagagcgaagctcgggcaacgtttaaatagcgccgggggaaggaaagagcggccggagagggaggaatcggtcgcggagatttcggccgccatagatgcgccggcgatgaatgcgggattaaatccgagcgaatccgagggagagagagaggggaaagcgggggaaacgggagagggaatcacggggagtgattcccctctctttaatgcgcgcggggacggcgggatgcggcgcaatccgcggcggcggcggcgctagggcacgggcgcggcggcgggcgcggcgggaggaaggcgatgacaggtgggccccacccgtcagcgagagtggcgggcgggcctgcctgtcagcggcgcgcgcgcgcggggagccgatgggccgcgggggaagagagagagagggagagggaaggaatgggccgagccggcccaagaagggaggaggagggggaaaagacttcttttagggttttctttttataaaacctttttaactttgtttatttcttttctattattatttgtgctctgaaaattccactaaaatttatt

SEQ ID NO: 58003 - DNA, 17483 bp, Oryza sativa
tttcgctttttccatgaggagtttacacttacatggaaaggtttaagtacacttcttggttttcacgatacctgtaaaatcgatctcttgaaaggaatttctgggttcgagaaaaataggttttgggaagacatttccggtgctacaatttgcaagaaacctagaacgaatgatatccataatcctacacttaggcttatgcacaaatggattgctatgactttgtttcctagaggtgatattagacccattaggggagatgaattgattattatgtttgccatggttagaaagattaaaattgctcctgtgaaatgtatgataaggcaatggttagaaagtatcaagttctttgctcctgttgagtgcacttctctgattactcggatagcaaaagggctaggagtcgttagtgaccaaattgcttttttctcagttactcgtccgcgtattgatgaggcctatctagtgcaggggcattttttgaaacatggagaagatggatctttgatttactttttctctggttgtacaaatgaaatcctgttgccaaatgcggggtatcatttgtacaactgtcatgaactaaccatacccctgcagaccatagaagaatctcgtgcaggtggagcatacagggagacgcgcaacatgacaagaaatgaacgagaaagttcatcatcctcaacaccgtacagatgtatgagcgaggttgggaaccaactagggatgcacccggatggacccaagctccacgtcacaacatcggagtcttaggctgggcaagtgccagtgaggaccggtggcgtgcacctcatgacatacaatggggggacaaccaaccctccagatcaagcggtttgcctccatctcctggtggatggcgctcaagttcctctcgttgggacttgggtgaaatctctagtagactggacacccttgatatgcagacgggggagagattcagtacaacctctcggaacacatagcacaaacgcaagaatggcaacaatctgctgatgctcagttcgccaacttcaacaacatgatgcagcaacagcacgattaccttcaagcatgcttgagcgaaggctttaggttcccgggcttgacggtcctagttacttgcggcattgccacgtcaggaggctcaaaacctcccggcaaccatccggcactggccatgcctcacccggctatgccaggtgtccctcataccgttggccccacaggtgactggcaaccacctaggggttgagcgatggcttcaggtccttgggcttgacggtccttgttacctgaagcacagccattttcggggacttactacccccaggccaccacccgaccccggtcagacccgaacggctgagccaggtgtccccataccgttggctccgtaaatggtttgcggccatctaggagttgaccgaagacctcggcttcatgggcttgacggtccttgtttccctttgtattgtcacgcaggagacttgtaacctcctgccaccatgcctagcacacatctcgaagccgggcgagatccccaagcacttgggtggcaaggccttcctcacttgtagcatcagggcatcagccgggctcctacatcaatccagctggtaaaggagtctggccaccctccttgaatagtcggcagcatgagaaagctaagtacactgcaaatttaaacgccagcgtatttacaagcttcagtctttgccacacattcccccacatgttctaaccaacaagatagaaaggaaaagtgtttcattataggtcaagatcattgaccaatgcagcagcagcagaggcgacttcttctaatcgccagccgacatcctcctcagagtagtcggccgcatacccttcctcgacagcagccatatcaacccaagggtagtgcgacttcaccattgccagggcatggttggtggcgatcctcgcagccgactcagccatccgacgacaccctgccatcatgaagggatctttgccttcacctcgactcgggaagagcacgcgcagagttgggaccagggccttcaccaagtcttcgcgctgtgccttcaccgagtcaagctcccgctggaaatgctcatactgcgtacgaatgttctcagcgcgcacattgacctcctgatacaaattcgccagattcgtatttgtcttcacgaggtcttcctccagggtcgccttttcgacaagaccatatacggtggtctcttgccaaaactaacaaaaccgtcataactaacctaattaatagatacaattgccttaattgagctctatctctaactggcaatgacggttaaaccaatctaggcccatgccgagcccaagtcacaccatatcggctgtatcggccatcagcattatcaaccttgattattatcaacctctgttttcaaccgatacagtcttcagccaatgcacagtccgactccaaatctaactcgatccaacaccgaatccgctttgatcttcttccttcttctccgaatctgatggcaaattccgttgttaacaacaatatagcagaatttgaaggagttttgctagttatgagaaaggcaaaagcactaggggctcagctcttgataattaaaactgattcaaagttggtagctagtcatttttcgaagacaattgaggcaaaagaagaaacaatggcaaaatacctacaagaagcaaggttgaatgaaaagcactttcttggaataaccgtaaaagccatagcaagagaagaaaacggagaagacaatgagctagcaaaagcagctgctgcaggccaaccattggaatattcattttttgatgttgtaacttactccaagctatgagagaaaagagtttacatgcatacaaaaagtggcaaattggagagaaccaattctgaagtatcttgttagtgaacaacttccagagaaagaagaggaagcaaggagctacaattgatgtccaggaagtacaaagtaatagaaggacagttatacaagagcggagttaccactccactgttaaagtgtgtaacaagagaagaaggcatgagaatagtggtggagatacatgaaggattgtgtggcgctcaccaagcaccatggtcagtagcatcaaaggtgataagacaatgaatatattggctaacaatcatgaaagacacggagaaatacatcaagacatgtaaagcatgccacaaatttggtccaacatcaaaagcactaccgaaagagttgcaacaaattccaccggtttggccattctatagatggtgatttgcttttggtcattatggcaattgagtatatttcaagatagattgaagcagaagctgtagcgaggatcacctctgcggaagtacaaaagtttgtttggaagaacatcatatgccgatttggagttccaagggagatagcatgtgacaatggaaaatagttcgagtcaggaaagttcaaagacatgtgtaaatcactcaatttgcttcagtaggccatccacaaacaaatggaactgaagaaagagcaaatggcaagataatggaagccattaaaaagagggtggaaggatcagctatgggaaaatgggtagaagacctattgtcggtgctttgggcattaagaacgatggtggttcgatcaactggaatgacaactttcattctagtttatggagataaggcaatgaggccaagtgaagttggagcaaattcacctcgagtcatatttcatcagcaagatgaagaagagagattacactagaaatgctagacgagataagagttgaagcattgtacaaaatgacaatgtacacagaaggaaccaaaaactactacaacaaaagggtgaaaacaaggaaaatacaagtaggtgatttggtattgaagttgttgttgggaaacttgagtcaaaatgggaaggaccatttatagtgaagaaaagaatagaaacaagcgcattcaatttgccatatcttgatggagaagaactaaagcacacatggaatgccatttcattgaagaagttatatgttttaaaaaaaacttttcgtgcttatagtatattactcagtttgtaaaatacctgccagcctgtaaagtactcctctccaatcttaatatatataaacatgtcacatcctgatttttgtttcaggatttataaattatttaataaattattattagaatttatattaaatgttcgttaatttacaagtgaagttaaatgtgggaaataaaatttcctaaatataaagcatggatggatttaatttttattaaattctccatggttaattatactctctggaattttctcggatttttcggagctcaattattaattttaatcatacaaagagcatttcagtaattacccacatattaaattaatcattaaatggtctaattataattttgttaagtacttttagtgtccaagtattttcaggatttttcttgaaattatttgagcattggaagtatttttaacaattcaaagatcattttagtgattattttaattgaaaaagttttaaaagccctcccttaagtcgttgggccgaattcggcccaacactccctctctcccgcgcggccgagccggcccaaaaccggcccgagtcggctcaagccgagccgcccgccccctcctctctcaggcgccgacatgtggggcccacatgtcggttgcttctcctacctccggccggccggccatgcctagcccgagccgccgccttgccgcctcaaatccgcacccaatccggccccgtttcttccggatttttgaggggttttgatcctctcgttctcctctatcctttcccctaagaatcggagcaaaccgttgagtattttatccgaatcgaactcgtttttgagtttatctccaaaaccgagtttttgatttcccggatcgatttcttgcgggaggagtccgatctcttcaatccaaggctataaataggaccccctagtcctcctctttcgtttgccccctcttccgtcctctcccgtgacccgtagagccgtcgccaccgtgcaagccgccgccgccgtcgcttcttcgtcgccggccgtcatccgtcgtcgttcgtcgcgttggtgagtaccatcgggttcgtctcgtcatcctctatgtgtacatgccctccaattccgcagccggccgctctatctccggcgaggtcgccatcttggttcggccatgggtgatgtcagcatgacgtcatcggtttttctttttctcgtttttctaatagattaaaacttcggaaaatcataactaaataaccgtagatccgtttcaggtggttcaagttgctaaatttttctaaaataaagatctacatattaaaattgtccataaattgaattaaatttatttaattttttttaaatgggctttaaatagatttaatcttgtaaaattcataataaattcatttgaagtcagaatgaggccgttcaagtctcataattcatctaaaattatgatctacatgtttgtttactttatatgtattgtttatttggtttttattagtctttttcttcgttttacgtgttagcttgttgtttccgtcgttgcgaaggttcgtgagtgcaccggaagtattcaagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacctattcctttgttatggccaatttgcattgaatatcctattccttgataccttgggtaataaattgattagcttgaaccttatgtattggtttggttcagctaaatgttagatataattgcttagcaaagcttagaaacattagctcactaataggatgaatcatatatattacattattatttatggttatatttaatggtagctcacgatggttaatcgtgttatgataattaattggtaattaaaatatgattaatggtgggttgtgagcacatggttttgaaggtcgtgctcatggcaattaaggaccggttcgcgagctactgttgtgaaacatttatcgtgccaaccacaagccagcgtgggcaacggctttatcttttgtatagcgtgattcattatagtgcgccagactgagaagtggcgagaagtccatgggggtcgctggggagtccatgccttgtttataagggggtgattatgatccaggaacggtgcactgttttgagttgtgttgtgcaaagggtattgtcacgatttccccctttgcaatgccgtggtggtatttcggggcatggtaacatgtgtggaatcgtgtcttgtgggtacagtggtacacctctggccagactaaaactattcgaatagccgtgcccgcggttatgggcgggttgagcaatgtttttcgtgattagtctcacacctctcacaataattatggatgttatacctggtaataatttgcttagctcctggtttggagaatagatctgtacagccgggtatggttgttcaggatggttgggcctgtgcagcatgggtgtgttgttcagtgttgattaaaatttctgattaattactccactgttttacttcttttaaatgttttgctaaatgctgcttttgcaaatgagcctatattatgccatcctttggtatccttgtgcacttgcatatttgctgggtggcttgttgagtatgtcatatgctcattcttgcaataatcaatcaacctcagttgaagaaaaaggatccagaaggagaagacgtttggcttataccccagttgagctgcctgtgggagtggagccggagcttcgctagattttattttccactgcagttttcttcttggtgaggactaagtgcctcttaagtaagtatttatcggtttagttattatgatggatttgtatattaaattgtcagtttgtgtacctcggctgattcctggacgaggattttatgcacaaatcagttcggaaattactagtaaatttccgggcgtgacaaaacaggatgtagggtttttatccataatggaggcccgaacctgtataaaaaacttgtctttgtgtgtttatgaatgatgatggaaaatactccacatagttcggagaaagtacaactcgatcacaagcatcgataaaatactctgcacggttcggagaaaacacaactcgatcacaagaattgagaaaacattctgcacagcttggagaaaacaaaacgaaactaacatgagctcgaacgctacaatctgtactcgagctcgaaagctaaaaattgcgtgacgcggcaaaacatagttcgacctcgtcactcctttgaaagatgaggatgacggtggttttcgagcaatttttgccttagctaaaaaaacatgcatatcttcagcattactttcattttgttctttgcggataagctcgagctcttcattacttttttccaaaacggtgatttgttctttcaacttatcttcagcatcagctagttggcgagaaacctcttgatgttcaaggacagaccgctcgagagctttttctcgagcatgtaattttttgttctcttcaacgagcacctttttctcctcaataagcccttttatcacgccgctgatttttcgaacaagatcagtgaaggcgttcttctcgttagaaactcgattgagctcacgatgaaggaattcttggtctttcttgagtttagctatatgttcgacggattttttccattgagcgcaaattgcctcaagtgctttcttagcaacatcccgttgaagtcgagcaaggctagcagtctacaaaagcaacaacaaaacaagtaagacgtgagcactcgaaaacttaaaagttcaaaaatatgattactcgacagtgaaagatctcgaagtgtagaaaatacctttgcggcagacacatcgagcgtggcccaagaggacataagatcattttccttgatgaactctttttccaactccaaagggattaaaatcctctcgagctcatcgccaactgggccgagggggttgtggtgcttcaagtcgtccatgcataggttggccctgtgatggctactttcccccatatcgctgaaattgggcaaacccatcaaccaatgcccatcttgagcgcaacgctcgctaaagctgccaagaacttcttttaccagttgaggagatggagttaatataaatgggggagaaggagtccaaacagttttcgaactatcaccaactcgaacatcgccagttatagtgttttttccaatttcgtgccgttggctgatgttgactggagactgagctgtctgagtttctaagtctttgttagctcgagtcgggctactcaagctggtagtctcgacagcatgtgctcgaacactcttctccactactgtggcagtggatgcaagtacatccaaaggagcagtttcgttcactgaaacggcaaggctggcatcagctcaaatggggatgacgttgataacagggaattcgattcgaatttaatcatcatccagttcatcatcactgtcattgacaattttgacgttgatgtttgggggcctgcttgaaacatttttcctcttcaacccgctcgaaacatgatggggaggaggagcgatctttgcagtatcagaggcagttgattcgctcgagctatcgctcgaactgctgctcgagtcatcatcactgcttgaactgtcctcatcctagtcattttccttattttcatcgctgtcttcattttccacattgatatcttcaacatcaacttcgtcttcatcggaggatggggcttttgccttctttttcttttttttttcctagctcgggagcttgctcgggatgaatgcaagcaggaatatcggtgtttagaacagcaaacacatgattttgtcttttcccattttgcagtgtcaagtacttcaagtactcatccttggtaaacggaccaataagcttccgacagggacggacaatgtcctctgggatgacaactgaaacaatagaaaaacatgaataagtcatttaaaaaactggaaaagcgaagaaaacgcaaaagaaaactttcaaacaagatgaaacttacgttcagaagaaacgatgaggggatgaagtagtgaggtggccccatccggaagttcaccaaggctaagggcccaactagttgagagaggtcgaataccaagacagatgaactcctcgaccaagtctcgaacactaaatttcgaaacgagttcttcaactagagatcgaatggcggtaaaatcagaggaaagcgctaccgatggttcgaagacaactttcggggtcttacaagaaaaagtgaaagggcagtctttctcagcatacaactcggcaggaatttggaggtagaaccactttgattgccacttgtttccccacttggttcgactcgcagaaacaataggcccgggatagccgcggttcgagtggggggagaagttgatgcagccaaacttcgaattctgcttggtgtagtgtctggtgtggtgaaagtacgcaaaatcttgagcatgaggaactccaccacaactgtgaatgatccattcgaaaacccctagcctcacgacagcgtttggagtaagttgtgggaactcgagcccatacagcttgagcacatccacaaggaaaggactgcaaggaaacatgaagccgtcatcgaaaaaatcttcaaacatgagtgtgtagccaggcctcggagaggggttcaactcgttgactggtcgaatagtgacatttgacaagaaatcgaaccgtttgtgacaagttcgtccaggtcctagaccagaaggggtcttctccaatttcttggtgttgtcgaagcgaccactgcgtacgtcgaaggacgtggttactcaacagttgttgggaacagtgaagtgtattaattttggaatttttcttgggatcccccttttatatgaccctaggggtctatttataatactatcacaggttcccccagtagggttttggttttacaggggaatttacataattgcccttacaaaagggacatttacatgggtacacagcgtaattgtgatacaagggccaataatgggcgcctccttgaagctggactcgttatggcgaagtcaccctccttcagcatgcacccttcgccatttagtctttgcccaagattcctttggccttgtgggataccagcgcgatccttcgcccttcgccgcctttcttcacagtctttgccatgggggcttcgcccagatgaacttgacaccttgagctcgaatcctcgctggttgcatggtttcggcaggtctggtcgaagggtttcatgacataccactaacaagccccacacgggcaagggtgagataggagcttcgaccgagaccgtgaaaaccatgcggtatggtatgaggttggcggtatgtcatgagacccttctaccagactagctgaaaccatgcaaccagcgaggattcgagctcaaggcatcaagttcatctgggcaaagcacccactgcgaagtctgttaagcaaaaggcagcgaagggtgaaggatcgcgctggtatcccacaaggccaaaggcatcttgggcgaagactaaatggcgaagggtgcatgccgaaggagggtgacttcgccataacgagtccagcttaaaggaggcccaaggggccatcccagccgctcaagcccgttggcccttgggccaacattcgccaattggcccattataggcccatgtatcacaattacgctgtgtacctatgcaaatgtcccttttgtaagggcaaccatgtaaattctcctgtaaaacctaaaccctaatgggggaacctatgataggatcataaatagacccctagggccatgtaaaagggggatcccaagaaaaattccaaaattaatacacttcactgttcccaacaactgttgggtaaccacatccttcgacgtacgcagttgtcgcttcgacaacagctggcgccgaccgtggggatctctgagcgaaaccactgagagcgaatgccacagaagaaggttgcaaaggagaaggttgctaagcgaaaggagagtgaagcaggaggggaaatggccgtcgaagagggagcagagccttcggcgcccgtcgtcgaagctggtgcagcaccatcggcttcggcacctgcgccgcaaccaccaccttcggctcctgccgcttggacggggcaggcgccgaacacggttgatgcggcataggcagctgcggcggcgagggcgctctagaccagggcggagatcctttcgacaagccaactggtggcgccccaagccgcttcgccgcaaccggctacgacttcgaccacgctcgccgctgcacaagtcaaccccaaccttgaggcacaagccgaagcagacatggaggccatgcgccagaaaatgacgcaacttcaagacatgcttcgccaaatgcaagagcagcagcaggcatacgaagcagcaaggcaagccaaggtcgcttcggccccaattctccagtattcagcgggctacattccaccccaagtctacccgcaagcaccgattcaggcccttccgccacaagtcatgcaagcgccagcgtacttcgccgggtagccttcggccgcaacagtacacccgacccctcgtgtatagccacaagttcagccagtcgctgcccaagtacgccccccaccacctggtcaaatgtcacaagcaatggcggagggggcttcggccttgcaggcgcagcttcaagctttccttcagtaactcagccaaccccacaacacttcaggtacaaccccttcggcccaaccggaggggcaaacaagtcagggtgcacccagttggctactgtcgaaccagcctagtccgggggcttcgccatggagtcaaggaccacagttcaacctcagcaatgccattcaagcaccaaccactcgaccacaggtaacgacgctaggctgcggaacaaatcaagcgcagaaccaggtcgctatggcatggacccagcctccgttcgacccatccatggtggcacaccaagtgccaccgttcggagctgggcaaccgaatactgtggtccaacctcatgcgctagtcatgacttcgcccttcgccacgccatatccacaaccaaacgggccttcgcagcaaggtaccgtgagcaaggcggggggcgaaaaggggctaccattgagtgggggaatcaaaatttgtccaatctcaccccagttcaagttcccacccgttctgcggtactcgggcgaaacggacccaaaagagtttctgtccatctacgagtctgcaatcgaagccgctcacggagacgagaacaccaaggcaaaggtaatccatctcgctctagatggcatcgcccgttcttggtactacaatttacaagctaatagcatttactcatgggagcaattgcgcgatgtctttgtccttaactttcgaggcacctatgaggagtcgaagacgcagcaacatctactcggcattcgccagaggctgagggatcgataagggagtgcatgcgttgcttctcgcaatcccgatgccaagttcaggacataaccgaggtgtccgtcatcaacgccgcttcggcggggctgcttgaaggcaaactcacaagaaaaatctccaacaggagccgtagacactcgagcacctgcttcacatcattgacgggtacgcaagggacgaagaggattccaagcgacggcaagcaatccaagccgagtacgataagccttcatcgccgctgctcaagcccaagtacaagcacaagtcgccgaaccggctcctctcgccattcaccaacctcagccagcgaaccaaggacaaccgccaaggccaagtcaagctcccatgacttggaggaaattcagaaccgaccgcgcgggcaaggccgtgaaggctgtcgaagaagttcaagccctccgcatggagttcgatggccaacaagcaggcagccatcaacagcccattcgcaagaaggtcagaaaatacctctactgcgccttccatggacgctcttcgcacaccaccgagcaatgccgaaacattcggcagcgtggcagcgcacaagatccaaggccacagcaaggagcagctgtcgaagcacctcgcgaagctgctcaagaacaagcaccctcggccgaatagcgccaagatgtgcaacgcaaagtaatccaagtgattacaagggccgatctaccagatcaaccgtcaaaacggcagaagaagatgcagctgcgaatggtgcacaacatcacttcgacaggcgaaggggctccgcggtatttgaaccagcagatctctttcgggccggacgatgccgaaggagtgctgttcccacatcaagaccccctgataatcttggccgagatagttggcttcgaagtccggcgaattttggtcgacggaggaagttcagccgatgtcataatcgccgaagcatatgccaggatggggttgccaaccctagccctcacccaagcaccaacctcgcttcaaggtttcggcggcgaagcagttcaagtcctgggccaagtacaactggcggtggctttcggcacaagcgacaacaggcgcgaagagcaaatactcttcgacgtcgtcgacatcccatacaactacaacaccatcttcggccgcgcaaccttgaacaagttcaaagccatctcccaccacaactatctcaagctcaagatgcctggtctggcaggcgtgatcatggtcaaggggctccaaccttcggctacatcaaagggcgatttggccgcaatcaacagagcagtgcacaatgttgaggccgaaccgcatgtccgggcaaagcacattccgaagcccgcctcccacggcaaggtgatcaaggtgcaggtcgacgatgccgatcccacaagatttgtttcgcttagaggcaacatgggcgaaaaggaagctgagagcatcctagaggtgctcaagaaaaacattgtcatcttcacctagggccccaacgaagtgggaggtgtttcgacagacctcatcatacatcatctggcggtcaaaccggatgccaagccaaggaaaaagaagctgcgcaagatgtccgctgatctccaagaggcagcaaaagccgaagtgtagaagttgctcaaagccgggttgatccaagagatcgaccatcccaagtggttggcgaatccggtactggtgcggaagtcgaacggcaaatggcgcatgtgtgtcgatttcacagacctcaacaaggcatgtccgaaagacgacttcctcctaccgcggatcgaccagctcgtggatttgacagctggctgtgaacttacgagctttttggatgcgtactccggctatcaccagatccacatgaatccagctgacatccccaagacagccttcatcacgccgttcggtactttttgccacctcaggatgcctttcggcctaaggaacgccggagcaaccttcgccagcctggtatacaaggtcctctacaagcagctggggcgaaatgtggagacctatgtcgacgatattgtcgtagaaagccacaaggctttcgaccatgcgtccgacatacaggaaaccttcgacaacatacgctcggcgggtatgttcgcgcgggcaaggttttgggttttcttatttctgaaaggggtatcgaggcaaaccccgagaaaatcgatgccattcagcaaatgaagcccccgtcgagcgtacgcgaagtacaaaagctcgcaggccgaattgcggcgctcagtcaattcctctcaaaggcagccgaatgaggtttgcccttcttcaagaccctccggggcgcgggaaagtttagctggacacctgaatgccaagcaccgttcgacgagctgaagcaatatatgcaaagcccacccgctttggtcagcccagcaccgggaagtgaactgctgctctgtctagcagcttcgccggtggcagtcagtgcagccctcgtccaagagagagtcaggccagaaacccgtgtatttcgtctccaaagctttgcaaggggcgaaattaagatacattgaaatggaaaatcttgcttacgccctagtgatggcttcgagcaagcttaaacactactttcaggcccacaaagtcactgtgccatcacagtatactttggccgaagtgctccggggcaaggaaattactggccggctcaacaagtgggtggcggaattatctcccttcgacctgcattttgtcgcccgcactgccatcaagtcccaagtcctagcagccttcgtggccaaatggacaccggcgttcgcctccgaaaccgagcccatcgaacaaccttgggtaatgtactctgacagctcgtggtcacacaagggggcgggcgccgtggcggtgctcacttcaccagggggcatgctgattcggtatgctgcaagactgcagttcgacacaaccaacaacacggcagagtacaaagctgtactgttgggcctaagaaaggcgaaagcattgggggttcggcgcttgctcatccgaacagactccaaacgggtggcaagccttcttgacaaatcttttgaggcaaaagaagaaggaatgaagaggtatctggaggctattcgatctatggaaaagtgtttcgccggcataacggtcgaacacctacctagaggccagaatgaagaagccgacgccctggcaaaatccgctgccagtggaggcccacattcaccaggcatcctcttcgaagtcttgtacgcaccaagtgtgcccacagagagcctggacatcatggcagtcgaccaggcagaactgggcgaagacccagaggactggcgaacaccgttcgtgaagtacctcaagaacggttggctcccagaggacgaagcagaagcgaagcgcctacagctcaaagccgcacgatacaagcttgtctctgggtagctgtatcgctccggtgtgctccaacccttgcttcgctacatctccttcgccgaaggtgaggatatggcaaaagaaatacaccaggggctgtgcggtgcgcatcaggcagcaagaacggtcgcttccaaagtgtttcgtcagggtgtgtattggcccaccgtgctgaaagtttgtgttgagcaagtcaagaagtgcgaaagctgtcagcagcatggctgaagccaaacagcaccccagtacgaacaacaacctatcgcaccagtctggcctttcgccagatggaggctagatatcattggccctttccccgtggcacgaaatgggtacaagtttgcagttgtagccactgaatacttctcccgttggatcgaggccgaaccactcagcgcgatcacttcggcagcagtacagaagtttgtgtggaagaacattgtttgccgtttcggagtgccaaaagaattcgtcactgacaacggcaagcaattcgattctgacaaattcggagaaatgtgcgaatggctaaacctagaaatcaagttcgcttcggtcacgcacccacagtgaaatggggcggccgaacgttcgaatggtaagatgcttgaagcgctcaggaaaaggcttgagggggagctgttgtcgaagcgacaactacgtacgtcgaaggacgtggttacccaacagttgttgggtacagtgaagtgtattaattttggaatttttcttgggatccccccttttacatggccctaggggtctatttatgatcttatcacaggttcccccattagggtttaggttttacagggaaatttacatggttacccttacgaaagggatatttacatgggtacacagcgtaattgtgatacatgggcctataatgggccaattggcgaacattggcccaagggccaatgggcttgagcggctgggatggcccctagggcctccttgaagctggactcgttatggagaagtcaccctccttcggcatgcacccttcgccatttagttttcgcccaagatgcctttggccttgtgggataccagcgcgatccttcgcccttcgccgcttttgcttcacagtcttcgccatgggggcttcgcccagatgaacttgatgccctgagcttgaatccttgctggttgcatggttttggcaggactggtcgaagggtctcatgacataccgccaacaagcccctcacgggcaagggtgagataagagcttcggccgagaccgtgcaaaccatgtggtatggtatgacgcgcccccttttcgaccgacgctcctgccgaaacctatactggagtcctgcggagaatgtgtgcactatgtgtacatgtgtttctagctttcgccttttgcaaacggcgaaacagtctttatttttctctgggccgaaatgaacagtgatgggcttcccttcgtgggcttatcattgtgtggcccgatcaatgagaatttaccgtttcgcataccct

SEQ ID NO: 58004 - DNA, 9379 bp, Oryza sativa
cgagggaggcaaaatagacttttgcggagaaatttgattggaaggatttggattcggaattgaactcgacgatagatcagggattgagatcttgagatggcacggacactagacaacaagcaaagaaacaaatttcgcaattagggtttttaagagataattttcccgctaggcgccacgacggaacgggcgctacagaccaacccccctaacaagaatctcgaccccgagattcagcacctaagggagcaggtccgggaactcggcgcggagaagatcttctcgctcccaggttgcctcgtcttcggaatgattgctccattggactttgtagaacttgatggtcttccttcgagtctgacgttctgcctcttcaagaaccttgatcggtctttccttgtaggtcagattcttttccagctcgatattacccaggggaacttgctcttctggaactcaaagacatttctttaactgggatacgtggaacacgttgtgcacgtctgcgagaccttcaggtagctcaagctgataagccacttcgccacgtctggcggttatgaggtaggggccgatgtagcggggtgctaacttgccggacatcccaaaccttctcataccacggaggggtgatacccgcaggtacacatgatctccttcttcgaactcaaggtcacgcctccgattgtcagcgtaattcttctgacggttctgtgctgtcttcaaacgttctcgtatcagcttaacttgttcttctgctgacttgagtatgtcaggaccgaataccagtgctttgcccacctcattccagcacaagggggtgcggcactttcttccgaacattgcctcattcggcgacatctgaatgctggcctgataactgttgttgtatgagaactcggcatacggcaaacaacgatcccaagtgccttcgaaatccaaggcacacgcacgtagcatgtcttctaggatttggtttaccctttcggtctgaccatcggtctgcggatggtaggctgtactaaaattcagatcagttccgagggcttcatgcaactgcttccagaaccttgaggtgaactgagtgcctcggtctgacacaattttcttgggacagccaaatctacatacgacatgggtcatgtagagttctgctagtttctttccatcataggaggttttcactggcacgaaatgagctgatttcgtgagtcggtccacgattacccaaatggagtcgtacccgttgggggttcttggcaaaccggtgatgaaatccattccgatctcttcccatttccactcgggaatcggtaggggttgcagcagaccagctagcctctgatgttccgccttgactctttggcaaatgtcacacagggctacgtattctgcgacgtctcgcttcattctagcccaccagaagtatgccttgatatcttggtacatcttcgtacttcctgggtgaatggagtaggcggactcatgagcttcctttaggatgagatctcttaactccttcttggccggtacacagatgtgtggtccgcaccaaactgtgccttgatcgtctatggagaaatttgtgtctttcttctcctgtattctttttattaattcttttatcccttcgtcgtctttttgagcctcccggatttgcgactctagggtaggctgtactgtcaagctggcagggacacctgactgtaccacggtcagtcttaacttctccaattctctgcacaggtgatcttggtcaggccgtatttgagctacattgcaataggccttgcgacttagcgcatcagcgaccacgttggctttaccaggatgatagtggattccaagatcgtaatccttgattagttccaaccatcttctctgtctcatatttaactcggtctgggtgaagatatacttaagacttttgtgatcggtgtatacttcacatctgttcccgattaaatagtgcctccagatcttaagagcatgaaccacggctgccaactcgagatcatgggtgggataattggcttcatgaggcctgagctgcctggatgcataggccacaaccttttgttcttgcattaggacacatcctaagccttgtcttgatgcgtcacagaagatctcaaaatcttttcggatatctggcaaggtgagaactggggcagtggtcaaccttttcttcaattcttggaagctgtcttcacaggctgcagaccattgaaatttcttttccttctttaacagctcggtcataggtctggctagcttagagaatccttcaatgaatcttcgataatatccagctaagccaaggaagctgcggatctctgacacgttcttgggcgggttccaagcaagtacagcttcaaccttgctgggatctacttcgacaccgttggaggaaatcacgtgtccaagaaatgctactcggtccaaccagaattcgcatttcgagaatttagcgaatagttgatgatctctaagcttttccattatcagcctcaggtgttcagcatgttcttcctcgttcttggagtataccaggatgtcatcgatgaacaccacgacaaactggtctaggtattccatgaagattttgttcattaagttcatgaagaatgctggagcattggtgagtccgaaggacataactgtgaactcatatagaccataacgcgttgagaaagcggtcttcgggatatcttcagatctgattttcagttggtggtaacctgacctcaagtcaatttttgagaaaactcttgctcctttaagttgatcgaataaatcgtcaatccgtggcaacgggtacttgttctttatagttacttcattcagggctctatagtcgattaccattctctccgagccatcctttttcttaaccagaagcactggggctccccaaggggatgagctaggtcgcacataacctttactttccagttcttcgatttgtcttttaacttctgctaactcattagcggccattcggtagggtctttttgcaattggagctgtgcctggtgccagttctatggcgaactcgatctctcggtctggtggcattcttgttaattcttccggaaatacgtcgggatattcacagactatgggcaccgactccaaggaggtgacttgtaaacaggttaggatagaccgacttgcggtaggggtgttaggggtaaagcggacttgctttcctccaggtccttgcaaggtgatggacctttcggcacaatctatctgtcctttgtgcttagccaaccaatccatccctagaatgatgtccaagctttgcgagtctaggactatcggtttggctaggaagtcaacttcctcaattctaaggttaacttccaggcatatttgagttgcccttatattccttccaggggaatgtactatcattggtacacgcaaattttgggttttccaaccatttcttttcacaaaagcttgcgatatgaaagaatgggaagctcccgaatcgaacagaactattgcgggtacggagttgacagagaacatacccatcacaacgtctggagcatcctgagcggtttctgcttgaatgtgattcacacggcctcgaccaaagttgttggaagcacgtgaaccttgtccacttgcctgagagctaggacgagactgagctgccgctggagtaggagttctggcagtgctaccattagcatgccctgagttggtgttggtaggattctgaggacactgtctagcatagtgacccatctggttgcaccggaaacactgaactgctgacggtccctgcggtgacttgaaagaggtaacactgttaggcgcagtatcgctactaggggcacgctgctgtggctgaggtgccggacggtttatctgaggacgaggggcgtagcctggctggcggttagcctgggtgaccgactggtggtattgcatgggttgaccgtagcgagggcgaggtgcgcctcgggaagaatttccctgatggttagacttgcgtttcttgtattcttcggtagcctcttttctggcatcctcaagtagaagtgccttgttgatcatatgttgaaaagtggggaagtcatgagcaagcaactggagtctcattccaactgcgattcctgatcttcttcttatctgtgtctacttcctcaggggcgtaccgagccaacttgttgaactgacttaggtactcattgacactgctgttgccttgcttaagtctgttgaattcttctttcttcatgtcaatagtgctttcaggcacatgagctgcacggaaagccgtagcgaactcatcccaagcaatgttagtgggttcagggtgtgcattgcagtaattctcccatcaatctgcggcaggtcctcttagttggtgagaggcgtagagcgtcttctcaacaggtgtacactgcactaagttgagttttctatcaacatctttcaaccaatcgtcagcctcgacgggctcgacggtctgagagaactctggcggacgagacctcagaaagtctgccagcttggatctgttgttgcccatgtgagggtggccatttccatgcgcattatgctgaaaactggctatggctgtggttagtccttgcaagatttgtgtctgaactgccattaagtgttgcatgttggtttccacatgaggtggggaagggaggcgttcttctccagaattgtgactggcagtgcggtgagagcggtgagactgttccatctctgcatcacgggaaactgtgcgatgcgagcggctgctgcggcggggttgctcaacctctgcgttgcgggaaacagtacgatgcgaacggttgctgtggtgagactgctcattagctgattcatgattttcttctggctcaactctaccatccttaaaaccaaagcgggctggtgcacgagctgcacggcggggacggctagccatctaaactcccagaagagggcggggtaagagtcagataagcacttaggagggcaaggagcaaagcaaatagcaactcatatagcacacactaggcataaactggatttttcaaatcataaaaacacctgatacaacgggtgtggacaagtcacagagctacgccgagcttgactgtgcgcacaccacctaggagaaccagactaccaaacaacacccacaacaaacacacgcacgcactacctggccacgactccaaaagagttggcggcggaacaaaaaggcctatcacacggacggctgctgaagactgcctcctctactcctcgtcggcctggctgcctcctgtagtcggctcctcagtcgaagaaacgtcgatcggctgacgcgaagggactggcggaacctgtcgagggccggcagcagcacgggccgctggcggtgggggagctgggtagtggaaacggaacacggtggaagaaccaacaacacgcttccgcgcggtgcggataaagcgtgggccacggcgggaggaagcaactggggtgtgtccgggggtgtaggaagggctaactgggtgtgggtagggggagtacactggtgagtacggcgcacgcgagctgggggagcgcgggccactgggagtgcgggcagagccgcgggagctgtgggaggacaggtggctggcgtggcagaggcggcctgagtcccaagagatagtgtcaactgaggtgacaccctcctcggccagacgggcctccaaagcggcgtagcggcgggcaagggagcggtaagcctcaaggagtaggtcgtgctgagtggcctgagcctccgaaagctcgaccacgcgagtcagcactggctgagactcgctgtacggacaagggtacctggcgtctgagtggccagagggaaggcgtggaagctgccggaaggcggaacctccgagacggtggctgtagtcgtgggccaggcgacgaagcgcagtccaggagaggtcctggtacgcgatctggagagtgggcctggccacagtgaagtggtgggggcgaaggccagctccgtgtatacctccacgggggtaaaggtacaccgagagctcacagtgagggggaacacggtccacggagtaccccgtgtactcgggacacgagaagccaaggaaacgggagaggtcacgaagctgagcgacgtggtgaccctcaccaaaaccgtgggaactgaagctggcgttcactgccatttacaattttgaaagagggagaaagatcagtaaccgttttagaaacaaactattgaaaataaagaaaacaaaagaaaccttagcttttcgcaagtagttttgaacttagtatccttagggtcgtcctaagcgtcgggtttcgccctagggccaagcctgtgctctgataccatctcttgtcacgccccgaactagtcccgaccggaactagcccgtgacgctccaaattaacctgttaatcgataccagtcccaggaaacagtgctggtatcacagggagacagagtatcacagcaacagaggtctctttattatagagtagaagtacagtcatgttgggctgcggacagatcccgagctcacaactgcattacaaaaggaaagcggaagccaggacttggaccaatcatcacaggcgcgacttgggaactaggccgaaaccctaaaactcatcgtagccgacttgctcctggaagaactcctcgtcagcaggatccacttcatcttcttcagcaactggggggggttatttatatagagcaagggtgagtacgggagtactcagcaagccaggggaaataagtgtttaatgcaggcttcaaggaaaggctgttgttttcgtaattgattttgtttgaactcttttctaaaaagtctaagtgagtgcttctcaaacgacacggatgagacagtgcgtctcgtccggtcggagtatgtgcaatgcatcaatctttagaattgaaacaagattggcacccggccaacagcttttcaaacggccacccgggccaacaacttttcaaacggccacccgggccaacaacttttcaaacggccacccgggcctagctgatcccgtcagctgctgatttttcaaacatcgaatccccttttcacaacagcaatttcacaagcagtagtcaaacaaaactacgctaggaatcacctcacatccgcccatgaccgtgggcacggctgttcgagcagtttgttaacctctgcagagggggtacactttacccacacgacattactaacccggatcacccagcccgtggggatcagccacgtcgggagacctccaagctttcatgacaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaagggaatcggtccttaagtgcgagagcgggaaaccgtacacccggtacgttccccggtccgcggttttggaaattcatttagttcgcaagcaccgacccaggtgtcgggttttccaagtcttttgtaaaactccagttttacccaagttgttactcagattttaagtttgaaggcgaccgtcgatactcgcacagagcgcacgaatatcgaggcgcaactgggtggttacaaggggacatggtataacaattaaccaaggaatgatcaaatgtaacaaattaggtaggtctgccaatctgccttgcagacgggacaacagattaagtgtgatcctatcaatgcataatatttcgcaagcaatataattaaatttcaaatataggctcaagatgttcaaaggtggcttgccttgctcgagatccggagcttgatcctcgaaatcctcgcactgcgggtcttcgggctccgaaactacacgcgaaacgggacaactcaacaaacggcgaaaataaagccctattaatgacctctaagcgcaccattagatagatctcgagatttgaggaattttggaagttgaacggagtcaatcggatttacggttgggaagatattgaatttctaagattattggatttttggtctaaaggaaaaaggatttatttaaatcctttttggaaaagaaaaagaaaagaagggagggagggaatatagacttttctcggacggctagggcgcggcccaagagaaatggagcggtctggccgagctaaatgggccggccggcccaaggcggcccaaactcgcgcgcgcgcgggagggaggagaaagagagccggtggaccgggctcaccacgcgcggtcccgggtgggacccgcttgtcagcggctcggctcaccgtgcggagggagcacgcgacgcacgcgcgcgggcggggaaggggcgcggtgcatgcgcgcggtccgcggtggacgcaggtgccgcggacccacgcgcagcctcaaggctcgcggtggaacgcgcgcacggggagggactgaccggggtcggctcgatccggtctaggctgagctggcgccgacgtggcgcctacgtggctgccacgcgggccggcgggaggtagacgacgacccggccgcgaatggacggcgggcggcggcggcgagcggcggagcgaaccacggtgatacgggcaaaagcgtgcacaccgggcggttgcacgtgacaaggggagacgagccaacggctcggattcgccggaggttgcttgacggcggcggattgtggcggcggcaaccggcggcgggagaagagggaaacggcgacgaggtcacgagaggtcgattcccggcgatgagagcatctacgcggcgtcgggaactcgacgctagcgtcggattggacggaactacgccgagcgaggccggcgacgagcgggtgctacggagctcgggcggcgacggcggcgagcacacggcgagcgacggcaacggtcggggcggcgccggctagctacggggaggctactcgtgctaccaccgaaaactaagggggggagatggagcgaggaggaagaacggagagaggcactaccgtgcggatcggggcgctgtgacgagaggccgacggcgcgggagtaatctctccggcctcgggccggggaagaggaaggagagggcgcggccggagtcctcttccacgtccttgctcgtgccggctcctccgacacgcgcaacgacgatcggcgacggcgaaacagagggcggcaatggcgcggaggcgaaaatgagggagtttggagggggagggcttgggcttaaatggacggcaatgtcggtttgggagaggggaaccgac

SEQ ID NO: 58005 - DNA, 3131 bp, Oryza sativa
gggcattatacttttgcaacttgttacagcacaagaaccaaaggatttgagaaagaatgggctcatcaaactaggagatattatacgattccaaggaaagagcatggagcagcaacatgaggtcctaaaaagcattgtggatcctgacctgaagaaatgccagttagatgacgccgcagagatgctgttcctgggattgaaatgcagtgatccaaatgagaaacatcgtccagacctcgcagctgatgtgtggccactcatcgaggaaatgaagagcagtgcctctcatcgtcagggttgagtgaagctgaggaagctctatctcttgaagcaagaagaataaactacaagattactcaacttgtgtggtgtgaaatctcccctctcctgaaatttgtgtggcaagcaaagtgctccacggatatgaaactttctttgtgtattgtgtttatgttgagttttgcaaagttgagtttatgttcagttcacaatagtcaagcctgaattcaataatttagtctgagatgtttgtggtttccacattcttgaggaaacaaattatttgggtgccaaacgctctggctgccattgtggctacccctacccatcatggcctgtccatttttgcaagcatttctgcagtgcaagatgcagaggccgggatgtttattattccattatctaaaaaaaaccatttctggcaaggtatacaaattaactacaaacccaactacatcctactcaggcattgtttagttcacaaaacaaaattttttcacccatcacatcgaatgtttggacacatgtatagagtattaaatgtggacaaaataaaaaaaccaattacacaatttgcgtgtaaattgcaagacaaatcttttaagcctaattgcgccatgatttgacaatgtggtgctacagtaaacatttgctaatgacgggttaattaggcttaataaattcgtctcgcagtttcctggtgaaatctgtaatttgttttgttattagactacgtttaataattcaaatgtctatccgtatatccgatgtgacaactaaacccaaaatttttccccaactaaacaaggcctcaaagaggacaaatccaaactgcatgattttcgtactatcctagagtaaattacagatagccgcaaatcaaaataacaattaattgtactagcctacatgatttaccccccttttcttttcgtctcatcgagagaagccagatccaaacaagcgtcaatagcatggcagtgaattaattaatggaggaaaattagtagggttttgggtacacctgggaatgtggccttccgatccttccgctagtccactgctaggttgcccccgccgacgaggagatggccggagaccagagttggccggagacggggagggaaagccttctgggagggaaagtcggaaaccccggtggcatgatagcgccggccggagcaacggaagctccaggagagtgatgcccgggagtagaacggaatcactcctctccaccgtctcctccgcatcgccgcccgtcggtcgccgccgccgccgcggcggccgcctcaccggcagaggcacattgctgcgagcccagcgatgaaggcggcggcagaaggcccacgttgccgggccaactcaggcccatatattgattggatgggcccacgcatattcgtcggctgcactctcataggccttaattacggcccgtgattggaagaccataaatttcctaaggaaaaagtacacccgaggtccctcaacttgtcatcgaattacaaaatcatctcccaaccgcaaaaccagatatatgacatcctcaacttataaaaccattcactttacgtccttcggtggttttgacccaattttatccgacgtggcggctgagtctgggactcacatgggccccacatgtcatgatgccacgtcagcatcttctctcgctttcccctcctctccctttctcatctctctctctctcactttctcctcttagggagcacggccggccggcaggggaggagcgcgacgggcgcgcgacggccagcgagggaggagcgcggctgagaggagggttggcgcgatgggtggcggtcggcgacgcggagcacgacgacgacttggggccgccgctcgcttgctcctgggggctggaagagtagcacgcagccacgcactcagagtggaagcggtgggtgtccggcgacgtcccgaggcgggcgaggacggcggtggcttgcctcccgctcctctccccgccgatctccctcgccggcccgcgggtgcgcgcggagaggaagaagggcagcggccggccggcagaatagccggtgaacccatccttccctccatttctttgctagcttccgccattgtctcttggattttatttgctcatctggtgcttctggccctttccgtttctgcagctcacagcctcacacccgctcaaattcttcacaatctgtaagtgtgtgtgtgtgtaaattcttgcaaattagaagctgaattgctgctaatagcctgcatcgactcgtaaatttatgtttttttgttggaacagatgggctgtggctagtggccgcagtacagctatgggggatgccatcctgctgcagaccaaccacattcgacgttaacaaggtgccaaccatgcggggacctagtgcaccggcggcgcggcgcactgaggacgacgaggggcggcggcggcacgcggcgcgcggtgaaggccggccgtgcgtcggcggggtgcggcgcacggcgtgacggcagccgacggcggggcgcggtggcggctaggcggcggccgcgacgcggacacgcggcggcggcgcggctaggacacgggctcgtggtggctggcgtgcggcgggccggcggctcacggcgccacgccatgcggggcggcgtgggggcggtcaagcgggcatggcgcggtgctgcgagcacgccgcggacggcgaatgcggtgcagcgggctagcacggcgcggtgcggcgacgccggtggccgggtgggtgcgggatacggctgagcggcggctcggcgcgggatgcggccgagcggccatggctgctcgctgctccgcccttttccttttttttttctttcttcat

SEQ ID NO: 58006 - DNA, 17501 bp, Oryza sativa
ttcttccgagtgattactccattgaactttgcagaaacggataactcgattcctggttcttctctcatttgtttccaagatacggattggtttctcaacataagtcaaatcctcttggacttctatctgctcaatattagcttcttcggtaggtatccttaaacatttttttaattgcgacacatggaacacattatggaatcctgccaaagattgaggtaactccaactgataagcaacttctcctcttctactgacaatcttataaggtcccacaaaacgcggtgccaattttcctttggtgtgaaaacgatgaacccctcgaagaggcgtgacacgaagatacacataatctccttcctcaaaactcaaatctctgcggcgattgtcggcataactcttatgacgagactgagccacacgcaatctttcttgaatgattttcaccttttcttctgcttcccttaggatatccgtcccaaaaacctgacgttctcccgtttgatcccacaaaagcggagtgcggcacttccgaccatacagtgcttcgtaaggagccatctgtaaactagcttgataactgttgttgtatgaaaattctgcataaggtagattcttatcccaacttccaccgaaatctaaagcacaagctctcaacatgtcttccaaaatctgattcaccctttcggtttgtccgtctgtctgcggatgataagcagtgctaaagttcagcttagaacccatctcttcctgaagtttcttccaaaaatttgaagtaaactaactgcctcgatcagacactatcttcttagggacgccatgcaaacacacaatccttgccatatacaattccgccaagcgacttccggaataggttgtctttaccggaatgaaatgagctacttttgtaagtctgtcgactatcacccaaaagaatcatggcctgatgacgttctgggtaaaccagtaataaaatccatacctatttcttcccatttccattcaggaatcttcaaaggctgcaacaaaccggcgggtttctgatgttctgccttgactcgctgacaaacatcacatactgctacatattctgcgatttcacgcttcatacttgcccaccaaaatctttccttgagatcctggtacatcttagtactaccagggtgaatggagtataaagtatcatgagcttctttcagaactgcatcttttagatctttgttgtcggggacacagattctctcacccaaccatacagttccttgctcatcctccaagaaaccaatagcttttcctcttctcatattcttcttgatctcttgaatatcaggatcattaatttgggcttctctaacttgatcaattagagtgggcttcgcttctaaggctgcaacgaaacctctactgacaatttccaaatttaatctttcaaattccttgcataattccaatggcaactgtcgaccttctgtagcattgcaatagcctttgctgctaagagcgtctgctacaacattagcctttcccggatgataatgaattcccatgtcataatccttaattaattccaaccatctccgttgtctcatgttcagatccggctgagtaaagatatactttaaactcttgtgatcggtgtacacttctgtacgagtaccgaaaaggtaatgacgccaaatcttcaatgcatgaacgacggcagctaactcaatatcatgagtagggtagttcttctcatgcggacgtaactgtcgagaggcataggcaaccaccttcccatcttgcatcagaacacaacctaacccaagtttggacgcatcgcaatacacttgaaaacccttctttggatcaggcaaaatcaaaataggagctgatattaagcgacttttcaactcttgaaaactccgctcacattcttccgaccacttgtactttacatctttctgaagcagtcgtgtcatgggcttagcaatcttggaaaaattctctataaacctccggtaatatcctgcgagacctaggaaactgcgaatctctgaaactgtctttggttgtttccagttggttacggattccacattactaggatcgacggcaactcctcctgctgagataacgtgaccaaggaacttcacttcagtcaaccaaaattcacacttgctaaacttagcatacaattgatgttctcgtagcttctctagtgcaaggcgaagatgttcctcatgctcttctttggttcgagaatagataagaatgtcatcaataaagaccaccacaaacttgtctaagtattccataaacaccttattcatcaagttcatgaagaaagcaggggcattggtaagtccaaaagacataacagtacattcgaacaacccatacctagtggtaaaagctgtcttaggtatatcttcctctttgattctcaactggtgataccctgatcgaagatctatcttggagaatacagtggcacctttaagctgatcaaacaaatcatcaattctgggtagcggatacttattcttgatagtcacatcatttagtgcacgatagtccacacacatcctttgggtatggtctttcttttccacaaaaataactggagctccccaaggtgatgaactcggtctgatgtatcctttctgtagcaaatcatctacttgcctcttaacttctgccaactcattggctgccattcgataaggtctcttatggatcggagttgttccaggtaccaaatctattctgaactctatatcccttttaggcggcataccaggtaaatcatctgggaacacatcgggatactcccggactataggaatctcttccaaagttatctggttcagtcttgaccttaaagactcagatgacaatgcatgaacagttacaactcgaccatcatagctggtgagagttacttttttgttggcacagtctatcacacctttatgtctggctaaccagtccatccctaggatgacatctaggtctttggattctaacaagataagattggccagaaatggtactccttgaatttctattctgacagaggggctacgttgcaaagagagtgcttgattacttggggtactaaccatcaaaggacgtctaagatcttctacttccatcccatgatttcccgcaaaactcatagataggaatgaatgtgtagcaccagaatcgaaaagtactgttgcaggaactgagttaacaaggaacgtacccaaaatcacatctggagcatcttgagcttctgcagcagcgacatgatttacacgagccttggatgctggtacagcagagttattctggacagggacaaccttcacgcgacggggcttcggacacttgtcagcataatgtcctgggtctccacagttgaaacacaccacgggcttgttgccttgctccctcttggcaggttgttgctgtgctggagctgcaacaggacgtggagcttgattacggatgttgttgccagcattgttgttgaagaactgacgctgcggacgaacaacagacgaagaacctccctgtggcatgggctggggtcctaaagtaagacgcggcttctgattatttccctgttgtgtcttgaattgagcaatccgacgtttcttctgctccatgcgattgtacttgtcctcctgacgaatagccttatccactaatttctggaaatcaggataatctccaaccatgagtgggtaagaaagctcatcattaagtcctcccaaaaacttctcctggcgctcttcatcattgcgcacatcttccggagcataacgagcaagacgattgaactcgtgcagatactccgtaacagagcgagatccctgggtaagcgacctgaactccttcttcttgagagacactactcctgatggtatatgcgtcttccggaaagcagcggtgaattcaagccaagtgataggttcagcagtaatcctattcaggcggaagtgatcccaccattcagaggcagggccatgcaactgatgtgatgcaaatgagaccttctcctgatcagtacactgaagcaaatccaacttcttctctatggcatgcagccaatcactagcttcaacaggattagtggtactagagaaaacaggcggcctcacacgaagaaattctgctaacttgttctgtggaggtgcatgattatttccttggttttgctgattctgaaattgctgcatcatcatgttcataagctgtgtctgttgagcaagaacttgagcaagagtgggattctctccattgttgttgttattggggttgttgggaccattcccattgctgcgagtgttcaccatctggcatggacagggcacaagaagagaaaacgggggaaactacttaggacagagaattactttaacttttattgatcttaactgagtttcattattacaaactaaagactctcacaccactaaactcaccaacttcctaacactcaaaagcaaacaaacgcatgcacttacatcccaccactgatgtaaatcacatgcgagccacacacaagcaaactttaagcaagcaaactaacacaacgatctaagacaacgacttaacaagtcactctagttcttccaagcatcggaggtcaattgaaggctcgttcggctcgtcttcatcatcttgggttgctacccactcaatcttggaattgttgcgcttggattcttcttcttcatcactacttatgatgatgaccggaggatccgcttgagctggggcaacttctttctccaccacacgaacctttggcgccagttgatagcgagggacaaatagagctctcttccttgcggtaagacgaatcctggccttctgcggcggtgcttctcccttcaatgcggctaattccttctctaaacgatccaccttgtcttctaacttgcaaatcttaccacgattccggtcttcacgatcttgagctgctaacacagtctccgcacgactttcatccatagcccacagcatctcaaccaaatgcttcgtggtagcatcattctcaattccttcagtctcaaggtaactgccacggtcacttccctggggttggcgaggatggtagcgatactcagtgtcggccaattgatcactgtagcgatcacggagctctcctatggcgatccttgccacctcctgacatgcatggatgtagtttcttcctccagcttcaaacatcactgaggggatatcttcactattactgttcaaggtgactttgactcggcacttctcttcatgacgatcatgaggaatctgggcataaaaaggggcagtcccaaatcgaatgacaaaggacatcgtacgcaactcctggacaaaaccctcaacaccaaacaggtactcaggcttgtaacgcggcatgtaaagacaagtgaaaggagagagttaagacctttatccaattaatagcacaagtttttggattaatttgaataaagttagaaaatcagagtaaaaaggtaagcaaataaagtaaaccaagctttgcgagataagttaaaacagttggaaacgaggtcacaaattttgtaattttgaataactggtttctaaagaaatgaaagaaaattataaaatcaacatgctaaatttattttattgcagcaagattaaataaaacagtattataaaacttttgctggtaaatgagccattagtacagtaatagatgtatagtactaataacactggaataaatttttaatgagaaccattaaaagagattatgaagtgcatgtgccattagtttggtttaattaaaagagaaagggaggagaacagttctacttttccaatatttttagagggcttctatggataaccatttggcataacctagggtcaaagaggctctgataccaacttgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagtccctctcaatcaataaaaatctaagcagcggaaaaaaaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagttcacaggataacaaaggatggcataatagggttgcatttgcaaaagcagcatttagcaaacatttgagaatttgataaaacagttaagtaattaaacaatattaatccaacgctatacaacataccctgttgtataggcccaaccattctgaacaaccaccccggctgcacagttctatctccaaaccaggaatgtaccattccaaaccaggagctaatcaaattattaccagtttaagcatcttttacaatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgctccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattaccaggttttagttggcacattaattaattaactaatcacgattgatcatcgtgaactatcaataggccatcatgaaataatagtgagtcattagttatcccataagtgtgctaatgtttctaagcagggctaagcaattatatctaatatctagttgaaccaatataaataaagctcaactagtcaaattataataacccaaggtatcaaggaattaagtaatcaagaacaaaagggctataacaaacaataggttaattccacccaatgacattcgaaaataaatgcaatagttgaaaagaaacaatagctttaaataggatcaacatgctcaaagggttgtttgggatctgtgtgacttgccttgctggccttggaactcttcaaactcttcttctgcgaaaacggactctccggaaacgacggaatctaagcagaaaagagcaaaatcaccaaaacagcacataaacaagcatgaacagtacatgtggatatttttagtgtgtagatctcaattttagaaaaatttagagacttgaaccaactaaatcggagctaagatgaattagttatgaatttttaaagattaaatcggattaaaacacttatatcggtttaaattgaattatgacgcaataatgaattatttttgaaaaggaaaagagaattattgcgtcagcgggctagggtttcggtggaccgggcgcacgggcggcggttcacgcgaacggacggccgagatctaaccgatccaagatggacggccgagatcgatcgggtccacggcggttcacggcggacgaccccgatggcgtcagcgatgacgtcaccgacggcggcggcggctcggcggagcggacggctcgggcggcgcacgctcgccggcgaacggcggcgcgagaacgcaaacggaaggcaccgggacgaagcgggcggcacggcgaactcaccgacgaccaaaagagcgacggagaagcaacggacggcgccggcgacgaggaggaaacggcggggctcttcggatcgacgacggcgacgatgctccggtggtcttcggcggcggcgaaggggcggacgaggacggcgatgcgacggcgaccacgacggcggccttcccgagcgatggcgacggctggaacgacggcggcgcacggctggagcggcggcggcgacggcaaagctagggcgcacggcgctaggtctcttccggcgacgagaggcgaaggcgagggtggcggcgagaagagaagagcacggggatccttttaaaggggctcggaggcgacggcggaggcccacggcgacggcaacggcgaaggaaacctcggcttggagagaaagaaaaccgatccgaatcgaactcatttccaaagctttccaaagcgatttaaccgatgattccaaaggagaaaaggtagaggagatcccggagattgtttcccctcaaacaattcggccggagaaggaaaggaacggccggatttggaaaggaacggcggcggcgcgaaactagggtttcgggcggcggcggccggaggttgacgacgggtccgacaggtgggccccacctgtcagcgggcggacgcgcgcgcgcggcggcggactgggccggctgggccgaagagagagagaagagaggttttgggccgactttcggcccaaagccaaaagaagacttttaaaacctttttcaatttagattatttcttaaatgcaattccatttattaaaatacttccttagctcaaataaatcccagaaaaatctaggaattatagaattaagcaaagtatttaatgaaattttatctggccactttttatattggcatttattaactaaaattagattttcttttcaagacttttaaaattatttctaaaaattccaattaaacaacaatttatatattttgaattttcagggtgtgacaggctcttcgccctagtccgccgcctctgccttcgccatgtgctcaagtagacgcgccttggcagtagatcggccgtccttttgctagaactgtttgcgctaggcacgaagtgcgggcaaaacgtcctgagaactgacctcccagtcccccttcgcaaaattggggaactcgacgatgtgctcgcacctgaactgctgcagcaggcccatggtgaaggccgccgacacacgcgcacaataatcgccgtacgcagtggcgcaatctgagatcgcaccgccggcctgttgagtccactccaagaagtcgaagacggaagcatctttgccagggagtcctcgtactctcgcccccatgtcagtaagggcaaggcgaagcgtatggcacacggtcttggcggactcggtggctttcgccatctcctgcgcgaaccgttgcgcctctttctcagcgttcgcctacgccttgagggcctcctggcgaagagcctccatctttggctcagtgaggttgtagtactcagtcaaggcggcagaaaaatcttgttcttttttgagctcggccttgagacgctcaatcttggtcttcgcctcgctccccttctccagctcagcttggagccgctcattttttgccttcgtctctttgagggtgttggcgaggctttccatttccaggctcttgcggcccagttcatcgtccttggctcgaagacggctcttgaagccgtcaagatgagcacgcatggttctctccgtcgaacaatgggccgcgagaatctagttcaagaaaaaaggggggccgaaaagggtgatcgttaatataagttgtcgaaaaatgactattaaaaggaaaagaaaaacgaacgacatacccggactgccaagctcttgatggtagaatagccttcgtcgaacccgttcagctcggtgaacaggctcgggctgccaaccagagagacgagattacttaccccctcgacgaaggggacaaggtctgcccgagtatcgaaatcagcaggggcaaagtggggcaccgctagagagtactctgaagcagacgtttcggcggcctttttcttccccttctcgatggcgagcggcgaagccaccagtttgcgcacagggctgccgtagagactggccgcggccttcacaacccgatcagcagaagctgaagtcccgacagcaacgctaccacccgctccgcccgcgtcgaccgcagcaccaggaatggtcgagatacctaggctccgaccagcaggcgaagtaagggtctcgtccaaagactcgtcgtcgctgaaaacgcgagcgacatcgacgagccctttcttcttggaggttttcttgaccaaacaccccttcgccaccttggccgctgcgatcgaaaccagcgccttcgcccccttcaaatcctttcggcggtggggggagctgttcgactctaccccggttttgacatggtcggggcttggagttggggtgtagccgcgcatctcggtgcggttgttggtggcctcgtccgcggccttttcggccgtagcctctgtctccccctcatcctccccctcctcttcgccgtcatgatcttcgacagtgtcttcgtcgtgggcatcggagtcggtggaggtaggggcccttcgcttccgaggagccaacttcacttgcctgtgtgtccgtttcctggatgtcccctcatcgccatcggccttgaagggcttcgctcggggaggaagatcaccgtcatacacccgattcgctcggccggccgcctgccgcataagcagctggccgaactcagcgatcaacacatcaccgatcatcttccgggcttcgatgtcggcctaagcaagggttaacactgcaaaaacgaaacgtgttatcatatcagatgccgaacagggaaaaaggcaaagcacaggaatgtatggggcataccgttcgccccctccggcatgaccagcttcggcaagccatcgacctcctcgtcttggttcacctcgacttgccatgattgggagagggggaagattcgaagcatacaaaattcttccaccaggtcacggcagctaaggcgggagcagaccttgcgaagcagggcgaatcgggcctccatagcgccatcgacggtgaccttgggcttcctgttcggcgcgatcgccctgcgccgccatcggagggctttcgcctcctcaaacccggcctcaaaggggatgctgtggtagaaccacttcaacatccaatggtgatcccatttaggcatagcggcattgaccttccaaagatcggagcgctcggggcgaacattgaagttcacgctcccgaacgccgtcttctttgttcctgccggagtgaccaccgtctttgaattcacggtggcataaaaaatggtgtcgaagagctcggtgctcggctcgaacccagcggtccggcacgcccagtcgaagatggcgatctggatgtttgccattgggctcaattgggggagctccacctgaaaaaggcgaaggatctccggcaacaacacgttgcccagaaattgaaggcccgcctcgaacaacacggcgaagaccaccttccttttgtcgccaggcttcggcaccactaccttccccggggcgaaggcctgattctctgccaatgcgccggaggtgaccagctttgccaactcgtcgtcgtccacaagcgaagcccctagaaaggcggtggtgtcatcatcgattctgccgggatcagggcctgtcgcggaggctgggttcggcttgcgaggagccatggcaaaaagtgtgtgcggtggcgaaaagaggaacaggcgaaaggtctagtattcaagagcgccgcgaagcaagagggcggagaaagagagagctcgcggtgaaaatgacgggggcggtagtgaaaaagggggtatatataacccacccagacgccggttcgccttcccacccaattatgagccgccacgtgtcacgagggtatgcgaaacggtaaattctcattgatcgggccacacaatgataagcccacgaagggaagcccatcactgttcatttcggcccagagaaaaataaagacggcttcgccgtttgcaaaaggcgaaagctagaaacacatgtacacatagtgcacacattctccgcaggactccagtataggtttcggcaggagcgtcggtcgaaaagggggcgcgtcataccataccacatggtttgcacggtctcggccgaagctcttatctcacccttgcccgtgaggggcttgttggcggtatgtcatgagacccttcgaccagtcctgccaaaaccatgcaaccagcaaggattcaagctcagggcatcaagttcatctgggcgaagcccccatggcgaagactgtgaagcaaaagcggcgaagggcgaaggatcgcgctggtatcccacaaggccaaaggcatcttgggcgaaaactaaatggcgaagggtgcatgccgaaggagggtgacttctccataacgagtccagcttcaaggaggccctaggggccatcccagccgctcaagcccattggcccttgggccaatgttcgccaattggcccattataggcccatgtatcacaattacgctgtgtacccatgtaaatatccctttcgtaagggtaaccatgtaaatttccctgtaaaacctaaaccctaatgggggaacctgtgataagatcataaatagacccctagggccatgtaaaaggggggatcccaagaaaaattccaaaattaatacacttcactgtacccaacaactgttgggtaaccacgtccttcgacgtacgtagttgtcgcttcgacaacagctccccctcaagccttttcctgagcgcttcaagcatcttaccattcgaacgttcggccgccccatttcactgtgggtgcgtgaccgaagcgaacttgatttctaggtttagccattcgcacatttctccgaatttgtcagaatcgaattgcttgccgttgtcagtgacgaattcttttggcactccgaaacggcaaacaatgttcttccacacaaacttctgtactgctgccgaagtgatcgcgctgagtggttcggcctcgatccaacgggagaagtattcagtggctacaactgcaaacttgtacccatttcgtgccacggggaaagggccaatgatatctagcctccatctggcgaaaggccagactggtgcgataggttgttgttcgtactggggtgctgtttggcttcagccatgctgctgacagctttcgcacttcttgacttgctcaacacaaactttcagcacggtgggccaatacacaccctgacgaaacactttggaagcgaccgttcttgctgcctgatgcgcaccgcacagcccctggtgtatttcttttgccatatcctcaccttcggcgaaggagatgtagcgaagaaagggttggagcacaccggagcgatacagctacccagagacaagcttgtatcgtgcggctttgagctgtaggcgcttcgcttctgcttcgtcctctgggagccaaccgttcttgaggtacttcacgaacggtgttcgccagtcctctgggtcttcgcccagttctgcctggtcgactgccatgatgtccaggctctctgtgggcacacttggtgcgtacaagacttcgaagaggatgcctggtgaatgtgggcctccactggcagcggattttgccagggcgtcggcttcttcattctggcctctaggtaggtgttcgaccgttatgccggcgaaacacttttccatagatcgaatagcctccagatacctcttcattccttcttcttttgcctcaaaagatttgtcaagaaggcttgccacccgtttggagtctgttcggatgagcaagcgccgaacccccaatgctttcgcctttcttaggcccaacagtacagctttgtactctgccgtgttgttggttgtgtcgaactgcagtcttgcagcataccgaatcagcatgccccctggtgaagtgagcaccgccacggcgcccgcccccttgtgtgaccacgagctgtcggagtacattacccaaggttgttcgacgggctcggtttcggaggcgaacgccggtgtccatttggccacgaagtcagctaggacttgggacttgatggcagtgcgggcgacaaaatgcaggtcgaagggagataattccgccacccacttgctaagccagccagtaatttccttgccccggagcacttcgcccaaaggatactgtgatggcacagtgactttgtgggcctgaaagtagtgtttaagcttgcgcgaagccatcactagggcgtaagtaaacttttccatttcaatgtatcttaacttcgccccttgcaaagcttcggagatgaaatacacgggtttctggcctgactctgtctcttggacgagggctgcactgactgccaccggcgaagctgctagatagagcagcagttcgcttcccagtgctgggctgaccaaagtgggtgggctttgcggatattgctttacctcgtcgaacgctgcttggcattcgggtgtccagctaaactttcccgcgccccggagggtcttgaagaagggcaaacctctttcggctgcctttgagaggaatcgactgagcgccgcaatttggcctgcgagcttttgtacttcgcgtacgctcgatgggggcttcatttgctgaatggcatcgattttctcggggttcgcctcgatacccctttcagaaacaagaaaacccaacaacttacccgcgcgaacaccaaaaacacacttctcagggtttagtttcatacctgccacgcgtaagttgtcgaaggtttcctgtaagtcggacacatggtcgaaagccttgcggctttttacgacgatatcgtcgacataggcctccacatttcgccccagctgcttgtagaggaccttgtacaccagcctggcgaaggttgctccggcattccttaggccgaaaggcatcctgaggtggcaaaaagtaccgaacggcgtgatgaaggctgtcttcgggatgtgagctggattcatgtggatctggtgatagccggagtacgcatccaaaaagctcataagttcacagccagctgtcgaatccacgagctggtcgatccgcggtagggggaagtcgtctttcggacacgccttattgaggtccgtgaaatcgacacacatgcgccatttgccgttcgacttccgcaccagtaccggattcgccaaccactcgggatggtcgatctcttggatcaccccggttttgagcaacttctgcacttcggcttttgcggcctcttggcgatcaacggacatcttgcgcagcttctgtttccttggcttggcatccggtttgaccgccagataatgcatgatgaggtctgctgaaacacctcccacttcgtcggggccccaggcaaagatgtcaatgtttttcttgagcacctccaggatgttctcagcttccctttcgcccatgtcgcctccaagcgaaacaaatcttgtgggatcggcatcgtcgacctgcaccctgatcaccttgccgtggggggcgggcttcggcatgtgctttgctcggtcatgcggttcggcctcaacattgtgcactgctatgttgattgcggccaaatcgccctttgatgtagtcgaaggttggagccccttgaccatgatcacgcttgccggaccaggcatcttgagcttgagatagttgtggtggaagaagcttcgaacttgttcaaggttgcacggccgaagatggcgttgtagttgtatgggatgttgacaacgtcgaagagtatttgctcttcgtgcctattgtcgcttgtgccgaaagccaccgccagttgtacttggcccaggacttgaactgcttcgccgccgaaacttcgaagcgaggttggtgcttgggtgagagctagggttggcaaccccatcctggcatatgcttcggcgattatgacaacggccgaacttcctccgtcgaccagaattcgccggacttcgaagccagctctctcggccgagattaccagggggtcttcatgtgggaacagcactccttcggcatcgtccggcccgaaagagatctgctggttcaaataccacggagccccttcgcaaaccgaggtgatgttgtgcaccgttcgcaactgcatcttcttctgccgttttgacagttgatctggcggatcggcccttgtaatcacatggattactctgcgctgcacgtcttggtgctattcggccggtggtgcttgttcttgagtagcttcgcgaggttcttcgacagttgttccttgctgtggccttggatcttgtgcgctgccacgctgccgaatgttttggcattgctcggtggtgtgcaaagagcgtccatggaaggcgcagtagaggtcttttctgaccttcctacgaacgggatattgatggctgccagcttgttgggcgtcgaactccttgcggagggcttgaacttcttcgacagccatcacggccttgcctgcgcggtcggttctgaattttctccaagtcatgggagattgacttggccttggcggttgtccttggttcgccggctgagattggcgaatggcgagaggagccggttcggcgacttgtgcttgtacttgggcttgagcagcggcgatgaaggctttatcgtactcggcttggattgcttgccatcgcttgtaatcctcttcgccccttgcgtacccgtcaatgatgcgaagcaggtgctcgagtgtctgtggctcctgttggcgatttttcttgtgagttcgccttcgagcagccccgccgaagcggcgttgatgacgggcgcctcggttatgtcctgaacttgccattgggattacgagaagcgacgtatgtactcccttatcgatccctcggcctctagcgaatgccgagtagatgttgctgcgtcttcgactcctcataggtgcctcgaaagttaaggacaaagacatcacgcaattgctcccatgagtaaatgctattagctggtaaattgaagtaccaagaacgggcgatgccatctagagcgagatggattacctttgccttggtgttctcatcgctatgagcggcttcgattgcggactcgtagatggatagaaactcttttgggtccgtttcgcccgagtaccacggaacagatgggaacttgaactggggtgggattggacgaattttgattcccccactcagcggtagccccttttcgccccccgccttgctcacggtaccttgctgcgaaggcccgtttggctgtggatatgtcgtggcgaagagcgaagtcatggcttgcgtgtgaggttggaccacagtatccggttgcctggctccgaatggtggcgcttggtgtgccgccatggatgggtcgaacggaggctgggtccatgccatagcgacctggttcagcgcttgatttgttccgcagcctggcgtcgttgcctgtggtcgagtggttggtgcttaaatggcgttgctgaggtcgaactgcggtccttgactctatggcgaagctgccggaccaggctggttcgacagtagccaactgggcgcaccctgacttgtgtgcccctccgg

SEQ ID NO: 58007 - DNA, 2000 bp, Oryza sativa
aggtaagattagggttcgtttgatccgtgcggatcttgtgcttttctttctttggatttctttccccgaaacgatctaaacactagggttgctctgataccattgttaaactttgcgctagaatcacccaggttagatctagtcgggtggttctatttggatttgatgtatgacattgtagatgaaagggagagggtttagataccgaccggttgaggagttcgtggaggaagaggcgtgtcacgccccgaactagtcccgaccggaactagcccgtgacgctccaaattaacctgttaatcgataccagtcccaggaaacagtgctggtatcacagggagacagagtatcacagcaacagaggtctctttattatagagtagaagtacagtcatgttgggctgcggacagatcccgagctcacaactgcattacaaaaggaaagcggaagcgaggacttggaccaatcatcacaggcgcgacttgggaactagggcgaaaccctaaaactcatcgtagccgacttgctcctggaagaactcctcgtcagcaggatccacttcatcttcttcagcaactgggggggttatttatatagagcaagggtgagtacgggagtactcagcaagccaggggaaataagtgtttaatgcaggcttcaaggaaaggctgttgttttcgtaattgattttgtttgaactcttttctaaaaagtctaagtgagtgcttctcaaacgacacggatgagacagtgcgtctcgtccggtcggagtatgtgcaatgcatcaatctttagaattgaaacaagattggcacccggccaacagcttttcaaacggccacccgggccaacaacttttcaaacggccacccgggcctagctgatcccgtcagctgctgatttttcaaacatcgaatccccttttcacaacagcaatttcacaagcagtagtcaaacaaaactacgctaggaatcacctcacatccgcccatgaccgtgggcacggctgttcgagcagtttgttaacctctgcagagggggtacactttacccacacgacattactaacccggatcacccagcccgtggggatcagccacgtcgggagacctccaagctttcatgacaaggcatttcgaaagccgatacaggtttaccatatgccgacgagaggggtcccagaccaacaacaggttaggtcccagaccatactgtgccaggaagcccagggatcctccccgacaccaccccggcgaatccacatgtctctcggcatcaaggctcccctgataagctagttactcagccaggggtgtcccattccacccatgtggtcgtacttgtcttatgtttggatgaaattccaagggaatcggtccttaagtgcgagagcgggaaaccgtacacctggtacgttccccggtccgcggttttggaaattcatttagttcgcaagcaccgacccaggtgtcgggttttccaagtcttttgtaaaactccagttttacccaagttgttactcagattttaagtttgaaggcgaccgtcgatactcgcacagagcgcacgaatatcgaggcgcaactggtccttgctcgtgccggctcctccgacacgcgcaacgacgatcggcgacggcgaaacagagggcggcaatggcgcggaggcgaaaatgagggagtttggagggggagggcttgggcttaaatggacggcaatgtcggtttgggagaggggaaccgacattggacggttaaggcgcgagctggcgctcggcgcttgcagccaaagcggcggcaggaggatgacgccggcgggggaaaaaggggaaaaaaaggagggggagaaaggggcttgcccttttgccgattcgggaaaaaggaggaggggagcgggggcgacgcggcagagggaggaggggcgctgcctccgtcccttggcggcttgcgcgcggaggggcgggggccgggcgatgacgacggcgatgacggcggggcgg

SEQ ID NO: 58008 - DNA, 1490 bp, Oryza sativa
tgttcctccccatcacgatctccctgttcgtcggcgacccctctcctccctccaccccggacggttgagacaatgtcactgttgccggtcgctagcgggccccgtagatcaagagggagaagccatcgccgtgctgcatcttgcccaatccatgacggaggagccgctagcccacgacatcgtcgacgaggccacggacaccgacaaggacgatctcgccttggccagccgccagcaaaagctcgaacaggaagacgaacacctcacgcgcgagagagaggatgagtgagagagacagagagaggagagagatgagagactatgacaggtgggtcccacatttttttaataaataaaatgctgactggactgccacgtgtacgccacgtagaccaaaaccaccgcggattgggtcgagggggttaatttgtccggttagcatagttggggggtgaagaatgtccggttttgtggttcaaggggggtaattcggacgacctcgatagttcggggggggtaattcgtactttttccttattttgggacggagggagtatatattagcatcgttagatttgcggtgtttagaaataatttttgagtcggaccacccatattctaaaaccaagattcgtcactggaggtaggtgggaaaattgaatagtagagggttgtgatttgttaagaagagaatgttggtgtataagttattatattttaggacaaattttagatgctagatattattatattttggaacggaaagagtactaaagatggtgattgttctaccaccaccaccctagtcactgacattgggccccacaatgtcagtggaacattataggcttggagtatcacctagatgtatcgggctactagtacaacagaatggtaacgatgaaaatgaatcgattaacaactcaatattggtagaaatataacaatgttgcgtcaattgctcttttaactctgctttgaaggctaactacgattatgatctcactcttttaagtttactcatgtgacaccacttttcaaaatcagggttggtgttgacccagttttcgttacacccatacgatatcataaagaaaaaaaataaaaaaaatgtattgacaagccaaacttacgaaaatgtctgggagtacacaacgcctatccccaaatttctgctcatccacccctgagcctattcatctcgcaaggcaggcatagaggaaggtgcaccggacggtggcctgggtggaggatgcggcagcgctcggagggagcaggggcggctgctgaacacggaagtagcggcggcggcggtgcacagagggagtggcggcgacggcacaaagaggcaaacaacagcacgggaagggtcaaaaacttcggcgctggcgctaagaaattgagccatcgagcgacacgcagtgggtgtgctcccgcatcgagctcggcatccacctccgtcgccatttatccagatctaggcgtccctc

SEQ ID NO: 58009 - DNA, 17701 bp, Oryza sativa
attttagtggtgataatgttaatattcataccactttggattctatggtaccctctcctaatagcaacaaagttggaaagacgggtaaaaagaagaagaagaacaataaaaatcagttttaaatgaaaggaatcttttcgaattgtgatgggtttaaggacccaaaaaaacataagtttatttccgacttaaccaaagaacatctattggactttattgttttgtctgagactgttaagaaagagttttctccggctgctcttaacaatctttgtgctggtaaagatttgttttggcattgtaaaccccctaatgtaggtctggtggacttcttttgggtattaatttacttaatgccgacattggtttgattgatgagggcgatttttatattaagtttcatttatgtaataaggtttataatttcaagtgggctttagttttggtgtatgggcctgcgcataatgagtacaaggatcaatttattgctgaattagttaatttgtgcagtcattagtctttactagtgcttattggcggtgattttaatattcttagtagcccaatgacaactatgatgatagatggccctttctgtttaatgctattattgatgggttgtgcctcagggagttacaaatgtctggtaggaattttacttgggctaataatttagcaaatccaacttatgaaaaaattgatagggtcttaatgtcgacggagtgggaacacaagtttcatctatcttctgtggttgctcttaatagagatatttcggatcatactcctttgcttctaaatacaaaatcttcttctaataatgtccaacatagttttaagtttgaacttggttggcttttacgtgatggttttgttgatatggtgaaggaagtttgttctagtgttgatgaaggaaattctcctatggaacgttggcaggcgaaaattcgtcgatttagacaacatctcaagggttgggctaaacatacaagtggtttgcacaaaaaaaaagaaaggagattttagataggttggacttgcttgataaaaaggcggaaacatttcttttgactcaggaggaaattgatattagatggttttataggaataggttatcttcgattttaagggaagaggaaataaagtggtatcagagggctaaaacaaaagatattttggaaggtgattctaatacaaagtattttcatttagttgcaaatggtaaacatagaaaaatgagaacttttcaattgcatgatggtgaccaagtaataaatggtgatgcgaatttaaaggcgcatattaccactaattataaagtctttttggtcctcctaatgattttgatctaaagtttgatgaggataatattgctgatattccccaagtttctcttttggagaatgaagctttaactcaggagttactgaacaggagattaaggaggccattttccaaatggaacacaacaaagcatcggatcctgatggatttctgtcgacgtttgatgtcgcgattccggtatttgcatagtatggggatcgttggtacaaggatatatgcgagattgaggtaaaagagacagagacgaggatttttatacaggttcgggcccctgaattgtcaggtaataaccctatatcctgttggccgaagccggttgttgctcttattcaccataaacacaccagtacaatatttggggtcgcctatctaaccgttgtcgacatggcggtctgaagctctgactcgtagtcgacaacagggtagtcttcctccttgagttcgtgcccggcgagatcagagacaacgcaatgtctctcctatcagtatccggagacaccgtaggggactagccgtgcctatctctaaactcgatatccgacgtcttgtcttggcgtatgttggcttgtatgttgatcttgtgtattgatctattgttccgtgtatgttgattgtctcccctctcctcctaggggatcttgtatttatacccataggttcccccttgtccaagtagaactagggaaaccaatatggatacaatcctagtagtccttgtcgtttccatgtagaactctggttgtctttccttatccggaactccctccatatccgaagtcagttcccgtataagacatggtatgtggtgggtcctgcggagattcagtcaactactattaggtatgtggtatccataaccctaacagtagcccctgacttcaatgcaaatgaacaaattcatattctcaaccgcaaaccttggagtaactgttatcgagctcacgtgaccgttctcggtgagttcagagataacgttagacttcctttatcagcctcgtgcgggcacctaaagggtttgtctgagtccatctccgacgtcaaccaagaaagtacataacatacgactaagtctcccgtcttgctgtaatcgagaatttggattgaagtcaagaaattttatctcggcaggtacaccatctcttcattccatattccttgtcgagatccactaaccgttctcgagtgatcgagaaggcgcagagtctgcgacggagccttgtcaacatttgtcgtactcgccttagtcgatcttggtgtagaaccatagagacatgaagtctttaacaatgtcgaatagaattttcctgaaatcaatactcagaaaagaatattagatagaaatagccccagagcgaacgctcaaagggtgacatgttataatatgtatggaaatttaaaaatgaattaaatttacagaccaatgttttgtgtacgagcgtcttctcttttaccgacttcgatcagtcagtttgttgagtcgtacactctctctagcccccagcattgttgtcagagaatcgttctcggaggataaggctcttggacccttgacctgccttggttgaaaaagcactgaccctagcccccagccgtgaagttggaaaatccaatttccagttacacggcttggttaatacgcatggcgagaactcttacacgaccagatcttacatggtcttttgtctcttcaggatccgacaaggccttatcggctctgggcgtccccagccgaagttcccttaggttcctcggaggccttgtcaagacggcgtaaaaggacatgaggataggtttcaacgctaggtgtcatcgtggtaagggatctctgggtaaaacacttagcgatattgtgtacctcatatcaactttgttggagtagaggtagtgggaggatcactacaccgctggtcgaaaaccagttgtagcaccaactggaccacttgaagtaaaggtagcgggagaatcgctacaccactggtcgaggactagatagtagtcgtaactcgaccacttaaagtggaaaaagtgggagaatcgctacacctctggtcgaggaccaggtagtagtcttaactcgaccacttaaagtggaaatagtaggagaatcactacactcctggttgagaaccaagtagtagtcataactcgaccacttaaagtggaaatagtgggataatcgctacaccgctggtcgaggaccaggtagtagtcgtaactcgaccacttgaagtagagatagtgggagaatcgctacaccgctggtcgagaaccaggtagtagtcgtaactcgaccactctcgaccacttaatgtggagatagtgggagaatagctacactgctggtcgagaaccaggtagtagtcgtaactcgaccactagaagtaaggcgagagagatcactatgttctaatggtttgagaaccaggagtaggagtctcttaatcacctatagggacgctaaagttggtttattacatgtgcatctcatgtggccagcatgagcatacccaaattatagcatatctgaatgtccgttcgcaatcatgtcgggtgatcaagccgacgacgttcgtgaggaattatccattcacaaccttttctcgagtagtccagccatggccggtgctatgagataggtcgtcggtcttcgttggtaggttgggcgcgacgactctgcatttgtcgagatcgttctcgataatggggtgtactcgaccacaacctactcgagtgctcaattgttcctgaaaaatattttctagaaagcaagatatatagcagagaatatcgagtatgtactcaaaaaactgcatggatcttctagtattatcaggatataacgagcagattaaatatcagggattatataaaccgtaaacaagaatgatttatacggaagaaaatagagcgagcccccagcattaaaccgtagtcgatttaacatcggggacacttgcacaatagatattgcataaaaaacatgatctaggtaaacataataaattattgatctgacaatattgtataatcagaaaaataggtacgataaattatatataaaccattgcgtacctgtgtagatatatgccggatatatctacggaattagtagatcaatttaaaaaaccaatcttccaattaccttgctgcgtactcgttcgatatcatgtgatctgacatcttttggtacgccacggagcttgaggcttgaatgatctcgatagaccaagttgttgacaacgatggttccgatcttgtcggggcacatactctggtcaagttagatcctccatagccgaagttatcgagtagtatgttgtcggagaatccatctcttaaacccatctcgtcgaaaccttgaagcaccaaaagatcccctacctggcgcaccattgtcgacgtttgatgtcgcgattccggtatttgcatagtatggggatcgttggtactaggatatatgcgagattgaggtaaaagagacagagacgaggatttttatacaggttcgggcccctgaattgtcaggtaataaccctacatcctgttggccgaagccggttgttgctcttattcaccataatcacaccagtacaatatttggggtagcctatctaactgttgtcgacatggcggtctgaagctctgactcgtagtcgacaacagggtagtcttcctcctcgagttcgtgcccagcgagatcagagacagcgcaatgtctctcctatcagtatacggagacaccgtaggggactaaccgtgcctatctctgaagtcgatatctggcgtcttgtcttggcgtatgttggctcgtatgttgatcttgtgtattgatctattgttccgtgtatgtttattgtctcccctctcctcctagggggccttgtatttatacccataggtgcccccttgtccaagtagaactagggaaaccaatatggatacaattctagtagtccttttcgtttccatgtagaactctggttgtctttccttatccggaactccctccatatccgaagtcagttatcgtataagacatggtatgtggtgggtcctgccgagatttagtcaactactattaggtatgtggtatctataaccctgataatttgctgctgagttttatcaagtattttggaatgttattaaatttgacttgttagaggtttttaaagattttcatagtgggtgtttacctttattttccttgaacttcggaaccattattctttttcccaagtgcatagaggctatgaaaattcaacaatataggcctatatgtttacttaatgttagttttaagatttttaccaaggttgctactaatagaattatgggtgtgtaacgtcccgccttcccccaggccgggcccgcttacatctgatagctttcataggtcatagactgccctcacagaccaacacatgtcttttttgcacactttatcctcactcgtccgcacccgggaagaatttcccggtcggtcacccatcccaaatagctccaggccaagcatgcttaaccctggagttctttagaaatcggcttccgaaaaagaagttgcaacaggcttaaaaataaattttcacaaaagtgaattattttgttttggtcaggcaaaggagtgttatgatcaatattctaatatctttggttgtaagttaggctcttttccggttaagtatctaggaattccaatgcattttaggaagctttctaataaagattggaaagttattgaagaaagaattgacaaaaaacttagttgttggaaaggtaagcacctatctgttgggggtagattggttttgattaattctgttctctcgagtttagctatgtttatgatatctttctttgagatgccaaaaggggttcttcaaaaaattgattattatagatcacggttcttttggtagggggacgatcataagaaaaaatatagatttactagataggatattatttgccaaccccaggaccagggggccttgggatatataatttggaaatacaaaataaatgttttttttgagtaaatggttgtataagctaataaatgaggaaggggtttggcaagacttattgaagaggaagtatctttataataagtctataacccaagttgaaaagaaacaaggtgattctcatttttgtcagggctcatgaaagtcaagagtattttttaagatatgggttcttggattgttaataatgaggaacaaattagattttgggaagataaatggctaggcaacttggccttgaaggataaatatccatctttatatgctattgtctgaaggagatcttcttctattgccactgtcatgggttctgttccacttaatgttgctttcagaagagttttagttggtcagaatcttgtatattggcatgagttgtgcgcttctattgtgcatatccagttgaatctttcttctgattgttttagatggaactatcatcagaacggtaggttctcggtaagatcaatgtagctagctttaattaataatggctatgttgagagaaataagtgtatttggaagctcaagatgccacttaagattaagatctttatgtggcacttgcttaaaggggttctgttaactaaggacaatttggcgagacggaattggaacggcagcttgaggtgttgcttttgtatgaataatgagtctattcaacatctctttatgaattatcattatgcaaaattcatatggagaacagttcagttttcttttggttttaaccttccaagtagtatatctcatatttttgataggtggcttttggggttgacatgaaaaagagtaaactaatacttgtcggagcttcggccatttgttggactctatggttgagtagaaatgatatggtttttgacaaatcgctatctatttcctatatgcaggtaattttcagggcaactcattggctccggttttgggcacaattacaaaggcgtgatgaagatggagagtttctgaaagttgcatgtcgcaagttggagacaatggttatgcaactttatgccaactatggatggagattcacaaataggctggaataaatatgttctccttattttggctttttctatttaagtgtgttatattttatttgaactacactcttatctcgagtgctactttgtaataattggctgtagctcttcttgagcaaaggccgggatattatatttgattatctaaaaaaagtagctgatgataagtatgcagtattattttgtttttcaaaaaaaaaaaaagccatgcagatgtgtcatgtgcccttgcattgatagctgattgatttgccagaccagattcaaatcaaaggatgttcgcttaccacccttgccgtgtggtgcctagtgggcgcgaagagtgccttacgacgacgtacgaacctggttaggaagacggtacggtacaaaacagagcatatgcacaaattccacaatctccgtagctgccgatttcggcccggcccacaacgtagccactaggcccatttaaaaccatctgcctgcttcagcgcgccggcccggccgccacattgatcgatcgactgccgccggcacggtggctggccgtgccgcacgtacgtctcggttggcgctcgccggcggcgatacgcggcatgcgtggccgctcctgtcgcgccgcgtcgacgttgggagatttgcaataatgacactgcaaacattaacctttactataatgacattggacgacgttggggaaaggcggcaatatccactggaaacaaaggagtagcaaaattgcaaaaacgctaattaacatcgcgatgtaattaacaaatttggtgagattctcaaatgttggccttaaggcaaacggcctagggctccataagcactgatcaagcttaccaaagtcacataacaaatgctagctttaggtttagggcacactatactatagaaaagatttatttttgcggtcaaaaccaattttcacagttgagtgggtggttcgtctacactcaggtgtcttcgaaaatcggatttttgcatacggatagagcaaccaaattttctcttctggacactgaagacatccgactgcaaaaaggaaaatcgcaaaaaaaaaattgcaaagatcgaaactctaaccctagaatatagaagccgtcgctgtcgctcaaaattggtggtggatcctcgcgcgaggggtggagaggcggcaggatccgtgcaggacgggatggggtgccgaatcctctcctcccgtcgtcgccactcatggatccgtgcgggaggagaatggggtactagatccgcccctcccatcactgctcccggaggatcagcccacttgtttgatcgctccttccctggcgagcgctagcagctcaattgttcagccgccgccaccccccgatctccgaacgactgagttgctggcgcctgtcagggaaggagcggtcggacaagtgggcaattcatcgtaggaggtggagagatagaagggggagagaggtgaggaaaaagaaaaaagaagattaggatgactgacatgtggggttgtatttatttaaggagcggccggactagcgggcagttcatcgcaggaggttggagagatataacagggagagaggtgaggaaaaaggaaaaagaagattaggatgactgacatgtggggttgtatttatttattttatcaatcatgagcgccacgtacgatgaaacagttatccatacagttgagagactcgatttgctttggtttttgaagatggaagagatgttatacctggtattgctagtgagagatgcgatttattcaggggcaagagttaagggaggtaaaatagactatttatccaacggtggagcagcccacggcccaccgttatatgatttgtatctcgtcccagttgtggacttgtggtcactggtcagtggtggagcacgcagctggtggaggcgtggagcagctataccgacgcatcggtaggatggaccgatggagagtagaaaatcgtgatgaatcagagggtgagaaattcaaaattactaggtgaaaataatgtacgataacaataactaatgtataaaatagctagacaacataagaatatgttaaagtggtttacgataatttaaatttaaatagtatatagaataacgattcaaatgtaaaagtaaggtgatatgactttattagagaagaaaagtagggagacagtttgaaccataaattaattatctatgagctaaaaacaattgaggtgatatggcttaatgaaagaagaaaaggtatagataatttggaccatagattaattatttaagcattaaaaatagttgatatgatatggcttaatgagagaagagagaaatatcattaactaattgaggatgaactatataggtatataggatattattaaaataatgaagatatatattgaaatattttatgaattatgtgagatgatgatttaacatgcttgcattataaagctctaaaatttaaaaaattataaaattatatataatatagcatgtttgcatgatatttaaatgtaatgattgtcaatggatattgatgtggcatgttgttagtggatgatgatatgacatctttacatgttaagctttaagagttagtgggttataactttatagtaagagaggattgggtagtatattttttctctttaacaaagcaggagtattggttcgattaaatatatactatcaagagatttttctctactactattgtacaagatatactagcttatattcttaatattttttagtgatgtggactgcaaaagagtttgctatgcctcttccagagaatttggaaggtgttaagctgatttaatttaataattagagtaggcatttccttcaaaaaaaaaaaaggaggcatgcgttgaaagtttcatgtttagagaaatgaataacgcaaccgaacattcaattcatttttttttcatagagaatgtatcctattaccaacgaatgactgaaaattaattgcataagctctctgtacatgattgcaaataattatattcatttcaatcctgctggcgggtatgttattagtatcaccccagctgccgtacgttcaagagtcacaatctgaacatatataacatggcaattcagtagaattaattccttgctcgagtgactcgaggtacttaaataggcaaaatgtctgcattccttttccttaaaaaaggagtcaatagaagagctatggtctgtttctttcggcttgagattattataatctagattattgagttagattactataaactagattgttataatctgtagtagaataagcggttagttgtttctttcatagattattacagtctagattatttggtttgcaagtctaaagagagagtggggtggcatggtgggtaatttttcatccaataatctggaaaaagctcatctaaatgagcttatcagattataataagctgggctctagattataataaactattttaataagttgtctgtttctttcagcttactcccaataatctagattataataatcataagctgaaagaaacagcacctaagcacatcatgtagccaggggacgttcggtagtgctttccagttctgcagtagccacagcatcaaagaggccagttactgtaatgccgcggctgcagctaggagcctaggagcgagcttggcttgcataggctcaaactcggtacaagcttgagccaagcctttaaaactttcgagttttcagatagactcagttcgatcttgactatcgagcttgatttgtaagtagaaaaatatatattttaagaataatcttttaaaaaaaataatttctaatttatcatattaatttaagaggaaaaaataaaataaatatatgatgctaatacaaagtaatttgttgtatgggatgcatacaaataataaatttgattccttaatttattaaataacaacagaaatcatatattgttaggcattagaagctcaaacttggctagacaaagctcatgagctttgcaagaggcttgggctcggctaatctgaagctcaagctaagctcgaattgagtttaggacaagtcaagctagagtagcccatgagtctcatgttttttttttctttgacagccctagctgcaacacagccgcagcaagctctaacaaatcaagaagcaaggttgcagtgttcgtatgtgtgctagtcatcagagcataataaatacaccctccattttaggcactaccatcactaatgcaaatactaagaaaaaaattatcaccacctcgattgaatattctcgatgcaggtaaataatgtgattgcagggtttgatagtagagcatttaaaataaaaacgaatttacagaagaagaggtcatatttcatgtatgtatgcatgcactaaatatattatgagatatggagaaaaaatggttgcgccgtatattttatgatagagtgagtgtagttagggtgtgttcagaactgcaggtttctaatctctctttttccgcacataaattttacaaactattaagttgtgtgtttatccaaaaaccttttataggaaagttattttaaaaaatcattttaatctaattttatgttttttaaattaatatttaattaatcatgcgctaatgagttaggctattttacttgcgtggaagccaacgacctttttgccagttgtgtctaatcggtaaaataccagtgttgacatccaaatttggtagcagggataaaatataagtttggccacatttgaaatatggccaaatttatattacccgagccttttatatgggggtctgactagcggcatgaggctggtcggaccggtggcataggggcggtccgaccgcagttacttagcaggtccaactggtggcctctgagttcaattaagataattcatatgtttctttgtatgagcccaagaaatttctaaccttaataagacgcgaagaaggccttgtggatgcaaaaccaacctctttataaaggctatggctgattcgattctaaacaccctgacaacaaccctaacaacaatcgaattgttcttttaattctacttttcagcaatgttttctactttacctagttcattcatctttgccaatttgcaccgtaaatcgtatgccttcactgcgagagtgcaataccctttgtaggtttgttctgtaaaccttccgattcactcacaaaacgggtttttacccccatatcgatctaaatcgacctagaggctggtctaatctcaaaatcggctccactagctgatcgaatattttctaaacccattttgatcgagagatttctagatcgaggtggttggtgactctattaacaccacaaattttcagctgggtccgtggttgccgaaaagttgccaacatgatgagtacatcctccactattacccgctggcaaagacgcaaaagtcgagcggcgactgtgtgagcctctaaataatcccacatttcttagcttgggaggaggaagccaccttaaaagggagagccaccattcccctattgtactagtcttttagggagattgggtatttcccctattgggtgtgccaaagaactattggggttcaggcaaccttaatttgttgggcctcagccaaccctagctggaccggattgttatcacaacaaccacattattagaaggtataactttttttgtttgtctaagctatatagatccgaatccactagagaggagaccaaatttatcaatactgccgttggatttggaccaatctgaggcatccttctattcctacagatgactacagatgagatcatggcacctcaccctctcctaattgactcccatgatctggtaaatttggagggaaaacacttctgtttttaggtgttgcctccataaccaggattactcccgtcaacacaatcgaaaacatataaatcctcttctttcccaaacaacatatgtgagattcaaacctaagacttctcaacacatgcaaaccaatcttacctatagaccacatgttgatatatatgtcatcagatgttattcttttaactattcttgtccaaatatgaaactcaagatgacatgaaatgagaatgctttcaactacaaagttgcagatctcatcgagctctaccactttagtgtaaggtatgtctcatccaagatcagttgaaaatttcaaaaaatatttttgaaatagaacacatcacttataacacatattcagggatgaaaacaattttaaatgaaaatattttcaactaggttatagatctcaccaaaccctttgactttgatataggccatgtctccatttgagatcatttgaaaaattcgaaattacgtttttcaaaatagatatcaccacttataatgcatatttgggcatgtaaactatctcaaattcaaatgttgtcagcacttgcaaaattacatttttcgaaatagatgtcagcacttataatgcatattcgggcatgtaaactatctcaaattcaaatgttgtcagttttaaagttatagatctcatcgtgatctacaactttgatatagggtatgtttctatctgaggttgtttgaaatttcaaaaaattgaatttttttctcatctgtgacggttcgtaactacgttatccgtgaagggtggtaattaagatctgtcacggatgagtgctctcatatttgacgggtcatctcattacatccgtcacggatgacatgctatccgtgatggggcatggttgtgacacgttataggtcatccatgacgtgatagaattacgacccgacaaagatgaccttatatcagtgacgggtcatccctgatagtcatccgaaatgaggtcgcattagcccgacacagatgtttcgtcaaggatgcccggatctatactagtgtcacatcttatcctttaaatatgccatacaattagatagtgaagaacgtataactaacatattatgggttgatgcatagatgctaatagactatgctttatttggtgagtataggccttcaggagtttccgtaggatttaaatactttcgagaagttgtgattgtttttttgagttgctctgttgtatgatcaaactgcagagtccctcgaaaggttatttgaaaattttctagcattatataatcaaaatcacccaaaaatcattttttactaatcaggacctaaaattgtgaaaggctattgatcaggtttcttatgaacacaacacacagtttgtgcacttgcatataaatcacaatgcaataaaacatccaggctaatgcgattagatgtgttgtgtttgtgctatgctacaattattttgtatgcaattagatgctatgctatgctacctcttttctcatgtaaaatttattttccctcatctcgagtaaaacaattgtgcatagatgtgttgagttgaccttgggtaaagccctaaagctaaatatgtggaggtgagacctttgtgaattcaagcaagtttccagttcattctatgtatttagccataattaataatggacaatttgagaggaaaatatttctatggaaactaaaagtggctcttaaaacttgtgtggtatctgctcaaaggagtaatattaactaaagataatttagtgagaagaaattggaatgacaaaaagagatgttatcttttatgaagaataagatgatttatcatttattctttcagtgtcattttgctaaatttctttggaaatcactacatacttctttttgacaaagatcccatattacttctcatatatctggaaattagcttatggatattgattaaaaaaactaagaaacttattttaaatggagtatttgctatatattaggctggttttgatgaatcctcatctaaatcttatgtgataattgtgcttttgatcttattctgaagtctaactactaacttggcccctcttttccaattttgctcatttgatcctgcttttcaaaaactgacccacttctacctgcattgctaggagtgttattagaaaatgcatttagagaattaacaagaccaaaatgccccccggaaatatatgtcaaacctacatcagtttcatcacatactttagttaaattccatcgcatattttatggggactaagtgaaaaacctgggtcgaataaacaaaaaaaaagattaggatcaaatggcaagggtataaatggtattttccccttatataacaccgttagttatcttcacgaaatagggtcggacctgatctccatttttgaaaaagagggtcaattgagcaagctttaaaaaacagggccaaaataatagtttggcttaaaaaagggtaacaacgcaattgcccccaatgttatatgcaggcaatgtaccggcctcagttctagacataagttgaaagatgtgatgagtacaatgaactattggatgctacgtgccaaaatctagctagagtcaacggttatgcaaatatttgctaacttcgtgtggagatacaaatagacttgaataaacgtttacctcctttagtattggtgctatgagtgttgcatcgtcatttcctgggttttatatgtactctctgttgagtggaattatatggtggttgtagctttgcaaaagctataactcatttccattatcttaaaaaaatatatattcgaccaatttaccctgagatgtagcatcattttttaaaaaatgttactatctgaacttttgtacgtatgaatatgattttgtagtaacacacaatacatcttcaagattaagttgctgagacgacgtacattacaaaacatcaaaattgatgccgcagggacatacacccatacaaaaatacagttcttatatctgaaaagggcttctcaactttcttcagtgaaaagcaagcagggtgtacttgtctatttgggcaccaacccacatcatgcaatatgtgggggcgaaaggcactggtgtcacgcctcaatctaatgtgttgttatatatcaactaagacatgtaagtagcttaaacatcgtatatatatttatgctttattgcttccttctgttctcagctttcttttcctttccattaattccatctctgtcatgcttcgtccggacggtgtgccgtccatttctttttatttatgacagtctttgcattatttatgcattacccagatttttaggtgattttctggtggttatttttttgcttgtactgaaccggtttggagtgtttcaaatcataccagcattaagtggaacttagattggtcaagcaatagcagggagtgaatgtgaatcatcggacttccattgttgtgacctggttatagccgacattaccgtcggcaaattacctgaatgctgatggtaaaaagccaaaggtacacagtacactcttgatcacatatttcgatatcgccgatgcactactacacgattgatttttcctagacgctgcccctttagtttccatgcggttcgtaagtggaaccgcacggaaaaatatgggaccggcgtcgggttgttgcccgcacgggatttcccgtgcggtcctcttaaatgaactgcacggaaaaataagccgatttttccatacgggcctattaagagagccgcacgcaaaaataatcattcctcttttccctcctacccacttcaaaattttccctttttccacgcctcggtcccctccctctcctttattctctcacacattaagtgctctctctctcctattctctcctcatgcgtcacgcgcgcctctcctatcctctcctcactcctctctcctctcctcccgcggcgacagagacgacggcacgcgacgggtgtaggcgagggcggcggcccgtggcgacggcgacgacggcgcgtggcgggcgtaggcgacggcggctgcccgcggcgacggggacgatggcgcgcagcggcagcgcggcggccgtggaggcgcaggatacggtgggcggttgcgacgacgaggtggcgtgcgacggcggcggcgcctccaaccgatggaggcccccccccacgcggatccggtggcgtgacggtggcggcggccgccccccgcatggatccggcggcggtgcggccacccccctgcgtggatcctgcggcatctggccctggtggggtcggccgagtcccaataacttaaggttccccggaccgcaacagttcataggcacacccactcagggaaagggctaatctcacacccactcagggaaaggcccaatctccctaaaagactattcctacaggggaagggtggctctcccttttaaggactcccta

SEQ ID NO: 58010 - DNA, 581 bp, Oryza sativa
  unsure (1)..(581): unsure at all n locations
ttggcttgaaatattgtcataattatttttttacatttatgtaacatttatgttgcccaattatcatatagttctaaaaattcaaaaaaaatattaatctcaaacatattaaattaaatcatatatctacttaaaaatacacaactaatttgtattgttttcaattattttacatatgtagctttaaattagcattatattatcatcaagtgttatttgacacctaaaatatgatgtaaaattatttaaaataggaaaagtacgaattaccccctaactattacggtcgaccgaattaccgcataaacccgaaaactagacatttttcaccctcaattattaataccggatgaattacccccccccccctcccaaaaaaaaaatcaagccgaagtggttttggtcctacgtggtagtccagtctgcattttaaaaataaaatatgtggggcccacttgtcacactctataccctctcaatccctcctgtctcacctctatcttttcctctcttcttaatcccattccccagcctcactcttctcnctccaattgctgctggggccggccgcaagcacgccg

SEQ ID NO: 58011 - DNA, 13210 bp, Oryza sativa
ctctcgttgccggtcgtcgtccgacgtcgtttgtcgttgtggtgagtaccgttgggttcgtctcgtcgtcctctacgtgtacatgccctcctttttcccggccgaccaccctagctccggcgaggtcgccatctgagccggccgccatggatgatgtcagcatgacatcatcatcttctccttttccagttttttctaatagatgaaatcttcggaaaatcataactaaataaccgtagatccgtttcaggtggttcaagttgctaaatttttctaaaatcaagatctacatgttaaaaatatccacatgtactgtttatgcttgtttttgtattgttttgttgatttttattcttttgctttagtttccgacgttctgaaggagagcgtttccgttgaggaaggttcggaagtgtttgcggaagctcaaggcaagtcacacagatcccaaacaaccctttgagcatgttgaacccatttaaagctattattttatttcaactatgcattgttttcgaatgtcatcgggtggtgaacctttccccgttaattaatggccgaagatgatcttattttcctatgggttataatttgattagcatgaaccttatatattggattggttcagctaaatgctatatgtatgtttgcttagctatgcttagaaacattagctaactaaaggggttaattataaactatattatattattcttattaattatggttatatttaatggtagctcacgatggttaatcatgtgatgttaattaattgataattaaaacctggttaaggtgggttgtgagcatatggttttgaaggtcgtgctcatggcaattaaggaccggttcgcgagctactgttgtgaaacatttaccgtgccaaccacaagccagcatgggcaatggctttatcttttgtatagcatggttcattatagtgtgccagactgtgaagtggcgagaagtccacgggggtcgctggggagtccatgccttgtttataagggggtgattatgatccgggaatggtgcactgttttgagttgtgttgtgcaaagggtattgtcacgatttccccctttgcaatgccgtggtggtattttggggcatggcaacatgtgtggaatcgtgtcttgtgggtacagtggtacacctctggccagagtaaaactattcgaatagccgtgcccgcggttatgggcgggttgagcaatgtttttcgtgattagtctcacacctctcacaataattatggatgttataactggtaataatttgcttagctcctggtttggagttagatctgtacagccgagtatggttgttcaggatggttgggcctgagcagcatgggtgtgctgttcagtgttgattaaaatttctgattaattactccactgttttacttctcttaaatgttttgctaaatgctgcttttgcaaatgagcctgtattatgccatcctttggtatccttgtgcacttgcatatttgctgtgtgccttgttgagtatgtcatatgctcattcttgcaataatcatcaaacctcagttgaagaaaaaggatccagaaggagaagacgtttagcttataccccagttgagctgcctgtgggagtggagctgaagccatcgctagaccgttaattccgctgctgttttcttttcttttgtaagtatgtaacgttattattaagatggatttgtatattaaattgtcagtttgtgtacctcggttgattcctggacgaggattttatgcacaaataagttcggaaattactagtgaatttccgggcgtgacaagttggtatcagagccatctcgactgtaggataagccaaatggtcaaaccttaaggacaaatcttccgaaaacataatttgtgaaaatttctcctttcttccttatctagaattctttgcaaattgtttcattgtctactctcctctctcgttcaacttgagtagttctgaaactagttgttgaaactagaagatgttgatgaggtcaacttatggaggccagtaaagtggatcgaggaagaaccgaagtgcaagtggtcaagatggaatgaagtttggatcctatcttagaacctatgccgccaaactgtcctcgaagaatagttagtagggtagaacgtttgttgtttgctttgtgtgtaggtatagttgcattcccatcattggagtagttcattgatgagtgtgtaactatactaggttgcttgcttaatcaacttgaacaatataatggtctacacacatcagatcagtgttaacctggttaaggtcttatctttagtgtaacccctctcctcctatcttctctaatctgcaacagatggtgaacactcgcgccagtggaagtggaaacaataacaatgaagagaacccaacccttgctcaagtgctggctcaacagacccaattgatcaacatgttagtgcaacaaatgcagaaccagcaagggaacaacaatgtcaatcctccgccgccgcagaacaagttagctgattttcttcgtgtgaggccgcctaccttctctagcactaccaacccagtggaagcaggtgattggttgcacgctgttgagaagaagttggaattgctccagtgcacggatcagaagaaagttgttttcgcttcacatcagttgcaaggatctgcttcagaatggtgggatcacatccggatgaacagagcagaaggacaaccaatcacttgggcggagttcactgaggcattcaagaagacacacatacctgcaggtgttgttgctttgaagaaacgtgagtttagggctttgaagcaaaaggatcataccgtggcagagtatcttcatgagttcaatcgtctagctcgctatgctccagaagatgtgcgtactgacgaggaaaggcaggagaagttcttggaaggcttaaaggatgagctgtcagttatgttgatctctcatgactatgaggattttcaggagttggttgacaaagcaattcgactggaagacaagaagaacaggatggacaatcgtaagagaggaaggattgttttccaggaggcacaggatagtagccagaggcagcgtatcaagccactccaaattggtgaatctttttctactggtcaaggacagtcgcaacagttgaacatcggtggtgagatcaaatcagagactaatgaaagcaatgaagttaacatcgagcaagctaatcagccggtgccagttcagcaggatcagtctcaagagaataacagtagtggaagggagcagcaggtatgtttcaactgttacaagccaggtcactttgcaagagagtgtccgaagccgaagcatcagcagccgcaaggtcagatcaacaacattgttgtcacaggagctaatgcagtgccagttgcgtcttcaagagttgcgtcttcaagtgttacagctcagccaccagtttcaaagcagcagtagttttctttaaagccttagaataattatctgagttatggaataataagatagaatgcagtttacctatgcccttttctttctagccgttccgaatctcgggacgagattctttgtaaggggggtagatttgtcacatcctgatttttgtttcaggatttataaattatttaataaattattattagaatttatattaaatgttcattaatttacaaatgaagttaaatgtgggaaataaaatttcctaaatataaagcatggatggatttaatttttattaaattctccatggttaattatactctctggaatattctcggatttttcggagctcaattcctaattttaatcatacaaagagcatttcagtaattacccacatattaaattaatcattaaatggtctgattataatttttttaagtacttttagtgtccaagtattttcaggatttttcttgaaattatttgagcgttggaagtatttttaacaattcaaagatcattttagtgattattttaattgaaaaagttttaaaagccctcccttaagtcgttgggccgaattcggcccaacactccctctctcccgcgcggccgagccggcccaaaaccggcccgagtcggctcaagcctagccgcccgccccctcctctctcaggcgccgacatgtggggcccacatgtcagttgcttctcctacctccggccggccggccatgcctagcccgagccgccgccttgccgcctcaaatccgcacccaatccggccccgtttcttccggatttttgaggggttttgatcctctcgttctcctctatcctttcccctaagaatcggagcaaaccgttgagtattttatccgaatcgaactcgtttttgagtttatctccaaaaccgagtttttgatttcccggatcgatttcttgcgggaggagtccgatctcttcaatccaaggctataaataggaccccctagtcctcctctttcgtttgccccctctcccgtcccctcccgtgacccgtagagccgtcgccgcgtgaaaccatccgccgccgccgccggccgggttgcagccgcgccgagcagccttctccgccgtcgccgccgcttgccgccatcacctttaggtgcgccaagccgtggggaagctcggccgcccgttccccttcgccgccggccaccggagcccctccgccgccggtcaaccgagccgccgccgtcgcccctctcgttgccggtcgtcgtccgacgtcgtttgtcgttgtggtgagtaccgttgggttcgtctcgtcgtcctctacgtgtacatgccctcctttttcccggccgaccaccctagctcctgcgaggtcgccatctgagccggccgccatggatgatgtcagcatgacatcatcatcttctccttttccagttttttctaatagatgaaatcttcggaaaatcataactaaataaccgtagatccgtttcaggtggttcaagttgctaaatttttctaaaatcaagatctacatgttaaaaatatccacatgtactgtttatgcttgtttttgtattgttttgttgatttttattcttttgctttagtttccgacgttctgaaggagagcgtttccgttgaggaaggttcggaagtgtttgcggaagctcaaggcaagtcacacagatcccaaacaaccctttgagcatgttgaacccatttaaagctattattttatttcaactatgcattgttttcgaatgtcatcgggtggtgaacctttccccgttaattaatggccgaagatgatcttattttcctatgggttataatttgattagtatgaaccttatatattggattggttcagctaaatgctatatgtaagtttgcttagctatgcttagaaacattagctaactaaaggggttaattataaactatattatattattcttattaattatggttatatttaatggtagctcacgatggttaatcatgtgatgttaattaattgataattaaaacctggttaaggtgggttgtgagcatatggttttgaaggtcgtgctcatggcaattaaggaccggttcgcgagctactgttgtgaaacatttaccgtgccaaccacaagccagcatgggcaatggctttatcttttgtatagcatggttcattatagtgtgccagactgtgaagtggcgagaagtccacgggggtcactggggagtccatgccttgtttataagggggtgattatgatccgggaatggtgcactgttttgagttgtgttgtgcaaagggtattgtcacgatttccccctttgcaatgccgtggtggtattttggggcatggcaacatgtgtggaatcgtgtcttgtgggtacagtggtacacctctggccagagtaaaactattcgaatagccgtgcccgcggttatgggcgggttgagcaatgtttttcgtgattagtctcacacctctcacaataattatggatgttataactggtaataatttgcttagctcctggtttggagttagatctgtacagccgggtatggttgttcaggatggttgggcctgagcagcatgggtgtgctgttcagtgttgattaaaatttctgattaattactccactgttttacttctcttaaatgttttgctaaatgctgcttttgcaaatgagcctgtattatgccatcctttggtatccttgtgcacttgcatatttgctgtgtgccttgttgagtatgtcatatgctcattcttgcaataatcatcaaacctcagttgaagaaaaaggatccagaaggagaagacgtttggcttataccccagttgagctgcctgtgggagtggagctgaagccatcgctagaccgttaattccgctgctgttttcttttcttttgtaagtatgtaacgttattattaagatggatttgtatattaaattgtcagtttgtgtacctcggttgattcctggacgaggattttatgcacaaataagttcggaaattactagtgaatttccgggcgtgatacttgctgagtacagtgggtagtactcagtcttgctctattttccccaaaccccagagtttgagtatgcgtcagatggtggtttctccgaggagtaggcttcgtccgtgccgtcgaggatgcctgtggagtggtgttctcgctgcagatcaagtcaaggcttagctccagttatctttcgtttttccgctgcatttatgtaagactttgacaatgtttgtaagacgtggatctgtatgtcaactttgtcgtctgtgtaccccggccggtcctggacggggattttaatgcacattctgcttggaattctattcgggaatttctgggcgtgacagctgcccagcgccgtcgttcggccggttggctttgtgccgtgccgtgccccagccgtgccgcccgtggccattggatcagctttgggccgatccgggccgtcagttcccgtggaccggcggtggaccgtctcggtggtcctggtccacggtggaccgacacccttgtcccgctgacgcgttgggcccgcctgtcggcgccgacgccccttgctgatatcagcgaatgccttttcctttgagaaaataattgataattgcatcataattcgataataattgtagaaatcaattaaaatggctcaaaacttctaaaattcatatctaattcattcgaactccgaattgagccattcaacttgcaaaattcatctaaaattgagcactacatgtttgtttactttttatgtactattttcttggtgtttattagagtttttcctcgttttgcgtgccagcgtgtagaatccgtcgtttcagaagtccgcggtcgcgaggaaaagagttcggaagatcaaagtgaagaagcaaggcaagtcacacattcccccttgagcatgttgatcctaatttacaaatgttttaccgtttgcaaataaacatgcatgtcttgctaattacatgggatccgggtattacctaactgcttgcttgtgctatgtttacttgatatctgtcctttgtcaaccttggataataaatcgactaactcatgttacttatgtgacctagcaagaactatatgcttagccatgcttaattaccacgtgttgtggggctatgtcttgtgggtacagttgtacacctctgatcagagtaaaactattcgaatagccgtgtccgcggttatgggcggtcgaccagattcactgtgattagtctcacacttaataaattgacccaatgcactgtagttcaggtgggttggttgggcctgttcaacgtggtgtagcgttgatcagtggagatttaatgttactttaattactcaacagttttactgttttgctcaataaaatgttttacaaccgcctttatgcaaatagccacaaaccgtccttgcgttccccttgcacgtctgcatcgttggtgtggcttgttgagtacggtgggtgaactcagccttgctattattcccccttttcagaagtgtagtgcttctgagctgaagacgaagttagaaaaccaaggctcagacccccagttgagttttacctttggaatggagctgaagccccgctaggatcgcatttttttccgctgctgtcgtttctttttggtgcgagcactaagagcctcttctgtaagtattgtacgctttatttacgtttggaattgtatattacttgtcgttttgtgtaccctggctggtcctgaacagggatttaatacacaaaatagtctagaaatttgggctaaatttctgggcgtgacagtaggtgttcaaccgttatgccggcgaaatactttttcatagatcaaacagcctctagatacctcttcattccttcgtcttttgcctcaaaagatttgtcaacttggcttgccaccagtttggagtctgttcggatgagcaagcgccgaacccccaatgctttcgcctttcttaggcccaacagtacagctttgtattttgccgtgttgttggttgtgtcgaactgcagtcttgcagcataccgaatcggcacgccccctagcgaagtgagcaccaccgcggcgaccgcccccttgtgtgaccacgagccgtcagagtacatacccaaggttattcgatgggctcggtttcgggggcgaacgccggtgtccattcggccacgaaggctgctaggacttgggacttgatggcagtgcgggcgacaaaatgcaggtcgaagggagataattccgccacccacttgttgagccagccagtaatttccttgccccggagcacttcgcccaaagtatactgtgatggcacagtgactttgtgggcctgaaagtagtgtttaagcttgcgcgaagccatcactagggcgtaagtaaacttttccatttcaatgtatcttaacttcgccccttgcaaagcttcggagatgaaatacacgggtttctggcctgactctgtctcttggacgagggctgcactgactgccaccggcgaagctgctagatagagcagcagttcgcttcccagtgctgggctgaccaaagtgggtgggctttgcggatattgctttacctcgtcgaacgctgcttggcattcgggtgtccagctaaactttcccgcgccccggagggtcttgaagaagggcaaacctctttcggctgcctttgagaggaatcgactgagcgccgcaatttggcctgcgagcttttgtacttcgcgtacgctcgatgggggcttcatttgctgaatggcatcgattttctcggggttcgcctcgatacccctttcagaaacaagaaaacccaacaacttacccgcgcgaacaccaaaaacacacttctcagggtttagtttcatacctgccacgcgtaagttgtcgaaggtttcctgtaagtcggacacatggtcgaaagccttgcggctttttacgacgatatcgtcgacataggcctccacatttcgccccagctgcttgtagaggaccttgtacaccagcctggcgaaggttgctccggcattccttaggccgaaaggcatcctgaggtggcaaaaagtaccgaacggcgtgatgaaggctgtcttcgggatgtgagctggattcatgtggatctggtgatagccggagtacgcatccaaaaagctcataagttcacagccagctgtcgaatccacgagctggtcgatccgcggtagggggaagtcgtctttcggacacgccttattgaggtccgtgaaatcgacacacatgcgccatttgccgttcgacttccgcaccagtaccggattcgccaaccactcgggatggtcgatctcttggatcaccccggttttgagcaacttctgcacttcggcttttgcggcctcttggcgatcaacggacatcttgcgcagcttctgtttccttggcttggcatccggtttgaccgccagataatgcatgatgaggtctgctgaaacacctcccacttcgtcggggccccaggcaaagatgtcaatgtttttcttgagcacctccaggatgttctcagcttccctttcgcccatgtcgcctccaagcgaaacaaatcttgtgggatcggcatcgtcgacctgcaccctgatcaccttgccgtggggggcgggcttcggcatgtgctttgctcggtcatgcggttcggcctcaacattgtgcactgctatgttgattgcggccaaatcgccctttgatgtagtcgaaggttggagccccttgaccatgatcacgcttgccggaccaggcatcttgagcttgagatagttgtggtggaagaagcttcgaacttgttcaaggttgcacggccgaagatggcgttgtagttgtatgggatgttgacaacgtcgaagagtatttgctcttcgtgcctattgtcgcttgtgccgaaagccaccgccagttgtacttggcccaggacttgaactgcttcgccgccgaaacttcgaagcgaggttggtgcttgggtgagagctagggttggcaaccccatcctggcatatgcttcggcgattatgacaacggccgaacttcctccgtcgaccagaattcgccggacttcgaagcagctctctcggccgagattaccagggggtcttcatgtgggaacagcactccttcggcatcgtccggcccgaaagagatctgctggttcaaataccacggagccccttcgcaaaccgaggtgatgttgtgcaccgttcgcaactgcatcttcttctgccgttttgacagttgatctggcggatcggcccttgtaatcacatggattactctgcgctgcacgtcttggtgctattcggccggtggtgcttgttcttgagtagcttcgcgaggttcttcgacagttgttccttgctgtggccttggatcttgtgcgctgccacgctgccgaatgttttggcattgctcggtggtgtgcaaagagcgtccatggaaggcgcagtagaggtcttttctgaccttcctacgaacgggatattgatggctgccagcttgttgggcgtcgaactccttgcggagggcttgaacttcttcgacagccatcacggccttgcctgcgcggtcggttctgaattttctccaagtcatgggagattgacttggccttggcggttgtccttggttcgccggctgagattggcgaatggcgagaggagccggttcggcgacttgtgcttgtacttgggcttgagcagcggcgatgaaggctttatcgtactcggcttggattgcttgccatcgcttgtaatcctcttcgccccttgcgtacccgtcaatgatgcgaagcaggtgctcgagtgtctgtggctcctgttggcgatttttcttgtgagttcgccttcgagcagccccgccgaagcggcgttgatgacgggcgcctcggttatgtcctgaacttgccattgggattacgagaagcgacgtatgtactcccttatcgatccctcggcctctagcgaatgccgagtagatgttgctgcgtcttcgactcctcataggtgcctcgaaagttaaggacaaagacatcacgcaattgctcccatgagtaaatgctattagctggtaaattgaagtaccaagaacgggcgatgccatctagagcgagatggattacctttgccttggtgttctcatcgctatgagcggcttcgattgcggactcgtagatggatagaaactcttttgggtccgtttcgcccgagtaccacggaacagatgggaacttgaactggggtgggattggacgaattttgattcccccactcagcggtagccccttttcgccccccgccttgctcacggtaccttgctgcgaaggcccgtttggctgtggatatgtcgtggcgaagagcgaagtcatggcttgcgtgtgaggttggaccacagtatccggttgcctggctccgaatggtggcgcttggtgtgccgccatggatgggtcgaacggaggctgggtccatgccatagcgacctggttcagcgcttgatttgttccgcagcctggcgtcgttgcctgtggtcgagtggttggtgcttaaatggcgttgctgaggtcgaactgcggtccttgactctatggcgaagctgccggaccaggctggttcgacagtagccaactgggcgcaccctgacttgtgtgcccctccggttgggccgaagaggttgtacctgaagtgttgtggggttggctgagttgctgaaggaaagcttgaagctgcgcctgcaaggccgaagccctctcagctattgcttgtgacatttaaccaggtgatgggggcgtgcttgggtagcgaccggctgaacatgtggctgtacacgaggggtcgggtgtactgttgcggccgaaggctgcccggcgaagtacgctggcgcttgcatgacttgtggcagaagagcttaggggtagacttggggtggaatgtagcccgttgaatactagagaattggggccgaagcgaccttggcttgccttgctgcctcgtatgcctactgctgctcttgcatttgacgaagcatgtcttgaagtcgtgtcatgttctggcgcatggcctccatgtctgcttcggcttgtgcctcaaggttggggttgacttgtgcagcggcgagcgcggtcgaagtcgtagccggttacggcgaagcggcttggggcgccaccagttggcttgtcgaaaggatctccgccctggtctggagcgccctcgccgccacagctgcctttgctgcatcaaccgtgttcggcgcctgccccgtcaaagcggcaggagccgaaggtggtggttgcggcataggtgccgaagccgatggtgccacaccagcttcgacgacgggcgccgaaggctctgctccctcttcggcggccatttcccctcctgcttcactgtcacgcccggaatttctatccaaaattccaaacgcttacatgtgtgtgaaccctcgtccaggaatcagccgaggcacacaataacaaattgataatagagtacaattattactctaattaataagcgtataaaatgtcattacagaggtagatagttcctctcaatcaataaagatctaagcagcggaaaataaaataaacggcgcagacggctccactccacaggcagcttgaccaaggctacacctaatcctccactccatcagcctcattgtagaactcttcctctgctgaatgattgcaaggtgagtatatgacatactcagcaagcc

SEQ ID NO: 58012 - DNA, 2751 bp, Oryza sativa
ccagcagtggaagctggaggtcaccacactgcaccatggagagttccttaagtgtgcgggggagtagtacattatcatcgttttccctcactctcaaccggtaacacttaccaatatgaaattctgcaagattatccatttctgaaaataacaaaggagctcggatcaacttttcacaatcaacaatccttaggatacgaagacttcggatatggtgctcctgcagtagaaagctttcctccagagaaattaaatttgagcagttgctgatgataactgagattagcttggtttccttgctttcaaaatccatgttgttaacatgatggtcatatatccttggaagggtggtcaatccaacatcatttacttctaaccgtgtcaaacttgaaggtagaagtggcagttcccctaattttttgcaaccttccaccactagagttttcagatttgggggcagggaattgcctgatgattggtcgatccgtttcaattctgcaagtttgtgcaattcaagatgcttgagccgctgtaaatttccaagagctgggaggtatgcccaacttctacattttctcagctctagtgacaccatatttatcaggcatggatggcttagccaagttggaaatcgaagaccattataccctgatatttccagattttcaagatgagaatgtggctcaatacattagtagtctcagaccagtttaaggacaacgatctaagatatgatttatctcttagcttagcctcaataatctcttcatgggtcccaacattctcaaagttgcaaatctgtagcttgcaaatactgcttaaattcctcagtgaacttattctgtaaccttccttcagttgaatctcaaaattgtgcaattcttgaagtgaagttaatctgccaacaaaaaattcaccaaaaccgttactgccatatgatacataccgcagatgagaaaggttttcgatattattcacttgtttcggtgctgtacttattcttttcactgcagtaagcacttgcaaatgatagagtttagagattccatctatatcctgcatcccagagaaagagatataacgaaggtgcttattaacaacttcttttgccaaacataacttggttatcccttttaagctcaataaccgcaatcctcttagaagctgtacaacttcctccaatgcagctatccaaacatcgttgacatgataggagtcttcaatgataagtgaacgcaaattctcaaagctggaaattgccttaatctcctcggttgttaacttgttgaagtttgcaatccataaatgtctaactgtacacttgtgctgcatatagccactagattcaagtcttagacattcaccaacagaaacactgcatgccaattcatgtactaaatcatgcatcacataatattctgcgtagaatttgctacaaggatctcccactgtcgcaaaagtaaagaatgattttcttgccaattgcaccaagtatctttctccgatgtcttctggcctttctgttccactatcaattaggatcaatcctgaatccatccacattttcactatttcgtccttcttaaattcataaccttttggaaatatactgcagtatctaaagcaaagctgtaaatgttcaggtagatggtagtagctcgactgaagaactgttgtttttttttttttgacgcaactgaagaactggtgtgataatggcactcgtttttccttctaagttttccaactgcctgtataaattattccaatgatgatgacttacattgctcctgagatgctcgcttgcaatctttgtcaccaagggacacccttgaaacttctttgctatgttttcagcaagtggcaggagatgttcataatcttcagttttcataccataaaaggcatacttcttgaacatcataaaattgtgatattcgtctaatccatttaggttcatataatcattattacttcgcatcacacttgtaaccatatctgctacagatgtcattcgagttgtcaacaggattctacttccgttatggggtctgttctggaaaggagccattaatttttgccattcaccccaattgctgtcttcccaaacatcatccaatatgagcaaaaacttctttgattcgagattctctttgagaatgtgttgcaatgcttccaaagtattagcattaggcttctgttttgtaagtgcctccaagatgttttttgttatccttgctgcattgaaagaattatcagacacatatacccacacaatacaatcaaagtatgttaaatctcttaaattcttcgcacacaatctgagcaagagtagtctttcctataccccccattccaattattgcagaaacagggactcggttgattccaggagtgttcgaatctccctctatattgtcaaccaaccacctcataacctcgttcttctctgtgtcacggccaaagatctcagtggccaccaaagtggagctagtctcttgattaatcttttcagcatgatctggcaagagagcactaccaaaacggcttgttagatgaaggaatgtaccaacaccagcagcagtttcatccaacctcgtgagagccaacctaagattctttaccatgttcccctcagaagtatacttagcaacctcaagtttgaaattttttacgaacaacattttgtttgaaattttttgcgactgaattacacacctcaagttctaggttgtggactccagcctcttc

SEQ ID NO: 58013 - DNA, 1786 bp, Oryza sativa
catcagtaaggtgtattcactggatctggatccgctgtctttttacaaagactttaataagcgggggctgcgcttatatattgatgaaacgagaatcaccacatattccttgaccagcgtgataatcttggagacgtgggaggtactcacttacttcgaatcaaactggacacgattactagccatgtgcaagtttgtgaattgcagaaacagatgcctgaaatttgtcctgaatatgctatttagattccattacatgcttaacttggtgaaaagatttgatatttcgtgtctgcaacagtgtcccaccatgttcatgcgatcatttggattctgctcaaccatgtttaagtgggaaatgactccttttattaaaggaaggaatccaaatgaaagtgtaaaggcaagagtcattcaagcactccgctccatggacctcgagggccatcctctgtcaaaagacctcccctcgccgcgtctcagtgtgagagctgagcgttattggttggcatccgttgcagatgtaccaagatgctcccgtgttattctggtctggcacattgcaacatgcctatgcgagatcaagtttgccaatgacagttttactggttgctgcttaaaatggatgtcgatgttaccatcaactgaggtggatgagaccgatgatgagctcgacaagtcatacgcggtgacatattacttgtcacgttactgtatgcacctgctggtctcaaagcgcaaactgctacccgaagacattttggtgtccaagaagaccctccaagacactgttcagtgtgctcgtgagatgctgaaaggctgcaactcgtttcagagcgtgtacgacaagcttatggaagaaccgcagaaagctcttgttccagacgctcatgacatgaatctgagtggaaacatattgcaacaaggtgctataatggccaatgcactcatcgtcaacgaggaggatgaggcatgtcgctgggagatcctagctgaggtgtgggctcacttgattgtgcacattgctcccagttccagaatagaagctcatgccgagaacctcaagtctggtagcgagttcataaccgtcatctgggctttgttttcccactgtggcatcgagaagagcgaattatggcagtagcagaaaaagggtgcagagtctgggaacagcacttttctggattggctaaccagagcagtgatgtagcagatacccatgttcaggaggctggtcctgattctggcatgtcctgaaacctgaattgctgatggctgatgctcttctcccctcgtgttttcagttttcaataatgggtgtgtttcacgccaaaattagaagtttggttgaaattggaaagatgtgacggaaaagttgaaagtttgtgtgtgtaggaaagttttgatgtaatggaaaaattgaaagtttgaagaaaaagtttggaactaaactcggccaaaatctgcatctcatcaaaccgattcctattggctgtagctctttttgagtaaaggctgggatgttatattccattatcttaaaaaaaatcaaaccaagatcatgttcttcttccaggaagaagaccacatcataaaatgataaaatactggcaaagacatcatgaaatgcattatgcatgtgaagatgtgcttccaggaaaaagaccacattagctctttcctcttcatcttttattatcgagataatccattaaatactatcgacaagtgtctaagtcccagaaataccatcgataagtgtgagttccaagaaatgccatcgtac

SEQ ID NO: 58014 - DNA, 39360 bp, Oryza sativa
cactaaaatttatttaagcattttaggcttttaggaaatatacaaaaatcctccaagcctcatttgacttttatctttgcacattttaattgttggaggctttcacacgaattttacttattcttttgcacaattttgaggatgaattttagagtcgatttgggacgcgacaaacctaccccccttaaacggaatctcgaccccgagattcggaagaactggcgaagagatcgggatgggctgccttcagctcgtcttcacgctcccaagtagcttctccttcggcgtgattgctccactggaccttgcaaaaacggattactcggttcctggtcctgcgctccatggtgttcaggattttcactggcctctccacgtaggtcaaatcttcgcgaacttcaatttgctctgagtcggcctgctcggatggcactcgaagacatttcttgagttgcgacacatggaacacatcatgcacgttgcccaaggaggcgggcaactccagctggtaggcgacttctccgcgtcgagcagtgatacgaaaaggacccacataccgaggtgcgagcttcccttttgtctgaaacctgtgcacacctcgcaatggcgtgacccgaagatacacaaaatcatccactgcgaattccagatcacggcgtcggttatctgcataacttttctgccgggactgtgccacctttagattatcccgaatgattctgactttagcttcagcttctctcaggatatcagtcccgaacacttggctttctccaacttggtcccacaataacggtgtccggcatttgcgcccgtacaacgcttcataaggtgccatttgtatgctggcttgatagctgttattgtaggagaactcggcataggggagactcttatcccaagtcttcccgaaatctaggacacatgcgcggagcatatcttctaggatctgatttagacgctcggtctgtccatctgtctgcgggtgataggcggtgctgaaattcaatcgagtacccagctcttcttggagcttcttccaaaagtgagaggtgaattggcttcccctatcagatacgattttcttgggaataccatggagactcacgatcctagcgaagtagagctccgctagtttgttccctccataagtggtcttcacaggaataaatcgagccacctttgttagtcgatccacaattacccatatagaatcatatccaccttgggtttttggaagtccggtgatgaaatccatcccaatttcatcccacttccattctggcacttggagaggttggagaagtccggccggtcgttggtgttctgccttgacacgctggcacacatcacatagagccacaaactctgcaatttcccgcttcatgctaacccaccagtatttctccttcaagtctaagtacatcttggtactgcccgggtgaatggaataaggactttcgtgagcttcctgaagtatcagctgtttaagttctctgctatctggaacgcatacccgctttccgttccataaggttccgtgttcatcctctgtgaaaccagcggctttaccctgtttcatattcttgaggagtccatgcatgtccggatcattcttctgagcctcgcggatttgatcgagcaaggtgggcttggcttctaacgcagccaagaatccgcgaccaaccatgcttaggttcagggcttccatctgttgattaagctcgggtggaatgcctcggacgttgagagtgttgcagtggctctttcgacttagagcgtcggcaaccacgttggccttaccaggatgatagtgtattcccacatcataatccttgatgagttctaaccatctcctttgccgaagattcagatccgactgggtgaagatgtatttcaagctcttgtgatcagtatatatttcacagcggttcccaatgagatagtgccgccagatttttagagcatgaaccaccgctgctaactccaagtcatgtgtagggtagttgccttcatgaggtcgtagctgacgtgaggcataggctaccacatgaccgtcctgcatgagcacgcaccccaatccttggcgcgaagcatcacaatacaccatgaaatccttgcgagtatccggcaagattaacactggcgaggaaaccagcttttccttgagagtttgaaacgccttctcgcattgcgggctccacacaaatttctcttcttttttcaacaactgtgtcatgggtcgagcgattttggagaagttctcaatgaatctccggtaatatcctgccaaacccaagaaactgcgaatctgagtgactgtcttgggttgcttccaatcggtgacggcgatcactgtttcggggtccacagcaactcctttagcagatatcacgtgccccaagaatttgacttcggacaaccagaactcacacttgctaagcttggcatacaattgatgttcccgcaactttcccaacaccagacggagatggtgctgatggtcttcctctgattgtgagtatatcagaatgtcatcgatgaaaaccacaacaaacttgtccaagtattccatgaacactttattcattaagttcatgaagaaggcaggagcattggtcaagccgaacgacatcaccgtgaattcatacagtccatatcgcgtagtgaatgcggtcttcggaatatcttcttcacgaatacgtaattggtgatatccggaacgaagatcaatcttggagaatacagtggcacctttaagctggtcgaacagatcatcgatccggggaagagggtacttgtttttgatggtaacttcattgagagctctgtagtcaacgcacatcctcttcgtcttgtctttcttctctacaaaaatcacaggagcaccccatggggaagtactcggacgtatgtaccccttttctttcaactcttccaactgtttctttacttcggctagttcatttgctgccatacggtagggtcgcttgtacagaggagtggttcctggagcaagatctatccggaactcaatctctcgcttgggcggcataccaggtagttcttccggaaacacgtctccgaactctctgactatggggatttctgacagttctatctgatgaagttctgaacttctggcagaggttgggggtgcaaagaaaacaaccggttgttctggccctcggtacagagtgacagtgcgcctcgcgcaatccactactccttggaattgagccaaccaattcatcccaagaatcacatccaaattcttggtgtctagcagaatcagatccgagggaaaaggaatcccctgaatttctatagggacggcagggctataatactttgctgtcataacccctccaggggtggtgatgagtagagggtttctaagcctttctacccccaactgatttctccccacgaatggcacagatataaacgagtgggaagctccagagtcgaacaaaattgtagcagggatggaatgaacgaggaacgtaccaacgatgacgtctggagttgtcagcacgtcctcggccgtcacgtgattcacacgaccccgaatgacgtccttgccaccgttgttggagcggggaggcgcttggccttgctgacgccttggcttcgggcatttatccgcaaagtgcccgggctcgaagcagttgaagcacagacgctgctgaccttgagcgtccctgcggccttgaacgggctgcacagctggcgtaggaggacggggcgcacgagtcccttgttgattctgctgctgctgcggctgtgggacgcgcaccacgaattgaggtcgaggcgctgggcgaggttgctgctgctgctgctgctgcgaggaggatccccctgggtagggattggtgtagcggaccctctggttagcaccctgttgattgcggaaattcgccaagcggcgcttgtgcgattccagctccttgtgcttggcttccaagcggatgctcttgtccaccagtcgttggaagtccgggtagtctccagagactagacgaacagacagctcggggtccattcctgccaagaacttctcttgcttctcctcatcttcccgcacatcctccggggcataacgggctagattgttgaactcatgcaggtactccatcacggagcggttgccttgcttcaactctcggaattccctcttcttgagagccacgactccggcgggcacatgggttttccggaaagcggcggtgaagcgagcccaagtgatcggctgcccctctggctgcgtagcctggaagtggtcccaccagagagatgcgggcccctgcagctggtgggcggcgaagacgactttctccttgtcactgcactgcacagtgtctaacttcttccccacggcatgcaaccaatccaaagcatctacgggattgttggagctggagaaggtaggtggacggatgcggaggaactcggcgagtttagagtgttggggaggtggtggtggagcattctgttgtggcgggttttggaggtggtggaggaaagcattcatcaggttagcttgctgggcgaggatttgggtgagaatggcgttggtgtctggtggtggtggtggaggcggaggaggaggtggaggtggattgccttggtggttgtggttgctgccttcgggttggttgccttcaccggtgttaacatttctcctggtcgtcaccatctgaaaaccccacacagaaccagcaaacagagaaggagagctgacgattaaaactaaccacccacgactactataattcttgaatttattactgctattaaattggttcattaatgttcaagttgcttaggcaaacaaataaagacaggctccgacatagttacaccacacaccggtgtaaccatgccccacacaactcaaaaaagacaaacgagaaaaaacacacgcgcaagcctactaactgctcgtctaacgctgcgacgggccaggacggaaggtgagcaacagcgcaccctccgagctaccaacgccggaggcttccccctcctggggaaccacgggcgcaggctcggcacgaggggtctcgacgaagcaggtccacgccagggactgacgaacaagctcaggcctggaggtgctcttgcgggcggtgatcttctggctgcggcagacgcggcgacgcttgggtcggctgtcctctccctgggcgatcttgagctgatgcagctgcgcctccaacgcgtcgaggtccttcttgagctgcaggttctcctgacgcagctccaggatcttcatgttgttctcgaccatgccacggcgcaccatctgatggaagtcgatacgagccgcgtcgtacgcctccaccatgcgtgccagatgcacgacggtagcgtcatcctccgagctggcgtctcggaaggtggcgtagtcgcgggctcctccgcgacgagggtggtagcggtagggcgagtgctgcaactcgtccgggtagcgctggtgaagggtgccgatggcgaggagagcggcgttctggcaagcggcggggaaggagtcgccacccgcggtgactgtcagcgaagtccgctcagaagagccggcgaggatcactgcagtgacctcccaaccagcgcggggctctgcatcctcaccctcctgctccgggagcggcctggcctggtaatccactccatgtggataccccaagaccacgcacatgccccgcagctccaaaacgaagccagtcatgtccaaaccacgacgggtaacgctgccggccatctacaaacaaaaacaaaaagagaaacaacattttaaaggacagattttgatgataagtgaagcagcaagacaaagagagaatagcgggttttcacaaataataaaggatttttatttttgaaaatattgctaaggcttgggatctacggctcgtcctagggtcaagggaggctctgataccaacttgtcacgaccggaaatcacccaacaggcgttcccgacgtgcgtgtattattccttgtcccaggaggcaaggtacaccaaaagttgatacaatacagagtttaacaagcggaagcgtatataaaattattacatgggcaacgaaggcccagcacactcaaagacaacgaaaaacagcggaagactagggcgacgaccacaggcgcttgacggcaggcacgagctagacaccaaagccttcatcttccaggaactcctcatctgggcttgggaaaattaagcaagactgagtacaaccaccgtactcaacaagacacacccaccaatgcagaataaatgcaagggagtacaagggaattataatataaagggttagggttgcagtaaacagcatttaaagacatttagttgctcaaagctactttgtaaacgcgatcctagaactaaacaatattattaatcaaggccgtgaacccgcacgaacctgccttaacccaaggcctatgatgattcagaccgaactggcaacccgaccctgggtcccagctcgtcctaagccaacccaggccaaccattccatattttagttgttaagcaagttttaagaattaaaacactaacttgggtacattgctcggcttgcccataaccgagggctcggctattcgaatagattttactctgatcagaggtgtacaactttacccacaagacacatcttcctcacgtgttgccacgtgccacataccaccacggtatacggacggaagacgtgacatagtttccaacccatcctagccttagacaagagtaccgacccaatcccacctacggccgggatacccgggacaggcaggcagaactgagcccctagcagcagggcaccaaccctctgccgtatgacatctcgactaccgggccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaacagaggcccgaagaccggtccttaaacggccgaggtgctactatcaaaaccatgcaccccgagcccagcctaaaaccattttggggattttgaataaagggggatggtgtgagtccaattccacaataaaccaacaattccagagtatccaggtgatatgaatatttcccaaagtctatagttgtaaaaccacctaaggttacctaattagattgcgaagcatctacctaaaatcatactagggataccatgagtagagtgtccactagttgaggttttgtttgtctagggtgaacaaggtagtaataataacaataacaataataatatggtcataacaaaggtaaataggcatggctaagtaaaacagtgataacgcgggaatttaaataaagcgataatgcaataatttaaatcaacataattttataaaatgggattcaatatgatcaagatgatgtgtcttgccttgctcgttttcccaatcgacggcttcgacttccacgaagagcggatcttccgaagctgcagcgtctacacgaccaacggaaaagaaaaaggctttaacactaaataactccacataacagcagaaacaaagcacaaaaatgggttctttacatcttaaggaaaaattagagacttgaacggtccaattccgagttcaaatggccaagatatggccatttgaagtttatatgctctttaaatggatatttgcgaatttcttcatttaattttcaattaaaaatcctatttattgcgtcagccgagggagcggggcgcgcggaccgggtccacgggagtggggcccacgcgtcagccccacggtccacggtggaccgggcgcacgcggctggcggcggtcggcgccgtgggtcccacgcgtcagccgcacccgcgggcgcgggcggctgacggccgggcccacttggcagccgcgagggcgcgcccgaaggcggcctcgccggcacggccgacgggaggaggacgcgcacccgcgccccgatggtcgccgccggcgaccaacggcgcggcggagtggcacccgagagagaggagggaagggggaagcgaacggaacggtcttcggctcaccccggtcgacgagggcggcggaaacgacggacggagcggaggaagacggcggcgcggttcgggatgacgatgacgacggcgctccggcagtcgacgggcgaagcggagcggcggacggggtcggcggcaacacggcgaagcggacggaggtgtcgccgagtaaggaggaagtccggagcggcggcggcggcggaacggagctcggcggcgatggcggagagagaggagcacggcgcgagcacgaaaccgacggcgagagcgagcggcgagcggcggaaacggaagagcgaagctcgggcaacgtttaaatagcgccgggggaaggaaagagcggccggagagggaggaatcggtcgcggagatttcggccgccatagatgcgccggcgatgaatgcgggattaaatccgagcgaatccgagggagagagagaggcgaaagcgggggaaacgggagagggaatcacggggagtgattcccctctctttaatgcgcgcggggacggcgggatgcggcgcaatccgcggcggcggcggcgctagggcacgggcgcggcggcgggcgcggcgggaggaaggcgatgacaggtgggccccacccgtcagcgagagtggcgggcgggcccgcctgtcagcggcgcgcgcgcgcggggagccgatgggccgcgggggaagagagagagagggagagggaaggaatgggccgagccggcccaagaagggaggaggagggggaaaagacttcttttagggttttctttttataaaacctttttaactttgtttatttcttttctattattatttgtgctctgaaaattccactaaaatttatttaagcattttaggcttttaggaaatatacaaaaatcctccaagcctcatttgacttttatctttgcacattttaattgttggaggctttcacacgaattttacttattcttttgcacaattttgaggatgaattttagagtcgatttgggacgcgacagtagcgatactcagtgtcggccaactgatcactgtagcgatcacggagctctcctatggcgatccttgccacctcctgacatgcatggatgtagtttcttcctctagcttcgaacatcactgagggaatatcttcactattactgttcaaggtgactttgactcggcacttctcttcatgacgaatctgggcataaaaaggggcagtcccaaatccaatgacaaaggacattgtacgcaactcctggacaaaaccctcaacaccaaacagatactcaggcttgtagcgcggcatctaaagacaagtgaaaggagagagttaagacacttatccaattaatagcacaagtttttggattaatttgaataaagtttagaaaatcaaagtaaaaggtaagtaaataaagtaaaccaaacttgcaagatgagttgaaatagttgaaaacaaggttacaagttttgtacttttgaataacaggttttcaaaagaaataaaagaaaattataaaatcaatatgctaaatttattttattgcagcaagattaaatgaaacaacattgtaaaacttttgctgataaatgagccattagtacagtaatagatgtacagtactaataacactggaataaattttgagtgagaaccattaaaagagatttatgaagtgcatgtgccattagtttggtttaattaaaagagaaagggaggagaacagttctacttttgcaatatttttagagggcttctatgggtaaccatttggcataacctagggtcaaggggctctgataccaacttgtaacgcccggaatttctatccaaaattccaaacgcttacatgtgtgtgaaccctcgtccaggaatcagccgaggcacacaataacaaattgataatagagtacaattattactctaattaataagcgtataaaatgtcattacagaggtagatagttcctctcaatcaataaagatctaagcagcggaaaataaaataaacggcgcagacggctccactccacaggcagcttgaccaaggctacacctaatcctccactccatcagcctcattgtagaactcttcctctgctgaatgattgcaaggtgagtatatgacatactcagcaagccacgcagcaaatatgcaagtgcacagggtaacaaaggatggcataatagggctccatttgcaaaagcagcatttagcaaacatttgagaatttgataaaacagttaagtaattaaacaatattaatccaacgctatacaacataccctgttgtataggcccaaccattctgaacaaccaccccggctgcacagttctatctccaaaccaggaatgtaccattccaaaccaggagctaatcaaattattaccaattatagcatcatttactatggtgagaagtgtgaaactaatcacgaaagacattgttcgacccgcccataaccgcgggcacggctattcgaatagttttactctgatcagagatgtaccactgtacccacaagacacaaccccacatcatgtcaccatgtgcctcaataccaccacggtacctcggaaaggagttgtgacaataccccttatacaacacaatccactgcagcgcaccttcctggatcataatcacccccttataagcaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattaccaggttttagttggcacattaattaattaactaatcacgattgaccatcgtgaactatcattaagccatcattaaataatagtgaatcataagttatcccaatagtgagctaatgtttctaagcagggctaagcaattatacctaatatctagttgaaccaatataaataaagttcaaccagtcaaattattataacccaaggtatcaaggaatgaggtaatcaagaacaaaagggctataacaaacaataggttaattccacccaatgacattcgaaaataaatgcaatagttgaaaagaaataatagctttaaataggatcaacatgctcaaagggttgtttgggatctgtgtgacttgccttgctggccttggaactcttcaaactcttctccggcgaaaacggactctccggaaacgacggaatctaagcagaaaagaacaaaatcaccaaaacaacacataaacaagcatgaacagtacatgtggatatttttaatgtgtagatctcaattttagaaaaatttagagacttgaaccaactaaatcggagctaagatgaattagttatgaatttttaaagattaaatcggattaaaacacttaaatcggtttaaattgaattatgacgcaataatgaattatttttgaaaaggaaaaggggatttattgcgtcagcggctagggtttcggtggaccgggcgcacgggcgacggttcacgcgaacggacggccgagatcgaaccaatccaaatcggacggccgagatcgatcgggtccacggcggctcacggcggacgaccccgatggcgtcagcgatgacgtcaccccggcggcggcggctcagcggctcggacggctcgggcggcgcacgctcaccggcgaacggcggcgcgaggacgcaaacagagagcaccagcacgtagaggacgacacggcgaacacaccggtgaccaaaacggcgacggaagaacagcggacgacgacggcgacgagaaggaaacggcggaaaccttcgggtcgacgacggcgatgctgctccggcgatctccggcgacggcgaaggggcagacgaggacggcgacgcgatggcgaacacgacggcggccttcccgagcgacggcgacggctggagcgacggtggagcacggctggagcggcggcagcgaagacgaagctagggcacacggcgctagagcgattccgacgacgagaggcgaaggcgagggtggcgacgggtagaggagacaccggggaggcttttaaaggggctcggaggcgacggcggaggcccacggcgacggcaacggcgaaggaaacctcggcttggagagaggaaagccgatccgattcgaactcgattccacgaattccaaaacgaattagccgaagattccaacggagaaagggtagaggagatcccggagatcatttcccctctatcaattcggccggagaaggaaaggaacggccggatttggaaaggaaacggcggcggcgcgaaactagggtttcgggcggcggcggccgaaggtagacgacgactgacaggtgggacccacctgtcagcgaccgaacgcgcgcgcgcggcggctgcggactgggccggctgggccgaggagagagagagagcgggttttgggccgactttcggcccaaagccaaaagaggacttttaaaacctttttcaatttaaattatttcttaaatgcaattccatttattaaaaatacttccttagctcaaataaatcccagaaaaatctaggaattatagaattaagcaaagtatttaatgaaattttatctggcccctttttatattggaatttattaattaaacttagattttcttttcaagacttttaaaataaattctagaaattccatttaaacaacaatttatataatttgaattttcagggtgtgacattcactctcctttcgcttagcaaccctctcctttgtgaccttcttcggtggcattcgctctcaatggtttcgctcagagatccccacggtcggcgccagctgttgtcgaagcaacaactgcgtacatcgaaggacgtggctactcaacagttgttgggaacagtgaagtgtattaattttggaatttttcttgggatcccctcttttacatggccctagggtctatttataatcctatcacaggttaccccgttagggtttaggttttacaggggaatttacatggctgcccttacgaaagggacatttacatgggtacacagcgtaattgtgatacatgggactataatgggccaattagcgaacgttggcccaagggccaacgggcttgagcggctgggatggccccttgggcctccttgaagctgaactcgttatggcgaagtcaccctccttcggcatgcacccttcaccatttagtcttcgcccaagatgcctttggtcttgtgggataccagcgcgatccttcgcccttcgccccctttgcttcacagtcttcgccatgggggcttcgcccagatgaacttgacgccttgagctcgaatcctcgctggttgcatggtttcggcaggtctggttgaagggtctgatgacataccgccaacacttggatttcgtggacttggccttgccaactaacttctttatgtcttttcccattctcaagaagagagagctcgcactaaaaagttggattgaattggacagtgctagctcgaatacatttcgaggacggcttgagtgtctttgagctagtttagaacgtggccaagagcaggagtggctatttgaaagcgacccccaccccttatatagcgcggggcggtgggggtcgcgagtgggtgagtgggcgcgagcaccgaagcgacgaaccccctccccccggtcggttagtgcaatgcaaggttgacacgtggcacacaaaaaaaataataataataacgcatatatagtaagaaataaaatatgcatatcagcatatatgaaataaacagtgtgttttgaccgaataggaggacggccgttttccccctacttttaactcgagcactgttttggccaaaaacacatgtcacccttacccgtgaggggcttgttgttgtatggggtaaacatcatccttcccattcaatcaaaacaccgagggaaaggaggtcttgagaatcctaagtttccaactcggaaaagacttgtgattgggaaaaatactattcgactggtaaagttccatttgagtggtaaagttctattcgagtgattttgtgatacttcagcagcttatcccgcttgagtagacttttacttgtgacaggtaaattctaagagcctaacaggtgaaaaggaatgtttgaactctcaagatggaaaagacgtccaatcgaggaactcgagggaaaacactacttgagcaaggaagataccataagaagattgcatgggaccacactcaaccacctctgccagctggcaccaaaagaccataaacacctccaaaatgttccaaattgcccctaggattgctgacatggcaagggtattatggtaaactcacaagagcctataggggcaagattataacctcacatgtacggctgtgggctatataagccggccaaaatcctgtatcaagacaagatataacttaatagagaaataccacttgctaataccgtgcattttgtgtccgagctcatttttaggataggtggggaaaacgtactttcccgcctatccctgaacttgtccgtggcctaaggtcacaacattgagaataacgttggattaaatattccgatgtggccctattaatacaatggcacattggccgagtttatgtgtataggaatgtactttacacagataggtttaatctatttaatttttattccatgaagccactgtgtgacttggtgcaatgtctgtctaaatattgaatcaaatactcccataagcctattttatatagagagctaaatttatttacatgaacaattattttatatgagtgaattttgtgccctaagagacttgataaagtgttttaaatattctagtgaaacttatagatagggtcattatagtggtgaccattatttcatgtgtacttatatttcatgacactcatcaacatgattcaagtatttaatatttgacctataatttaaattagtaattaaccttccctttgtctagctttgctttcttgtgcgtaaatatttatagggttcataataaatatcttattattaaaattattacttagttgtacaactttagtttaatttcccattgtgacaatttatggcttggcaagcaatagcagccataacatccagcatgatgtaaaagttttaaaaaggttcaaatttttagtgatttttattatcaggaattttcaggatgttacacattcacaaaatttgtaaattgagaatggatagttactcctttatgtatgttgttgaggatgttgtagggatgatcttgttgactctttgatgaatccttgggtgagacaccgtactttgttgcaagtgactactccattatcgtcttgttagttgaggaagacccagttggtgccaatgacattatatttgtgtctcttcactaatgaccatacaccattgcgagtgaaattgttcaattcttcttgcgtagtcatcacccaatctacatcaccaagtgtatcttccatcctaattggcttcaaagaaaaaacaaaagagtaattcttagaaaacttacaatgagatagaatagttaccccatttgtgatatcaccaagaatcttatcgatgaggtgatctcgttgaacaatgtagtgaattcttggatggtgcactgaggggacatgagcttgcatggtgtctctttgctcttgagtacccttggcatcaatcccattcacttatgttggaggcatgacttcaagttcttcatagtcggttgtgagaggttgactagagttgatgaaggttgaccaagtattccatcttggtcatcatggacttcttgatgtctcacatccccaagtattctctttttttccattatctagcataattgagagaacatgctccatttgggagtcattagcaacatcacacaccacacctatcgtgatttcaataaatattagctgaaaacatggtaagtatgagggtttgtctaataaccaaggaccttattccaaaaagatataaattgaaatttcaatagaagaagatactacttgaaagcacttggtcattagggataccttgagcatctaagttaagatgcccgtttgctttcttcaagaacacatgttggtggagtcggttaattcttggatttttttcattttcatcacttcacaccttctcaaccttgggctcagtcttatattgagcacaccgtgcatttcactcgaaggtgtcttgggtttcatgttaagcacaaggaaaaaaaacccaaatgaagtagaaaaaaactcattcataattaaggacaagaccgcatttgttatcttacgtgtttagataagcgatgagttcgtgaagattgatgcatcatagcttcaagctcttgtctcgagtgaggctttatcgatttgactcataattgccttcacttgataggttgtggtaaacatgggctcaaaaatctacaacaaaactttgagatggattataaataacgcacaagtttttattttgcaagccatgctgagatctcaaccactcataaatattaataaacctgaaaaattcaggttttcagattttggaaactcaaaatgagcttggaaagagcattgaaacatcacgaaaaaaaaagatttcatgaagtttaacatttgtaaaatcttggatgagttagagacgtaaagagaagccaatatccacaaagaacattagctaaattagctaaacccaccatatgcatgcaagtttaagtaaaaatgtgctgaaacaagattttggataaaagccattttgcttggaataaaataatttttactccaacagctttgaaaaacgttacaaacaaatattgaagcaattttgaaaagatcttcacaaattttcgacttttgaccaaacaggctatttgaaagggctataaatccaaaatttgaaatctttcatgttttgaaagcaagagatacatgaatataatttacataagttcaccctaatgtatctctcacttgaaatccatgaattcaacatttttggacaagtccaagtttgagaaaacatatacataaaagttcacttttccaaaccttccttaaaaaagagaaagaagtaacaaatgagatgctttggattgaaatgcatatgtattagtttgaaaaacctccattaaccagcatgtatcaaaatatgtagttctcgtggcaaaactcacttgatgccataataggaccaaatatggcgagattgctttaatatctggttaatctaattaatagataagagacttgttttcgttggatacgaggaaatcattctacctcgaaagattgaattagacagaatgtcagatatcatttcttctcagagatgtgacaactggggaaataatttggctctagcgctaagcaagactttcctggatttgatagaatcaggggtgttcaaactatgagccagaatgaacctccgatctgataccacagtaaactagatatcttttaatcaacatcctaccaaggttgaggggatggtgatttcagaaaggcaaacaagaacgcaactacagaagataggctttttttggaagaagcacagaaaaatgaaagccagataaaggaagtggtcggcgaaggattgccctacccaacttcttgctagccgtttcaaatctcgggatgagatttttgtaagggtggtggatttgtcacaccctaaaaatcattaaaatataaattgttgtgaaaaaggaatttttagaaattattcaataattaaagcaagtgtttgaataaaatttatgaaaaatttgaacatcaaactgagctagataaaattttgttaaatacattgattgcccaagtattttcgacaattttcctggaattatttgagcattgtaattatttttaatgaatgaaagatcatttcagcaattatttaaattggaaaataaaataaaatttcttcctagcctttggaccgaaacccggcccattcctttcttcccacctcctcggcccagtcacgccatccgcagccttcacccctgtttcggccaaagtccgcatctactccctccgccccttcctctcgctgacatgtgggcctatgaacagtgtcatcccctacctcccacccgatgccattgttgaaaccgagcccaaatccacatccgatgccacccgactcccccgtccgtttccaaaattgattgaggcctatttcgctagccgtgggaaatgatccgaaggaaaaccaacccacgtggggtttgggttgtccccgctccccacacccaatacctttcctcccaatccccctctattccactgtcacgttatgtcttgttccctagcagtttggagtagaaggtgggattagaggtgggattagaagggattactaccattcaaattcagagtgagaaaatatcatgaaaaattcggataaattaaaaaaatggaaggtcacgaaagtcaaaataattcagaaatgacaagaaaaaaaaagatcatgaaaatggaacagaaattcaacgtgcaaaataattctaaaaagcgtaaaaacagaaaatcgtagatttaccacagatgaattctaaaaatagtccagaatattaaaatcataattttggatagattaaattctacaagcagtaaaacatccaattgccattgtgcaaagcaagctacaaaattggttcttggaaggtaatatatctctgtctgatcaaagtgttaattttgtagaaaaaattggttcctgcaaccatcatagctacatgaattaagaagcagttaggaaaaattgttgtccatccatcgcatttcataattcaagcggtctctgagaactatcttgcaaaagattccttccaatgggcgtagctagcaaatgggccatgggaccctgtaactacacaaccaaaaagaaaccagtcttagacattagacaatggtgattgttaatatgtaaaccaaacaacaggtaaaatgaacttgaatcaaatcagataaatatgcgaaagatggttacttatactcaagttagcaaatccgatatatatattaaacctcagagatagccaaggtacagttctcagattcagatatgtgtacttagttttgctaaaacctcacgtagcagaggtacaaatcttagattcagaggtcagtatatttgtgtgccaattcaaattacttctgctactctagtaaatatgcaggggtaagattaaatgcttcgtatcaggtaaatataagtacaactgtatgtagttttttctcaaataccttgagtaatatcaactccttcagctttccttttgccaacctcacacgccagtgcctctcctgaaaatttaattgagcacaacagattatatttttgtcattcaatagccatttatatagctttgtatggtatgacctctagtaaaatatctgaacacccagtttcctgaaactagttatgaacatagtagcagttcagaatagataaatatgctaaattgattgctaagagtaaaataggtattccaataaaagatatgattacatttttcttgacaatacatcagacaacaaatgcctaattggtgttctgtgttcagatattttacttcttgttgcttgtttggtcagattttcactgttttagcgcaattctgtttctgtccatcaaggcttaatggcttatgcattgcgaagatattcaccactcaagtactcaagtagccaattaatctggtagttcagaagcactttcacccaaaaattactaaagattaattgttgggagaggatagaagcttggatccgaggcacttttgtgacaaataacagatgaagtactcaagtaacaacattttgactgcaaaacaaaatgtaacatgtaaccataataaaatggatctgggaaccactatagcaagaacgcaagaatcagttagttggcagagattcatgagcatctgctcatttgttttcgcaatacacttagtcattcctctacagaatatgtatttatctgttttggctgttctgtgtgtagccgggagaaattcagcgagatgctcccgctgttggaaaagaggagatcaagaatcatacatgcttcttgatgtccaggctgttgccctcgaccttgccctctcccgcaaccggtgaattcgaagcgaggaaggagagatggcgagcagcggtgactgggcgggatggagagcaggaaggagagcagcagcggctgaagcgggatggagaccggcggcgaccgagggcgggatggagagcggcggcggctggaaatatgctgctcccggatctccaccctagctagagccacctcccggacctcgcgccgcatccaaaccctagcgccgtgaggagtcgaggaagacaagcgccgtatttgctcgggaagaaaacaaccgtctccgagacgatttttctgtacccgggggtttggcgtggatcgggcggagaattgcctccaccccggcccaggcgaacgtgcatatgggccatggaagaaaattagacccggccgggatggcacacggggatttcggcccatcccccccccccaaacggaataagttcaccagaggtccctcaacttaacagcgagattttttgaggtcccttaaccacaaaaccagaaatatgcacccgtaaactttcacaaaccgtgcacaaaaggtcctatggcagtatacgtgagtggtttcactgacgtggcatcctagtcagcgaaaataaataaataaagtacgtgggtccacatgtaagtgagagaaaacgatgcgggccccacatcccttctttttccccctttcttctcttctctcgtcttcttcgacgggtggggcgacggccggcgagagcggcggcactttttgtaccttgttagttactctggtttaatagaattatctttatgagaaattaagatttacttagtgggaattattcttggttagttcctaatcagcatatgggatcatttttcactatagtccattaaatatatagtgattgttttagtgtttagctagcactagagtagttattaattgcgtatacgcagtgtgtgggtaattaattttcagtggttgctgcgtatcccacagtacgttagaggtgactattgaggcggtgacagccctcaagagcacttaagtcctccctgtacgagtatgtagtagagcgacatatgagaacagcgggttaccagtgcctgaagtatcgtgttaggattaaaattaagctttccttagacactacttctcactaggaaatactctctaccctttgcctatctttgctttgtgtccttggatgaatctggagaacacctgagcacacacgttccctgtggaaattgataccttggaatacttccgggtgaagtgctacattggtatatccgtgcgcttacggattttatttgtaatgttaaaagataccaacactaagcatcacctaaaccaatcatatcatcaaattataccccaagctatcaatgattcgggataacaaaggatgagtacaataggtatccatccctcatgatattataaaataatgcaatttaagtagaaagcgagggatttataaattaggtacaatatgatcaatgctttgtgtatgacttgccttgctctggcgctggaggaacttctgcaaccactttgtagtaaacgggagcgtcggaactgctggattctataagccaaacaaagcaaacaagcaaaacatgctataagtctattgaaacatgaagcaaaaccatttttaatggattttagatatttttataaatttattgagacttgatgggttaatatagagcatggataaattagatacgaattttagaagttttactgtgttctgactataaacaaaaaattccttaatgatttattgcgcattaaagcctgagggctgacgtcatcaggggggggcgttcggtgccgacaggtgggtcccacatgtcagcggcacggggtgccggcgtaccatggacctggaccacgtgggtggtccaccgccggtccacaaaaccgacggcccagatctgccataagggccgattggacggcgcactagcgttgtcgggctcgagatcggctcggccagccatggcgagcacggtggcagtgcggctaagcggcggcacacggcgacggtgcaaggcgcaacaacgatgagcggcggcgcacgttcacgagcggcattgaacgacgagagagaaaaacaaagtggggtccttactggtgagcgacggcggccggagcggaaggggaggtggcaaacgcgacctggtggtcggagcaacggacggcagcggcggcgtctagtgggcaaaaacaagatggatcagggtaggggaagatgaccatggcggcaagcttcgctggccaaagatggaggagatgggaggactcaccggcaagcagcggtggtggcgctccgatgggaaatggtagcaaccaaacggtagccacggtgcagaaggagagggtgaaagcaacagtggcattggtgcagccgggcggcgactagcagcggccggaggtggagatgtggcagcggcggctaggacacggcgcggcagcggaatagggctcaggaatggtggcaaaaatagggaaaaaggtggaggaggtcctgagggggctttttaaggtggcggtgggctcagtggaggctggtggcggctagcgtggcgacggaattagggcggcggcaggataagggcacgatttctgccgattttgaaggggataagggcggtggcggttgcgacgggatggataaggatgccgcgtgcgaggggcgaggccggaagcggcatgggagcggcggtggctgttacggcggtggtggcgcgaggtcggggatgggcctgacaggtgggccccacctatcaatgtcccagcgaggggagcggacgcagctaggccacagcctcaggccggcccagccaaggaaaaatgagaaaactcaagatgtgacaacttcattcgcaaggcatcgcgaatgcattgatgctttgctattggtttaatttggttctggcctccttttatttcttctcttttttttcttcccgttccgtgatacaactcgatcgaactatccttgttgcttccactgcaagatttcaaaggacagaaaggattatatacctcccaaggtattgtactagtagtacctcccgaggctgggcgtggcacggaagcgtcggcggctgttgcggcagtggcggcgcgaggacggggacgggcatgataggtgggccccacctatcggtgtcccagcgaggggagcagacacagctgggccacggcttcaggccggcccagcaaagggggcgcgcgggggaagggaaaggagaggtgtgggccgtttccggcccacagccaaaggtgagagaggaaggaattttaattaaatttaatcccgttaattactttggattcattataattaccttgtttgctctaaaaattccactaaaaattctgtgagtgtatttaaacctgaggaactcaagaaaaattccaccatcccaattccacttattaactgcattggtaaattaatgttagctccaggttaaattaaataatttctccggttgatttattaatgaattcgagactaaggaaaaataggaaaactcagcatgtgacaacttcattcgcaaggaatcgcgaatgcattgatgctttgctattggtttaatttggttctggcctcctcttctttcttctcttttatttttttcccgttccgtgatacaactcgatcaaactatgcttgttgcttccactgcaatatttcaaaggacagaaaggattatataccttgcaaggtattgtactagtagtaccctctttttcttaaaaaaaaggcaaactaaaaatatttttcatataatttaaaatttgggttgatagcgaaatttaaaatataggtttaattcggttattaattgagtaattagctgaatggaaaacaaatggtttaaagttgtttggctgttaactatacggttttgatgattaattatatacatgaagcgtaatttaccaaagctaattgttgttggattttcggtttggtcactgttaaatatgtatgcgtgttgttagttttgcatgcaaattagagtccagaattttctacaagcgccgagggttgaagacgaaagcgtgcagtcaaagaagatcccaatagcaggcacaagtaatcggcacagagcatgcctcggtgaagccatgtcacggagcatctcctctggccggactccaatgcaatatttctttgtgtggatgtttactgattcggtcacaataacgtctataatcctatctatctatatgtcctgctatctatctatctatctatctatatctttgtgttcaagtatagcatatggcctacgcaggctacgcggcaagcatttcttcatacatattttttacttatttatttttattattatattttattctaaaatttttttatacatttagtttattttgcaattcatattgcaataatttttttattttaaattttagtttatctcaagttgtattttagatggactcttcttttaatatttcttatttttcaattctaatagttatttctaaattatattgctatatgtgtcgacgggctatacctatagacgaaatttgtagagcatgggaaagattggaaccagaatatacgcgagactatatcaagcagacaagtgacagatttgtactggttacagaagttggacgactcgcgcatatgtctggttggcatcgatgaaaagattaggatagcgtcgatcagattggattgaaagattgtttgaaagcacgaaaccaaacatacaacgaaaataaaaagaaataataataaagttactctaataatactggaaccctaaattaatcaccctaataaccaagacaccctgcacagtatgaaaccttgggtacagcaccgaaacatgaaggctacggtacacgcgcgtactatggcattgtgcatgtccggtaaaacagcaaactgatcgaccttgcacgaaaaacactataactccaccaattctattccattttatgtgaaactcgaaatataagttataaacatggcctaggttcaatttttaccaagaaacataaaaacaacagataaaattgatgagatctaattaaactctaatctaaactaaaacagaaagaagtttacttaaaacctacatcgtgatgagaagctaaccagtgaaactgcgctaggactttcggttgattatcgggtgcagggtgaatttggccatcgacgtaggcgccatctcagcgcgcgcagatggtggagttatggggtgcgtcatttgttacgccgtctcgtcacgtgcaggaagagacatggagtctgtcgctctccatctactctctgcattctaatgtactcaatgatgaactttgaagcctataatctaaactggacagtgacccacacgtgagattagttttgggctttaaaaatccatggttaaaattaatctatggtcatgatattattgttaatataatcaaaggtcacaatattgatttaatacttccaaaacctaattacaaattaataatttgacctaatagtagcaattgccgtaatataataagatattggaactatataattttaaaatataaattttgaagacaaagtcaaattacttcgaccaaaacatgacaattcataaaaaaattgaaaatatgctataaatgttgaaccatatgagacatgaatttggtagatataaagagatattgacgtgaacgtgtttgaaaacacatgcatatgaatataatttttatacacataattgagctgagtgttgcgagcagatcgcacttgcctagcatttgtatgagatcttctcaagagctaattaacatgtagattgcacatgtaagctacatattacgttcctaaatctttgaggaatacctaccagcttccgatgtggtgtggttcgaccggtctgcacactgcagccgatctgccgcctgctacaccttgctgtacgtgcctagatacatctcgtgatgctgtgctccccatcgatctactcctgcgttccccacactgtacgactcctaaatgtacgtacgatgagcaaaacaaataaaggttgagatatatgtggtgggcaaaacatagattggctaggcctgtaattaaagcagttgattggacgagctttacatgaggcccataatgttaatgccgattaaagtttataatcaatggttaagattatatgatctatcaaaattaacgatcagattttacaagttaatgcgggagctcgtagaaagtggccaattagtataagtactagtcggcaacccgcgcgatgcatgggttatcataaaaaaatagccgtaagctaaatatgatagttattttattgaaataatagaagatacctatgatggttttaattttctattattgtttcaaatttaaaaataaaattagcaaaatactgatcaaattaagattggtgtgacttcgtatttattaattttgatttggcattatttaattttaaacaattaaaaatctaagggtccgtgttatatttaatttgatgtcttatgtgacacatattctggctacttatctacggttatcatatctgcatgggctacatttataaatagcaagacatattataacttgcagctaaactgtatggtgttgagagcaaaactttccaatcatataagttttgttcaaaatgccatcattgtagaaagatgggttaaaatattacgtatacctagtgtgaatccagtcttattaattcatcatttatttgtgtattattcctaacgattacgaactgatacaaataataattgtaatttagatgacaaatataagtttgctgaactcagagtatataagcatacgaataaacatccattgtaacactgtcaaaattaaagaaatcctaggtgcacagagataagatttaaaatccgttcgtttctaatcacagatgttagctaggtttccgctttttaaactactaacgatgcattcgtgcgaaaagtgtttatatagaagtatactttacaatataaaagatacataaatctattgttcaagttaaaaataattaaaaatcaagtaattatgcactaatggtttttttgttttgcatgcctgtacttcatcttcattgacgcactactgaccggagccttacttgatctccatatttcgatttagatttgcatgaatcagtctatataacgaattgaaaaaaaaaacagacatgaagtacatatgggttaatcaatggcttaattttaattgaaactatacgtactttggtgaacgtaatagtagatttactggttggcaaatcataaaatttgtgtttgacccgaccaataatctcatcatttgaattcacagagcagcacaacacacatgtttagatgcgcgaagctccaacgctggagcaggcgcagcaagcccatgaaattaaacttcaattaaattgatagcatatatatgccactgctaacctgctaccatgcatgtccatgcctccagctcgctccatcgatgccaaggtgtacgtgttacgtgtgtagctgattctgtgtgcgtacttcttccggttaactacataatcgccgccgatcctgatggacacgtcacaccagaggctatgaaggagttcatcttggccgccgtcttagttttgggataggtctcctactggagtacttgttacattgtacgtgagatacgtacggtggttaggtaaatgaggcgtattagatgggcttaacctggcccacaacgtcgatgaatcgatctattacttaaaagctatttaattacatgatcgatggtgacgatgatacgctcgacctaatcaacggccataactttctaattaacatgagaactcgtaggaagtgcccaattagtataggtatagaggtatagatagatagatagatagatagatagatagattgatagatagattgctaaaaggaccatccctttgttgtgtaattatagttaacgtggcattttaccaaagtgttaacaatgcagaagtgtcacaaaaagtaaatgactaaatagaacacggatacatcacatatcacaaaggaagtgaaagttttattttattgttgagtaccaactgatcaccattacattagtaaagcgacacattgccaacataattacttcaagccgtgtagtgacaggcatgataaaatgctacccttattcttctcttatgcctcagcaactgcatagtgcagcagctcgttgtccctgatgagggcatcaatctcactcttcttttcctcctatgctgcattgtaattctcagtctcaccatccttttcaggattgtaattctcaagttcctgaacgtttgacttcagcttccatgcttcaaccttctctgcatctagagcttcctagactgaattcttctcatcattcaggcacggatacttggcatcaagttcattgtatgatgcttgcaactctgataaagaaacacggatcttcaccaactcgtctcttagcctatgggcctcagcatccttgtcatgcacggctttctcagccgctttcttgccaacttggatttcctctaccatccgaagcttatccttttcactttccgccaaatccttgctagcctggatttcctccaccttcctcttaagatcctccaattccttcatgattttttctttctcagcatcaaatgccttcgtagtcacctcctttgcctccatcaaagcatccaatatcttccagagacgcttaacctctgcttcagatatgctttctttctgttctgcagtagaaacatccaaccgaagtttatcattttcaccctccactaaatacttgttggcctggatttcctgcaccttcctcttaagatcctccaattcctttaagatttctgccttctcaacattaaacgcctttgcagtaacctccttttcctcctctaatgctttcaattcattcttcaggctcttaatctctacttcaaattgattatatttctgcttcgttgtcacaatatctaactgaagcacgttattttcactctccaccaaatccttcttggcctggatttccagtaccttcatctttagatcctccaattcctttaggatttctgtcttctcaacattaaacgcctttgcagtaacctccttctcctcctcgaatgcttccaattcattcttgaggctcttaacctctacttcaaattgattgtatttctgcttcaatgtcagaatatctgaccgaagcacgtcattttcactctcaaccaaatccttgttaaccagaatttcctctaccctcctcttaagatttcctgattccttcaagatttctaccttctcagcttcacatgcctttgcagctgcatccttcgcctccaccactactctcaatatctgattaagccacttaacttttgcttcagactggccatatttctcctctattgccaaaacctctgactgaagcttatcattttcaccttccactaaatccttatttgtttgcagttcctcaaacttcctcttaagatcctctagttcctttgtgatttcatcattttgagcttcacatgccttcgcagcagcctccttcgcctccgtcaatgcaaccaattccatattgagtgtctcaatctttgcttcaaacatgatttgtttttgctttgtaatcagagcttccgaccgaagcctatcattttcactctccaccaaatccttattggcctggatttcctccaacctcctcttaagatccgctgattccatcatcattttgtctttctcgtcatcaaatgtcttaacagctacctctttttccatcaccaatgcacttaattccatctggagcttcttaacctctgcttctgactggccatatttctcctttattgccaaaacatttgacagaagttcatcatttttagcttgcactaaatccttatttgtttgcagttcctcaaacttcctcttaagatcctccagttccttcatgatttcatcattttgagcttcacatgcctttgcagcagccttcttcgcctccgtcaatacaaccaattccatattgagcctctcaatctctgcttcaaacatgatctgtttttgctttgtaatcatagcctccgaccgaagcatatccttttcactctccatcaaatccttcttcgcctggatttcctccaacctcctcttaagatcctctgactccatcatcattttttctttttccttcaccaatgcacataattccatctggagcttctcgaccatatgattatatttttcctccacattcaaaaccttcaacccaagcatttcattttgacccttcaagctactctccacctcctctttctgccttgagatgacctgagcttcctgctttgtctcctccaattgcttctccactttacccttctcgtcaagcagctgggcatttttgttctccaactccgacaccctctccccaagtgtggagacctggtgcattagggtcctcctcttgtcatctgtgaagaagtatgcaacatatgttttagaggggtcttaggggagagagatgggaccacactgtgcaaaaggataaagatgatcacctttcccacccggaagcagcgatttcagcgatgacggcatgctagtcactattgccacacactcctaggtggaagatgccttgttgtctcactgtgcagcagccaaaggatgcagtatattttcctgcccctgcagaggttgcctcagagtgaatatatatacaagaggagtaggagaatgagaggatgaagtatccatgactcctccaagaggaagagggaagaagcaagggagagaagggatggagtgttggtgcagcagaggaatggagtgtcgatcgggaagagggatgggtgaatatacgttttgttttgtaagaagaaaattaaaaagggataatagattttgactatctagtgttagtagggcaagacaggattaaaattgctgccaagaaagaatcaacgtaatgcagaaggaagaaagaaacgaacaaattctcgatgggaaattaaagcagcacagatatattgttcacaagtgtcttcattcgcaaggcatcgtgaatacgttgatgctttgctattggtttaatttggttctggcctcgttttccttcttctcttttgttttcttcccgtttcgcgatacaactcgatcgaactatccttgttgcttccactgcaagattacaaaggccagaaggattatatatatacctcccaaggtattgtacttgtagtaccctcattttatttaagaaaaaggcaaactaaaaatctttttcatataatttaaaagtttgggttgatagccaaatctaaaatataggtttaatttggttattaattgagtaattagccgaatagaaaacaaatggtttaaagttgtttggctattaactatatggttttgatgattaattatatacatgcatgcgtgttgttagtttttaatgcaaattagagtccagaattttctgcaagcgccgagggttgaagacacaagcatgcaggggccaacagatgatgatgaagacaaggacagggacaggcagcgcaggagtcgtcacaagagccgctctgtgtgggattggctcgggcgcctgtcctcaagtcacagcagggagccagaaaggagagatggccagggggcgctcgcgcaaccgggagcgctctgatccacgtagcagaagcggccgttcccgagagccaagcaaggtgagaccacctctctcttcatccttcacctctcagaacaatcctgcctcagacacccttctaccctctcccaatcggcttgcctctccatgcaagcaaccaagctcggtccgcaaaccgagcccggacggggacgccactgctaccttctccgtcaaccttgccatcccggaccaggctgttcttcaagctgacaactgcttctgttcgcaggggcaggaggatgttcttaccctcccggagagccaccttgacccaatgctgcacgaggcggcggtgcagtactccatctactcgccggacacaaattccctccgtgctgtttcccctgttttcgtattttcctcttttgcagaacaggtgactcaagttcatggggcgtcggtggcaggacaggtgaacaatcaagctcaagctgcattgctggtaagccaggtgaacaatgtggaagagttcattgacaccctctcgattccgcttcagccgccgctcctgcctgctctggacgcaaatgctcgccatccaagccacgtgaaagtgacaatacctgcaatttcctcggcacaatgtcatagcgaacgcctgcttggcatgaggcgggcgggagcaaaacttgaaacttttgctcaagagatcatgtcaaaaaagtttggtataattgatgatcatgcttcctttgatgataacatcaaaaagatttacttgcagcgctacaagaaaccgttgtccccctccttcttgaagacaatcactgagctggcggagaagggaggatgcaagagcatccgcctgaaggcagcaagaaagaaggcagcgatcgcgcccctgtgagcgcgctgcatcctgaagaagtaccctgcattggccatgaagagtcccacccctcatcaaattagcttgtcttcctactgtcatctctgcatgttagttccagtcaaagatgttttgtcttcctctgcctgtgcttctcccagctttgctggttgtgtttcaagaaaggccttgttactttcaccatcaactagagtagtagttgcagcagcttctgtgcccatgtcacaagacaatgtttacttgtttaactggaatgtaagggttctgaattccaaggcgaagcaagatgcagtgaaagttattttgcaacaatatggtgccactcttgtctgtcttcaggaaactaagattgcttccatcaataatcgtattattcttaacactttgggtcaaagatttgtgcgacactatgttgccctgccggctgatggcactaggggctgttagacttgatgatataagctggcgctatggagcactgtttcaggagctctgtttcttcctcaccataccgtgcactgttcgttgcatgcaaggtgtttgttagagtctgttttatttccgttttttgaggcttggttgttaaggatcgagctgcgtcctgtaaagccggaatcgtgcgtgttcacgatgaggcgtagtgtagcgagtcgtacgctcacgttcttcgccgtgtgggatggcacatgcgcaaatggacttcatgggagtgcacagagtcggagacacgatctacatgatcgcatgatctcgttttcgctttgtataaactagaaaggtagcccgcgcattcgcgcgggcatgtaccatacgtaggataaatttgagaaacttataacggcggtataccagcgaaataatttctacaacgtttcaaaattgtggtttttttttcatgaattttcttcgttagtattgcatgatgaatttaattgttatatataaaattacctactggagattagggttagcaacttatgatacctaagagatatgactcttgaagtttcatagggaaagagagaaaacttaagttataaagacattacatatataagcatatataattaacagaaaattgataattaatttattatttgatggcatacatcgattggtcatagctatggataattactcataggaaattaagaatatgtgtccagtatagtgatacaaattagataaaatagtaaaagttatgagaaaaaataaaatattgtgcacaggataccctcaacttttacttggtttggtagaccattatttctaaccattggatattcatatgatctaacatattgtgcacggtccaactaaccaaattattcgtcttccctcaccacagacggtggatatgttaattcgtccctccggcggcatgctcgcatcatcataccaagaagaaaaaaaaaacatgccctacatgtatatgcataatacatgtaactatcttatgcccctctttttatctgagaaaaatattctacacccaacatgcatgcacaccgggatgcaccggctagctctccaatttgttcactccatggacagtatgttgctttgttctagtgattagataatttaataagcacaaataagtatgtgaaatcaatttttattagtagaatatccgtaaggacaactctacagaccccctctccccttcttcttttcttggtgtattagttggatttgagcaacgtgagatagcattcccgataattctgtgatataggtattttgggctatgagttaatgtccgactaccaagggattaaggttttccaacactcgacaccgaacacagcacaacatctcgtgcatttatccttaaaagaatatcatatctttataaaagcatcgcgattaagtaaatagcctccacatacatgttaaagaatatcatatctttataaaagcatcgcgaacgttcatgttgagagatataattaagttggttgagagtcaaaaggtccattgatgctataattaaggttaatggtttataggtatgggtccattgattttatcagaaaaaggtggatattttgatttttaatgagaactcttaggatttttttcatatggatgtgggtccataatacaataattttattagcaattaaatatagttggtatagattttaaactattgattaactaaaaaatacaatggttcaaacagatcataaattgaatatataatttaaaatttacagctattgaagaatttttttatttatttataaaacatcgcaagatcaatatgtatgagggatattatctatgtctatatttgcaagtgcatgcagtctttggagtgtgatgaaattaagttactaatatataagatattagatacccttaagctaacttaattaccttagagaaaaaaagggaagtgagcaaggaaaaagcacgcatactcttctcatatgtgtggatggaagcacgtacgtgcgttgggcggactcgtaccgccagattgatgtttagttttttttcctaaagataaatctaacggtatttgatggtaaaaaaattagattcaccagattaaataaaaccaatagttagatgttctccttttttacatagcttttctaggaattaattagagcgttctatgtcatcttaggagcgtttctaggaatatcacgtggcagttcaagagtgcttttagtatgtaatagatagatatatctatgtaggtgtgtgaaatttactttataatatatattgtcatctttattgttttgttcttattttataaagataaatataatagttgaaaatagtggatctaacgatttattaaacaaatagtgggtccaccggtttattagaacgccatgtggcggtttagaagcatttatatgatgtcacatggtgatttaggagtgtttataagaaatataatggacttttagtatataatagaagattttgctttctaactaataaagcataaaaatatgagaaggaagagttaatctaggaagacgggtgaaatatgaatcaaatatcataattaggtaagtacctatgagattaggacagaatgattagttaaatttataatggttaaaaataataggttcatcgatttaagtgtaaattgttggtgtgatattttgctttttttcacaacttttttattttttaatcttaaattagggcagagattagccgtgaaggattaattagtttaaaaatcctaatctaatcgtcaaaaataataggctcaacggtttaagtgtaaatcaattatatgaggttctgcattttacttagaaatgtttggattttattgatctaaaattatttgcttaactataaattaaatcagactcatcatgtttaccttgaattgcttgctataaaatagaaagtagagagaaggggagacacatgatatatgtgcgctacggataacatatcacaacataataaaaataataatatctgagatatatattttttttcatatataatagttagtcgtacgtgacatctacgtacgtacgcacgtttgtacatgctaggtgggcccaagattgggtgtttaagataaatctaatggttgtaaataatgggtccaccaaatttaatgaaaatcaacggttatttgttagagtgccacgtgtcgggttaggagtgtttctaggatgccacgtggcgacttaggagtgtttataggaagtttcatggacttttagtatataatagaatagatggtgatgaaatacacggaaaagctgcataagtttggcggcacaaaaacttctcgcgtgtgttcttctcttccactgttcatcgtcaagcattgtcgatttccaagggttcgtgtgtagtttgatcctgagttttgccaacatctggtatcagagccatgtcggctccgacgccgcgagtctcgcgatcgccgcgtcatcaatcccgctcgcctcctctgcgccgtggtcgtcgtcggcctggcgacgcctggcacttgggtccagtcaggcgcgtggtcaaggaggtggggggctcagccaactattcgatcctcacgaagacgaactacagtgattggtccctcttgatgagggcgatgctccaggtgcgtggcctctgggaagctgtcgacacgggtgacgtcaacttccaggaggacaggatggcgttggaggccgtcctcaaggtggtccccgctgatctgctgccggtgctctctgtcaaggagacggcgaaagacgcctgggatgccatcaagacgatgcgcgtcggcgtcgaccgcgtccgcaagtcgaaagcgcaggagctgcgcaagcagttcaatgcgatcgagttcaaggaaggggagtccgtggaggaattctccgtccggctgagtgggcttgtcaacaaccttgccgtacttgggatccagcttgaggaatcaaaggtccatgaaaaatttcttcatgttgttcctgaacatcttgagcagattgccttgtccatcgagactgctcgaccttgataccctgtcgctcgagaagctgacggggcgtctgaggaacgccgaggagcgccgtcccaagaagaagtccggcgatgagggcgacaaactgtatatcacggaagaacaatgggccgctcgcgccaaggaacggcagtccggcgagggatcgtcgcgcaagaaggcgggtaacaaccgccgacaccgcgatgggcgaaagaaaaccgagggcactgccgatggcgagcgcggtgcgcgttacacgcgcgatcaagggcgtgacaagtgcaagaactgtggccgcctcggtcactgggcgaaggactgctgccagcccaagaaacaagtcgcggcacacgtcgcacaaggtgaggaggaagatgatgagctggcgctgctgatggctcacgcggttgagctggcgccacctccaccatcgctcccaccttcaactgaaccgctcaacctcgttgagcccaaggtgttcacacacctgcactgcgatgtcgacgctggtgtttggcatctcgacaccggcgcgactaaccacatgactggcgtgcatgacatcttctccgagctcgacacggtggtgcgcggcaaggtctgttttggcgacggctcggtggtcgccattgagggccaaggcaaaatcatctttgagtgcaggaacagtgaacatcgggcgctcataggggtgtactacatccccaagctcaacgcgaacctcgtcagcctcaggcagctggatgaaaatggctgcgacatctgcatcttccatggcgtctgcacgatccgcgacgctgcgcgacagctcctcgctcgcgtgcggtgtacgcgtattcggctgtacctgatcaagatcaccgtcgctcggcctgtgtgcctctcagcacgcacgcaggaggccgcgtggctgtggcatgctcgcttcggccacctccacttcgacgcgctacggcgcctcactcaacaagacatggttcgcggccttccacagatcgaccaagttgagcagctgtgcgactgctgcgtcatctccaagcaacgacgttcgccgttccccgggcagtctctgttccgggaggaggaccgcttggagctcattcatggcgatctttgcggtcccatctcgcccgcgacgcccggcggcaagaaacactttctgctgcttgtcgacgatgcaagctgctatatgtggctcactcttctacagaacaagggggaggcggctgcggcaatcaagcactttcaagcccgcagcgaggctgagtccggctgccatctcaagctcctccaccccgacaacgggggtgagttcacctccgccgagttcgccagctactgcaccgagagcggtgtcaagcgccagctcaccccgccgtattccccccagcaaaacggtgtggtcgagcgtcgcaaccaaacgatcttggcgatggcacagtgtctgctaagggccaagtcagtgccggcatgctattggggggaggcagtcatgacggttgtctttttgctcaatcacgcgccgaccaagtgcctggtggacaagacaccctatgaggcttggttaggtcgcaagccggccgtcggtcacctacgcaccttcgggtgtctcgtgtactcaaggacgttcagccacacatcaccaagctccaggaacgcggcaagcccatggtcttcctcggctacgttgagggaactaaagcctacaaggtgttcgacccgaagtcgggtcgcgttcaagtgacgcgtgacgttgtgttcaacaagggcgctagctgggattgggatgccacagatggtatgcattcccgtcccatgtctgacttctctgttgaatacattgtcacacaggagccggaacgtgcggagtcatccatgccgacaccggccacaccgagacatggcgcggttgcgcacgacgctatgtcaccgacggcctcgctgcccaatgcgaggtcaccgagattcgtcagc

SEQ ID NO: 58015 - DNA, 10568 bp, Oryza sativa
tttggaactcacacttgtcgatagcatttctaggaattagacgcttgccaatggcattttatggattatctctctattatcagcaagcagttagcatgtactattatgttaaaggacttggattcaaaggctatattcaatgactcttcagccttcagatcatatgattatactattataaatgccttcaatcagtctagtgtgaatttggtagcgtgtacttcagaatatatatagctattgcagcaagttgatgggggactatgaattatgtaatgcctgttgatgtcagaccactccaaatgctgatcatccaacttgtttagcttcaacatcatatcatattagtcaaaagattaaaaaaaatagcaagttgatcatatcaggaccaaagaatcacaagttttttcctcaaatgtgttgcaccttccatccaacactccaccagcctattttgtagcttactgctaaaacaaggccgcagcattgagccattaaccaactactgtgtacaacctgaagaatgcctctactacctcccatcctaattcctaaaatacatttgttttttcttttccgaacaaaaacacttttaacatttaaaagacaaattaacagaaaagaaaatgatctacattcccctcatcaaacgaggggtgattggcaacaagataaagagaaatttgaatgaacacgggcggccgatcagtgacagtctgacagacaattcagagtgaacaacattctgcgtgcgtgcagttgtagcagctcaggtaaaagagagtgcggttgggtccccaactccccatccaccgtccgatcaatcttgcatggcacagatcgtgtccacaaaaataaagtagtattttttttctcgaacgcgcagtagggttgtacatcaatatattggaaaaaaagaatatttgttagacaacgcaatttgctagaccgacttatgcagcgggaaggggcagagcccactactctcccaataaaaccccaaaattagtaatgccagctaacgaccataaatggctctctgaaaggatagactgtaggacctccgagaccgaagataacgcagagtctagagtcaaaaaccttggagttccgttccttccacaattgccatgagaccaggagaatcagagaattgaagccggcatggtgatgctcagaccaagtatgtcctagacgatggccaccaatcttagaggcaactacaacggggaggagaaaataaagtagtactatccaagtgaaaattttgataacaagcccttgagttgcttatatttacagaaacaaaggaccaaagtgaaaatattcaccgccgccgttgttctggctgtgggtgtgcctccggcctccccggaggaggagatgggccgtcgggcggcggaggagcgtcggcggcggagaaccatggcgtcgcggctgccccgtccctgagatcaccggtacgcctcctgccctgacccacaattttactctcttgtcgtgggggtgcattaacatgtcatgtctcttgcacgctgtatgttcgacggaagtcctgaaccaaaaacttctttgcttgtgttatgtggcactagttgctgagcaggtgaggtgagcttcatgccctcagagttcaaatgctgtccatgtgtgcccactggtcccggaggaggaggagattagccgccgagcagcggcggcggagacgcatggagtcgcggctacccgtccctgagaatgagatcactggtgcggcttctaccctgatcctccattttactcttttgtcttgggggtcgtatctgtgtgtcatgtctcttgcacgttgtatgttcgacggaaatcctgaaccaagaacttctcgattgcttgtgtccagtctgtgtagatatagtttggttcgcaattgagcttcacacccaccgagtccagatgctttccatttgtgcccaatggtcagcatgtagtggcgcagttggtgagcctgataagaactaatacacttcaagagtatttcataggataactaactaaaggaaagacaaatcagttccatgtagcagcaaagcttgtccttgtcctgcaccgagcatattctgccctttgacagttggttaatcaaatgctatgttttctgtggtctatttgtaaaacaagtttttgagaagggctagaaatgtaaaaacttcagttgaaaagttttagtcttataaaactaaaaacgtaaacttcaatgctactactggaccgatttcatttctcaagagccattttcatgaaactgcaccttgattgtttagatgttaaggacaatttgcaagcggtaggttggcgtgttgactctgagttagtcaggacaacaaaaccaacaaggcaacaagacattccctgttcagttgttcctttaatcccatcatctacttcgctctatcaatccgaggctgcaaacaagaagctagctgtatcttttctctgaaatctgatggagaaggcggcggcagcgatggtggtagcggcagcggcgacggcggtggcggttgcgcatacccttgtattttggctcaaccgcaactcacaggttgctttcctaagtccctacctcctcaagagtcaagaccttgtaaaagttcaaaccgtgatacaaattaggaatgcttagctatgattaatcgcaggctgaaaggattctttcactggaggcagacctcaaccggcaatctgagaatacagtaagctcttacggacaaattatcactacttttatatttttattacagttcatctagttaacgtatcttccggttcatcaaagcaactctattatgggtttttagcttcaaatagttgtttttgacaagttagtgtgcgtgaaactaatgcaaatgttacccctcctctgttgaacgcctgataattttaccaagatatttacatgttactttgtcaaaaagaaaaattgcagattcaaactagtaaaaactcatgataaggtcttctatttattgcagctcaaagaaaaagaagagcatgagaaaacgagaactgagcttgaagtaaaggagaagcaacttgaagaagagagacaaaaccacacattgactgtccaaagacatggtgaagaactcgaaaggcagagcagagaattggaaagacagcgcgaagaactagaaagacagggcagagaactcaaaatgaaggacggaaaactcaataggatgaaaaccttgacaatagtttatgagaaattccgtcaatggattgagggtgaagcttcaaactccagtagtggcttcactgagttcagtcactcagaggtagacgattcaatcccaaaggaccaaaaatatcatctcgggaaaggcagttatggcatcgtttacaaggcagaacctcggggcaagactgttgctatgaagattcttgataagagtagctggcaaggagagcgggagttcaagcaagaggtgagtagccccagaaaaggtcaaatactttgtgagttagtattctatcattactactttgtgaactggaagtgggagggagtataggagaaagggcagacagagattattgggacttctttgactcatcaatttattcttgcttcatggtaatagcactaacctcattgtacagaggattctaccaaatacgggtaagatcaatctaaacaataagatgtcaaacacctaacccttatcctagaaaactaatcaaactatttaggaaataggtgacattcagaaaagggtatccttagagttgagcctgctgctgcagtaccagcgtatactgcttttgtgaggtacttatgcacagtctactttaataactgaaatgaatcacttccaattgaggtagaccatagacactgtctccaatagctcaaaaaagacgggtccaacagtttagattgcagagttcacctttttctccctggcttcacccttccaagcaaagattctagcaccatttaacttcttgcattaccttttaacaaacctaatatttatccaacgaataaatctaacatgcattattattcttaacaacaaaaattctggaaatgcaggtggggatactcaaaaggatcagacacccaaacctggtcattctcctgggagcatgcagtgagaaatttgcactcatgtatgagtttttaccttctggcacccttgaagattgcctcagtaaagaagaacgcaaggaatcattctcatgggaagagagtcagagtggcaaccagcatatgctctgctcttgtattcctccacaataccaagcctaatccaatagctcacggtgatcttaaaccaagcaacatcctcttcgatgcagaaaatgtatgcaagctcagtgattttggaatttcccgtctgttacagcacagcactgacacagtaatacctaaccatattacagaagtgccaaagggtagcggcccctatatggatcctgaattcatgagtacaggcaaactgactcctcagtcagatgtattcgctttgggtatcatattgctgcagctagtcacaggccaaagtgcaaccggcctaagaaagcatatggttgataaattggaaaggcaaaatttggggaaaatggacacacgcaggcaaaagatgatccttgagaaacttcaaatcttggatgataaattgaagttggacgacaagtttatacaggattctataaggatgctgtccctgggcctaagatgcagctataacgaaaggaaacggcgtccaaacttggaagctgaagtttggcctgagattgagtcaatgaataaatcagaatgcctctagcggtaagatgaagttgattgactggtgtccattgaaacaagtaattgctaagaagcatagcagataaatcagttcttttggttgcaaatttatatattctaaatgtgtgctggaactaactctgtactcgataaaatctccctatatgttagctgaggttcattaattatatgcagctatgcagatgaaacctcaagcctggactgtttattttgtttatgcttaatccgccggagtctgattgtccctatatgttttctgtagtcgacttacttttgtcccaactgttgattggattatttgtttatcttttttgttgttgattttcctgtttaaaaatttattttcatatgatattgcttgtcaaaacttcatatttgatcaatatagaaatttgttattgaattccagttcatgccatgcaaacaccacattttgcagagcgcatggaaccaccttgatctgtactaccaactatttcaagaatttcaataattatatgcaccgttgatcttctagctctagtaagcaccgagtgatacaataatcatcaaggaacataatacaatctcaaatgagtaaaatggatatcacctccaccattgaggtttgctgaggttcatttgatgtcgcgattccggtatttgcaaagtatggagatcgttggtactaggatatatgcgagactgaggtaaaagagacagagacgaggatttttatatagattggccgaagccggtgttgctctttattcatcataatgacaccagtacaatatttggggtagcttatctaagtgttcgacatggcggtctgaaggtctgactcgtagtcgacaacagggtagccttcctcttcgaatccgcatccggcgagatcagagacagcgctatatctctcctgacggtatccgtaggcaccgtaggggactagccatgcctatctttgaagtcgatatccggcgtcttgtcttggcgaatgttggcttgtatgttgtggcttctgttgttccgtgtatgttgattgtgtcccctctcctcctagggggtcttgtatttatacccatatgtgtccctttgtccaagtagaactagggataaggaaaccaatatggatataatccgaatagtccttgtcgtttccatgtagaactctggttgtctttccttatccggaacttcatctatatccgaggtcagtgtccctataagacatggtatgtggtgggtcctaccgagatttaatcaactactattaggtatgtggtatctataactctgacacattatatgcaactatgcagatgcttaatctagcaaaataaacaaattttggcacaatctattactaagaatctggacatgcatgcctcctgtccaattcgtacctatccagaattccagattcatagcagatatgtgatgtcccatacttttttttattataggtttgtttatttccaaactattttctgtagtaaaggtttgtttatttgagacagaggaaagactacctccatcccaaaataagtttatttttggatttctatatccaacgtttgaccgttcatattatttgaaaaaaaataaaacaatcagtcgcacacaaagcgctattcatgttttatcatctaataataataataataataatcatatttttttaaaaaataaaacaaagagtcaaactcaaacattgtatcaaaaattgaaaaataaactttttatgggacgaaggtagtaggtaataagacaagttttgatttctgggcccagagccatctttttctatctgggcctaaaagcagaagtgggccgaccaagtggtgttgttagtactgggctgcaatttgcagaggcaccggaatggtcgaggccggcggcgcagatccggcgagcggcggcggcggaagctgatggctcccttcctccggtctcccagttgcttttcccccattttctccgctgtatccgccgctcgccggcggggagggaggtccggaggaagtgaaatggcggcagtcgcagcggtagcgatgggggtcaagtcggggatagtactgcggcggcggcggcggcggcggcggtggtgagcgtggccggcactcgaggagggcgctccacgggggcatgcttgctgggtcggccatggccttggcgtctcgctcaatgggactccatggtgcgatgtggagctctctgtttctctgattcatcgcggtaaaattttcgcagctcagtccgatctcctcttttttttttcaaaaaaatatatattccggtgcatttctcctcaaatcatgaaataatgggatagggacagtaatcctagattatcgaatggagtaatggacaaacaaatcatggaagggaacagcagttttgacttttgattcaatggttttcttttttatgtaactcgaatagttttctggtatatccagatggatgagcaagtacagatccgacacctatacctgccatattcagtctgctcatgtgaaagctggacatatgattttttttttctgtgattgcttccaacaccattgcagtattacattaaaactgctttggtcatagatgcagagtgtagcaagacagctctgccagaattttttattccgtggcaaacgccatattttaggaagtgtgttaaaaataaagactcatcattcatcaaggcctctaccgcgggatgcgtggttcaattttataatcgctatatcgaattggaggtaatggaggaacttggcctatgacaacttgccagtttccagatcccagtgctgccttctcggctcaaggtcttgcctagagttctctccatctgcccgagctgtggataatacgccatgagaagctgctgaattctgaatgggtaagattgactccttttcgccatactaccgcagtttctgatgcatctgtattgcatgcttgaatcacccgctgcctggatttttcttgtagctgccagcaacagattgcatgaaaaatataacatgcttgcttttcactggctctgtttgtgcagtcagagttcgaaatagcagctgcttggttactggttaggaagagttttcttagtagttacagttttttgcaggtcaaaagcagagcacacattgtcaacaccattttaactgacacaagattgtcaggaaatcataacaaggtccaaatagatagataaacattgctgtggaccgcagcaaggttgccaagcacaagctgaagcaggtacacccatcgtttgctctactcattggctaattggctagaaagtgctacatagatttgtgtagattgtgtcatcataagctaatttgtccattctatccaaagaattgtagcttactgttactgactactgatcaagagaaggatcaaaccgtatagtgaatgaaatgcacaagcaagaagcctcactgtatataaatatttttaaatatggccactaatatattttcagatttctagggcaggtcatggaaaacctcactgtatttatcttctacctagaaaagcagttatattttgggacggagagagtatttcactaatcaataataagttgaactataaaggtaactatattttgggacgaagagaatatttcattaagcaataataagttctccactttcaaatattgattattcgttagcaccaccacccatctcatcccatacaggcctgtgaagcatgtaaatcttgttacaatggtccagtatagcattgtcagcataagttcatgacccttcattgcacttgttatatattctgtaacctatatttctgatgaagtttctctataagtttaatttgccagggtctgcggttaattttgactacacacttttctgtgggaaaactaaaaatgagtcctggtgctcttattgcaaactttcttatcaaatggaatctggagagctatgtcttgcttcgcatccgagtcataatgggaatcctcaccatcctctatctgatgttcttcttctcaagccttttcttcacccgtatatacagatccatggtgaacttcctggatcctgtggctgacgccacccttgtatacattatgggggctatgcaagctgcacctttaaataaccagctgttcccagtctgggcccttatactggttggtctccgctctagcatccatggccgctctagttctggaatgttttttgagctgagaaatgtgttgaagcttttagttgtggcatacatgaatttaacacgtggctccaaattgtggcgttttccattttggttcttttggggtcttctggtacttcagtgcttctacaagattctggtgcgccatatagcatccaagtccttgtggaatggtcgtagttcagaacttcttcaggagtacatgggtgccaatggtaacaagagcaactttaatcctgaaatatgcaacccagagactatggaaggatacaagtacttggtttatggagagttacagaaaagccgaaagagtgcacacattctaaaagttgaagacttgaagtccctagttaccttggacaagatttggcgatgtgatagtgccttgctgctaacctccatcaacatgcaggggaacaacatgaaggacatggccctggcatttgcattatctcggttgctccggtgtaggctggaaggagcaacgttgcatgaagctactgtttccatgacccgaaagctaatcagcaagatgatcctctcagatagtgctgacaaggtactgttcggtatcctggagctggatgtcaggttcctccgggattccctccactccagttatcctatggtcttctgcagagggcttctttcgctcttcttcactcttctgctgtctttggtgaagtttttcatggctacatggctttttgtagatgtcaatatggtgcatgtcccaaaatcagtacgagacaggccctcgggcccgttttagttattcgctgcactcatttggttacgattcaggtatcactgcagcagccatgtacatagtaatgattgatgagatttttaggatgctcgggtacttcctatcaaggtgggcaaaactaatagccatgtgcaactttgtgaatttcagaaacagatggctgaaatatgtcattgtgaatacacctgccagatatggggaaagaactatagttatacaccagcatgccttcctgcaaacgttcagctcaagcatctcggggtggaaaatattctcttgtattttagaaagaaatcaaaatgcaagaatggtttggtcagaaggaaaaatgaatgacagtatggccaagaatgtgaaggcagcagtaattcaagcactccgctccatggatctcgagggtcatcttttgtcaagagacctccctttgtctcgtgtcagtgacagagcagagcgttattggttggcatgccttgcagaggtaccaacatgctcccgtgttattctggtctggcacatcgcaacaagcctatgtgagatcaagcttgccaatgaccataaaatcaacttaacaacaatgtcaagattatcatcgtttctggtggatgaaaaagctcttacaggtgagcttcaaaaggcatacacagtgtcaaattgcttatcatggtactgtatgtacctgctggcttcaaagcccaaactgctcccagaaaccattttgatgtccaagaaggcctttcaagatgctgttcagtgtgctcatgaaatgctcagtgattgtcactcctggcagagcatatacaa

SEQ ID NO: 58016 - DNA, 6275 bp, Oryza sativa
ccgcttaggagattacactacacaaaatgcttgattatttctgttggccgtgataacataccttggcaatggatgcaacaaaatagaacgtcccttgaaaccctggagatactgaaaccagaggtgaagcttttagtaaataacctttgctctctcaagagattggaatttgatacaactcatcgtttccttgagtttcccattctgccatcttctctggagtctttcattattagaagatgtaatccagagttgttggcacgctggaaaaggaaagatagttctgaatgggacaggatttcactcatccgccatatgagaataggtatgccttgcttttgcatctatccttgtcatcatctcctgcaatctaatggtcacttggtcagtcctagagatgttattcgtatgttactttgtttttccttctagcaaaattttaagtttgtttttcacatgttaaccaaaacgatcccctgttagaatctgatttgggctgtatctcctgccaagctgactgtaagttaatctacaggagatgcatactacaatttcgggaaaccagcggacaaattttatagctgtgattcttcagaagacaagacaagaaataggtatgtgagacacgtactacagtttcagggaaccagctgaccaactttatagccgtgattctacaaaagagaagataagaaataggtacttgttctacatctttcacaatagatcagaaattcgtcaattctgatactccattattattactaatctatttcactggcactctacagattagtgaagtccaagatgtaagcccctactgtgtgcaagacccagttagaagacagttttattagtgtgactggctgtgaataccttaactgtgccaatggattcttcagaactacagtcagttccacatattttatagaaatatctgcaaggattcgaggccagtgtcttgtttctcagtctcatgaatgtgaatcacatgtggaattaaaggatggaaatgcacacacaaaaaaatgcaatgacatgttcatccgttcatgccgttccttgtcggtaaacaagcttgattgttcagtagtagcctctcaaagtaaaatggccaaccagtattgaactgaaagtcatccaggaaaagctgatcgatctcttattttagagctctagttgatatgtgtgaacattgttaatttcgcttctttttcttcaatattagtgagtttcatctgatcgatgaattttatttttatcttaattttatgaggttgtctaatatcatattagacacatgtgagtgtttttctttttttgaagaattgttatgatgtggttttatatggaggttttggtattcactgtctgtttataaaataatccttgcttgaaacatcaccactcctctatgtttaggaaaattcactgtatatctctgaaactttgtcaaatactaccttatatgtccctgaattttgcgacattagagagcttaataagcacctcgctaacggctgcagaacgccgaggtctgtgacgagaagctccagatgctccggaggctcgtagtccctcgccggcgcctcgacgtccacgctcggtgtcaccggcgcaccgcccaagtccgccgttcgatcatctcgttgttgcttgacgtccttctgccccaatgtatgcaacctcgcaaactacacgcaaaaattcatgttcaaataaaaaaaaatcaagttgagttcaaaaattcaggttcaattcagatcagaattcatgtcagggacacgaatggacgagttggattatattttcacctttgtagctttcggttgccactcgggcttacccatggcgcgaggctaccactctaccagcgagacctggaacgtggatatgcaagcatgataacttatttgaggatgaggcggcgcagaagggcgatcgtgcgaggcggctagggtttagtgtcggttggcaaaatccatgccgtctgtttttatctacgatcgcacaggagtggaagggccagcacagcgggacacgtggacatccagatcgagcctagcggtagaacggatggtcgacggttgcagggattaatgtgtaattaattgaaagagtaaggacttctttgcaaaaacatcgctgaaattctcagcaatctcacgcggtctagagaggttaatataatatatatggttatcatatatatacatataccgttaaattgttttagaattttcatgaaattttagcctgattaattcagttttactgatttaagtatgggtagttaaaaaagataatgaatatagatatcaacttgttggtattttactttgaattaagaattaaatagaattagttgcttggatcatcaataggtagccactgttgcacttgagtccggctaaccatggactcacgagtcagtggcggatgtatcctttggggtttgttagggctggagctccacctccacagtgacagcaacccctccccccctcccccctcgggcggctcaaatcctggcccattcactactataaaaaaacgtttttccatgcagccaaaacacgttttcgtaggtggccaaaccttccgactgtatctaaaggcctgtcaaaatcctcaatttttactggcggaccaaagcactgctcgcaggcagcagtttcaatcttcccaggcgttgcttgcgaaaatactcttggcgccaaaaaaatttcccgccagccccgccccctccctagggtttcaaatcacaaattctcttaaatctcatccaggaaacaaaatccaatcataaacatccatacatcaacacaagagcattggattcaaatccatagcatcaacttgcaaattaacatcaatcaacatgtaaactaaaaaaaacaacgtcgtcgttaccggcaaactcctccgtgcctcctccgctaccgcacgcaacggcagatccggccggagggaggggacagccgcgccgccgccgctgctgccctccccctctggcgggatctaggagggagaggaaaatgggggagggggggccctccaagcgttgccgttgcatgcggtgaccgccgtcaccgccctccccactccggccggatcagggagggagggaggtgtccgccgccaccaccgccctcctttctcctcgtaggggccggatctgggagagggaggggaggggagccgccacggcgttgttgtcgccctcgtccgcgctgccgtcgccgtctctcctcctcctccggccagatctaggagcgggaagagagaaagggggagctgccactgccgtcgctcctcctcccctggccagatctaggagcggagagggagagagagggagtcgtcgcaccgtcatcgccctcccctcctccggtcggattgggagggagggagggagggaaggggaaagtgaggttgagaggtggagatagaggggcggggagaacggagtgagcgtaccgtgtgagatgagggagggagtaatatgggagtacgtaagtgtgggcgatttttataagttattatttttttaggcggacgtcttaaggtcctgcctgcaaaaataacaataatctcgtcctatgaaaaatccaacaaataagaacaacatgtcaagacacgttttagatcctagtgaaactgtttatttgtgattataattggaattataatgctaaactctatatttaatttgatctgcaggtcattgatgcatttttatgtgtttatgccatcgtatttgattaacaagtaccgacagttgattccttagtttattttttcttttctatatacaaaatttaaattatatttgcatgagaccgacaaatgtatattttttaaatgtttttattgcattgtgggttggacataggatattaggagcacctcctctattttcatcctagattcaccactgttacaagtcacgtacagagaaactggttgatgaacgggagataggtcgactgaaaacagaggcactattctcaatcaatgttgtaaaaaagtcagaatatgggttacatgctcaaactattgcacaactaactattattcaaagtagttctataccaaaataccatagtgcatagacaaatcattggcttgtctggaaacctatcgctgaaagcacaaacgtaaagcatgtatatgcctagtagcttacttgggttgtgacctataggcccacatatcaagtagaaaatattttcggctcgatcattaaacgtcttaattgggtcattaactgctaatcaactttgaattaattggccattttggtttttatgcaccaaaacatgttccaaactgcagtcggatgaaaaagagatgagaagtcgaaaaaatgaaacggaccacgtacgacaaaaacgatatcaatgtttataataggtaaatgatatggggatggagtgatatggcgagggagcgatctgattaaaaaaattaacggaaagttagattagattttttattttctattttcagggtcggtatatcagaggacaactaaaacactacgaaatttttaattaggtaaagatttgctttcacattatttcattctctcgggctcatttcttgtccaggctaccaaaaaaataataaaccctctcatatgcctgatgaggtaaaattttccatagattcttttacacacattcatgttatttttttttctcatgctcatcactcagggcaccaatgcaaccaaatgcccctacgaatgtggacttttacggtacaatatactgctaatatatacagcaagtatacaggatctatcggtgtagattgatttgattttttagttaatcagattgcagtataaaatttgaaagggtaattttatcttttctttgttattctatcatcaaatcgtactatcatcacgtgtttcgtcatcaaatgatgctcaggatgctcctgccctagtgcacgataagatccaggactagatactctcaattagagtcaatctgaacaaaaagattactgaagtgtattttttattttctatcaaatttctaacttgctcgataccagatgatggagcataaaaatacaacttagcctgaaatgttggtttcggaaagatggaataccggaatgatcgaaatgctgtatttcctcaaaacaccagcgctcactgaaagaagtgcaaaatggacgtttaagaactgttttccttgctaggtctctggctctcaccgctcctcatgctgactgttccaatgtcaacttgcatgacagctttgcgctacgcctcaatctcaatgtcaacttaatttacagctttgtgctaatatatcaatgcctccaacaatgcttcaataatgtcaacttgacaggtttgtgctgatcaacgcctcaatatatattaatgtcaacagttgcaataattataaactcgatgaacaggaataattgttgtactattgtttcagtaggtaaatcaaatggagttagactaatttggctgtgttctgcttttgcaacttcctcgatcgtttactatgagcacactttctaaattattaaacgatgtatttaaaaaaatgttttgtataattttttttaaaaatcaaataaacatattccctactggagaaaccatctttgttgggttggccaaaaaccacaatagccccagtttgaatagaaaccgacactaaagatggttttttttcccggtttaaaactctatcagccctagatgatatttaggctaaccgggactaaaggtcatctttagttccggtttatttattgtcagaggaggactaagacttatcctcccaagtcccaaactcctcatctcctatttctactctctctcttatccttttctttgctgatcttatcctctccttcctttcactagctaaaacgtgaggattaattttagaaatttatttaaaataaagagtaaagtccatcaccggtccctaaacttgtaccactatgtcatccctgtccctaaactcgcaaatcgattgttcaggtcctcaaacttgtttgactgtgtcatcccggtccttaaacttgcagatcactcgtttagctccaacttatttagttgtgtcaccccggtccctaaacaggacggtctaaaaactttatattaaaaaataattcataactttttcatgtgaactctaatgaagacaaactttatatcaaaattatagtctttgacgcgacttacaactttgtagttgaaaagtttttgaattaaaactgtttaggtc

SEQ ID NO: 58017 - DNA, 8495 bp, Oryza sativa
atgtttgctaaatgctgcttttgcaaatgcaaccctattatgccatcctttgttatcctgtgcacttgcatatttgctgcgtggcttgctgagtatgtcatatactcaccttgcaatcattcatcagaggaagagttctacaatgaggctgatggtgtggaggattagatgtagccttggtcaagctgcctgtggagtggagccgtctacgccgtttatttattttccgctacttagatttttattgattgagagggactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacagagccagcggccggagagggtggaggagatgcccaagatcacccagaggtgtgaggccctccgcccgctctttagatttcgtagttttcttttggcgtttgccatggagggcgaacgatgtgaatttgggcgatggccctctccctttcgtattgtagccgaaaacggcatttttaatatatgaaatagatgacccaagtttagccaactattatgtttgatgcctttggtgcatatgcttgcattgtttcacatacgaaagggtgtttacccttttcgccaactttgtgtgttttgctgagtcttaactttgcgctttgccatttaccctttctatactgtcttagcagggtcttcgccgaaaattttgtgttcggccccccttgggaattggcgaagtaaaaacgagaagttcgtggcggtgaagggtttgccgaaggtccggtgtccgtttcagcctttttaccacgagatgataataaacggcaacagttacaatgttttgaaagttaccggctggatgcgggcgcaccccgggcgaaccctggacgactacgacagtgtccatgtggaacgtctagaggacatggttcgcttttggtgaaaccaccggaggacggatcgtcgggaagcgatcgcccagcgccgttatagtttagtttgtgtttcgcccccttctcctcttagggttgtgtataacattagtagtgatgacgaaccgagttcgccgaatcattccttagggagtggtgggtgttttgggggcgaagatgtaatttttttgtaagctaggctgtaaagcccgttactttctttcacctgtaccatgttgtatggcatgcactctttgatattttttgaagttaataaagatgtatttcatttcctttctgctattgttcgcatagtcacctttcgtgctttcgttaggtcgaaacatgtcggcccccttgcgtatattagcgaaataggtctgctaacatttcagctttcgacttccgctttcgatctgtggtattccgcgccaagagaagcgcttgcgttttttcacatgaatcgaatataacggtgttcggttatttacttcccgaaacaagctgtcgcggtttcaacgtttggcgagcgatgcttcggccgattcgtttcgcccccttagcgttttcgctgatcgggcatttgccttggggtttttccacgaactatcattcacacaagtaaaaaaagcgaaagacacaagaattttatattggttcgggcctccaggatggataatagtctgacatctagtttttttcttttttcattttcctctttttttgcatttttgtgccgaagggcttacataacgagaggtgccgaaagtcctatacaatagtatgtacatttttacaagttaacgaatgaggtgccaccccttctaaacatagaagcgcttaagagaagcagcgttccaggagtggtcgaactcttcgccttccagcgtcgccaagcgataggagcccgtcctggacctgtgcttgatgaggtatggtccttcccactttgattcaagcttcccgaccgccaccgggttcgccttctttcttaggacaaggtggccaggcaatagctctgtcggtcgaacttttttgttgtaagtcaccgaagtgcttgtggcttagttgcgcatgtgttctagcgcttcgactctcaccccttcgaggagttcaagtgacacctcgcgcccatcttcgcctccagagaacatcactcttggcgaattagcccctagctctgttggggtcattgcatcgtcaccatagagaagcatgaacgggctgaacttggttggccttgtgggggtcgtccgaagggcctagagaatagatagcatttcgttaggccatttacccttcgctgccccctcaagcattttcttgagcgcctcaaggatcttaccattcgcacgttcggccgccccatttgactgtgggtgagcgactgaagcgaacctgatttccaggtttagcccctcgcacatttctctgaatttgtcagaatcgaattgcttgccgttgttagtgatgaattcttttggcactctgaaacggcaaacaatgttcttccacacaaacttctatactgttgccgaagtgatcgcgccgagtggttcggcctcgatccaacgggagaagtattcaatggctacaattgcaaacttgtacccatttcatgccacagggaaagggccaatgatgtctagcccccatctggcgaaaggccagacaggtgcgataggttgcagttcgtactagggtgctgtttagcttcggctatgccgctgacagctttcgcacttcttgacttgctcaacacaaactttcagcacggtgggccaatacacaccctgacgaaacactttggaagcgaccgttcttgctgcctgatgtgcaccgcatagctcttggtgtatttcttttgccatatcctcacctttggcgaaggagatgcagcgaagcaagggttggagcacatcgaagcgatacagctgcccagagaccagcttgtatcttgcggctcggagctataggcgtgcttcgcttctgcttcgtcctccaggagccaatcgttcttgaggtacttcatgaacggtgttcgccagttctctgggtcttcgcccagttctgcctggtcgattgccatgatgtccaggctctctttgggcacacttggtgcgtacaagacttcgaagtggatgcctggcgaatgtgggcctccacaggcagcggatttcgccagggcgtcggcttcttcgttctggcctctaggtaggtgtaacgccccgattttcgttagggattaaaaatcattaaataatgcatttgacaaaaaataaataaaaatttaagcaatttaatcaagtgaaatagtgagggaattaaaattttctcccttaaaaatcattggccgaggatattttgtaatattctttgtgccctaaatattccccgaaattttcccgtgaattttcggagctaaagaagtaattttaacatcacaaagttcattgaatcaattaaataaaaagaaaaacaaattaaaaatcggttccccactacctcgtccacctcttcccccacttttccccaattttcggcgccgtttcgtgccccatctccacccacgttgagctccatgtcgccggccgttgccgcccaaattcaccactccccggcctccccgttgctccctcgcgctataaaaagcctccccgtgctttcctctttcgtttccccctcctcgccgagctcctcacgccctctcccatgctccccgcgcaccacctctctccgccgtcgccggcgagctccggccgcctctaaccgccactctcgccgccgccgcgctgcgccgccaccgctgtcggtcgccgtgccgaactccaccccagcctccactcctttttcccccttccaccccgaaacgctgccaccacgtgcaccacctctctccaccaccgttgccgactccagccggccgccaccgccgcttccgtcgccgtcgcgtcctgccgcttgcgctgctagcttcgcaacgccgcgctccaccccggcaacccctcctttccccaaaacatcgccgtagcactgcttcccccatcaacccgagctccaccaccgcctgtagcctccagccgcgcaccgcgccgccttcgtcactcgcttcgtagcgctgaggagcacctcggttgctgtttttcaccgccggaaccccgccaaaacatgttttcccgtcgccggtgagtatcttctttctttttcctcttcggccggccatactcacgcctcctcccttttccctaatccctccaatcgcttccccaggtgtagccgcccctcggcctcccctcctccttcgttggaagcggtcgaatcgccgtcgccgttgtcttcctccataccagctgccgcttccggtgaggatccctcctcccttcttcctttcccatccccttccttgctagctgccgcctctcggccgcttgccgtcgttccgcgcctccggtggctgtgcgctgctgtcacaccccgaagttctttcccaagcctaaattgaagttataaatggtctcaagaaaataccagtgtaaagcaagagtaaaccctaataaattaatgcgaatggtaatcggatttggcatgtggaatttttcttgagttctacatgtcgaaatacgctaacaagatttttagtggaattttcagatctctcgaaataattttaaccaattaaaaatgaccacaagcaatatttaatcccaggaaaatcctttttccttctttttcctttttctttctttttcttttctctttttcctttgaaatgggccgccggcccattcttctttttcttccccctcctcccactgggccggccgaaggccgaggcccagctaagcccgcgcgagccggccgcccgcctcctctcacccggggtcgccgacaggtggggcccagctgtcgggcccgtcgcccacctcacgcccgcgccgccgcgccaacaaccgctgccgcgcccacgtcggccacgcccgtgcatgcgccgcgtctcccgcacccacttccccctctctcccgcccgcgccctccccactccccacgtcggccggcgaatcccgcccctaccggccacatccgagttccccctccccaatttaagctccgccgccaccccccctctctttttccccatctcgccgaactcactcatgctccccatcgctcccgcgccgtgcacccatccgtcgctgccgctcccgctactccagccaccgctagccgtcgctagactcgccgccgcaccgcaccgtcgccgccgtcgggttcgcgtggccaaggtccacaccgtccacacctcctccgtcgaggtccgtcgccggagcccgcatcccctcacactccggtgagcaccacctctaccgccgccttcggacatggtttccgctcgccgtggtccacccctctccctctaatctctctcttttcctctcttagggcatctcggagctcgtccgcccgccgccgttgtcctcccgtggctttccgtcgacgttcgccgtcgtcctcctccgcgccggccactctcggtgaggcattccccctcctctattcccctccctctccctcctagccgcgccgggttgagccgccgccccggtcgtgcgccgccacccttgccatggccggccggcctactttgtgccgagccgagccgagccaggtcgccgccgcaccgtccgatcggccccggcccgatgcgggcagtcgatcccgtggaccggaggtggaccaccagcgtggtcccggtccacggtagaccggccaccccgtgcgcctctgacatgtgggccccgcctgtcggcgccgaccccccctgatgacgtcagccctggggcttgttgttatagtaataaacacagagaatcttctaaaaatcataactaattcatccgagctccgtttaagcccgttcaagtctcagtaaatcaagaaaaatgtgtagaatccattaaaaatggttttgttctctgtttcagtagtcttatagccgatttggattgtttgctttgtatgtcgcttagattccggctctcccggcgctccggtgtacttcgaaatagtcgccgaggttcctccagtagcagagcaaggcaagtcatgcttgtcacttgaacatgttgatcctatattgcaaatgctctattgtttttcttcaaatactgcattggtttataatgttactatgggatgtttacctattgtcatagccatgctatttttgtaccatgttcctttgttagcttgggttataacatgagtagacactgggctagggactgcttagccatgcttagttcaactagcacacaatgagggaaatcctattaatgtttagactgtaggttctaatggtaatgttggattagtgataccgcttcggtgttggttaattaaaataaatcacatggtgggctgtgggtgcatggttttgttggtcgcacccatggcaattaaggaccggttcgcgggatgccctggaagaacttatcgtacttaccacaagccagcatgggcaacggctgggcttgtagtgtagctttcctctagctgacgcatccaggcaagggtgggcgtgatggagtttggatgggccatgcgacggcctatgcggcttccggattcacctaggcacgagagggggctgcccgctgccttgcgaggagtgggggtgaaacctgaggtgtggtgtgcttggttagagggggttatgcgaatggtcctgtcacggcctctttccggtatgttgtggtggcatgtcggtgcacggtaacgtgtcgtggggctgtgtcttgtgggtacagttgtacacctctgattagagtaaaactattcaaatagccgtacccgcggttatgggcggtcaaccagattcaccatgactagtctcaccctagtttagttttatgaagtggattagtgcaggtggatggttgggcctgttgcaacatggtgtagtgttggacagtggatggttaatattgattaattattacaactgttttactgctttcaactattgtttataaaggctcgttttatgcaaatgaatcgctctagctactctttgagtttatcctgcatcataccctccgttccggtatgacttgctgtcacatcctgatttttgtttcaggatttataaattatttaataaattattattagaatttatattaaatgttcattaatttacaaatgaagttaaatgtgggaaataaaatttcctaaatataaagcatggatggatttaatttttattaaattctccatggttaattatactctctggaatattctcggatttttcggagctcaattcctaattttaatcatacaaagagcatttcagtaattacccacatattaaattaatcattaaatggtctgattataattttgctaagtacttttagtgtccaagtattttcaggatttttcttgaaattatttgagcgttggaagtatttttaacaattcaaagatcattttagtgattattttaattgaaaaagttttaaaagccctcccttaagtcgttgggccgaattcggcccaacactccctctctcccgcgcggccgagccggcccaaaaccggcccgagtcggctcaagccgagccgcccgccccctcctctctcaggcgccgacatgtggggcccacatgtcggttgcttctcctacctccggccggccggccatgcctagcccgagccgccgccttgccgcctcaaatccgcacccaatccggccccgtttcttccggatttttgaggggttttgatcctctcgttctcctctatcctttcccctaagaatcggagcaaaccgttgagtattttatccgaatcgaactcgtttttgagtttatctccaaaaccgagtttttgatttcccggatcgatttcttgcgggaggagtccgatctcttcaatccaaggctataaataggaccccctagtcctcctctttcgtttgccccctctcccgtcctctcccgtgacccgtagagccgtcgccgcgtgaaaccatccgccgccgccgccggccgggttgcagccgcgccgagcagccttctccgccgtcgccgccgcttgccgccatcacctttaggtgcgccaagccgtggggaagctcggccgcccgttccccttcgccgccggccaccggagcccctccgccgccggtcaaccgagccgccgccgtcgcccctctcgttgccggtcgtcgtccgacgtcgtttgtcgttgtggtgagtaccgttgggttcgtctcgtcgtcctctacgtgtacatgccctcctttttcccggccgaccaccctagctcctgcgaggtcgccatctgagccggccgccacacatcatcatcttctccttttccagttttttctaatagatgaaatcttcggaaaatcataactaaataaccgtagatccgtttcaggtggttcaagttgctaaatttttctaaaatcaagatct

SEQ ID NO: 58018 - DNA, 7544 bp, Oryza sativa
gcttgcttaaggatttgatatatctataatatcatatatgctgttgcttgtgttcatttttatgtaattctgtattgttgtggctggtggtagtaacttttggttaattcggctaaaaccgaaaccaaaattaaaaaaccgaaaccgaattttgcggttttcagttttttggagaaccgatcgggtggtgaagcctgtaaaccgaattttatagcaaccgaataaaccgaaccgaattgtcggtttaaaccgaacgcccaggttgagtctgttttcaactcagaatccataatatttctcaggatttcactttgctgcgatggagttctcttgtagaaccacttagcatctcccagatagtagagcacacgttttcttaagccctttgcatctagatccccagtaactagctgcagcaatacgatgcccaaagctgctacatatccaactgaatcttgcaaggctcagtgataagccgtccaaattctttcgaatacagataacacattccgagatcactgagtaagcacgcatttcctggcctgaagatgatgttgcttggtttcaggtccccgtgaatgatcggcttgggctttctgctgtggaggaacatgaggccggagcatatactgacggcggcaaaagcaatggcaaagccagcctgagtgcctgacgtccagccaccagctcgctgaagcagcagcaaggcaagtatcaacgaatttggatgggctgagctaggctagtagagtgatggcccaatgggggctgatggtgtagatgagccaagcgcatggctagaaaaatcagattaaagaacaattcgaaaacacagcagcaaacatgtatttttgtcacaaatctgtagagcaggaatcttaacaaacctccttttaaatttttcactagaaaactaagcacaatagatatatcaatcattatatttatcaaatcaaattattggttgtattgggtgttatatttttcgccgggcgtgttggctgttatattaatcgatcaaatacaattatgtgtttagggctagaatcataattgtttttcaagaccacagtgagtaataattgagtcgtagttacaaggtttcagatccaatgtcaatcgagattattaactggtggtgcactaggtacaggaaatgttaattcaagagttgaacttaacaacaatagattacatagaagtccaatgacatgttcttttccatttcttgaagaaaccatatattggccaacctcctcatcacacagtacttgaagccgtcaccacttaagtatgagaggcactacttcttcattgactcaatctggggcaaaacttctgtggcgaggcttggatgatttttcgatattggatcgctgcacctcaatcccaagaataacatcctggcaacatcttctgatgttctgtctgttttcaactcaagattcacaatcttctctaggatttttctttgctgcgatgaagttttcttgtagaaccccttagcatctcccagatagtagatcacacgttctcttaaaccatttgcatctagtttccctgtaactagctgaagcaacacgatgcccagagcagatacatccaactgaatcttgcaagggtcagtgataagccgtccaaattctttcgaatacagataacacattccgaaatcgctgagcatgcatgcatttcctggcctgaatatgatgttgcttggtttcaggtcaccgtgaatgatcggcttgggctttctgctatggaggaacatgaggccggagcatatactggcggcggatttcactctgatttcccatgtgagatacttgaggtgactttccagtgtgttgttttctctgaatcggtaaacgattgcccttttctctatgcatgctcctaagaaaggaaccacattcggatgactgatatttctgaggatttcaatctgcattttcagaactagtgtgagaaatgaagcaatacacagtggttctatcttgcattttcagaggtactgttagaaatcaacagggtgtataatgtattaatggtgtcattggttttctatactttggaatgcaaaacttcagtcgcttttggtggtgtttgatgaacttatgtttgaacatagtgcagagaaagttatgtgttcaacgaaacttaccgcttgatgaaactcttgcatcaaaatccattctggtagtgttcctttgggaacagttgtagcaatatccattccatcaaaatctgaccgatacacattatatgtagctgttccacggagccacttcgctcgtttgctgactgcagcatctatttctgaaggtttgaacacaatgaacttatttccgccacttgagcgagaagctttgttcttgttcgcctgttcaaggtattgctgcaaggaccatgttagaacaaggaacattgatgaacaattgaacatcattttctttcttaatattgccgactgatagtgtctgatgcatgagcaaggtatattacaatgtaacatcatcgtttgaagagcaatacttacttgtgcagcagtgactacacaaacgacaatgattgtaacaatcgccaaggtgaccatgacagcaccaagaaggatgaaggtcgcaacagcactgatggcgccaacaacgacgacaacaatgccaacagcaacgtccataggcttttcctctgcttgctgatgaggattcttttgaaccttcgctttctcccttgtcaccaaccatgatcgtagatttcagcaaacatggccaaacgaagtgttcaagtgaaacaagaatgaaagagtccagattggcaccatcttgtgccggttctttaaaaaaaaaaaacattctccagattcaccttacctttttactggttgagcagctgcaggattttggtggcctcctcctccaaccatggctggtaaacaggttgcaaacgcttgatctctgcagattttagattgagtaactggatagcaggtcaatcaaatgactgcaggtatgagatgaaaagtaactggttatgagcgagcaatgctggtgttgccggtcgctggttatatatatgccatgggcagaagccagaaccagaaggttgtccgtgataaacaacaggcgctgccaaagcagcttgactgatgggaggtacgaggtctttttgttcgtgtttctgcagtggtatacggcacattcttcaggttgaagttgatcaatgcagcatgctgtttcacttttaaattagtttttgtagtgggtgatggaaggcatacacgtcaggagtctcctgtgcattgctttccgtcaacttgatctgtgtctttggttataatactggggctaaacgcgtgagatgatttggatgttggagtggttatctggtagaatagtcattgtctaaaaaaagacgagtagaatggtattgatagacattacatagtcctaccaatctagtatcacgcgtcagaaatggcatccccctatcaacttgctaataatatactgatgattatattaaattctcaacttgctaaattgtactactgattgtagtttcattttcgttataataaactgagtagtagtagtagtaagaataatagcataagcttgagtcagtgatcatggaggagtttgtaccttttactgctgacgagtcgcaataaacatcaccacttttctgctctcaatttccaatggtttttgaattccagcaatgcaattaagaatgtaaagatcactcgagcctgacaaactggaaaaaaaaaaaagacaatgtaacattacctcgctcgatgcaaattctttatgctgatggcaaggcttcaaaacacaactttgatgactcttaacaagcaacgaaacgcagcgcagcagagaggcatttcgtcgagcaggttgcagaccagaaatgctccgtcgagagattgaccagccaagcagagtcaagaggaggccaactagatcggtggctgggcgatggagtagcttgcaccccgtgcacccgggaggcggcggcgcaccggccggcggccggccacgccgtcttacgacggcgctgctgcagttcgcgcgccgtggcgaccattaccaaccatatgcatttgcttccggcttcccgtgctctgttcgatcggaaaagttgcacttccagcgaacggaaggcggcgagggacggcgagtccggccggcggggatcggtgacgtggcaatgcccgccattgcccattggcgacgcgagaccggccgccgccgctgcctcgctagcgggaggaagaggttgcagaccacaaatgctccgttggattcacaaaatttcaatggtggcgatcattagaagggcatatttgcgagaaaattgcaatattgggatagcaaacattggggatttactgttttgacactctgagcggatgacaaatgggcccatctgtgtctatgaaatgtgggtccagtgtcattatagcaaagggcctaatgggctactttgttcgccgcgagccggcccagctcaatatgggaggcccaccaattgtcatctttgaaactgttagcattttgtttttttgaaaaagtccaaatacccccgtaaactttgaatgaaagttcatctaacaccgtaaactttaaaactgaacatctaacctcctgaactctgtaaaatcgttcatattacccactaaagtggttctggatgatggttttacatattttgaaagcttaaactcacaactttaaataactaatatatcatatttgcatatcattagttgtaagtcatcaatttatatatatacagtgataccatcctattattatattggtacttgtttgtaagtaagagctaacaagtggtaaaagaaagatttaagtggagattgtaatatatatgttcaatgtatatgccatgtgatcaaacttatccaatttatatacaaagataaaaatcattatacaaaaccaccttagagagtaatatgaatggttttgcaaagttccgagagttggatgtccggttttacagtttagggtgctagacagacttctatctaaaatttaggagggtatttgaactttttccttgttttttttttttttgggtaaagaacatgttagatgatcagggaaaatatgaagtataaactccatacttgtatatctgaaaactatcgtaagataatagaaatggatgtatgagatttgtccatgtcaccacctaagtagtcgtctattttatatctgaaaacactgtaagcttcattgcctcactggacagcaataggcaaaagaatatgtacaagttatcagcatagtactgcttgattgacaagtgattagcagccataagcatctcaaagttaatatactcggaacaaaaactcaaggtagaaaatgggacaacagcattttatttttgacaactgaacatcaaaacaatgcagcatattgaaactgttacacacaggttaagtatgttcttaggggacagaggaagctgtatgcctactacatatcatattaccattttcacaccaaacaaatcgaataaatttgaggtttttctttcatgaacagacaaaccatcaaccaacttaaccggctcaaaagaaggagcgatgaacccaaaccatctgagagtaagtcgtactatgcatcgattgaatctgaggcagcacttcactggctaattgaggacactgtttccctgctggatcactgaatctcaagcccaagaacagcatcctagctgcaccttccactggtgtttgacaccttttcagctcaggatccacaatccctttcaggatttctctcttctgcagaatgctcttcctttggaattcactatcatctcccagtttctgtgccacaaaatctctcagactctttgcatctgaatgccctgtaactagctgaagtagtatgatacccagagctgatacatctgtctgaatctgaatcttgcagtcatcaatgtccatgaaagtccgaaagattccctgaataactttttcaccgggcattccctgaataacttcctcaatggcggatggtacatgttttgttggatgtaacagagtggaaattccaaagtttctgagcttgcatatattatctgcagtgaagtggacgtttcttggtttaaggtcaccgtgaatgattggcttgtgattatttctgtggaggtaatcgagagctgagcatatgctggctgctgttgtaaccctgtctctccaagtaaaagatttctttcctctaaacgtaaaagatttcttgatgtcagtgaggcgatcttccagtgtgtcaggtaaaagctcgtagacaagtgcacgccttggtgagcatgctcctacaaggtttgccaggttcttgtgctggatgcttctgaagatttcaagctgcattttcagagatatagtcagaaaaacagaagaatatataatatctataacttgcatgaagatatacagctattgcatattgaaatgttatacatgcaatgtcaaattattgctgtcattattttcaacaattttcaatgggaaacttcagtcacattgggttattgtctttgtttccttccaatcttaaatatgtaatgatgcgtaagctttttacgcctttcctgaaaaatattgggttattgatgatgcatttcatccattactagatgcacctgagcaaaaatgcagggcagaatgcatactatatttttttttgcggggaaaaaagtgtattactcattcaaaacgtcctcacagactagctgtgaaatgaaattacaacttccttccggccaaagcccagaaattgaatcggccctagccctattagctaaaaggtggctaacaccgttttggctacgatggatcttggtaaccaacacttccctacgctctgacaacaggcgtttaatctcctggactaaattagctaattcagacagatccctattcccttccttcagaagattgactagcgaaacacaatctgtttcaatcaagatagggcgcatagtccactgcagggccaaaatcaatccctccatgcaagctcggatttctgcctccagggcattcttgcagctatccagggacttacatgctgcaaaaactgtactaccactgttgtcccgtagaatcataccgatacctcccttcccacgatcagcatcaaatgagccatctacattaagtttcatccagcccagcctcggcttctcccagtgcaaacgggtcgatgcagtaggaggaccatctggtcctcttcttctaagtgcacttataacagatctgctaacaacagttttacctttttccagatcagcgtgggggtattccctgatttggaatagagtagcaatataactttccaggaatcttttggagacttccagcggaggaggcggcttattatgtgtgatttcattacgcacataccagtttcgccagagagttaataaaaacatctcatgttcttcggttggtagatattccaaacaatcaaacagccagtaattgccgaattggaaattcacca

SEQ ID NO: 58019 - DNA, 691 bp, Oryza sativa
cattttcataatgaaatcttgatgatgaaaagatgtattatacaatttgttacctggtttgttccattggcgacgtcgatctcggtgagccagatggggagcttgagctgcgcgagcgtgtccagcgtggcgcgcatgaaggggatgtttggggtggcaccgaagtggctctcgagcccgacggcgagcttcaggccgccgttgccggggaaggaccgtatctggttcatcttggcgacgtacttgctggccatcgccgccatgtccaccggctgctccacggtgttgaactcgttcatgaacagcggcgtctcgccgtcgatcttccccacctggtggtagatcgccggatgcatgtattgcaaatatgttttatataaaagttttttaaaaataaaattaatttatttctattttttatatttaatactcaattaatcctgtgctaatgacttgcaccattctgcgtgcattggataagctcacccaatgaaattgatcgaagtctaaagtgggagataaatgacatgacaaggtgtcaaaataatatatttgatattaaatctctaataatatatgaataaataaaacacataatacattatagaataattaattcggtttttatctcaggtgcgtgaaaaagagaaaaaaaagaggaacgtggggcttggtgcatgaagtaggtaca

SEQ ID NO: 58020 - DNA, 7039 bp, Oryza sativa
ccatgagattcatagttgcattacttatagcttccttattcgtagacaaagcggattcggaattgtctttccttccaaggataacttgtatccatgcgcttcagattattagcctggagttcgccaccagcagtatagccaaccctaccctatcacgtcaatcccacaagcctcttatccattcccgttcgatcgtggcggggggagtaagtcaaaatagaaaaaactcacattgggtttagggataatcaggctcgaactgatgacttccaccacgtcaaggtgacactctaccgctgagttatatcccttccccgtcccctcgagaaagagaattaacgaatcctaaggcaaaggggcgagaaactcaaggccacccttcctccgggctttctttccacactattatggatagtcaaataatgggaaaaattggattcaattgtcaaccggtcctatcgaaaataggattgactatggattcgagccatagcacatggtttcataaaatctgtacgattttcccgatctaaatcgagcaggtttccatgaagaagatcttgttcagcatgttctattcgatactggtaggagaagaacccgactcggtattcttaaaaaaagaggggaagcagaaccaagtcaagatgatatgggtcgccccttcttcttgcgccaaagatcttaccatttccgaaggaactggggctacatttcttttcaatttccattcaagagtttctatctgtttccacgcccttttttgagacctcgaaacatgaaatggacaaattccttctcttaggaacacatacaagaaaaaggataatggtagccctcccattaactacttcattttcatttatgaatttcatagtaatagaaatccatgtctctaccgagacagaatttcgaacttgctatcctcttgcctaataggcaaagattgacctctgtagaaagactgattcattcggatcgatatgaggacccaactacgttgcattgccagaatccatgttccatatttgaagagggttgacctctgtgcttctctcatggtacaatcctcttcctgctgagccccctttctcctcggtccacagagaaaaaatggaggactggtgccgacagttcatcacggaagaaagaactcacagagccgggatcgctaactaatagaatagtactactaactaatactaatatatagaaatagatatctagaaatagaaacgaactaatatatagataatcgaaattgaaaagaactgtcttttctgtatactttccccgttctattgctaccgcgggtcttatgcaatcgatcggatcatatagatatcccttcaacacaacataggtcatcgaaaggatctcggacgactcaccaaagcacgaaagccagttagaaaatggattcctatttgaagagtgcctaaccgcatggataagctcacattaacccgtcaattttggatccaattcgggatttttcttgggaagtttcgggaagaaattggaatggaataatatagattcatacagaggaaaaggttctctattgatgcaaacgctgtacctagaggatagggatagaggaagagggaaaaatcgaaatgaaataaataaagaataaagcaaaaaaaaaaaagtcaaagatagaagagcccagattccaaatgaagaaatggaaactcgaaaaggatccttctgattctcaaagaatgaggggcaaggggattgataccgagaaagatttcttcttattataagacgtgatttgatccgcatatgtttggtaaaagaacaatcttctcctttaatcataaatggaaagtgttcaattagaacatgaaaacgtgactcaattggtcttagttagtcttcgggacggagtggaagaagggcggagactctcgaacgaggaaaaggatcccttcgaaagaattgaacgaggagccgtatgaggtgaaaatctcatgtacggttctgtagagggacaggaagggtgacttatctgtcgacttttccactatcaaccccaaaaaacccaactctgccttacgtaaagttgccagagtacgattaacctctggatttgaaatcactgcttatatacctggtattggccataatttacaagaacattctgtagtattagtaagaggaggaagggttaaggatttacccggtgtgagatatcgcattattcgaggagccctagatgctgtcgcagtaaagaatcgtcaacaagggcgttctagtgcgttgtagattcttatccaagacttgtatcatttgatgatgccatgtgaatcgctagaaacatgtgaagtgtatggctaacccaataacgaaagtttcgtaaggggactggagcaggctaccatgagacaaaagatcttctttctaaagagattcgattcggaactcttatatgtccaaggtcaatatggaaattctttcaggggttttcccttactttgtccgtgtcaacaaacaattcgaaatacctcgactttttcagaacaggtccgagtcaaatagcaatgattcgaagcacttctttttccattacactatttcggaaacctaaggacttgatggtatggatatggaaaatacaggatttccgatcctagcgggaaaaggagggaaacggatactcaattttaagtgagtaaactgaattccatactcgatctcatagatccctatagaattctgtggaaagccgtattcgatgaaagttgtatgtacggcttggagggagatttttcctatctttcgagatccaccctacaatatggggtcaaaaagccaaaaaaataagtgattcgtttttagcccttataaaaagaaaacggattcttgaacctctttcacgctcatgtcacgtcgaggtactgcagaaaaaagaactgcaaaatccgatccaatttttcgtaatcgattagttaacatggtggttaaccgtattatgaaagacggaaaaaaatcattggcttatcaaattctctatcgagccgtgaaaaagattcaacaaaagacagaaacaaatccactattggttttacgtcaagcaatacgtagagtaactcccaatataggagtaaaaacaagacgaaataaaaaaggatcgacgcggaaagttccgattgaaataggatctaaacaaggaagagcacttgccattcgttggttattagaagcatcccaaaagcgtccgggtcaaaatatggctttcaaattaagttccgaattagtagatgctgccaaagggggtgggggtgccatacgcaaaaaggaagcgactcatagaatggcagaggcaaatagagctcttgcacattttcgttaatccatgaacagaatctaggtatgtagacacatggatccatacatctcgatcggaaaagaatcaatagaaggagaatcggacgatatctttctcgaaacaaacaaaaaggaaaagaaagagaaaacagaaatcatgatcaactaagccctctcgggggcttgcttaagaataagaaagaggaatcttatggaaatagcatggaataaggtttgatcctattcatggggattccgtaaatatcccattccaaaaatcgaaacaatcgggacttttcggagattggatgcagttactaattcatgatctgacatgtacagaatgaaaacttcattctcgattctacgagaatttttatgaaagcgtttcatttgcttctcttccagggaagtttcattttcccagaatgtatcctaatttttggcctaattcttcttctgatgatcgatttaacctctgatcaaaaagatagaccttggttctatttcatctcttcaacaagtttagtaataagcataacggccctattgttccgatggagagaagaacctataattagcttttcgggaaatttccaaacgaacaatttcaacgaaatctttcaatttcttatttttttatgttcaactttatgtattcctctatccgtagagtacattgaatgtacagaaatggctataacagagtttctgttattcgtattaacagctactctagggggaatgtttttatgtggtgctaacgatttaataactatctttgtagctccagaatgtttcagtttatgttcctacctattgtctggatataccaagagagatctacggtctaatgaggctactatgaaatatttactcatgggtggggcaagctcttctattctggttcatggtttctcttggctatatggttcatctgggggggagatcgagcttcaagaaattgtgaacggtcttatcaatacacaaatgtataactccccaggaatttcaattgcgcttatatccatcactgtaggacttgggttcaagctttccccagccccttttcatcaatggactcctgacgtctacgaaggagtgtggttcgttcgacaaattcctacctctatatctatctctgaggtgtttgggttttgcaaaactccatagatatgcagaagagaaatgctatccccactccgaccaagacagaacttttaccaaaagtttattgtgatctttttgttcaaataacaattaaggtgaagcagggtcaggaacaacgaatctctttatgataaacagatccattttgcaagctcgttattacgggtagttcctacaaagaatcggactaatgacgtatacaatgcttgaattatcgacgtagatgctacatagtgggttctcatccttcagagactacgagtgtaataggagcatccgttgacaaaaggatcaccctaagatgatcatctcatggctattgggaacgaatcaaatcagatggttctatttctcaacctttctgacttgctcctacggaaccaaggtcgaaaggattgaaaaagtcagtcattcacaaccactgatgaaggattcctcgaaaagttaaggattagtagttctttttcgaaatcgatttcgaaaaagaatggattcggtcttatacatacgcgaggaaggtaatcaaaaaagaaagaagacaagttcttctttcttttatcacttaggagccgtgcgagatgaaagtctcatgcacggttttgcatgagagaaagaagcgaggaatcctcttttcgactctgactcccccactccagtcgttgcttttctttctgttacttcgaaagttgctgcttcagcttcagccacgcgaattctcgatattcctttttatttctcatcaaacgaatggcatcttcttctagaaatcctagctattcttagcatgatattggggaatctccttgctattactcaaacaagcatgaaacgtatgcttgcatattcgtccatagggcaaatcggatatgtaattattggaataattgttggagactcaaatgatggatatgcaagcatgataacttatatgcttttctatatctccatgaatctaggaacttttgcttgcattgtattatttggtctacgtactggaactgataacattcgagattatgcaggattatacacgaaagatccttttttggctctctttagccctatgtctcttatccctaggaggccttcctccactagcaggtttcttcggaaaactctatctattctggtgtggatggcaagcaggcctatatttcttggtttcaataggactccttacgagcgttctttctatctactattatctaaaaatagtcaagttattaatgactggacgaaaccaagaaataaccccttatgtgcgaaattatagaagatcccctttaagatcaaacaattccatcgaattgagtatgactgtatgtgtgatagcatctactataccaggaatatcaatgaaccccattcttgcaattgctcaggataccctcttttagctgctaggtctatttcttagttcaagatccctcttactaactggaataaaagaattagtagatctgttccgcccaaaatgggaatgggcgctagggtaatgaacttataatcatggaatcgactcgatcatcagattataagttcattccataccggaccagaccatgcacattcttattaagagaaggggtcattcgagcctatggaaataggatactctgtttacatagaaatccccacgtccttacattctatttaggattaggaataggtgtaatcagacctgcttttgacatatctatcctatccttatttgggtaccatatgcacctctttgggcttctattgaatcgagaaattggattgtacatctttttgattttgatacatataaggtgtcctacggataatgcaaatcgaagctatttgatgtctgactcaggcctatatgaccgatcgatcgaaatactccaagactccacctttgtcatatattccatatatcacattagatagatatcatattcatggaatacgattcactttcaagatatcacattagatagatatcatattcatggaatatgattcactttcaagatgccttgatggtgaaatggtagacacgcgagactcaaaatctcgtgctaaagagcgtggaggttcgagtcctcttcaaggcataatacggagaatgcgcattcaatgagcattccccgtagagtattccggaaatctgcgcctggcgctctcctctatcttctgagggccttaaccacttccctgagaaaaggagacagtaaaagccaaaatagactaaatatagcctgaacgatcctaaaaatccctcgaaggagataatataataaagaacccaaagcagacagtatcctactgcaagggtggtgttaagaatccaaaagaggttgctcataagagatagatgtatcccaacctctattgctctcgcgtaaagccttttttttacgcgacaggaaaaagtgactacgaattcccctttttgtttgcgaatccctgtttgtatcctttgagcgcacgtccataagtagcgatcaaggaaatcgatcaaacgatcccaataccgtgaaagagaaacttcccagatccaggg

SEQ ID NO: 58021 - DNA, 1672 bp, Oryza sativa
ggtttttgatctagccctagtggatccccccttatttgaaatttttttatgattagtatttttattgctattagatgataaaatatgaatagtactttatgtgtgactaaatgtttttaattttttcacaaatttttcaaataagacggacggtcaaacgttgaacgtgaatagtgtaaaactgcacttattttgggacggaggtagtagtagagaccgtacgtattcatggactactagtactttatatggcctggtttgtcaaccaccacgttaccgctgtcgtgtgatctagctgcaggggagataatactcagtggacaggtcataacttgtgtgcatggagtatacacgaaaagcttatatgtgtatagaatgtgttcctaatctatacccttatagtatatctattcttcacctccatcccatctagccagggccgtctccagtattttggggcctcggggtgaaatgcaaagtggggccctataatttaagaaatcatgtctaatataaataaaacatattttcactcaattatatagatgcaatatgtgttctaatattatgaatttacgatatatcatttactagatcacggtttaatcttacccgtccgagcctccgaggtcgagctgttgagggtcgagtcaatgatgacgagcgggcgaggaggaggaaggcaggagctaggatacgagacaaggtagcaaggcaaagccgtcaccgctgccgctcgaagcgttggaatcacatgcagcaagttgtatcgctgccgcctcgatcatcgtgcatgcatggaattgggaatgacgtctcgtcgtctcgtctcttaaatcggcgtcacgcggaattagatagctcagcaaccaacatcaggacgaaaataacgatcgcacaacatcgtattgagtattgaatttgggcgatgaatttgggcagggcctagcattgttgatctacccattgggctattgcctattagctgatgttgtattgtattgctatacttgaagtgggccttcatatttatatgggggcccaaaaaatcgggggccctgtgcgggtacctatatggcatatggccatcgacgggcctgcaatgttcgacgatattttgtacattttttttataaatgaaagaaatgaagtgtgtcaaagtattaatttcgggaatggtgacataataacgaaattggtgattaattatcactaataacacaacctggcgtacatggcgtatacgtatgaatattatgagacacttgccgtcggctgctctagtatatacgtactcacgacattttgatatagcgtgatcgatccaatttcatggttggctgatggaaggaaaaaggtgtgaatgttttcatgggaatggaagcatatgccactgtagcactgtcattagaggaagttaatcacatcatttgccggccgttaatctctcacgtcatatgcatggaaaccacgtacatgcttgcatggaaaccaaggaaatcaaaagggcaagatagctctatatgaaagtttctttctatgagcagtgcgtgagcgtataagtatacaaggaaaattgatccatatcacgtcagattggaaacgaaacagataatagcagcaagcacttgagatttcacatggaaatactactctccgtatcaccatagaa

SEQ ID NO: 58022 - DNA, 1817 bp, Oryza sativa
gcatgtaatattattggagttttaatataagattactttatttgtaattagacttagtatgtaattattgactatggaattggtgcgacaagtagcaattgactattgtagtcttaattatacttagcatatacgcacgaaacacttagcatatacatgactattgtagtcttagcatgtaatattagttgagttttaatataagattattttatttgtaattagacttagtatataattatttactagctagggttgtacaatatacgtcacctagacttagcttatatcacgatttgtaattagacttagcacgtaaggttgtgtagggttctaatgtacgacatttacacttagcatacatgacttagattgttaaaacataaatgtctcgtgacttagacagatgtttcttgtatcaacagatggctgaccgcgatgaggaacagatattgtacgatacaatcgcggagggaagcagccagtactggaatgaagaagaggggaacgaggatccaaaccagtacttgaacgaggaaggaaacgtggagagggatgcggaggggaaccagcaggggcacgtggaaagggatgtggaggggaaccaggaggaggaggctagtggtagtcaacccgccgttggacagaagagggcacgcgggcaacgaggtgcagcgaagaagcttgagggttgacacatcataacggaagtgcaagaagatgaacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacatgggcaggcgatgatggaaagaaacaaagaaaatgccgccaagaagaagtaccatcaccacttggggtcaggaggctatagcgtcgcgatgccgaagtgggaggagatggaggctagcttgattgagaggggtatcgaaccggcaacagccaattggccggaacgatcgaagttctggtactatgctcacggtggaacgctcaacccagctgatggctcactggtcttcggcgatcagatacgagaggctgcgcgacgactaacagatgcagtggaagcctcctctcagggcacgttccgaccagacagagatagggacgaactgacactcgccctgcagactctagagcatccaggacgaacacgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatgtccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacatgtcccgttgatgacatcactcagcggacacaatgtgagctg

SEQ ID NO: 58023 - DNA, 1416 bp, Oryza sativa
ccaagaacaaggacccgggatacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggttaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccgccggtagagagatgatcggagcgaggatcagggacacggacttcttgcaaggagatgacattctctggatcaatttcaagcgaatctacgaactataccagctggacgccctcgacgtctctattatgagttgctggattttgtaagtatatcgttcggttagatttcttactatacgtctcctttaataaattaggtccttgtatataagtagactatagaaaataatatactcccttttattgttgtagaatggagattcaaagggcccgacggcggagggttttcgatactggattcatcgaccctcggagagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccattgggtgcttttactcttcgacctggaggcctgcaccgtcaacgtatatgactcaatggataaaaaagagtctacgtttgacaaggttttcgaacttatagacaggtaccatcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaaataacttgtgcggctattacgtgtgcgagtattg

SEQ ID NO: 58024 - DNA, 8939 bp, Oryza sativa
atatatatatatatatatatatatatatatatatatatatatatatatatataaagtgcctgtaatatcatgaatcgtcatatattcaaatggtacgatgtaccagttgtgaattaatgatgaagtatatattaattacaattcggtatccatcggctaataggttaagttgttattaatcccatgacagatcgagttgttgtatgcttgctttaatatttttatccaagattagtttagcccctccaagtacaaagtacagagcaacgatactaccctttaacaacggaaattatatagtagaaacataaaaactactaccataagataaaaatacacgtctgagattaatttgtccacatgaccatgagtaaaattaaagttttactaggggtaaagttttacatatggtgaggtggacaaatatcatatgttcatttttatcatatagccggtagtttatacgtttccagtacatattttcgtactttgtagtagggataattttttttagatcggtatgcaggcatgttaattcgagaggggtgtgacttatcaatcttcttccgttgctcatttgcgatctattaggttaattatataattgtttgagtttttttcatgcatgggaaactacggtaaatatcatcattttcctttttcttgataatatgccaaataaactttttcttatttataaacaaaattttccataatgtctatctcctaattattggaggtggactctgagggcagatataccaacacatattcaagccctacataggaccaactggacgtcgttttggcttagacagtacaacacaaatcttggaggaattatcttttagatcatgacaggtttcaacaatatcaaagtgtctcacggatttggaccctactagcttgcagggtaaaataagactaaatttcatcatataggtagacaagacaagaactggtgacttaattattcggttagccaaacgtgtcacaactaacggcaaagaagttcaggcggctgttcatgttattgtttactactaacggcaaagaagttcagagtagtataattgctcgtagcacacagccatacaaacactaatctacccatgctattctggctgctatctgctctgcatcctcctgctttatccattaggtatttatattattgttgttaggcgtggtaattgattactagttagtgtgaaagtggatgaagtacggtgctcctacctgtcatgatggggtgccagatttactattagagatatttagaggagcatatatataagtgtgttaaaattgaatcattatacgaaataggatgtgtgcgtgcagtttgtcatgtaaaaatttacttgtagtcatagaacagtagaagtatttctaaactgtacatcgcgataattaagttgcatggagtacgtagcatgttcatctctaaaaagcttaaattatgcttaagctcgcagttaacagataaatcaattgtactaattcgatatatcatatatatacaccttacatgagtgtactgttcaggtactaaggtgcgcaagaagtggaggattcgaatttatttcaaggtaaacggatcagcggtccacttaaagtcttttattgaactaagccaatagatggatggaatggtcagttatgtacatcttgtcgaaacaaaatactccctccgtatatgaaaaaaacgtcgttctagccataacctcgtttgcgatttaaacgacgttctgaaccgcagcaggctatgtggacggaattacccttgtctgttcgatagccgctcccgcaattaatccgcagcacgcccgcgctcgcctcgtttaattccttaagcgtcgcatgcaggcatgcagcacgccgctcaacctcgccgctcacgctcgccgccgccgcttgcgtcgcgctcgccggccctgctcttgtcgctctcgccgccgccgccgccgccgctttcgtcgcgctcgccggccgcactctcgtcacgctcgccgccgctgctctcgtcgcactcgccaccgccgccgcttgcgtcgtgctcgccggccccgctctcgtcgcttacgtcgcgctcaccggccgtgctctctcacgctcgacaccgccgccgccgctcgcattgtgctcaagatgcttgacgagaagcgcgaacgtgagctcactcccaggaaggatgatgccaaagaaatggtaagataacacaacttaataatcgcattacaaggatgtctctattaattgagtgcggaagctaactagcttcattctaaatgttcgatgcagcaagagtagccttggcttcatctaggaaagatggttgacaaactgatctgcaacaactcttgtatctttcttgcctagtttcctattcttgcttctagccaacaaagcttgataaacttgttttctcacttcttcggtcatgtctttccttccttcgatggtttacttcaacgggagccacgacatgttctagcaaaaggaagaaaatcaagttcattgatagtacaaataaccatggcatgttctagcaaaatctaattgtatcaaaaagcaagttggcttaccagcaaggtgttgtacataatcgaaatcgactgcaccaaattcatttagtggcaagttcaaatcaaaaccagttaaaaaaaaaggaaaacaatgatatgagaaacgatagagaagaagagatagtacagttgccgtacaaacatgcacgagagaagaaaaatcctgtcaaacagagaagaaaagtaccattgccgtgctccaacggaggctcgttcagatcaaaggcaaactcgccatcgccatcttcggccatgtgtactgcaatagtgagagaaagctagctagaagcctagaactagaagatgagatggctcagtactccaaacgtgaaagcaagttagcgtatatacgggcaagcagtaacccaagcgtcggcattctcagcacgcgcgcgcgaaaaacttaccacggcataggcgcgcgaatagcggtaacgagcgccaggcaaaaaaatttaagcatcacgcgcggcagtgaacccaaactaaaaaagcaaaacaaaaaacgcgcctaaacgccacctgcatgagcgccatgcagtcaaccaagtatccaagcccgcctaaatcagtgccatgcaaaaccaagcaaccagctcgccaggattcgaacctgggtcctgcggaatccagcctcggcgcactagccacttgagtaaagtgtttttctcatatggaaggctacgcgcaaccgtatttaataggggtagacagggaaaaatacctataattaatcacttcttggtatgctaaatgctgtcctaaacgtcattttttactagtatggagggagtatggttgtgaacttgtgattcctcttaacatcagtgagggcctgcatatttaaacaaaatatggttccgaactggggtagtgcagatcacatttagcggtaaaactttcggaatattagttaattggttcactgacactatactagtaatatttttgacaaactttggagatgtttggtagcctaatacccaaaaaagcgtgggcaactggggcatgtgccacagttgattttttcagaacaacaaaaatataatccattaaaacagtcgctaacgctgtacattttaattattagtgaaaacgaaatatacaatattgtatactgacattaatgttattatcccaattaacaaaacacgagaccacattttatactgacacatgtggcctgtagtaagccgagcagaccgagcaaagcgcccccacgtaagccgattcgcgacgagttcatcaccgcgcctcggcacacgtgcccccacaccaattaaaagctgcgcacgtcggccatcgtcgccgtcgaccaccaccgaaccaaaccaaacctcgcgccatcgatcacctccaccttccattaactcagccgccccccaccacgcctcgctcgatcgctcgccgccgccgccgacgacgaccttgctcgcttctgccggcggcggaggtagttgttgagatggggaactgccaggcggccgacgcggcggccgtcgttatacagcacccgtcgtcgtcgtcgtcgtcgtcgtcgtcgtccgggaacggaggaggcggcggcggcggccgcgtcgagcgcgcgtatggcgcggtctccgcggccgccgtgatggccgccaaccccggccactacgtcgccgaggtcgttcgtcccgttgccaccgcgccggcggcgacggcggcgacggcgtcggcgcctgcggcgaggcggcggctgaagctgctccggcccgacgacacgctagtgctcggcggcgtctaccgcctcgtcaccttcgaaggtgcgtctacactacagcctcttcttgcatgcgtctcccgccgccggcgagcttgatactcacacggatgacggatcaatggcgatgatcatctgcagatgtgctgaagcagttcgtgtcgaagcggaacgccacgatgagccgcgccacgatcgccaccgctgccgaggacgacgatggtcaccggcgacagggtcaccgcggcggcgaggcggcagcggcggcgccagcgaaggtacgaccatatccaagcattcttacgtgtagagatgagatgagatgagatgacgcgtatggtgtacgagttcttggtcagccattaatggcgattggtgcgtcacaaggaacaaccgagacgaacgctataattagcgcgacttgttgggagctgtacgagcattggttgcgagcttggtgacgtgagttaattaattaattagcgaaacatttccatcgttttttttaatttcccttttgaggtagacgacatgtcggcatatgcatatcatccttcgtttttaggtaggactgtagcgtcccgaagtactcaaattaacctactacagcgaacactgcacatttgaaagtcaatatcagagcttgatatatgtgtatgaaaaataacagccaaaataaattgcatcttgttatatcaggaagaccgtaaagtcaaaatgtaaaattaaaaagacaacagatgaataattttctacaagttttattgtcgtgatatagtatgaagaatacataataaacaaattctaggttgatacatatatgctaagaatataaagctttttagtatcagacacacttattgaaaaatctgttttggaatataagaatttttttagtgttggacatagtcattaagaaagtacgtgatcaacctataacatgttttttttttaatttcaattatataaaagacccatactattatacacgtactccacagtaaacaatcgtttaggctgagttcgttttgaggagatgggaacaaatctcctgcgcacggaaaacggagcgatccatcagtatgtgattaattaaatattagctatctttttgtaaaaatggatcaatatgatttttttaagcaacattcatatagaaattattttgtaaaaaaaacgcaccatttagtagtttgaaaagcgtgcgtggagaacacggcggggaggagttgggaacatagccactatattattgcatacaccacttattttaattattagttcagtttatttcttgaaatatttaatttattcctataattaaatactccctctgtcctataatataagggattttgagtttttgcttgcaaagtttggccactcgtcttattcaaagttttttgaaattattatttattttatttgtgacttactttattatctacagtattttaagcacaactttttattttttatatttgtaaaaaaaattgaataatacgagtggttaaacgttataagaaaaaaaaactcaaaatcccttatattgtgggacggagggagtagataatatgtaatccgctcaagaagctatatcaaactcagccgctttatatgcctccaaaatcaacattagtttgttttacatgttgagtggcccaacatacatcttacttgtactttcatcattgttttatgtattaaaaaacccctaatagatgatggttgggaacctacataggtagcaaattttctaaccggtgccccgctatgcggcactgataacaagcatcatgcacaatatatcatttatcgtaagacatatatggggtagcaaatcgagcatcatacggcaaatctcgacttcttttcaatagatagagaagcaccaaaattaagtagtaaatgaaaatcaaaaacgaatcaaccacatcatacgaatgaactgcagacacacgtcactaacccaaagtcaaatgttaaaccattaaattattactactagctagctcagtactccacatgacacacactaacaatcctactcaatgtatacacaggtggcggcccagtctcgtcaagagaatccatccagcccaagcccgaccgatgaggcccggcctgagcctgaacccgagcccgagcccgatctcgtagcgacggccatggcgctcggcgggaggatgagcctctcccggcacgggcagtggaggccggcgctgccgagcatcgccgaagggagcgtcctgtgcttttaagggagggagatggctgaccaagtgaccatatgttcaaaatatgttacactctgatctgcagagcttgctcactgcagccgtgggttatattagctgtcgtgttatacgagagtctctgcatatatttttctgccctgttctgtttgaatttgaatcggagtttgtcagtttgaattagtcatggcatacgtaggagataattgtttttttgtgacggtacgtttaacacacatgtatggacctacttcttgacttgtaattttattttattttgtcgtcacccatcgatctgtgcctaatctcgtcgcagaatatgtagctcaatgatgggctgatctgtaatttatgggtatgttcgataggctattgctgcagcattctaggctgtgctgcaagttttgccttgggatagcaacggggcgggtttggggctgggttggcttggaacagccccgtccccgacccccgaactctccacccgcccccgcccccgcccccgcccctgcccccagcctctctaggcctcacaacccgaccggggctccgcattgagtaacaactccatccagtcgtctgtgcaccgctgccatctctctgcacgccgtcgtcgccgtgcctgtgcgcctatgtgcagccgccgcgcctggggcccaccgtcgtgcctttgcactgcgccgtgcgttgcccgtgcaccgtcccgcatgctgccgccggaggagaggggcatgcgaccggagtccagaggggaaaggaggggaggggactgtgaagagggcaaccagagggagaggggactggggagagcggtgagtcggcgagatccgaacttcagattcgaagtctgcgcgtgagcgccgagcgcgtatgcggctgtgtacggcgcgcctgtgctgtgcggcggcgtggtgggtggtgggaggggaggtctggttggggtaggttaggtttttttttccttaaatatgttgattctagtgggcttcttgggcctgtattcctgtaatgggctacattttaagagttaatatacctctccagaggcccacggggtcacccacaggtggaatgttctccccatcccctcacccgcaaaatgcggggcccctgccccgatggacccgcggggcagaaatgtcacccgcccccgcttccgtaggggtgggtcctcgcagggaacccgccctgtgaagaaaattgccatccctggtttagccattcggcttcaggaaacagctgctagctactggatggctgtatagtaactcctatagcaaccggagggagaggggactggggagagcggtgagtcggcgagatccgaacttcagattcgaagtctgcgcgtgagcgccgagcgcgtatgcggctgtgtacggcgcgcctgtgctgtgcggcggcgtggtgggtggtgggaggggaggtctggttggggtaggttaggtttttttttccttaaatatgttgattctagtgggcttcttgggcctgtattcctgtaatgggctacattttaagagttaatatacctctccagaggcccacggggtcacccacgggtggaatgttctccccatcccctcacccgcaaaatgcggggcccctgccccgatggacccgcggggcagaaatgtcacccgcccccgcctccgtaggggtgggtcctcgcagggaacccgccctgtgaagaaaattgccatccctggtttagccattcggcttcaggaaacagctgctagctactggatggctgtatagtaactcctatagtggctggctagctggctacagcgtagccgtaaggctgctgcagctagatctttagaacaaagggttatggattttctacatctagttactaagccatccatcatttgcacgtgacttaaatagttacagaaaaaattaaaaatttaataacattaattgagatgatccataactagagaaacaaaaataataaaatcgggtaaatagtacttgtaaagttgctacccactaatactcctaaaacacaacctgtaaatatgccacgtcatcacgtactagcaactattactctaaagcattacatgattaatgctgatcacaattagaaccaactgtaactttcttactcctttccatcccacccactgaggcatgcacatgttttaaggtttaagtccttaaatatttaaccaataaatagtgtggagattatgggtatcccatacccacacggcatggttatccgactagtcataggggatagcttatatctatggaatatgtaacagatcatgacttggatattacgtttccttttatattatggagcggcctaaagtcctgatttgataatattgt

SEQ ID NO: 58025 - DNA, 1301 bp, Oryza sativa
ttcttgtttaattactaatcaatttcatacattcatatagtttattcgcatgagggataacctgaccacacacaaggaatttatcacggcggttcaagaacaactcatgggattcatcaacgaagaaatccttaatcccaagggtgaattctactacgacggaaacacaattcaccggtccttagcttctgagctagcagcgagtactactacgtcgaaatgatagctagctagctaggacatataatggattgtaattaatacatgactacatatgtttctatatgcatgtgtacacattttctataatgtaaatatattttggtcatatatatatctatatacatatgcatttgcataacatatatatgtataaatacatatatattatgcatgtatatacatataatataatataatatatatatatatatacatatatatatatgtatgcatatatatgtattgaaacatatatatgcatggtttatatatatatatatatatatatatatatatatatatatatatatataaaccatgcagcaacagggccatgaaaaaaaaaaaaggtcagctcgatctttagtcccggttggttggctcagccggccacgtggctgagccatctttagtcccggttggtgttaccaaccgggactaaagatcgatctttactcccggttatttcacccgggactaaagatagcgatctttagtcccggattggtactcccggtttagaaaccgggactaaaggggggttacgaaccgggactacaaagggtttctccaccagtgagaaaagactgcccaccaaaccaaaccaacagaccatggagttaaaaaataactcgcggaaaacgtgaagcaacgaaccctcgcccgcaggaccaaacaaagctgaatgtgaagttaaattttaactaatactatgttgagttatgcgctgcggtgatttcgtcgttgagttaaaattttacctatgttccggctatatgaatgagtcgtcattaacttaaattacgggttggtggttatgtagttaaaaatttactggtagacgatgatctatgatgaaaaataacacagttattttgtagattctttttttatggatgtgtgttgtttctcatgacaaggaatgtgagttaaattttaacttatcgtaaactggtatgagtagatgaaaaactttgagacattaggcggtggtggcgatgtgtgacgtaattcacactttattattagaattttattgttttgatgcacatctccccagaaaattatgtcgatggaaa

SEQ ID NO: 58026 - DNA, 2329 bp, Oryza sativa
ggctttgtgggataggtctatcggaaaggaaggttgtcactttgatgtagccgtatttgatgcattatccctcaaatcttaaaatgaaaaaggctataaatatcatagtagtgtttcattatatatttcagtaggttgccctatttctatggtatatcccctcccccattagtttgaccttttagaataaatgctgtcaaactttgctcattattatgttgggttctatcttggtgatgaaagcattattaataaattggttattgaaaataatactatgaaaggtatatatttaaccataaattattaagaattaatgattaaaaattgcatcttgaggcccgcagcccacacatgaaactatatccatagccgttatggtttgcctttcagctagtgcatgttttaacgttgattgttttcgcaccgcaggacaagaatgcttttgctgaaattctgaagaaaatatcgaagattcagaagactaatggccacaattatgtcgtccttagagatgacaagaagtgaagagcaaaactaaagtggtgctttcttaaaatgcaaccttttgctttgctgtgccttttggcataacatgtttgtaagataagtgtattggaagaattggccttgtaacctgatgtatttagggcctatttggattgttaccctaccaattttttggtagtgccaaaatgtaggcaagttttggcactaccaaatctttggtaaagtaagattgcattgatcatatttggtttgctaccaatatatagctaaaatgtaaaattgtagtgaagaatattctagatgataccaaatctaaattaggtattaccaatgaataggcttcgatccaaattaaacacaactactattcaaattaccaaaatattggtagggcatgtttttggtaacaatccaaataggcccttagatcttttttaacttaaggtcattgatcacttatcattgttgctgccgcgcttttagacatcctactggaaaccagctgtttctaaaactacaggaaatttttggtacaaaatactcgctacagcagcggggttggtaagtaaaactgtagatttaattaatgttgagtagatttcacttcggacgatctttattactaccactgtcccaaaataagggcagccgtggatatccgtgcctaatgtttgaccgtctgttttatttgaaaaatttatgaaaaaattgaaaatatttagtcacataaagtactattcatgttttatgatctaatagcaataaaaatactaaccataaaaaaatttcaaataaaacaaacgatcaaatgttaacgtgaatagtgtaaaactgtacttattttggaatggagggagtagtttcatcatggattaggattagacctatgtttccgctcaacaacaatcctttgcgcttcagaccggggatcatgacttagacaacctctagtcatccatgtcccttcagtctaaatctgcacgacctctcctactccctgatgatcttgttgatccttcacgaccaccaatccaatgctccaatgtcccaatctatctatctatctatctatctatctatctatctatctattatattattaaaacagctttgaaaggaggcaccatattctgctgtggagagctagaagattatcgacattaatcgaagaaaaaatagaagaattcaaccgacgttggatctatgatggacatagattataacggtggagattgatcacactactatagaaatctagatttcgaatatgttttggagtccgtatgacacagttttaaaagaaattaaaggttagtactaatctgattccatgcgtggcttgggactaatgagactcggatttgacttcaagacccctccgacttgctgcttccataaaaagaaaaaaacaaggctgtagaaactatactaggtaattataaaaatggttttcaataataattccaaataaatttaaaaaatcatgaaaattcagaataaagaaggagtactatttagatatatctaaaaatcggaattaaaaaagaaaaataaaaggtgagttcaactagaaatacaatttaaaaataactgaaattcgaaattaaaaataagcactattcaaagaagagtccttataagaacccaatacgagattaattaatattcagaaaaaaaataaaatccaaaattattaaaaaaaggaaaagaagagttcgagtagaaattcaatttaaaaataaccaaaaattcggaattaaaattaagcaatattgaaataatagtccatataaaaacccaatacgagattattaagatt

SEQ ID NO: 58027 - DNA, 1941 bp, Oryza sativa
  unsure (1)..(1941): unsure at all n locations
atcgattcctgcagcgttttttaactgcaattcggaattaaatattatgtaatattgaaataagagtacatataagaatccaatagtagattaattaaatttttgaataaaaaaaataaaataaaatctaaaattagacaaattaaaaagagagtacaagtaggaatacaaatttgaaacaactgaaatttaaaataaaaaataataaaaatattaaaagaacacaatacgatatcagttaaaattcgaaacaaaagataaaataaattctgaaatttgaaaaagaaagataagatttcaactaggaatacaatttataaataactaaaattggtgataaaaaataaagactattgaaagaaaaagactatctaaaacatacgacgagattaattaagtaataggcctataaaggcgtagagtggtggcggttgaagggacatctaagaactattaataaatcaccaaatgacaattaaaaggaaggatgacgggcaggtcatgaagcaaccggtcaaggcggttggcaagacttctagaaagtaaaaataaaaaaaaaccctaatgataatcatatttgatttttaaaatctgaacgacaataaaaatgagaggcagcgggcgggtcgtacaggagtacaatggcggcgggcagagccgccgatggttgatgggacttctagaaagtaaaaaaataaattcaaacgatagttatgttcgatttttacaatcccaataacaataaagagtaggcggccggcgggttgtagaggagtacagtggcaacgtttgacgagatttctaaaaattataaaaacctgaaacccaaagacaataagttctaaaaattataaggtccgatttttaaggtttgtgcttctaaaagtaaaaaaaaaaacccaatgataattatgtttgattttaaaatctcaatgacaataaagaagggcggcagcgggcgagccgtagaggagtacaatgacaaagtcgctaatgttttggcagaacttttataaagtaaaaaatgaacataaacgataattatgttcgatttttaaaatactaatgataataaagagaagagccagtggacggccgtagaaggagtataatgacaacgtttgacaggatttctataaagtatactccctccatttccaaaatataaggcacaaccaccttaacctaaagaccaagaaatagttattatcatcttgtagtntagattatcctaataaatgtaatgcatgcatccaatagagttagagaatgtgagagtgaaggattttaaaaagtagtaatttaatggagaatatgtcatagttaatggcatgcatgcatgcatgccttatattatggaacatctaaaaaaagtggttgtgccttatattatataatggagggagtaaatgataaagatgaagcctaaccggacaataaacttctaaaattattagattcaatttttaaaggttataaggagaatgaatagaaacagatcgagcaagcaaataaagaaggatatgacagaaataaggggtagcaattggtgtgactttcaaaatataaaattagagagattaggatgataaggcatggtctttcaaaatcttaagacaacgagataactatttaataaattttaagtaaaatcatattaaaaaattatataatttacatgggtgctagtcgcgcaattgcgtgggccacccagctagttcacgttatccaatcaattgacggcccaagcatgtgccaccaaatcaccgataactgaggaaaatgggagccctcgcgccatggccgtgcgtggctgcgtcgctcgtcttcgtttcccaccgccccacgaggccatgacactcctatttcttctttcaaccagctacgcctttgtgcatgggtggatacggaattgctagaaaacttcagtatgttttttga

SEQ ID NO: 58028 - DNA, 22356 bp, Oryza sativa
  unsure (1)..(22356): unsure at all n locations
ggattcaaatccccaaacaggagtaaggtattacctctcattgagagggcctgaacctgtctaaatccttgtctctgcatccatccacttttaggtctcgtgcactaccccttttattattgccgaattcatgtttcgacagttggcgcgctaggtaggggtgcgtcgagtttcccgtcgaaaagtgtgatggaatcaatttctccggtatcatatttgttcaagcagcctagattctaccgctgctggcatcatcttctgatcaaatcaatctacgaagagatattgggtttgtcgttccaatttaactctcaatagattaatttttaattatagattgatctacgtactcgggtattatttttgttaccagtgtcgtcgtcgttgccgagcaacaatatcagcctcctcccagtgcaaatccgagcccacacagtgcgagttcggatctacgcctacaccgggaaccactcggcgaccacgtgacatgctaaagctcgtaggcctggatcggttgctgccttgctgctacctgcaactcagtacacaggagatttggccatgctgcatgccgagcgagaaagcacatgcctgcatgttgccttttgcatgtcacctgatgattgttctcgccgggattcgtgccgtatattggcctgagtgcacatctcctgaccgtttcataattttccatatttagattgatttctaatctcaaattaatctctcgttgtttttttttgttgttgttcgcatataattacgcggcactattgaggcgattaatgctggtcatggactcgaggcgtctcagctttccggtcgatcagccgcgagtccattccgccggcttgtcgtcgccaccgccattgctgatagcaacaacgacttcaccgccggcttgcctccgtcgccgccgattggtgtctccgcctacacggctagcctgttatgccgccgtcgttgggcgtctacggcttcaccgccggctcgcttccgtcgccgccgactggtgtcaccgcctgcacgggtggcctattatgccgctgttgttgggcgtctacaacttcattgccggcctgcctccgtcgccgccgactagtgtcctcgcctatatggttggttggtcacaccaccgtttatgggcgtccgcgtcttcaccgaccgactggccttcgccgccgccgactggtgtctctgcctacatggctagcctattatgccgccgttggtgggcatcttcgctttcaccgtcgaccgccttcgtcgccgccgactagtgtcttcattgttattgatggacgactttcttcccacattggccacctctgccatcaccaaggggaatattacaaagctaagtcatcattaattttctttatatgatattttcctttccttctgcctcactacatcaactgtttcgccgttgactagtgagtcgggggctacagatgttatgtaatatttttaaacaattttcataatatctatcttgattgcttgtgaaataatccgagtaacaataaagttcctatcgagttatggagttctatcttcctatgctttccgtttggtttgccgatggatagttgtttttgggccgattcctagcacccgggggctcgttggatggaccgagtaacgcaaggtgctaagtattattcggaataaatcaaaagcatagagataagataaatttattttcttctcttaacaattgcaaaagtactcgagtagtaaattcagattcgtgaaacttttgttccattattgacgaactcatgtcactcatatgcatgtttgggaagtgcctaggctgactcccggtgcttgggggcaatgactagtcggacagagcgtttaaacgtaatgagtcatctgctcggggaaatcaaaattgacaagagaagaaaaacatattcacaaacgttttaaaatgtttgaattttcctcgagtattatatttatatcagatactactcatcctatatgtttgttctgtaggatccagatcctgataggcacaaaagggattcatggctttaagcttatctcttacgctctaggaatggatcagtcagaacatcaccaccggcttgccgtcgtcgccgccgactggtgtttccgcctgcacggctggcctgtcatgccgccattgttgggcgtctacgtcttcaccgaccggcttgccctcgtccgccgccgactggtgtttccgcctgcacgactggcctattatgccgcctttgttgggcgtctacctcttcaccgactggccgcctcgtccgccgccaactggtgtttccgcctgcacggctggcctattatgacgccaactgatgctaccttcttcacggccggctacgtcgccgtcaccgctaataggcgtcatcatcttcaacgcaagctgtctacgtctgctgccgactagtttattcacttccatggctacatgattctaccagtgttgattggccttatcttgttcaccgccggtcatctcgtctgctgttgactagtgccctcgcctctatgtccggtttataccactaccactactgatggacatcatcgtcttccgtcgccgactggtgcttttatcttcacaactgcgcgtcttcaccaccggtttgcttctgttgccgccgactcgtgttcacttcatcacagctatgcaactttgtcaccatggtgaagcgacttcatctatattatcttcggcaccggcaaacctaattgccgctacttcgcaagttttgctacttcaccaaccacgacgtctacaagagcttcgacatctcggcatgcacttccatattcgatgtcgtgttattctactacaacaagtggtgttccaatcttcaatatttctactcggacatcttcaaacgtatcttcactcaactgatggctactcgatgacatgaagctacagttctcgactctatgttcagttgtttctcaactaaccaaagagtcgggggctacacaaataccagactcaaaatttgacaagctttatgtcaagacaaagcaatcaatcagccaatgagttctatagaatctacctcgggagtcatcagtttcgtcttcgcttcagagcagacgttctacttcagcaacatcaattatctttataaatcaagtttgatggattattgtcactgacatcatcatcagcacatctacttcatcggtcctgatgtctccgccgttgctaatgggtgactacgtctttgcctccggttgcttccgacattgccgacttgttatttcgccttcacggttgatctattattgccgatgagcgtcttcgtcattatcatcggctgctacaccgctattgactggattaccgacatcgtcatcttcatcatcttcatcaacatcctgtcaagcctcttcaacatagcccactctactgctattgatgggcaacttcgtcatcatatttaatcatctctattgccgctaatcatcattatcgtcggatgcgtttgccatcgccgactattttcttcatcttcactgttagttgatctgactgctgtcgactggtttcttcgcttccatgccgattgcatcagctatcactgatggacaatttcaactactccaaaaggataagctatatgctcaggggcttacgagctcaagcacaaggatcatacctttaagccggattgtgttctagatacaggcaacatgcactcgtagtcctgagattattttctatgttcgaagactggaccaatcattattccccgtaagcccgtaagggctatcaaccgaatacttgcgccagtcgggattcaatttttatatctattttggagtatcctataagggataatcactcagatcagaagctattcatatgagctatacttggtctatatcacccggaagatttattattcgggagcatgttacatgcgtcatcctttaaagggtgtcgaaggcatattttttggcctaagcctaatatgtctgcagcctatattttcaggtgtggcctgtcacgttcttttagggacttaggcactttttgcttaggccaaaatgcacgtgatcaagtgcccaataccttaaaatccttttataccgcagttactcaactttttaggagttggtacaatgcatcttaaaaggtgtcaaacagtaaagctttatatagctgtcccgctgacttttttatatagtcatggcgctgtttgggtttatcaagcaattgattgaatacaataccattgctttttgcaatgtaagtgtacacttttattgaccaatattatggtttaggctgattatatactgtggtcattttccaggcggttggtaaatcctttatgagtttatttactcggatgttacaccacatatgccatatattttcaggtgtggtgaaaccatgtgtcttttagggacttaagcacatctgttaaagtagtgtgcgcatggcgtatgcccaatactttaaaaaattctttattcacgtcatacaaggttctttatagctatttttgctatgtgaatttttaatgatgtagtcaactttatgttgtacacatcatgttttacaaagcagtcggtatatcacttggattatattattcggggattcacaatgcacatgctatatattaatatcaagtcgcttggttgactacaattatcgaaaccactttgttggttggattatttattccttaactgtatgcttggtttgttcaattaaccacattgtcgggggcgacacctattaggtgcatctggtcgatgcacctgactttatttttcagccctccacaatcttcagatttggtaaaagtactcgggagaccatggcaaagatgattgaagcactcggctttggagtaatctaattcgagagaagattatcttttcgactgtgaaggtctcaggggctactgtggagattatggataccccatacccacacggcaaggttatccgactagtcataggggatagcttatatctatggaatatgtaacagatcatgacttgggtattacgtttccttttatattatggagcggcctaaagtcctgatttgataatattgtaaaatagatttaggaaaccgataccgtcttggttaaggtttctatcttgtaatcctgccccccatcctatataaggtgggcaggaggccctctagggggcatgagcacaactagatcgtcagatctatactacactcggcggattcaaatccccaaacaggaatagggtattatctctcattgagagggcctgaacctgtctaaatccttgtctctgcatccatccacttttaggtctcgtgcgctaccccttttattattgccgaatttatgtttcgacaaatagtttattataaattggattttatttcatgaaaataatatcatccgattctcatttaaatttactttcatatgattttcattttgttgctataaacattgtagtatataaaaaattataagtcaaagaaagtcttaaagatcgtgccaagtttgaccgcgtcttagtgagtgggatgaagggagtaataaattagtaaataataattagtcaacttgaaaattttaaatttatagttgaaagtttcaaaatttgtaattgaaagttttgaattttagaattgaaagtttcaaaatttgagttgaaggtacaaaaatctatccacaaataacttcaaaataaaaattttaattaacatcaaattcgcaaaatggaaaaaatattttgaataaatagttgcctactaattggcccacaaagagctggcccaagaaagcaacaacgtgctgctgtgcctgtgctagcccacacgcacgcaatgttgacatagtgcgcggaataagtctattttgcctctctcatctattacccctgattgaagcgcatccttcaactacaaaatggctcccccatctttgaaaaccggtgcaaatcgactattaatttcagtggtttgggaagtggtttatgtaggcgaggcccacatatcaatgaggtatgacaaaagatatgtggttgcccttttatgtcaattccttttcttcttccccacctctccgtctttcttgtctctccttgaaagcagcagctgaggtgagaaaacgactacgtggaccatctcacgaagttctcaagcgctgagaagaccaccggaggcagcacagcaagaacccgtcgatagcggcacagccgtcggaatccagaaggagcgtatccctcgccactgcactagaagttggagcacctctattgccctatcctcccctccttctcatccccgctcctctcctcctcaaacaagacccatcctcatccatcttctcatgcctcaccaccgccagcctcgccacttcctagggatgagcccgtgcgttgtgctggcttaatatttagttttcgacgtttgtatcggagggtgccgtaccaatatttctgaaaatttgaaaaaattttggtcaaatttaaataaaatattacaaaattcacaaaaaagaaaaaaataaaaaaattgattgaaataatatcatatcgggaggggggggtctgatagaactgaaatttcattatgaaattttgaatcctagcgttgcctggagaggggtcaccgctcgctagagggatctagcctcatgcaccgtgccgtgccgacttgccaatatagttggccatgtgggccgcccggcacggcacggcccaggcccggccgtgcctgggccaaggcttgtcgggccggcacggcccgaccgacgcaccgggccgtgccgtgccagcccacgtgccgcactcacggcccaagcacggcccaacacgcctcgggccgtgccgggccggcccgaaggcacgatgggccgtcgtgcttttcctcagaataagtctaaatttcctccctcctattgggctgtgacatatgtacagctacaaaaagtctattttacctccctcttctttgggctgggtatataaatagctaaaataagtctatttaaggtccctattctttagacagttacatttatatgtctatttttagtccccatactttatgtaccgggcctggcctgccggcccatcgtgccgggccggcccgaccgtgccgggccagcccagcgtgccggtggggaggcccaggcacggcccgacggtcgggccgggccagcacgggcccgacccaagtcgggccgtgccgtgcttgggccgggccaaaaaggcgtgccgtgggccgggccttcgggcctcgggccttatggccaactatacttgccaaccaccactgacttgtccagctcgtccgcctacatgctgcctccaccagtctgctcccacgcggctccactttcgccgctgtctgtggtgccgatgcgcttggccaaaacgacaccgcccgagtagctgcagctccccacttgaaaccagcctgagcgaggtacctagcatcattggagaggcagctatggagctcgattaggccatccgggataagaccaccatggtcgccgtcaaccaccacgacaacacgaaaaacacaacacatccgaacaaccatcatctagctagctatatggagcttgaggaggccgtgcaggatgatacccatggcgatgcacattctcggcagcctcgtcacactagcaccacgtgacattaatggcgacaacctgatcatctcctagctctcactccacgtgacgctggcactcctcaactcggggggaggggggggggcggactccacacggccatgatactccctgttcttgtcggtgatatccccgcccactgcgacgagaggaccccgaggaggatctgtggtcattgtcagtggacgtgcttttcgacaacaccggaggcagagggagcagcttcggagggaatgcgacattaacgtcgctgccacattatttggaggacttcacggggagccggaagcctctgtcgaccctgaaggggttcggcatggcctcactcgcgtgcagcacgccgcactcacgcgccacgcaccgcctctgctagcgccggtgctagtgcatcctctgcagcggagaagaacacgagcagtaagagggagaggtaggaaatgagaaaagatactgacatgtaggacccacaatatatgttttgtcatatctgactgatatgtgtgcggcgcttacagaaaccgcatcccaaaccattatagaaatcgataaatcgatttgcaccggttttcaaagatgaggaaggcattatagcttgtaaggttgatggatgtgattcaatcaacaagagagaaggggcgtaaaattagacttattcctagatgcggtaactagtctgctgctttacaagtgtatccgaaatggggaatccttcagtttatgatgggcctaggaggccataacctagaaaaaaaaatcctcccaataggccatgagcaatcaagttcacccgccatccactcgtgtagtccacgccagccgtccgattgatccgtcaggacctaccattcccctacatgagcccattcataatagcccataatggttctaaatctgtagatgaacaaaactaacaaaaaaaaaagaaaaatagcaaacaacatttttcaatacattatatcttacatgtagcattttacatgcagtattctggacaattatgattatccaccctagcaaatttttgtaatgccaaagtgtcaattctagaaatcgggcctatggactttttgagcatgtccctcttcttctctctcaacgaccaacaccgtgcttaccacctgagtgtgttatttttttttagtgttggctggagcttaatcactattaccgaagggaacatctttaaattttttagaagtttccctttaatttgacactagtcaaattaattagatgcgactgaggtgtcctaattgatctcattcgaaaaacataataattgctatgagtttgccaaatcctccgtcaaatgggatgggtctttccgtgtccgcccgggcatgcatgtgcagttgacaacccaggaactacatgacccgtttggctgtgcgcgacccgtctagtcacaccgtgcttgggctgctaaatggcccagcgtgctaacacgagaagtgcatgtagcaagctagcacggcatggcccaggaatagcacaacacggcctggcccatgcaacacgatgacgaccgatgactggcgaacaaccccattcatgagcaaaaccattaagcacgtcggtcattgggggctcactagcttgagacaaaggaagtaggaagtgaagtgccacggtggtgcttagcgacgaggaagaggaatgtgctatcaggggcagaggacctcgctagagcttcgtcggagtttgtgcaacaggatgcaacaaactttgtttgtatttctttcttggtgtttatcatatttgggctaatcggcctccacatagcccacgtaccttaatcatgccaagccaacacaaaatgacccgacatattactaggccgtgcctaggctccgaccttagcatatgggccgatacgacctggcctgttcggtgactcctgcctaattggaccgtgcccaaatgtaactattatttatccaccatctcaaccttatctctactattataaaaattgaagatgtttttgccggtattttggtacgtcatccgtgtttgagttggttttatgttcgctcacttttgaaaatacagattcatgtatgagtccgattttaagttcgtttgcttttagaaaaaaacaaaatgagtcatataagaaatctctttaagaaaactcgcatactaacttgagataaaagtcggactcctgattgcagctcatgattttctaagaaaaatatgtccaagcgaaattccacggtgaattttatcctagctaaaccgtacaacaataataagattataataatcttcacccgttgcaatgtacgggcatttttttctagtgtataaaaaagataaaacaaaaatccaccgttccgaagatccaaccctaggagctccatttggaggatgagattatgactaatgaacattatcctgctttaaaaaaatacattatttccattttccggatttacaccctttgggtagggtggggatgggatgtgcaatcctggtggatctaatgctaggcgaaattacaaaactatcatcggcattttgaggtaggtatggtttggcctcagtcgtgcgtgagttatccgtcagtttgcccaccgcctccgcctccgccgatccccatccaaccgcgacagcgagcgagcaccgagcaggttgccgtcgttcgtcctgctccatccgcccgcatccatcctggtgagcacatcctctgccaccgccgcctacgccgatccctgtaacaccccgctcgccggcgtaagagatttggccgccgcgagccgccacccgccggatgtgtgaacacgcgagggaattgggggtagttcgtctcttttcttacttttgataatcgatgaggttacagccgtgttccagacataatttaaacccctcagcacgacccaccggtcaggcctaagcgcgcgcgcacacacacttattacataaatacgctttcttcacaggaagacgccttttcctcaatccgtcttccctgtatcgttgctgtgtaatgcctgcatcttcaggtgccacacccaccggtgtgacactgccgcccccatgagaaacaggatgtccccaaactgttgctaacggaaaatgagctcgcagcacagaatagtcctcccaagtagcacactctggtggcaaaacacccaaacgaacaagaacttgtgttagagccgcattccctttcttgaccaaacgacgatccaatatctcagtgggttctagagcagaaatatccaactggacagttgtcggcaactcagagaaaactggaacatgtgaaggaacaaaatgcttcagttgggagacatgaaagacagggtgaacctgactatccacaggcagtttgaggcgataagccacagaacccactttacttagaatttcaaaagggccaaaatacttgaatgccaatttaggatatggacgcgatgccactgatttctaaacgtgtggttgcagtttgagaaacactgaatcacccactgcaaactcacgaaaagaacgcttctcatcagcatattgtttcatgcggttatgtgccttagctaactgatgctgtagcatttaagagaaaagttgtctgtcctccagcaaagactgaacgccagtatcatccataggtgcagcatcaggaagcatgtcaggaaggaatgcataccttggatccatgccaaatagagctttataaggtgtgcaattcaaagatgaatggtaagttgtattataccaatactgggccaaaggaagccaagagcaccacttagttggagaaacagaagtagcacaacgaaggtacatctcgaggcactggtttactcgttctgtttggccgtccgtttggggatgataagttgtactgatgagtaaaggaaccttcattttggcgaacaacactttccaaaactggcttgtaaaaatggcaacgcggtcagaaaccattgtcttaggaagttcatagatagaagctactctgtccagaaaaactgaggccacatgttgagcagtataagggtgttttaagggaataaagtgtgcaaacttggtaaaacggtcaaccaccaccaaaatcacattcttactgtcagataatggtaagccgtcaatgaaatctaaagagatatcctgccacacaccttgaggtacaggcaaaggttgaagtagcccaggtgatttacataattcatgtttagcttgttgacatatgagacactattgcacaaattcctggactgagttgcgcaaattagaccaaacaaacaatttatgaattctttgaaatgtggcttgcacaccagaatgtcccccaattgctgaacaatgaaaggcagcaatgattttagtttgcaaggctgaattttcaccaatccaaactcgccctttatgtttaatcaaaccccccactaactcataaccttgatcattaggagaaataacagccagctcctgcagcaacttctgagcctgcatatcaacggcataagaattgactatctcctgtatccacggtggctgaaccaaagatacacttgaacaagcaaagaattgaccaactcttgaaagtgcatctgctgatttattgtccacacccttcttatactgaaagtgatactgagtccaattaacttagtcattgctttcttctgcatctctgaatccaggacatgagtatcaagatgacccagaaatttgtgatctgtcttaataacaaatgggcctcgcagtaaataaggtcgccacctgtctactgccatcataatagccataaactccttttcataaatagaaagtttttgattagcagtacccaaagccttgctataatatgcaatgggatgncccctcctgagacaaaacatccccaatgccagtgtcaaatgtatcagtctcaatgacaaaaggtttactaaaatcaggcagtgacaaaactggggtagtgatcatagcttgtttcaaagtctcaaaagcctgttgagtgacagaactccactggaatggtaaattcttcttcaacaattcaatcaagggcttagccaacaaaccataatacttgacaaattttctataatacccagtgaggccaaggaatcctctcaaatcatccactaaactagggacaggccaattttgcatcaccaaagttttagcagggtcagtagctactctagttttagaaataatatgtcccaaatactccaactgctgcaaagcaaaagaacacttactgggtttggcaaacaatttatgttgctgcaacaatgtaaataccaattccaaatgttcagatgatcctctagagaatggctataaatgagaatgtcatccataaagactagaacaaattttctcaaataaggaccaaagatagaattcatgaggcactgaaaagtggcaggtgcattagtcaatacaaatggcatgactttaaattggaattggccatggtgggttttaaaagctgtctttggttcatcacactcttgcattctaatctggtgataaccacttcttaaatctaatttagagaaatattgtgcccctgcaagttcatccagcaactcatcaataattgggaggggaaatttgttcttcatagtaatagaattcaacttcctatagtccacacagaatcgccatgaattgtctttctttttcactaaaagaactagagaagcaaatgggttgagactaggaaccaccatgccagactgaagcatctcagccacttggtgctcaatttcatccttctaagcaggagagtgttgacgaaaaaatcgaacacaccggcctaggagatctgcttagctccagtgcagatccaaatatgatgagatgcgggcgtgccagtcagtttgaccctgcaactaacaagatatgtaaacggtagatcaaatagccgatcggctgacaagccgatggagtagttctagccgatagccgataatagccgatgccgataccagccgatagtgatagggtttaagcaatcggctatatgtccaatatagataatgatataaaggtaatcagctgatgatgatgtaataaaataataatataatccagtataaaccaatcggcaaataatgatatgataaataagcatcgatccgaaggttaaagcacacatcggctggaggtccgatgtcatgaaatctacaagattagattgaacagtgaaacctttgttgtcatcggctaaatccaacttatatgtatatgcaatccttatgagccgatgcaacgtccagataactcaccggctgaaactccaataaaacccttattggcaatcaggaagtaggctagagattatggttctaagcatgacttagtagatcaaacttaactgatgcagcactaagaatgaaaagaaacataatatctagacaatcaagccgttgactgagttttcagggtggtagatgtctaagctaatctaatctagcaatgcgatttagctgataccggcagaaaccctaaaacgagaagcagccaatagagctaaattgatatgctaagactagattaacaaagacatatgataaaataggtaggcaaatatatcatccaaaccagagcaatccaagaggtcaaatgtactgatgcagccttgaacgacgccgacgtaaacgatacaattgcccgggccagcggaacattggacttaccccttagccggagatcgaacaccgatgcagccccgcgtcaggtgccaagtcccgccggacgataaaataaagtagaaaaggtaaaaggtggcgatgcgccgaattgtattgatcatgaggatagattataatgaccccgggtttacatatttatatccatgggtagatactagtccttgtaggacgagaaagaaactttcctaaaaaaaaggaaaacataaagtccttataggacactaaacacactttcctaaagataaaaagaaaactaacaaactattcctaattaatagatacaactgccttcttcggactcgatctgtacgtggcaatcacgtcaactcaatccgacaatgattccaatatcaccttgccggaatcggctacatcggcttgccttgttcgatttggtaactgccgatgcacactgtagccgatgcggttccgaagccgattcataccctgtttccattatcgatttcctcccaaatccgcttcggccataactccaaattcgatgtaaatttactaaatttggttgttaacagagagtacctatatggcctggtgttaacaggagctgcattagggagcagtgtaatagcatgatcaaaagtcctgtgtggaggtaactcagtaggggactgaaatattggttgaaacttctgaattaattgctggacagcaactagaaggatttgctgaggtacatgctgtacttgttgaatgacagccactgcccagatctcattgccttgatgccacatcaacaactgctcacctgaaattgcctgcaaggactgagaagtaggagcagtgggtttaacaccttgcaattgaatctgctgccctttatgatcaaatgcaatccacttatctacccaattacaagtcatagggctgtgttgtgttaaccaatccatacctaatattgcatcatatccccccaaatccagaattctcatatcatggcaaaaagtatggccctgtatccaccactcaaaatctggtaccatctgctgacaaatgacttgctaaccattagcaaatggggcatttgtaaatttgctaccagtttttttaatattgcaaggataccactcgaatgacggttctaatggcatttttgcaattttttagtggcagttttgcaataacgattcaatttgatgatatatgatgaaatcacaataaaataaatgataattacataattttttttaataaaacgaatggtcaaaacatatctaaaacgttaacagcgtcagatataaaaaaacgaagggagtatgaaatgagctttgtactataaaaatttacatattttgctacatggagattgactattgaggcaatttgctgtaatcgtgtaggtgaattttaggccatcacgtttcactctgtttctcttcacgagtgcgtgaatatattgcaccccaacgtctgcacctatgccatttaaatggtagctatgtcttaaaatatagtcctctatttcaaattgatcatcatataatatcatataatatttgtacatcaatatcaaggataatttaaaccacatcgattaagacgtcatgcataatatattaatatgtatacattctcctattctcctatgttgtgttaattatgctatgataaaatccgtgtttatataacatatggttatatgaggatcaatttgaaaaattttagtttttattatatgtcgatcaatttgtgaaggcacgagtaataagttttaaagttaggtgcgatattaatgcagtggctaggcgtataactgacctgacatagattaagctgaaccaagtgatccaattattattcactaattaagcaaaaaaggaaataaaaacaagtacaaaattgtttgacaaaaaaaaaatcgagcacgctagcacgaggacaatgtacgtgtcacactctcctagaccttaatgttgaccaggcgctccgacgccaacgacgcggcgtccaccgtcatggcgcggacggtggcgttcgttcccagggacgggtggctcactgtcaggttgtagtcgccgtgtgggaggtcgagctcgacggcgccgtcggcgccggtcgtcgccgccgtcttgtgcgtcttccactcggcgatcagcttgtcgacgagggtcccaacgggcaggttcttgaagctgttgtccgtcaggcacatcacgtagcaacccttggcgtgccacgccgcccacattatcatcccgttcaccgacgggtgcgcgtacccttccctcagcacctgctccaagaacttcacctgattccaccatgccaaacataatgttattaggtaatgtataacttaatttggtgtgtagatttttcactactaccagggttaaatcttttgttttcggtattcatatcgggagtgccgatatagcgatattttagaaattttcgaaatcatgaacaaaatttagtcaaatttggacaatattgccaaaattcacgaaaaattaaatcaggctgaaataatatcttatcgggggattgggttcatgatataaccgaaatttcgaaaatttcagtgcggaattttaaaccctgactactactattgcagaaaatgacatcagtgtcaggtttacctggttgggtcctttgacgacatcgacctcggtgagccacatgggaagcttgagctgcgccaacgtgtcgagggcgctcctcatgtaagggatgtttggggtggagaagtggctctcgaggccgacgccgagcttgagggcgctgttgccggggtagctctggatctgcttcatcttggcgacgtacttgctgggcaccgggttggggtcaccgggctgctccagcgtgttgaactcgttcatgaagaggatggcgttcttgtccagcgcgcccacctggttgtagatcatcggcgacgcgttcggccccagcttggtctcgaagaagttgaagtgcaggttctcgttcaccacgtcccagtggatcaccttcccggcgtaccgcgtcaccaccgacttgagccgcttctgcatcgccgccttcagctggtccaggttcagcggcgtcacccacttcatctgcgagttctggtcgtcccagaatacgttgtgtcccctaatcttcaatttgtaacaaccaacaaaaaaaaaattaatactccctctctttgtttcatattataagtcatttaacttttttcttaatcaaatttctttaaatttaactaagtttgtagaaaaatatactaacatttttaatacaaaacaaatatattataaaaatatattaatattaaatttaataaaactaatttgattttgtagatgttgctaatttttttcttaaaaacttgatcgagtctaaaaaaattttgactaaaaaaaatatcagacgagttataaacgaaggaagtagttagtaaggtacatgtgctggtataagaatgtcgtgagacagttgggtcaatatccgatgtcaagctgaccttgatgttgtacttttgggcgagcttgagcatggcgtcggcgacgcggtagtcctcgttgttctgggcccactcgttgctgtaccacttcatctcgttctcgaacgtggccaccgtgaagcgcgacgtgaaccacttctcgtacgccggcaggtccaggatctccttggtcagcgcgttgccgaacgggaagccggcccggaggagctcgacgatcaccgtggcgttcgccatgggcgcgccgtcggcgccgcggacgaccaccctgacggtgctcctccgcaccttggcggccgactgctgccggtgcgcgtcccactcgtcgaacgtgaacggctgcagcgacacgctgtccatccagatgtccaccggcgcgtcgctctgcgaacattatgtaaagttgagatcgatggaacggctggaacgtacgccggcgatgtgttcgacgaaattgcatcgagtggctgggtcacctcgaagaagatctgccctgggccggaggagtaggcggtcatgccgcccttgagcatgctccagcagccggactgggcggagacgctgccggcgacgacgcgctcgccgttgggcgtcttgacgaacgccttcacgtgcgcggcgccggccgacacctgcaaccacgctgcggcgccgcggcgcgccggcgaggcgcggctcgtcagacgacggggaccacgcacgcacgcacgcacgcatgcatatgtgctcgagtgctatctagttttgcacgtacgtaccggacagcgagtagtgggtgtcgccctgcagctggatcttctggtagacgctgcgcgacggcacggcggcgccggagagggagtcggcgcgctgcaccacggcgaacttgttgccggacggcgagctgctcaggccggccttgatgtcgcggtgcgtggaccagcccatgaggccgctgttgaactcgccgttctggatgatgccgccgttgtacagcggcttcatcggatcgcgaaggcactgcagatatgtggcatgcatgcaagctcgtttgaacattacaggaacatttcaatttttttaacggtacacataaatgccgtaaattttgctttttgttgacctattcactgattagagatgtttcagtttacaaaatagtcgagtgatttggattttgattgaaccaaattaactcagggtgttaatttcctgggaataataaaataattttgcgttttttaacagcccagctctaatcaatttttggcaaaccaaacaattttggcatcccagtcaatcttggcataaaacgatccagagccttacattttaaaactagaatacaactgattttaataaacaaattatcaagttttatagatagcagaagacgagaataccaactatcgatttgcaatttaaaatctgtgagacgagacggagataaaaacgtttaacaaagtcagagatttgcacattttgccaataatctcacatatggcatctgtttgagaaaagagcgatatatacaaagagaacaattaaacaaaatcacttgcctcaatacttgctgtatgatcatattctaaagattgcaccacccatcctacatcaagaatagatacattaatcttcaacgacatttcaagatgaaattatgtgatcaaaacaaatgcaaaaacgaacaagaaaaccatgcgcattttttttgaggaaaagaccatgcacattttgaaaacattaaatcaggaattcgactaaaaccaacataatttacaaaccagctgaccttggcagagtgaaatacatatcaaggagagcaccagtactttctccatgaaaaccttctatgtgtcgtctgtcactctcactgctaacgaagacgattcagctaattatgcagagaagcgaatatatataggcttgcaggattgacttagctagcactaattatgatttacgaaaaatggtgcgttgttttcgatattttgaattgaatcggtacacaatcggcgagagaaacggtacacagagaaacagttgctggatgagtggacgcatgcaggtgagtgatgttatttatagacatgtactgggcaattagttcacagagaaatagaatggtaagatccgtagatttctctgttgctgcgttcaatgaacaagggtttagttgcaaaataaatattgaagatttaattntgagttaaatttggatgtctattattcatatttgcagaaagttaggtggtcccagaataacattagtatagtgaggggataacatcgttggggtagccgtggcgttgggtacacagtatctagtttaaatcctagtgtacacacgcacatggaggatttgctttcagtaagaattttgtgaggtttgtcagtataccataagtcgcggctattaagagtgtgttaaaacgagatatattcttggcaagtttggtcttatgtttaggggtggatctatattgacaggctaacaattaacaattaacattggtgtcactcgatcccgatgacttatagtaaagaccactctaaaagtgctgcgataactttttgggtggaaatatattaaatataacgttatagtgcaaatatagtgtaattatattttaaactaaattttataacttatatgcaacttgcatgtaattattatgaaatctgggtaattttgctcccttggtaggcatggtcatgagtttaatcacccgcccccatgcgtgattttatttacgctcggtgtgcatctgatgacacagaaatagatagaatccaaacaaaaaaaacttttagcaattctatttggtaaaatcacaaaactacttaaacattgaaggtaatactgaattggggttttctttgtatggatggaaagctaagaagataacatatccaatgtgtatatatatatatatgtatatatatatatagatacccatatgggactctatggtgcccgggctctaaggtataaaacacacaaaatcactcaaattttttaaaaaatttaaattgtgagtatatacctaggtctataaatttgattcataccaatacctaacaacaaaataactcaaactcaactttatttcacaattcattattacatacctaacgaattatatgtttggatgttatatacctagaatcaaaatctaacaaaaaaaaaagttcaaactcagttcaaacttgttagtaaagaagttaatgttcatacctaaaacatttaaaaaaaattcatactcattcaaattggttatatactcaatttgaatcttggagccaatactccatgtagcacgagttaatttacctatatatatatatatatatatatatatatatatatatatatatatatatatattaaatttgtttggtgctccatggtgcccgggcaccattgttgaaattgagtatatacccaattcaaatgagtatgaaactttttcaattacttaggtattaacattaactactttactaactagttcaaagcaagtttgaactgaacttgaacttgtttttgttagatcttgattctaggtatatagcatccatacatataattagttaggtatgtaatcatggattgtgaaataaagttaaatttgagttgttttgttgataggtataggtatgaatcgaattattataactaggtatatactcacaatttgaaaattttaaaaaatttgagtgattttatgcattagataccatggtattcatatatatatatatatatatatatgaatatatttttaatgcatgaaaaatatatacatatacaaagtttatataggacgtacaaactttgtatacgatgaatataaactttatatacatacgtattaaaaaataaaaaactagaaaatacacaacgtatacaaaatttgcatacgcgtatacaaagtttatatacgtacaaatacaaacttggtatacatacgaatacaaactttgtattcctacaccttaaaaagagaaaccagaaaaaaaaggaaaaaccaaccaaacagaaaccaaaaaaagggaaaaaacaaaaaaagggaaaacttgctctctctctctctctcctcttagcgcggcgcgtccgccgtcccctctccgcgcgcgacacgtgtccagtcgcgcggggaggggcgcgcgcgactgatcgctaactagccttctcgcaagttgacgtctagaatctgtcctggcgttgcgtcaccgtatttgggcctttgggccgtgtatcgtgttggaacccattagggttgcgtcaatggttggttgcacgaccctaaactctatatatcagtacctgccgtcacccttagggtttgggttttgcttagattattctgtcaagaacattttcgccgctagatcggtttgtaagaacccaacttatgagcttaatcattcatctgcaattttggttgtattctaccttattcttgtttgtgttcttcgattcgcaaacagagattagccttctcggcgagatcatccgcgtttcgacacgggtgataactagaggagatgtggt

SEQ ID NO: 58029 - DNA, 3797 bp, Oryza sativa
aaaaccagagtaggaaatcggatgaaccagggtgctgaaccaaattggaccatccattcatgaataaacaactcagccaaaccggatcagatagagagaataacacatgaggattggaggcatcagatccacgacaaatggaacaataattaggtgctcaaataccatgattatctgcagttttttaacaagcacataaacatgccactacttgaacccaaattgtgtccgtatcattttcgatcttcttcaatttgggtatacaataactgatgggtgtacactttaaacttgtagtaaaggaacagaacaaagacatgccattgaggataccaataactcagtaaaatatatcagtttgatcgtgtgtagggatcacggtatgttttagtagcaattgaaaagtccataacacacctggtcagtgaattgaagaggattgaagtggcatttacacaaatcgctggtcagtgcgcggaggcgtaatagcatcgacaccgagccgttgtcgaggggtcaatcggtgccgacggcagcggcgatccagtttgcagcttttaggctgggtgagtgcgagggaaggcgagggccagtcgtccacagcgggttcaggcggggcaatggtgaggcagagcgcagtgggcggctatgccgaggggaagcgcggttaccggttaaggaaaggcggagctagcgtagacgggagaggggaagcgacggcggtaggagcgtggttgccggcaaggaaggcgatgggtcaatccacagcggcgatggcaacgtggagcgccgttaccgattaaaggggaggtggaggcggagtgcgtgcgcgagcgtgagcgctaggggtgggaccgaaggaggattgcctgtttccttcggagaatccaaaactcaatcccatgcgttaattcgagtggatcggacgggtagatcaagttgctctattagggcaagtattatgagccccttatcactaattccaagatgccatatagaatcatatgatgatatggagcagaggagaagagagagaggagcagccacccctcatacaagggacaacctccacaccaatttcaagaaataagagagaaagagagaagttgattggtagtaaatgtattgggtttagtgtaaggagatgcaatctattgtatgtattacctctaaattaatatgtagatgatttagacaaaattagatgtgaccactacctctatcatgaaacttgcccttatagtatagataaaagaaactttaatgttacgtggccattagagaagtgtcaactttgggatgttggcatgagaatcttcagtagattaactcctataagtttaagtttaagcaactccataaaacttaatacacatcttgaaccaatatgaactgcaatacaacagaaatcaccaagttacaaaatctaaacaaattacaggaacaggctctaggttcttgctagtaagtggaaacaaagaacgatcacaatattccaccacatttgtcacccgggacaataatcaaactgattgattattctcctggagtcctgggcgacaaatggacacacacatatcacaaatgacacgttaccaaagtgaagtgattattcagatttcatccactagacagagaacatatagtcacatgttcccagcaaacacaaaaagacacaaggtgtcactgtacagaaccaaggacgaaggtgtccataaaacacctagacatgcttacattgtcattaattaacaagccaagatatatcaggcacacgaggcaacacaacacctactaggactgacatatatagcttcataggcaaaggtagttagtcatccaaaactcggtaaaatcaccaagcatagctctcacaaccaccataatcaaatactatagggtcattcatcattggggcaacagttctgccgtcaataagcaaaacaaaagccaatttgttaatgacataggcaaacggaaacatcacaagatgagcaacgagtcaccgatataaattcatgccatagtcatatggtcagcaaagttaggccaaatccccataattacacatcataaaccaaaatgcaggacatgcgtgttcacattatttcgcttacaagaggtgatatagtcactctatgttatgtcaggaagcaaaaccgagcttttaaataatactactcaaatatgcaccttcatgaagaaacattaagaaaatacacaatacaaatttaccacccaacatcctatagcaatgttaggactacagtttatgcagtacgcagaacggcatgagaataaattaagcaaactgttattatttactcgttctatcccaaaatataataaattgtagcactcaaaatttgtcccaaatataacaacttctctacctatattctcttctcaaccgatcaaaatcttccgccattcaaattattcatccactttctcgtcaaccagtcacaaccttcccccatttaattctaccaatctatctatctatctattatatactaaaagtccattaaacgtcctataaacactcctaagttgccatatggcgctctaataaattataaaaaatcttagaaattctgagaaaaaaaaaacatctagccctcgattttacttaatacggtggacccattatgctacaccactagattatacagatcaattttaaaaagacaaaaaaacccaaaacccatcccgtggatctccacctccaccccggcccctccatccaggcctcctcttcacacgtacgtacacgcctaagtatgtacattccccatctagcctacacctatattttctcctttccttccttccatattccggttttctagctagctagcaaaatttaatacaaaagaattcaataattagctagctatataattataaattcaaagaatatattagattttagtttaatacatactcaacgttaccatctcatcgattttagatgatgtttaacagagcttgtaatgtattatagatagatcctcatgtatgtggcaatgggcttatatacctttagggtaagaacataagtccgtttattttctttctgcacaaaccaattaaaaggttaatcatctctagatatgagcattaacatgccacgaacatatttgtcctgcatatatacacaatgattaactttaagattcatttagattttatgatataccaaggtatggaaaataggactaactaaacttgatcaagagtgtgaacacaacacatgacaattttcataggtgcaaccaccatatctcagtatctacagaagtttcgtaacatggggcacaatgatcaggagttaaacgtatactagatgcacacaaaaaaatattacaaatttatcttgaaagaatttattgagtcttttgaacacaaatatttttagggttgttttggaattgaaagtgcatctaggcccctaatgattttggtgattaataacaatgcgattagagacgactaacattttcgtttgagtagatgtgaggattgttagttctcggcgcaccatgtttccatgccaaactcgataatagctacaaatccaagcgatgcggcatatgagcaaagggtatattgtacattttaatttctttgtgtctttaagaaagccgtactattagggggggtgatgcattgatgatgagtgatgtgggtgctcaaaaatcaatttttcaaagtgtttcttctcattttctctgttctggaattttctggagttgtctgaaacaggttttcagaatttccaaaaatttacagaa

SEQ ID NO: 58030 - DNA, 9556 bp, Oryza sativa
accgcttatgtatattttcggacatgtccgaaagtaatttttggaatttctgaaaatatctagcaggcaattttggttctggatattttcggatttgttcgaaatgttttcggaatttccgaaaaacttagttggacttcactgtgtttgctgttctggagattttcggacttgtccgatgctaattttcagaatttccgaaaaatggaattattgcacataacgggcagatatgaagctgtggctatagatagcctcctctcaccaagtcaaggctgctgctctcattgaaaacttgtgcccttggcttactactcttgagatttacttttgagccttgcttgcttgattcccctctccacccgtgtttgattcggatttggtgtgtgtgagagttgtggtttcgagcttgtgtgagtgcttggtgttgtcttcgtgaagatttttgagcacttgcatcattcccgggagttctttgcatcatttattactcttggaggttaaggacttctagatggctaggtcactcttgagtcaccgatctacgtgtggttggccaagagaagtttgtgaaggtcggatctcacctccgaaagggaagagaaaccactagtggaaggaggagtgctttgtgcaatctcttaaggaaagggttagcgaagacccggctcctcaatagagagtagaatcccctcaaggattcgaatttcgggaacatctcatattgcatcaacgtcaatgatatccctttctccctcctctagctttgcttgtttgcgccgctataagtctattgttgtttgtgctagtatttcttttgtgtaggcagctagatctagcatttcatttcagttgcgcctgctatgttatttttggaatttccgaaaatcattttcggaatttccgaaaagtgttgcttccgcatttacttaagtttttgaattagcctattcatcccccctctaggcctaattgaccctttcaggaattatatttagctgtttgatcgtgtttgtagttatatttagctatttgatcgtgttcatttttgactacgtggagcctctctgcatgaaactctcatatgggttgtccggcccccacccaattcactaaacagtgagaacatatattagtcttagctgcttatacaaaagccatttttttttaaaaaataaaagtttatacataaggtggaacattgtgcaactatttatcatcccacaaaatataaaagataaaataagaccagtataaaataaaatagaaaattaattatatcaatagggagtaaagtgatctaatttagagagaacctattttacttagcttgaaacatccatctctataagcatagcattgtaagtgcttagatgcgtattcgggaaaaagaataactgcttagatgctaatggtgttccctttatcctatatagttaaggtttctccacaactttttttaatcaatactgatgaacaattttttttggtgagaaatcatacttttgaatcgtggcataattaatccagtttccacccttataaacatggcatacgatacatgcgtgcgcaacaatacgagctaacttcctagtttccttaatactagtgtccaactctaaaaatacttatattttggaatggaggtagtgaatattttggatctgctaagttcaaaaaagattatccgtttctcaattacagaccatgtaattgaagaataatattggaaatgatatgtcatatgtaggacagttcatcaaggaaccaagcagttaaaggaacaataaatgtcactgagcaaataaggcattaacaagcaaccagcaatcgaaaacaacatgatttttctatacgtacagtgtaaaaggcatggcaaataattacctttagtataaaaactagtgaatggatgacagatgcctactcccggggcttggggaagaatcttaaattgcagactccagattaaccatgaagacaccaatagctgttgccagaaataccacattatgttcctcagcaaagcccagaatattcattggtgccggtgtatcagtatcaggccttggttcgaaaggaaggagcctgtccagttcaatagttttctccagcacccatccagcagcagcactgtcactattgatcttatgcttccatagattgagactaaaatcccgcacagcaaggaagagaagcccaccatcctctgctggtgcaatctggtcacctccatcgccatgcatttctggtagcacatcgatctaggctggtatttgtgtatccaaatcaaactgaaggatgacggtcccaataacactttggaacaagcaataaaaaaaattcccaaccaggggtactagaacgagtcttgtgccccctaaaattaaacgcatttgagatgaccttgccccaattgccggtgtcggatgagtaaacgcaagtgaaaagccgcctccggtacttattgaagcctattaccaccacctcaaagggactggagtggcagccgccgtgcacatgcccatccacgcatcgcatcgcccagttggagacgtacgccggccggcgaccgaacggctcggggatatcaacggcgcgccggtcgccggtgacgggatcccacaccgtgatttgcaacaagctccggtcgtagataagggcgcggccgtggcggaatgcgaacatatggtaaaagtgaccaaaaaccggggggctgccaccgccgccaccggggagcgggagctgcagggagaaacgcgccgcggagatccggtccggcgggtccagcgtggggatgaagatgggatttctgtagctgaccttgaagaagccgaggaggggtggcttcccgtggtgggatcggaagcgccggaggaagacggcgtcggagacgacgcggcgccaccgcttgcagacgagggaggcgcgggggagggaggacggcttcgccgggaggcggaggaggatctcggagaggaggtcgtcgtcttccagtggctgcgcctgcgccggcgacggcgaggtggtgcggcgtcggtggctggtcatctccgcctcacacactactctagaggtggccaaacgggcggcacggcccggcccggcacgggcacggttccggcacggcccgtttcggcacggcccgttaggcacggctgatgaaacgggccgtgccgtgccggcccacgtgccgagccgccggcccaagcacggcccgtggatggccgggccgtgcccgtgccggcacggcacgcccgcggcccacgggccgttcggggcacggcggcccgtgaaggcaggccgccagcctgcagtgcactgtgcgcagtgttttttttttttaaaaaaagcaaaggaaatgtataaggaaaaaaaaattaaaaatggaaataaaatgtttaaaaaaaagtaatgatttactaatgttaaaaaatgaaaaaatggtatttaaaaaatagaaataaaagttttttaaaaaagtaatgatttgctaatgttaaaaaaaaagaaaaaatggtatttttttgttgtgttgaaaaatttaaaaatatagattgtgattcattattttgaaataatttaaaggtaaatccacacttgcgaaaatattgcaaaagaatttgttaaaaatagtaatgacctttattaatgtttatatcattacaggatacaatgatacatgctgcctcgttaaaaactttgtcatgtaaaaactcataggggaaaatgagaaaaccatgacaaagaaaagagtacagctcaaaggtcagaactacttctaacaaaattctactggggttggtctggatccaggtagagttgctcgaagtgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaacttgaagacgatccaccccaaatcctaccccactgtatcttcttcttacctgtagtggggataggagggggtctccgctggcgaacttcctgaaactttacttcatatcttccaaaaacctcatataatttacgtctaacctcagtataaaaagaactataatctacacctatagtatctccaacaagtgataaaatagcagacaatccccttaatttacacctaggatctaaaacaaaagcaagagcatacaacataggtatatttttccaatatttcaaatatttttgtttcatgtgaaagacaggttcagttagaacgtcatcattttcgtattctttaaataaagtagcaatttcaagaaggttgtgcaaaattatattagcagttggataataaacatgtgacaaagttagagtacaatcataaaaagtttctagaaattggtaaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagcttccacaccggccgcattgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagctctagaattagcagatgcattatctagggtgacagcaaatattttatcagcaagattaaattcattaattacttccctaattctttcagctatgttttctcctgtatgtgagacatctattaacttaagccctaaaactctcttttgtaattgccaatcatcatcaacaaaatgaacaactacgctaagataatcctctctagctctactactccatatatctgaagtaacacaaacagagaaaatacatgtactaaacagttccttaagtgcagttgctttcttgtgataaacattctctaaatctctagttgatgtttgcctactcacagctttaaacctatggttatgagattgctgaatgtaatgttcaaaagcaggggactccccaaagttcaggggtaaatcttgcctggcgattaaccggacaagagattcccgagcaaccatgggatcgtactcccaactgcgtaccgtaccgtctgggtttagcataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcgaagctttgccacacaccggaggttctcgatctcttcgagccggtgtgtgtcgaaacacttccgctcgcggttccggaaaatccttccgaagctgtctccgcctgaaccggtacctcctcaacgacagccgtatgaaccggtacctcctccacagatggtggagttggagccgatccggaggtaccgtcaaaccccgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttgaatattacttacatctttccaaccgcgagctcttcaaacctctgcgatcaaactgttgaactacgaaattaattttgatttttgacaaaatttgagcaaattttgtcaaaataaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaattttttatgaattttttagcctcccaacggttattttcaaatttgaacggtcaaatagccgttagtgccacgtggcggcttcccattcgaccgcgcgcccgccctgtcagtgcgccgctggcgctttcggcctgacgggccgcccgggccgtgccgtgccgcgggccgtgccgtgccggcctgctacagtagccgtgccgtgccgtgccggcccgcgggctcggccaacggcccaagcacggcacggctacacgggccgtgccggcacggcccgttactgtagcaggccgtgccgggccgtgcctgctacaggaacggccgtgccccgggccgcccgtttggcccggcccatttggccagctctacactactccctccatccaagattttggttggacgtgccatgtcctattacaataaatctggacactcatgttagattcgttataccaggatgttgtactaggatgtgttagagcatctccaacagcctctccaaatacctctgctagctactctagcaaaaattactcatccaaaagcctctccaactggatggccggctggccaaaacactccctcccttagccaaatttgaccagccaaagtgattggctaacggtgagccccacgggcattcctcctcccaaaacacgcaccgcgaggggagatggatcggggcgacgagcggcttcgccgcgcgctggcggcgttcggaggcgacggcagcggcatttggagtcgagggcgcgacggcgaaatggcgaggccatcggtggcgtcggggtcgacggggcggcttgacggcgcatgagtccttcttcggcgtcggccatcggcggcatgatgagggcgacggggtagctcgacggcgagccgacgagggaggaacgaggaaggccggcggggagcggatcccgtcgttgcctcatgcgcccatcctcgtcgtcgtctagcggcctggtgccggccatcgtcgcatgaaaatagcgtcgccgccgccggctccccatccacgtgccccctcgactcgaggcaccgcctcctcatccgctgggtgggttggagatgggagggagtggcagtgacggcattgctcgacggcgaggttgagggagatgaggcggccggtaagagcttggccagaggggcaccggtggacggagcccgagcatcggcggcgggcggatagggatggggcggcggcaacagaggggagagggaaggggattttgagagaagtggaggaagaagaaagtcgtagagactgacacgtgggctctattatcatagactcagcataagcatagagaggatgaattggaagcctgttggagtaaaagagagtttgactagctaaattagatggagagttggccaaatagatatttggagagtgacatttagagagactgttggagatgctctcacctccaaccaaaatcgcttatatttagggacggagattatagtggtgtaatactgcactcttctctaatgtttggttagttggatgacttatgatgtgagatcttgtttggtcgattgttcttcctctatccaaaagtttaatacctattttttttcatcaagactaatttgtaattaattcattcatcatgtgataaaatcgatgaacatgtaaccaataagtactaaaatgacttcttgggctctcctaaaaaatttaatataccatatagtgactacaaatataacttatacttttgaaaaaaccaatgaatgaaatagaacttagacttttggatggaggaagtacttacaaatgctgcatactgcctctattccaaataaatgaatcagtgtctagattcattgtactagaatgaaatagaacttagactttgctacatactccctccgtcctaaataaatgaatcagtgtcaagatttgttgtactaggatgtgtcacatctagaactaggttggttttttattggacggagggaataccagagatattctttgattgttcgtatcagatcatagtatggttacctcctcttttgtagggtgagattaccccagcaattatggtgtactattcaattgcagttctattacttttcaattagccaaattttgttaaaatctgttgcatatgtaatgggtgaaaatcagtatgaagaattatataaaacaatgaattgtgctgcaacgataaataattcgctgcttagtctgaactttatatacgctataacatgtgagagaaaatgaaaaaaaaacagagaaaacgatagaaaagaaaaaaaatgtgcatctcgtcgtcgtcgtcattgtggagattatgggtatcccatacccacacggcatggttatccgactagtcatagggatagcttatatttatggaatatgtaacaaatcatgacttgggtattccgtttccatgtatattatggaacgacctaaagttctggtttgataatagatttaggaaaccgataccgtattggttaaggtttctatcttgtaatcctggccccccatcctatataaggtgggcaggaggccctctagggggcatgagacaactagatcgtcagatctatactacacccggcggattcaaatccccaaacaggagtagggtattacctctcattaagagggcctgaacctgtctaaatcctttatctccgcatccatccacttttaggtctcgtgcgctacccccttttcatattgccgaaaatttgtttcaacagttggcgcgccaggtagggggcgctgagttttccgactagtcatagaaaaattttctttatacgatattttccttttcctctgcctcactagatcaactggttcgccgttgactagtgagtcgggggctacatatgttatatcagattttttaataattttttatagtatttatcttgattgcttgcgacataatctgtgtacaaaagtgcctatcgaattatggagttctatctttctatgctttccgtttggtttgtcgatggatagttgcctttgagccgattcctagcacccgggggcccgttggatggaccgagtaacgcaaggtgctaagtattattcggaataaatcaaaagcatagagataagataaatttattttctgctctttacaattgcaaaagtacccgagcagtaaattctgattcgtgaaactttgttctattaatgacgaactcatgtcactcatacgcatgtttgggaagtgcctaggccgactcccgatgcttgggg

SEQ ID NO: 58031 - DNA, 1744 bp, Oryza sativa
tgcaacaaccggggaaactgccttccctgcaatgtgcgatttctgatgcccagtagtcaatctgaggctattggcacttatgatatcagtgcttattttactagccttttaccgtttcttggtgctgcttatctgaattttgtgtggaattgtgaattgtgatggctgaaatgatattctatgtgaaaagaaattactcgatggatgtctgttcaaaacttaaaccgctactaggaatgcttaaacatgtgaatagaggtagtaatatagtctgataatgacaatgatgattagataatgagcaaagcaagggggtaaagagaaaatccgtaaaagaacaattgaatttattaactatctatactaatggacaacaattcttgattgaatttaattaacggataacgatatttggtagataatcgatttttttttcttcttctccaagaagcaaacaaacatgattgataacagaatggtcctttccatttttttttccatattaaaacaacataaattgtcgtcctcatctccaattctccacagctcgtaaacccccaaaaccctgactaaaaccttcgtcatccgccgctgcaccgtcgccatggcttttttcgccgccgctcgccgggccggcacattcacccttcccctgcttcgcccgctggccgccgcggcggcgcggccgcagccccgctcgatgccgttctcgtcgtcggcccccttgacgaagcccgccttcgacagtgagctcgtcaggatcatcgacaacgcgatcaacgacgccgaggaggagagcgacggcgaccaagaccgggtgcgtgcgcgcgcgagctcctgaatctcactaaatcaaatgctgctattcgatcttctgctctatcatcagagaattatcttttgacatcattgaatcccctttgtttgttttgattttagtcgtattatatattaccatgaaataaacttaagcaatctgtcgccgttaggtacttcatatgttgtttgcgttatgttctatgttgctatagtagggattgggattagttatttaactttgtttttaaagaaaaggagtaattttcatactgtaattggtagcataatcatgtttacagcattgcaattgctttgctgagattgaggtaatatttggtacaatgatgtggagtatttgctattccactttttcatgctcatattaacttcaacttctcttgattatagtagattttggtgttatttatttgcagttactgcactattttagtgcttgatcattgttgttgtgccttgtttaattcttgtgtaaggttttgtgcgttcctcataagaattcaatatgccttgctattgtgccttatgaattgtagtacttttttgtctcctgtattcttgttctattagtgctgatgtctaaagtcgtttattttgaaatttttctccgcttagaactctgctggtaagttttaatcattctatctagttcctgtacctttctctgcgattatgcataaccagattgttttcctgaactatacattcatgccagtttgattactctgcgcaattatatatgatatataagttcaatgctttgaacaattttcatgctctccttgagagcaatgtgctgtgactgtctgactgagggcctcattttcattgtcatactgatacaggccaaggagatccctaataactccccctttaaaatctttaaattctttaaaatcaattatgg

SEQ ID NO: 58032 - DNA, 3020 bp, Oryza sativa
ccggcttaatcgacgagtgttttgttaattatgagttcatataatctcggcgtggaaatctcggcgtgggctgagagacttaagttagatgacagacatgtaatctcggcgtggaaatctctcttctccttttctatccgctccctcgatatataattggactctctgtactttctttgctattaatggattcaggtggggaagctctcccccccgggtgaattttcaaaaaaattatgagttcatatctcccaatttgaagtatggtgattcaaaggggagctatgcagtactagtttttggcttaattacatttagggaagagtggatttggagtactccatgcatatcggcgccgctcgccgtcgccgccgacgctgaatagttctggaagtttgccttgtcggccgtcgtgtccttctggtgctaaaagcccatctttttctccttttttttttcttttcctttttttttggggggcaactgttagaagagagggaagggtgggccatattaagtggggcccacatgccgtatcatatccatgacctttgtccttgcgttgccggcggcggcggcggcggcggctacggtggccatggagatctcacgcgaccatttgccggtgaggtcggctgctccgcctccgcctccgcatctacgcctgattgatccccacccctatctccactgactgtgctatcgcgtttccggcggtggttgatcgaggcggtagcccgtgcggcgcgcgagattccgcccgtccacggatttccggtcgccatcgccggggttcgtcttctccggccagcccctcgccgcgcgaacctgcgccgcccgtcctcggccaggatctggtcggggatcgcttgtggtaggtgttagggggcacttgggtttggaggacagcatcgttgatgtgctttgactttgagttccttgctaatttagttatgctgactgttcccataatccctaaaatcccagcagttgcgttgcgtggtaggttatgtaaagcgcattcctgtgatgaaaaatagaccctgggagacatattatcaattgtatcaagcgatccaacacactaggtccccaaatattgtcgtagataccattttctcttcagtatgctgcttaaaacgcaaagtgtaaggttttctctgtgctgtccagttacatctaattccttatgtttaaagactgatattagtctttggttgggtgtgatgtgcttcttgttaatcgcaatacttgatctttactatgatactatcggtgcatatttagttccagtatgcccttttagttaagttgctgaagcattgagcatcttgtcatgttgatcttcttgtgagtggttcaatatgatttgttctgttttaatggaagtaaaaacgagggctgtcccctcctaatgggaagagaaaaagagatgtattccagcaaccatgtgttatagtacaatccaattagttcgctaagctattatggcctttatatcctgctctgagtatttatttgatttgctgtaaagttattaaatttatggcattgttatacgtgatttgtacttgattatatgctgctattggtgattcatgtaattagagctgaatgggatttttgctagatacacattgcttctttcaacaacccttatgcgaacaaaattaatgggctggtttctcttctgtgctgatttccattgctccatagctgaagcttaagtaattgcaaaatttgtaggaactcatctgttcttttgctgaaccaatagacttttgtaaatacatttgcacaagacattgaggtcaactaaaattcttctatgcccaatggtgcagccatatttcatacatgaatatggctatcgctttgcctgataggttatggactgtgaactctgtgtttattttgatgtgaaaatggcctcaggggaacgcaggataactcatacatgtcaatccatacactaggtcctgagatattttcttaatgcccttttctcttttcactatactctacttgttaaacttctaagaaaagtcttatccctctactgttctattatatctataattcctttgttttgatgtcaaaagcagtgtattcagctgtatattttgttgtgatatgctctggttgatagtagttagtgtccgtgttttgacttgttgctgaacccttgagagcatctcgtaatgtttaactcttatgaattgctcgagatgaccttttttgtcttgatgaatagtggcatggcaacccaaggcaagagcactagggcctagaggtattcctagaaacttaggagcaaacggagaaagacgtagcaggaccagagcagaggacatttggcacctttgaaacaccataaatcatctcgtaaaatatattcaactttaaaatttgtactatgtaataggtggttaaattctgttcttctgagtgatggaattgcatattgtaaatcaatctctacttgtacaaaagatgagtaaatcttttgcttattcttatctacttttttttgtcaaaatgaataggaatatcaggtgcctttaaagtgcaagtataatggaaagagttggtaaattttaatatacttctgaaagaatcatcatccttgtgccattatctttttcatgtattgaacaacagatttgcacatgtatttttgccatctctaacagctctttattaacggatagtatatggctcttcttttatgtagggggatgttgagttgtaagaagaccagatgcatcagctctgatttagtgattttagaggcatgtataacctgtcaaagagcagcaaaagaaatgcgtcatagctgtgtgatacataactttgccaggagatctctctatttaagcacacagactgctatggcattgttaaacatttgctcagtttctcttaaatgcatttctgctggcataagatggtagcatggtggaggttctgttgttaaaccctggtatcaggacttgatcaagcagtttggtacgttcggt

SEQ ID NO: 58033 - DNA, 4198 bp, Oryza sativa
tattaagctcgatgatagagttgtaatttcttcctagaaagatcttttctcctcctcactcagaactctaaacatgtactccctccgtcccataaaaaacaaatcagtactgatatattctagtacgatgaatctacatatgtatgtccagattcgtaatagtactaggttggtttttatgggatggagagagtaataatgatctaagagttttactcccgtcggcgtccggcagcctgtaccagacggtactagtaccgggaggtacaagatcaaatctggccgtccatcttgaaatgatacgattgggaaacagaaaagagaagcggaacgattccagagtcacgccgccgctttcctccctagctgcgctctttctttcctccctccccgcatcgcttctttctcatctattcctccctccgagcgcagaaacggagcagttgcgccgcatccacgccccgctggacgattttttcccatccatctaccgtccgcgccgcggtgctggagaaacggcgcgctcgccccgcatccacgcctccgccagtgcccattttttccccatccatctgctgtccgcggcagcgaagccaccgacgcgctccgtcaccagcaacgccgccgcattcacgagcgaaggtgccgtggtattctgtgtcccctatccccccccctcgacggctcaagcaagtacctaacctcccccgctgccatcggcgcagcctaggcccccattacggctcaaacactgctccactatatggtctagttattttgtaatgaacaattcaatctgccatgtttcttgtaatgaatttgtgagaaaagcacaagcttttgctggagactttaatctttgaatggaaaattttaagctcatctgtcgtctgttttttttatgctgtttacagggcatgatctatcgttgaatggagcttttgacataatttttgtctgctgtgaacagagcatgatatatatgtcgtattgagagccattaatattttgtctgctgtttttgctcgatctcctgtaaaatacatgtcattctgcggagtgatcagcagcacaacaatggttacaaacaagtgttttcaatgaacagcaatccagctagagatctaaaagttgaggaatcactggagtaaagtgctagacacatgggcaataattgctgaaaaaaagtataatttacatgattctgaaagactgaaacaaacatactcgtactagtgagctgtaattcagagtttcagacagtgggagtgttaaatatgtgacaatatattcggattagtttcccagtaggagtttctatcaggtgtatttattttatccccctatatatactcttgtaagccgtacaggaaggggtgacgttcacattgtgattcccctacgtttgtaatcatctcctctgtagtgatcattgccggtcggcatccatggttttttcccgcaagggttttccacgtaaaattcgtgtctccgttgtgcatatattttcataacaagtggtatcatagcattggacatcaatctactaatcacgcggccaccggtgtttttgggatcggagaatcaatctgatcagcggcggcggcggcgctcgtcgttcgttggtgtcgtcgagttgccgacttgccgtcctcctgaccgccctgcgcatccacgcaggagcagcagcagtgccgcgtggaagccgcgcgggagaagcagaaaagcaggaggagcaacagcgtccaatccatccaaccagcgcacagttcccgagaaaacaaaaataatctaccgagagatttctgatccggttgattttttcaaagtgggaattgctacggccacctaagcttgtgtaccaggagataccctgatctacgcttcgtgcacacggaaagtgcaccagaggttcgcgtttttgctagatttaccctaatttctttctagcaaattcaggattaattcccatagcgagtttgaagtatgatctaccgctcctggaccaacacacaagattctcactttgacaagtgaagatgcgagccgttcttgcacaacaagacctcgatgatgcactttctggatttgacaagaagacacaggattggtccaacgatgagaagaaaagggatcataaggctatgtcatatattcatcttcatctatctaataatattttgcaggagatgcttaaggaggagatagccgctaggctgtggttgaagctggaacagatatgcatgactaaggatctgaccagtaagatgcacctgaagcaaaagttatttttgcacaagttgcaagatgatgggtctgtaatggaccatctctccacttttaaggaaattgttgctgaccttgagtctatggaggtaaagtataatgaagagaatttaggccttattttattgtgttcattgcctagctcatatgcaaacttcaaggatactatactttatagtcgtgatactctaactttgaaaaaagtttatgatgctttgcatgccaaagaaaagatgaagaagatggtaccctctgaaggttcaaattcgcaagcagaaggcttggttgttcggggcaggcaacaggagaagaacacaaacagcaaatcaagagataaaagttcaagtggctaccgtgggagatcaaagtccagaggtaggtataagtcatgcaaatactgcaagagagatggacatgatatctctgaatgttggaagctacaggacaaagacaaaagaaccggaaagtatataccaaaaggtaagaaagaagaggaaggtaaagccgcagttgttactgatgagaagtctgatgcagaattgcttgttgcttatgttggttgtgtacaaactagtgaccagtggattcttgatactgcatgcacctatcgcatgcacctatcacatgtgcccgaatagggattggtttgccacctatgaagctgtccaaggtggtactgttttgatgggtgatgatacaccatgcgaggttgcaggtattggaacagttcagatcaagatgtttgatggctgtattagaacattgtcagatgtgcggcatattccaaatttgaagagaagtctcatctctttatgtactcttgatcgcaaagggtacaaatattccggtggagacggaattttgaaggtaaccaaaggctctctcgttgtgatgaaagctgatattaaatctgccaacctataccatctgcgaggtacaactatattaggtaatgttgtagcagtttctgattcattatctaattccgatgctactaatctttagcatatgcgtcttgggcatatgagtgaaattggtttggcagaattgagcaagcgaggattgctagatggacaaagcatcgggaagctcaaattttgtgagcattgcatctttggcaagcataagagggtgaagttcaacacatctacacatactactgaaggtatacttgattatgtgcattctgatttatgggggcctgctcgtaagacatcctttgaaggtgctcattacatgatgactatcgttgatgattattcacgaaaagtttggccttatttcttgaagcacaaatatcaagcttttgatgtgtttaaaagagtggaaaactatggttgaaagacaaactgaaaggaaggtgaaaatccttcgtactgacaatgggatggagttctgttctaagatatttaaatcatattgcaagtctgaaggcattgtgcgtcactacaccgttcctcacacacctcaacaaaacggcgtagctgagcgtatgaacaggacaattatatcaaaggcccgttgtatgttgtctaatgcaggtttgcccaaacagttttgggcggaagccgtttccactacttgttatcttatcaatcgatcacccagttatgccattgataagaagactccaattgaggtatggtctggttccccagcaaattattcagacttaaaagtattttgttgtactgcttatgctcatgttgataatggtaaattggagcctagagctattaagtgcatttttcttggttatccgtctggtgtgaaaggctataggttatggtgtcctgaaaccaaaaaggttgtgattagtagaaatgttgtcttctatgaatcagttatgtgacacgtcaaacactttactaatgttcctgttgagagtcaggagaaagcaaatgtgcaggtg

SEQ ID NO: 58034 - DNA, 26657 bp, Oryza sativa
  unsure (1)..(26657): unsure at all n locations
cctgcagcccctgaaatgaataggaaaaagtacaccgaaggtcccttaacttgtcatcgagttatgaaatcgttgtccaaccacaaaaccagatatataatatccctcaacttaaataaccgttcactctcttcatgtcagcgtggctatgtcatcacctctctctttccctcctctctctctctctctctcacttttctcctctttccccgccgcgccgtgcctccctcccggtgctcgctctcctcctcctcctccccttccgcgtcctcgccgctgccgcggggtcccacttctccccctgcggtctcccgcctcgcgggccgcctccgcctctccccgtccatggccgccgtcacgctcctcgcgctcggcaacggcgcgctcgacgtcacgggcgaacgatgcaggagggacggcgaacggcgcggcgatgagcgcgacagccccgacgacgaacgcggagatgaacgggcatcgacggccggcgacagacgacaaggcggcgacactggagaagggaggaggccggcggggcgacgaaggagaggagaaggtccggcggctggctcgcggccgctcgctcgcccgccaccgccgctctgctccaccgaccgcgcgcttgcctgccgccgacccgccgtcggcgcttcgctccgccggccgctcacccgctgcacgtgcgtgcccgctgccgcttcacttcactctgcgcctgacactcaccgacgccccgacccctccgtcctcggcgagctcgtgtacagcatccccggcgccaagaacgtcctcgagatgcccctcctcgcagctcaggcacgtacatgaactctcatgcgattatccatttaatcattgtgtttgttgctcataattgttagctaaataatgtaatcttgtgcagtttctgttgttgcgttgcatacagttggctgtgttagaatctggcagcagccggtcagtagtggatctagatcaatcgggcttctttctgttatgcatgtaacaaactctgtaattgaggagaataaatagaaaaccagaaaagcagcaaaggtattacgctgcgccaaaaactctgctcgttttctctgttcttcagttaaactgttcacgttcgacaaaaggttcagagattgtgagagtgagagtgagagttcgtgagttttgattcagtgtttctgtgttcctaacaataatcatctacgagttcttgttaatggcgatggtttaggtgactcaagtgcgatgggttcgtgctcggtctcgccatcaaccactgcatgttcaacggcgtcggcgtcatgcagttcgtcaactcggggtgtgccgctctccgtcccgccggcgctcgaccgcgccctgctccgcgcgcgcgaccccccgcaggtcgcgttcctgcaccacgagttcacgcagatcgacgacggtgatgacggcggctcgccggcgcagaacggcgccgagccgttcctgcacaggtcgttccggttcacgtccgagtcaatcgcccacgtcaaggcgctcgtctcggtcgactgcggcggcggcgggcgcgcgcccacggcgttcgaggcgctggggatggggcatgcgtggcggagcaagctcctcttcgccgtggacgggcggccgcagttcacgtcgcctcctccggcaaggagacgccgggcccagccccgcgctcgcgggcgctgccctccggccggcctgcccagaggagaaaagtgagagagagcgagagattggaggaagggagaggaaagagggaggaaagagaggtgatgatatggcttactgacatgtggggcccacgtgggtcccacgctgactcagccgccacgttggataaaaccagggtcaaaaccatcaaatgacctaaaataaacggttttgtaagttgagggatgtcatatatcggaggacgatttcgtaactcgatgacaagttgagggaccttgggtgtactttttccaaatgaatactccctccatattttaatgtatgttaccgttgattttttgacaaacgtttgacctttcgtcttattcaaaaaatttatataattataatttattttattgtgacttgatttatcatcaaatgttctttaggcatgatataagtatttttatatttgcataaaaaatttgaataagacgagtgatcaaacgttggttataaagtcaaggcgtcatacattaagatacggagggagtatattgtttccgtaaaatggcacttcatggttattgataggaacaatcagctatctgaaaacagtggtatcatatcttactataaagttatcccccactaacttcttaagcttgatatgaagatgcctcatcatcattcactaacaagataccacaccatcatccactaattaacaagatgtcacatcatcatgcactaacactcatcacatttaaacatcatgcaaacatgctatatctttatagtttttataatttaagagcttttcaaatacaaacatgttaaattatcatccaacataattcatataatgtttcaatgtatatctttattatgttttatgatatcttatatatttatatagttcatcctcacttagttagtgcttaaatgattaatctatggtctaaattatctttttctttttttcctctaattaagttatatcacattaattgtttttagtctttagatgattaatctacggtccaaactatctccctacttttttttccctccgtaaagtcataccagcttactttttacgtttgaatcaccattctacatactatttaaatttaaattatcataaatcacattaatttacttaatctgatgttatctagttatcttatacgttatttttttattattattatcatactaaatttccgcagcaatgtgcggggtttcacctagtttaataataaatataagtatatactacggcagctggccaacgtatgatgaccctacgctaatgatgcagcaatctgccacaagctgtttcaagtgctcaatggaaactcgaccatcaagctgcaaagtgcaaaattgctgcttcgttcctctttccatagcttacggatcggaccgtttctcaaaccatgcatgtgctaaataagagagagatataaatgcatgcacttaattaggacttcccaaacataaagatcacatatatatagacatcaattctaatgtttaatcaagtctatggagaaatactaccaaatgagccaaaacttcccatatataaattatttttttagtaaagtccatcaccgtccctaaacttgtaccgttgttttatctcagtccctacactcgcaaatcgaccgttcatcctcaaaattattcaactgtgtcatcacggtccttaaacttgcagatcactcgtttagatcctccaatatatatatatgtatatatatatatgtatatatgtatatatatatatatgtatatatatatatatatatgtatatatatatatacacacacataccagctatgctgccgtgtacgtacataaccagccggctgctgaaattactatacaaccaagacgacgtggacgccgcggtgttcaaggctctcctgtacttcatgtacacgggcacgatgcccggggggccccgccgcgcaagacgacgacggggcgccggcggcggtcatggcgcagcagctgatcgcggcggccgatagattccacctcgacaggttggagacgatgaggttgaggcttctctgcgaggagttgtggactagctactaccggtgtctggcgacattaatctgcagcgtagccagcgactacgtctttgtaacgtcctgccttcccccaggccgggcccgcttacatctgatagctttcataggtcatagattgtcctcacagaccaacacatatcttttctgcacactttgtcctcactcgtgtgcactcgggaagaatttcccggtcggtcacccatcccaaattgcttcaggccaagcaacccatcccaaattgcttcaggccaagcatgcttaaccctggagttctttggagattggcttccggaaaaaaaattgcaacttgttgatataagtattctattaatcctattaagccctaggccgggatgttacaccctcccccttaagagagatcgacgcccccgtcgatcaaccctaggccaggaacgtcctctcttggccacgtccatgtgtccagtgccagcgcatgtgccatgctgtgtaaccactcccggtctacaccagccatgcgcaccatgcctgcgcaactgcgacacacgcgcccgtgaaaccgcgagagtcggctctgataccattttgtaacgtcctgccttcccccaggccgggcccgcttacatctgatagctttcataggtcatagactgccctcacagaccaacacatatcttttctgcacactttgtcctcactcgtgtgcacccgggaagaatttcccggtcggtcacccatcccaaattgcttcaggccaagcatgcttaaccctggagttctttggagattggcttccggaaaagaagttgcaacttgttgatataagtattctattaatcctattaagccctaggccgggatgttacagtcttccatggtttaaggacatgttttcaaagttttgtggtggtgccttttaatttaggcttttcgagtaacgggtgcagcttaattatgtaaagttatactaatatgtatgacgtcgttgattttttttaccaatatttaactattcgtcttatttaaatttttttttgcagatataagaatattttaacgtaggtgccacgtcagtcaaaaccgccatccaaatcgtcttgggacttattttgcatcgtttttgatagttgagggaccagttatatctggttttcgggttgaaggatgaaaatcagattggttgacgagttaaggggacctcagataagcttattccaagcaaaaaaaaaagctaagaggagagggcccacgcgcgatggataaaaccctctcacgtattggcgtatgtattttgttcgtgcgaaaaaaaaaaaagaagttcaaaactaatcgcgcgcagtgatcgtacaagcgatcgatcgctcattatatatccttttcgcgcatatatacatggcaccgtagaaaaggaaaggaaaacccaacacggaaaattaaggaaaacccacctcgcacgcgggtattccacaccgagtccgagttaattacgttctgccccgagcggcaacagtatttatatcgactgcaacacacgtcgtcgtatcacacgtaaacccggccgctgaaatacaaaccccaaaccaattcgagtgagttctccgacatgatgacccgtcgccaggatgcctactaccgctacccaaccacgtcgaccatcgtcgcgtcggcgccaatgcccaccggccaccacgtcctcaggatcgacggctactccctcaccaaggccaagttcgccgccggcgaagaatgcgacgagtcgtgcagcttcgtcgtcggcggccacgcctggcgcatcaggtactaccccaacggcgccgtcgtctccggctccggtggcttcgtatccctcatgctctcccttgatcatcagcccggcgccgcattgccggccgccgtcgtcaaggcgcggttcgcgttcagcttgctcgacatggacggcgagccggtgccgtcgcgcacctacgcgagcgacggcgtggtcagcttcagcgctaattcgtcgagcacgttcggggcggagaggttcatcggccacggcgagctcgaggcgtcggggcacctcaccggcgaccgcctcgccttccggtgcgatgtcaccgtcgtgaagcgcgacgggcctccgacgatgtcgaccctctgcccggtggagcacgacatgttcagatgcctgctcgacaccggggacgacgcggacgtcgcgttcagggccgccggcggcgagacgatcgccgcgcataggcgggtgctcgagcgacgggcaccggagctggccaagctctgtcgtcgtcgcggcggcgcctcctgcttcatgggactcgtcgggaggcacatcgacgtcggcgacatggacgccgctgcgttcaaggctctgcttcacttcgtgtacaccgacacgctgccggagacgatggccccgcgagaggtgccggccatggcgccgcagctgatcgcggcagcgcgtaaatacggcttggactgggagaggttgaggctcctctgtgaggacaaggcgtggggatggcgcgtcgacgacacgagcatggacacgacggcggcggctgctccggctaccggcgatgatccgaagcgtagccagcgacgtcttccatggtttataaggaaatgtttttaaagtttggagatgcgtagttctagcacagacagatactccctctatctagaaaataagtgctaccatgagtttctgtgcacaactttaatcgtccatcttatttaattttttagaaaaaaaaatctaaaaacataaatcatgcataaagttctattcatattttataatctaatataaaaaaatacttactaaaaaaaaatactagtatacggaaacttatgattgtacttattttgaaacagagggagtatatgaaatactagtagaaaaatgtacctctacttacttacatagtcataaaataaatagtttatatcttctaaacaaaataaaagttcacttcagttttcagttcagactcaccttaagctctaaatgtaacgaaacggaaccaataaaattaagggactgtctactcctcgacagaaaacccctcctaatatcttgcaaatttttgttcattggattgatttgagattcgtgcaaaccccaccaaaccctaaccaccttttcctttttcctccctgccgccgcacaacgctcaagcgctcctcccctcctctcagcaccgcgcgcctccttcactgccgccgccgcctcactgttccgtcacccggcctcgccggctggccgaaaagtgtcaacgacgccggcgaggccccgccggctggcccccttcccctcccctcctttgcctcaagccggcggcggtgcgctgtatgtcgtcttccccgtcgccggcggcggggcgccatcaccggctacctcctcctaccactctttcagctttgcccccgtcgcctcaaccggcccgccgcccgctcccgaccccgcggcttcggcgccgccgccgccgcctcgccacctgcccgatccgccgcccaccgccggactgccgcctcccacggccatccctctaaagccgacgaactcccctctcttccccctcccacccccaccccaccccgggatcctaattcgtcggccctctgccggagtttgggttcgccggcgccggagaagaagaggtggtcgccggagttggagaagaaaagcacgaatcgtgaagcacatccaatgatccaaaatttgcaagatttgagattgtgttttctgtggacataaatttagcatttccgtaaaattaatattgttttttattgtttttacattcaatatctctaattctattgtatgcatgttacatgtaaggttaatcaaaacgagaagatgataataaatatttttttatctttaattaaagggggtaatgctttatattttagaatggtgggagctaaggctacactttactgctataagatcggcgtcttctctccacacgttctatccataagtgtcgtggcgacgtatactcagcttctcttcctcgctcgaaagggtgtcgccatgcgcgcgttcgagagcttcaccggtcgtcacgacgaccgccgcctcgccttcatcaaggacggcgtcgagctgcgagccgggctgccaccagggccggctgggacagtaaggacggtgcgactgtactgagcctccaaaaattaggagcctcgaaaatatgtatactatgatatcaggcctgataggcttagaaaaaagacagaagaccaatcgacgatcgaacatatcgtgacggcttgattgtattttaaacttatttagtgtgaaattcgttaatgacaatgagtttttaaatattatcttgtaattttatggtaaatgtagaccttcattttttttccacaccgaaccactaaagagtcagtgccggccctggccaccgccgccacccgtcggcgaccctgagtccggcggcctgcgccgccgcttgctctccttgctggacgggacggacgtcaccttcagggtcggcggcgaggcgttcgccgcgcatagctccgtggtcgccgcgtggtcgccggtgctcagcccccctcccccccccaccccccttgcggtcgccgccaccgccgccgccgtcttcgacgctgcttcacccgaggacgacgaaggtgcatccacgtcgacggcgtggacgccgtggcgttcgaggctctcctgtacttcatgtacacgggcacgccgccgccgccaccggagacgatgccggccggccccgccgcgcaagacgacgacggggtgccggcggcggcgatggcgcagcagctgatcgtggcggccgatagattctgcctcgacaggttggagacgatgaggttgaggcttctctgcgaggagttgttgaccactggtgacaatcttctagtgtagccagcgacgacgtcttccatggttcaagaacatgtttttaaagtttggaggtggtgccttttaatttaggcttttcgagtaaacgggtgcagcttaattatgtaaatttgtaaatgtatatatggaaaagtatttttagaacttggtacgattacacctagccacctactagctaggttatacatgtgttatcatggtcctctgccatgacaagctgtggctgtgacgcgtcgagctgtggcggatctaaaaaattgattcgttggtgtcataattaatatgtactccttccgtcaaaaaaagccaaccttaatatggatgagacattacgtagaacaacgaatctggacatgaagcatttccagattcattgtcttaggtaatgtcccatccatactaaggttgttttttagacggagagagtatatcggtgtcataatatgttaattatactagttactggtgatgacacaatccgccgcacgtaggcagcgacatcttcaatggttaaggggatgtttctgaagtttttggaggtggtttttttagggattttggtcacacataaatactcagtcagtttcattgtcgttttaccttttttttttctaatcaaacttattttattgtggtatatttttctataaacttcatcagacataaggaaatttggcagaaaaagaaaatcaaaccgacttataatataagcgggtgcactattaattaattataacatgttttatctcaactttcatgttttcaaacacgtgaagtgggtttacaaagtggtcaaagctgcagatcgatatcatcatcaggattgctttgtttgccttgccgacgggtgtgtctgtcatttgtgccttttgctacttcgcctcgttcccatcgccggcgccgcgccgccggtcgccggcacggcacaggcggcggtgctggcccgcgatgaaggtggcaatgggcccatcctggtgacgcaatttaggcccatatgttgactagtcaacgggcagtctccccttcatatgctgatgggccgattcgtgggctttaatagaccttacggccccgtaagtgaacaaaataaaatgtttctacctgaaaaataaattgtttctgtaaaattctcctgttctaaatggcgcttcatagttttttttataggaagaaacagctacttgccagtactaaaaataacaacagtaaaatcctaactatactggccatccaagggtaatgatgcaatctctgaccaatgctgtaagcctataactgtaactctgtgcgttctcagttcaatggaagcatcaaactcactcacatgaagccgcaaagtataaaattaagctacctacaattaattgatgaaaggatgtgtataatgaatctaatccccgtagcatgctcttaggaaacaataggcaaacaaacgataaaaaacaatagatcaatcacataagacacgagattttaacgtggaaaaccctcccaaaacaggagagaaaaaaccacgggcgctaaccagcaaaatatcttcactatatatggggtgaggttacatcgctgcacggcgacgggcctccgctctactacggcagaaactggactttattaagtgcaaatgaatttggatcacaactcaacacatgctgcatgattactgaacaaagcctacaaaacaaagtgcaaaaacgcctggataaagtcagaaactagcccctgcatgacactattattccagtcactctacctacagcaagtacagctacagctagtcgagtgtaaaaagaaagtcatcgtcttcgtcgatggctttggtcaggtaaagaagaactgatgatgatgcagaagcagtggcaaactggcaatggacaaaggaaagcagcccagctttgcttgccggctaatgctgtccgtgtccggctcacttcacttcagtgtgcagcggcagaattgcctaccaaataggctttttttctcacgtctgcaaaaatcttcatttgtccttacctttgggcctagataatgaccggctcctcctcctcctcctgctgctgcaagtctgcaaccggagctgggaaaaatcgagatccaatgctgtaccacccactgtgcagaatctactgttctccatgcaattccacagtaatgcaaagctcatgtgatttcagaaatgaaattcgaaatgcaagattttcaggtaaaccatctagcatttctgtacttggaattccattcagaagtctttgcacttgctgaaaagcacattgtatttttctttgaaaacaatgaaagcacatttcaataaatccttggaaacaaaattattattactactacagatttcagatatatcagggagattctggagtagtttggtcaaagatacaatcttttgttttactacctcacaaaataggactgcacagagaaatgatgaatgatgcaaatagggatggtcctacactcctaccaagcaacagtaaaatatgtcagcatgggttaataatacaggcagagatccaggagaccagaggcatgattcagaaaggctaaaaacaagaaacaaaaaaaatgtgacatgcaaaagatgatcagtagtactagtggctgtttatctccattgcctctgggtgatgcagctgtaatcacacaccaaatggtgaaacagaagcttcctccagtaattcaaaatgtattggtccaagggatgaatatgaccaacagtcaatggttggctgatcatgctcatactcatactagcagaccagctgctgttgcggagtaaaaatttatcctttctgacaaaagcctggactgctgtatatttatgctttgataggttattagagttaagtgcagagagtgtcatggagtgtgaaaagaagcaatcagttttattttacgaatgatacattaggtagtagctaattccaacactagtacatagacggatagaccgtgtttagttcccaactttttcttcgaacttccaacttttccatcacatcaaaactttcctacacacataaatttctaactttttcgtcatatcgtttcaatttcaatcaaacttccaattttagcgtaaactaaacacacctatagaacattcaaggactgcaactactaaatggacaacactaggtttgatttgtagactatgttttattgatgttggagcaattgtgcaaatatgtagggtgtgtttagttcacgccaaaattggaagtttggttgaaattagaacgatgtgacgaaaaagttggaagtttatgtgtgtagaaaagttttgatgtgatgaaaaagttgaaagtttgaaaaaaagtttggaactaaactcggccatactctcatccaggttggaagaattttgtgttttcttccaatgatacagaaatgttttaatgaatcctttcaatattatctaaaaaaaaatgaatcctttcaatgaatcctggtagaaagtttcactatccacataagtgcagatcccagagggtcagtgtcacagactgaaaaaagcaatgaattcaacatgctaaaaggtgctgcccaaccctaagcaacaaccaacagttaaataggcgtgaagcagagctaggagtgaccaaagactaaaagagtcatcaaactactcctacttggctacaccgaacattcaaatagtaaatgaaataactcaagtttagttttgaacatttccaatattgagtaatcagcactcaatttaccatcattcagagaggacaaggctcctgtttgtagggcttttacaaaggtaacatcaagttcacccttttaaaaagatcctagagaaggacctacttgctgtatatatttagtgtaacaaagtgctgtaatgactgtcattaagtaggattcagaccagggacccctcctaatcataggcttagagccatagacataaggtggtgcacacaaaatcttgacctctgcacttcatagctcatgccgcccagacagtgacagtcctcagttcattgaacttcacataagctcaccaagtaaccaaaacacataagctcagcttcagctcagtctcctccatggagcccaagtcttcttcttcctcacactatctgcagccatctgcaacattgccatcaacaagaagagtaagcaacaaacacatctccaatcccttcttctacttgatttcttgattcaagaagaccagacaaatcaacaacaaatcagtttcttgattgaaaatttcatcgtttgatccatcgatttgcagaactcattccaaggagtgggagctgaagctggaggaggaggaggaggcatgaacccattcgggcccacattcagtgacccactctgcagcctcaacctcaaggagacctcagagttcgtgaggtcatccttccccatggctaccatggcgaggagcaacagcagcaacggcgccaccggcaatggcggccatggctaccaccgcgagacctccacggcctcttcatcctcttcctcctcggcctcagctcagaggaggcgagccgagcagcagcagcagcaggtgccagctactccagggcggccattgctgttcttcaattcctcgagccctgcacatcaccagctcgtctccgcgaggaggtcggtgccttccaagtgggaggatgcggagaagtgggtgaggcaggcgtcgtccgaccaccatggcggccatcaccaccaccatggcaagggctccaagcttcaggaggagaagagggcgtcggcggtgaggaggtcggtggatgctgacgtcactgctcttgctctctacactgctcctgctgcagaagtgttcctcaaaggtgagatgctgaaatatttttttcagttaatttttgtacttctttgagtttttctttgtgttcataggcagatgaaatttcagtgaggtcactgtcagaatgaatttctgaactttcttgtagagttgttctgagcagtaatttctgaactttcttgtagagtaattctgtgcagtaatttcttaactttcttgatgtgtaatttctctgcactttattggtttcttaagctctcattttgtttcgtattttgttctgaatttgccaaatgttttgtatcttgatgtgattcatacgattccttcacatgtcacatatgcatccaaagtttcagttgtttgttctgaatttgccaaaaattcagtaccataattgttcatcaagaactagaactgcaaatctcacaagttttttacgtttcagacaagttcactgacaatgtggagccctccaaggagagcttcgtgttccggagctcctactgcgagccaacaaagaacacggcggcgcaggcggtggccgccggcaacggcatcgaccaccggcgtgacatcggcacggagatgactccgctgggcagctccaccacctcgaggtgccacacgccgatcaagagcacctcgccggcgaggcacaacacgccggcgagccggtcgggccccctggtgccgtacgccggcggtggcggcggcgccggccaggacatctcggacctcgccgactgccacttcgccaagctggacctcggcgcgcagttcgacgccatgctcatcaactggagctccaaggaggaggaggaggaggaggtgtccaagagcttgaggcacttcgaggccagcgtcgccgccgtcggcgagaagcgcggcggcgccggcgactgccggtgggaggacgatgacagggccaagagctgcataaggtttgcacaagaaattttagcataaattatggcaaagattagagatgaatttctcatatgatgaaaattttcttgtgttttgtctgattattaggtatcagagggaagaggcaaagattcaagcttggatcaacctggagagtgccaaggctgaagcacagtccagaaagctagaggtaaaagctaaataatttcatcttttttcatattgcaaagttcaattatggcatcagaaatagctattttgcttctggtccaagattacactttaagaacaatgtagatgcaatgataaaagtagccaaaacccaaaaggtgtagtagtgaattcagaagggtatatgtgtgatcattttgagccctgtgcatattgcaaagtaaaattattgcatcagaattcagaaacagaaacatttttttttcttccagtccaaaattacacttttagatcattgtagatgcaatgatatgagttgacaatatttgccaaaaggtgtagtggtgacttcacttcactagttcactagggtagatgtgtgatcattttgagccctgtgatcttttccttgtggattcacaggaagaaattgcctgtctcaatcttctgtacaacaaaagaatctgaacctctggaccctaccggtttgaccgtgatggcatactgagaatctgaaaacagttgaacaaaccgaattaagtacttcaaatcctgcagcagagtatcagttatagctggttgatgatgctgccaaatatgacatattggcatctagttctgtcaagttcaaacattgcattgtgaattgtgatttgttaattgacaatggtcaggtggtcactgtggctgtacacgctaaaaccatttttcagatacaatttgtctgaacccaagtttattgatcgataacttggtattttccaagtatcgataaataccagaattataaattacagacgaagattgggatcatggctatgtcattcccatgtttctttgcctttgcagtcttgaacatggttaaatccactgcaaattcttgtttgtttctcgtgtgtcgctttgcttatctaagttgcttagaaatggtggaaagtatgattgttcattgctttctatgccatcccctaccctttcaaccagttaccatgattctttaagattttgttcctgacttactatcattccaaaagccatgtgaagttcttcgatccgagagcgccacacgataacatttctacccataatcaaagatcaagacatgtgctttcagtgatattgtcatgatctgtgatactacaatactagtaccaatgcatatgcactatattctagtgaacacattgaattcaaagtttgaaactttttccctccatgctgcattctcccaggtcatggcaagaccagctgcatggtccttcagaataatcctctgaacctgacagaatttctgtcacaattttttttttcaggtgaagattcagaagatgagatcaaacctggaggagaagctgatgaggaggatgacgaccgtgcaccggcgcgccgaggagtggagagcgacggcgcaggcgcagcacctccagcagctgaagcgcgccgccgagcaagtccggcgggccaaggccaccagccaccatcaccaccaccaccacctcgccggcagcaacgcctcctgcggctgcttcccctgcaatggcagcaacaacatcatcagtggcaacctcctgaactactattagatatgatcagctagccgccatggaagaaggatcaagaatgccaatttgttcgggagatcaacgggttcttgttgattgtagtggatgtttgggacgtgtgaagatggagatgtgggagataatggtgtcatgtgtatcaaaaaactctgatttttcaaggtgatatataccagattgctgaatgccaaatgtcatgaatggtttgtgcaaatattcagaatgagcatcatcaatatgaagaacaaattgaacagctgaaccaagaatttattagcaaatcctgaattttcagctaagcgattcatctaatactttcatgcaaactcaagccacattccgaatgcgcggaattttttccccatgtcctgaggaactcgaactatttcatgtaaacttgcagtgatctataaacttgcagtaaaatttttgtactagttcaaaatgtcacagtgataaatcttgctggtacttcaaaatgtcagagtactacaatctgaactccatgcctccttgtcttgctctgtctctcaagtccatggttgctgctggttcactaaacagcacaacatgtagcctcattcggacagttcttcccatcaggattcaggaatttctcacaatcttgctcctacccacaacaggtgaattaattaggccattaaggagtactaatactaaattactgtcagctagaacaagaggctcgttgcctcgacattcgtgcctgcctgccatgccatgcctacaaaaacaaaaacagaatcaaaccccagcttaggttcagtcctgctgctaaaatcaagattggctaagctatcttaggttcactaaccccagcttaggttcactaaccaacacatcgcttttgctgctggagtggagtagcttgctttgtctgcttgtctgaacaaactaatctcatactctgacgacgttgctgccaaaacacccaaagaagaacacatcagcatcgccgcaaagtaaccaagttaaattaacccgactaggccatattaatctatcactaatcctcgatcagtaggctgccgacggagaggaggacaggtccacatggggaggcgagccattgctttgaccggagggtcacaactgaactcacacgggtgagatgagccaagcagcagcatcgcatgctctagctaaagctaagctagatgatgtgtgggggccttggaggttgtccgttttggaggagccagagacggcattgttggctatggtgaatgcagtggcacggcaacctaggatgccattgccattgccatggccatggcctcgcgtgcgccatgaagaagatgtagacagtaggctgcactgtagccttctctctcaccttgtcgtcgagccctgtgtcccctgaatgcagagagagaaagagggtgagagtgtgtctcaaagtgtgtgtgcaatagtgtgagagagcaggataaaagcgagatgggagaagataaagccctagaaatgtgaacgaaagcaaagaagaaaaatactccactctactgatttgtaggtaaaactaataatttattagtgacatcaaacagtttagaaatgaaggtatgaaaagagactacgataaaaaaaaagaaaaccaaaatcaatcctcaagggtaacttcaaaatgcgggatttgaaaaacacagaaatagaaaaaaaaaggataggatgtcattcctcgtcgaatcttgtaataagtgaatccatgattttatttttaaaaaatattttctataggaatttcaaaggattttgggaatgccattccttcgttccaaatgaccatataagactatttttcaatgaaataaaatgatttattcggattgtaggaaaaacaaagggaaaatgaagaatttagatccctaaggattcgatgactgtagcaccgtttggttcacatgaatttatcttagggaaaatcaaaaggaaattttcctttcatgtgaattctacttagaaataaagaaaaacttccatacactccaacctcctactgagaagcaaagataaaattccatccactccaaaatgttcctacgtttttactttgccatgtccgagcacatattttacaatccaatctaaagaattctagttttttcactcctctattttacaaatgcattgtgatttttctattcctacgtttttacaatattgtgttccgaagaagccctaaaattcttttatttttccttttgtttcagagcagaggttgaaaagccaacaagccagaatgttgctgatagcagaggcatggctgcactgaacgagaagagagaggctctgcttttgttgtaggaggtgacatgaggagaagggaaggtacaggtactaggacggccatgcgtcggatgttacatgacatgcatggctctgtaaaactgtagaagagagatcggtgagaactgaagacgacgacgtgcaggtgacaagctagggaagaagaatcgtggataggcgtcgcatgggtttttgctgctgctcaccaggaaacacgagattcttcagtgcagaaaaggatgtcgattttaccggttcatttgagtaattttttagctacttcatccgtttcatattataagactttctagcattgcttatttatatatatatatatatatatatatatatatatatatatatatatatatatatatatatatatatatatatatatatatgttaatgaatctagacatataatgcgtttagattcattaatatttatatgaatgtagtcaatgctagaaagtcttataatataaaacggaggaagtaaattacaacctcttattgctgatatctcctccagtcctcgtagcaaaagaaaacaaggcagctaaattagctaagaagaggtactctgacacggctcttttcgaacgcaggaattttgacaagattttcgcgaaatttggttcaattcctgaaaaagaacattttgaaattcctccttgggagacctatacagagttttctgggccatacaaattacctgctaacttcagcaaaagcagagaatttcctaccgatcgtcctgngataatctctcacagtggcacagttcgttcatcttttcagggagatgtacatggcccatggcttacatgaccaccattgctgcatcggaggaacatgaatgtatcgatctctgctgctgctgctaaatgtctgaagaaagcatagcactgcaaaaggaggcgcggtacatgggtacattacatatgctgnctgcnnagcanatttgcacttgactcatcagctggatcaatcggcttgaacggcctgcttgtcctctgcatccccatcccatctggatctcactgacaacaatctcatgtcacaaagagccctcttttctccagtactcactcccggccatcctctgccattgcacaccacaccatagacatccaaggccacatgcatgtttctccttgcgttttccattgcccaatcttgtccatgtccggatgctttcatttttctcctggtgaacgctgatgagttcttcatcctcttcttctatgaacattccatgaacagatcagattccgaaacagatgaaccgagaagacaacacatatcagcatcagtgatgactgttgctgcagttgaaagctataacattctgctgtttggaaatgaaggtgtggtttatttgttgcaactagtcaatggaagtagcacagatcgaattaggtacataaataattacaattgagagccatgagtttagctgctaaaattgtggtggtcagaactcagaagtcaattttcaagtcatttgagggtaacttcttttgccactattctagacacacttctgcaggcatttatttacaatgcagaacgtgacaacattataatgcttccttagtgaaatccttagaaatgagatagtacaggcaggacagttggaagagttgttgtcaaaacaaggaaccaatgtacttctctgcttttcgtagctccaaaggatctgccattcaatcaaattgacatcaaaatggcccgatcctccgcttattgtgctgcctgcctgcccccgtagtaaaaaaaacagaccaagactgtcatacaaataacatgcacatattcttgggtgtccagtttttctttctttccagatcttgctgtaaatcctcaggactccagttatttaatctcagttcttcaatccattgatttttcactagttctaggcttctagcaattcccttgttgaaatgcatccaattctgaaaacatatatagaccatttcttaccaatgcaggtgtgttgttcagtcatcgtccttaatattgttgtcttcagacggaaaactatcaagcaaatcacttcctttgtagttcgtagaaccaggacgagggttgaacgggtactgactgtttgcgatacacaaggatgctgatgatgttctgttactaccagcaccccagatggcgaactttgtattttcaagaagaccctcagaagcaatccttgcatctcggaagggttcaatgcatttttccttggcaaacttaacacaagcttctcttgctgcttcaagacaagcggccatctcacgctcttcacatctctctctttcttgatagtcagttggtgctcctcccaataaacctttccaccagggtggcttgcatttgcgtgatgcagtaattgaacacccagaccgtgccccagcctgtggaatgaaacacagatccttactcattcatcatttttgttttaaaggtaaattctctactagaatagactttactaagtacactacacaacaatggtggatgagaagatatatgcaagcaagacatattgattcagcctgttggaaatcagttattatactaaatgaaatgcataaaacagaccatggcaccctagaagatgaagaaaaatattaaaggcagctttagttttttgatgatttactaacacacatgaattgtttcttggcatataacagttcttgatcaacacagtattgtttgtcaataagcaacacctgaacacaatatttgacaacctctgctcacataagtactgtccaatccttctgagaggataaattcctaacaggaggtgagctcacaaagaggaatcaatagttccaacacaatgcttttaaaatgataactctgcgcattgtaataggaacaagctgaaaggtatgattcatgttctttataataagatacacagaagacagcataacacactacaggatacatgcatatgtcaaatcaccgttgaaatctagttccatcacacataattattacttctagaacctaacactaacagtatttcagtagagaaaactgcaaaattgtaaatgcacttcaagaatatattgtgaaagcattatcaatcatgacaactaaagctaagcagtcatgagctggttgtttgctctctttaatgtatgcagctgttatacttcctgactgccagagctttagccagtcagctcggccagctgcaagagtagcaacagtcgtcttcttttaagggtaaaagatgcaaaaagaacatagtgaactgctgtatcaatagcataatgcgccacaagaaggattatcttgtcttgcatatggaatcaataaagtttgttcaaaaaaagaaattcaattgtgtaaagcatgttcaatcctagcaaatgttgtagcagcacatacatgggaggctgtcttcccttaaacaagggagacttattagccaaaataatagtgttcctcccttctatcagagtaaaactcccagttgatgcacacaggatcattacaacttactggttgagtgtccatgttgctccaaaaaactaaaaagattatattgtcatatacatcctgatgtatgaatgacacgctatagcattgtactgtgcaaaagtaacacagcctgtggaatgtacaatgttgtggagcattgtcaaccccaaccactaatctccagtagccaggagctggtttgctctgtttgatgtatgcagctgctaaacttattgcctagcataactagcgcaaggcaactcggccagctgcaaaatgaatcacaatctcaggggaaataattctaactgcagagttgcactggacttattaaattgcctttatcatcaacacaaaaaaaccatacactaggcaatggaacaatacctgatgtacccaaatccatcagtaaactattaagtaaaaatctttcgatgctctagaaccaattaactacttgcattagccaatggaacaatatttaatacacccaaatccatcagcaaattatttgcattgctcatagccgcacctgtaaactaaccgagaactcacattttccacataacgaattctactccgaaatagtaaaatcctacaatgttgccaataggtcacggaggagaagggggattcacctcgcattgcgacaggaggctggcctcggcggcctcccacgcggcgcgccagctcgcggcgtcgcggaaggcgaggacgggtggctcgccggatgcggcagacgacgggacgggcgcacggaggagcgggagcggcgggtcgaagcggaccacggtggccgccggggagtagtcctccgactggtcgacgctcccgccgggcaacggaacgtccatcgcgccaccggcgtgggggcaacgtggtcgccggcggcaaccgcggcggcggcggcgagggaagtggccttcgtcgatgcaattagttagggtttggcatataaacgagtaggattcgtttatatgcttgctggatcaagtctgtctacgtggcggccgagaggcgagagctacaaggtgcagacagaattcaactcaccattgcatgtctctaatatgaattctaatctgaaggtgaactcatcttatgacaaataatgtctcctccacgacgacatatttctcatacttacaagaattatggttaactgtgggatcacgagaactatacagacagctagttctatcaaaaagctctgtcgtgttgtgagctacccgaactcgtacgacaaaatgtctcgtaattcgtcattaattaaaatcaaccgatgccaatattcataagattttctagaaaataggtcgtaaatcaatgatgttttacatgttcgtcatatggtttttgtcacataatatcatatttgttgcagaatgttagcgaacccctatcgatagatcatagatctagctaccaacctttgctcgaacacaagactagatgatgaacggggccaagaacacagggtgtttggtgctgcgatgaagcggcagcttttctgttcttttctcattgcaaatataaaaggaaagacaaagacatgcaaagcaccatgatcctccactatgcgcaccacgatcggttcacggcgtgtgccatcccacacgcccccgatcgtggtgcacgactcgactatgacgcgctcggttcgcactctatgcaatagaagcgccgggcccaacttgcaaccgataacatgggagataattaacacacagcaacacacagtaacacatacatgaatccccgcaccaaaaaaaaaaaacatagatgaatccttacacaagattattattattaagtatcttcaatatgatcctcattaggcctagcctttcatcatttcaatcttgggcaatacttcagtcgccaagtccgggcgctgtttcctgtcattactgctgcatttcaggcctaggtatatcatttgtacaacgtgtcctgcgtacttgtcttccaagttcagtttgctgtccacgatttccagtgtcctgagcaacttttgcctgggtgtattctgtgtttccaaatttacacctgccgaactataggataaatatgtttctaaaaacactgcactttgccctgttactagctgcaacaaaatgatacccaaagcaaacacatctgactgaggggtcaattgttttgaactctcgaactccggatcaatatacttccaagtgccctttggttcttttgttccatggagaggtgttgctgtgtgttgagtatactctaaatggcgggaaattccaaagtcgcagagcttgcattcattttcagcgttgaaaaggatgttgctgggattaagatcaccgtgggcaattggattaggttttgtttcgtggaggaacagaagagcagagcatatgctggcagccactttaactctttcttcccatgagaaagattctctgtgttcttctgagagacgatcttgaagggtaccattaggtaaatactcaaacgagtgcgagtttctcagtgcaggctcctataagggtgaccaggtttggatgtcggattctcctgaggatctcaatctgcgttgtagtgtcatatatgagaaagaataagaatgcaagaaaacctttatattttgggcaaaattgctgtttgtaaaaaaacattttgtatgaaaaaggtgcatcaatggagaaacaattaagaaaacatagcaagtacgatacgaactagttgagctagtatctatctatatattatattattaaaacagttctgaaatgaggcatcacgttcgctgtggggctagaaattcccacattagtcgaagaaaaagagaaaatattttgatcgttagattgtagctgtttagatttttcaatggtgcagattaacacatgaaaaatatcgaagtccaactagaaaacgactaaaattgggaccggcctattctatatacagtgatggcaagttaattaaacctttatgattaggattaagagtcggacatatttgcatggaggtcctgtaatcaaatccagagtacaaatctaatcagtgtaggacacgttaactcaaggtagaaataaaaaaaatcaaataaccaatacagttggaataaaacaatgtaagaatatcatgtatgcatgagcaaagggaccaggaacattaggcgtccaagtaggaatacattttaaaaataactaaaattcagaataaacaataattaatattgaaagaagagtccatataggaacccaatacgatattaattaaaatttagaataaaaataaaataaaacccaaaattagaaaaataaaggacataagagtttaagtaggaatacaaattaaaaataattgaaattcggaattaaaaataagcaatattaaatgaagagtacatataagaacctaatacgagattaattagaattcagaataaaatataaaataaaaataacataagtttaattaaaatttgaaataaaaatcaaattaaattctgaaaatataaaaataattataggagttcaagtataaatataatttataaataatataatatcggaataaaaaatatagaattttcaataaacaccatccatctagaaaacgcaacaataacgaatgacaataaagagggaagaagcaacaaagtcgtaaaggagtaaagtgacagcagttgatgggacattcaaaaactataaacaaaacccaaatagaatcccaatggcgatcaaaaggagggacgacggacatgccgttaagcagtacgatcacggtggttggcgggatttctagaaagtaaaaaaataaacctcaatgatattaaagagggaagacaacaagggtaaaaataataaacaaaaccacaaattaatagaatcccaatgacgattaaaaggagagatgacggataacctgttaagcagcacaaacatgatggttagcaggaaagtaaaaaaataaaccataatgagaatcacgttcgaattttaaaatatcaatgacaattaaaagggaagacatcggatgggccgtttaggagtataatggctaacttgcttatggcttggtgggacttctacaaagttaaaagtgaacaccgacgatcattatattcgatttttaaaatccaaatgacgataaagagagaaggagacagacgtgcataagtggagtagagtggcggcgtttgatgggacttctaaaaattataaaaatgaaagccaatgagttgattaagtctaaaatttataaggttctattttaaagttcaaaggaggacgaatagatgccgtagtagatcgagcaagcaaataaatgtgtgaaaaaagagcaagaggtagcggcaagtgtgactttaaaaaactataaaattagaaaaatagagatgataaggttcagtcttttaaatcctaatataacgaggaagctatttaacaaattttaagtaaactcatatgtaaataattttgtatggatactagccgcgtaattncgcgggccacctagctagttattatattattaaaacagctttgaaaggaggcaccacgttcgttgtgggggctagaaattctcacattaatcggagaaaaaggaaaaaaaatttaaccattggattataatatatctagatttcaacggttaagatctaatacgtatatacgtatatagttagacattagagttgtagtgctaacgtaggaataca

SEQ ID NO: 58035 - DNA, 2268 bp, Oryza sativa
tgttaacttctaagaataagcttatccctttactgttctataacatctataattcctttgttttgatgtcaaaagcagtgtattgagctgtatattttgttgtgatatgctctggttgatagtagttagtgtccgtgttttgacttgttgctaaacccttgagagcatctcgtaatgtttaactcttatgaattgttcgagatgaccttttttgtcttgatgaattgtggcatgacaacccaagagtactagggtctagaggtatccctagaaacttaggagcaagtggagaaagacgtagcaggaccagagcagaggacatttggcacctttgaaacaccataaatcatctcgtaaaaaatattcaacttttaaaatgtgtactatgtaagtgttgttcttctgagtgatggaattgcatattgtaaatcaatctccacttgtacaaaggatgagcaaatcttttgcttattcttgtctacttttttttttttggtcaaaatgaataggaatagcaggttcctttaaagtgcaagtataatggaaagagttggtaaattttaatatacttctgaaagaatcatcatccttgtgtcattatctttttcatgtattgaacaacagatttgcacatgtatttttaccatctttaacagctctttattaacggatagtatatggttttgcttttatgtagggggatgttgagttgtaagaagaccagatgcatctgctctgattttagaggcatgtataacctgtcaaagagcagcaaaagaaatgcatcatagctgtgtgatacataactttgccaggagagatctctctatttaagcacacagactgctatggcattgttaaccatttgctcagttgctcttaaatgcatttctgctggcagaagatggtagcatggtggaggttctgttgttaaacccggtatcaggacttgatcaagcaatttggtatgttcggtgaaaattcatgcacatttgagcgatcgtacagtactccgaagttggtgttttctatcctccggtaattgtggatcactggtataatgaggaaatcaacctaacgtataattgccatggtctatatttgtgtgtatgtggagactggtgtgtgtactaattttctggaatgtcatttagtcagaagagttgtttagaagaggcataggcaaattctcttgtaaggcttttgtagttccttgagagtttaacatggttataacattagtgcgccggccgtcctcggccaggatctggtcggcatagcttgtggttgttgggcacttggggtttggggtttgaaagacagtgtcgttgatgtgctttgagttcctgcttaattgagttatgctgactttgttagtatccacatcttcagatactattcccataatccctaaaaaaccagcagttgcgttgcgtggtagctaggttatgtaaagcgcattcctgtgatgaaaaatagaccctgggatgtatcaagcgatccacacactagctatgtcccccaatagggacaattaatagaaaaaggtggaaagatggtgatagggaaagacgacaaaatggaagtattaaccaaaagatcaaagaagtattagccaaaagatcaagacggggatagagaaatgtggaacatattagccaccaatcgcagtccacatttcgacgacgagagacctggctgcccttctaccaccagttcacattcccccaaagcatttccaggtcttttacctcctctgcttttggaatctttggaatcacaggcatggagtggttttaagaaatgaagctctgtctcttcatagattgttgacgaattgcattaaaaatgtgactctttgggcggaacgtattaagctcgatgatagagttgtaatttcttcctagaaagatcttttctcctcctcactcagaactctaaacatgtactccctccgtcccataaaaaacaaatcagtactgatatattctagtacgatgaatctacatatgtatgtccagattcgtaatagtactaggttggtttttatgggatggagagagtaataatgatctaagagttttactcccgtcggcgtccggcagcctgtaccagacggtactagtaccgggaggtacaagatcaaatctggccgtccatcttgaaatgatacgattgggaaacagaaaagagaagcggaacgattccagagtcacgccggccgtttcctccctagctgccctctttcttttctccctccccgcatcg

SEQ ID NO: 58036 - DNA, 2296 bp, Oryza sativa
tgcgcggctagcacccatacaaaatatttattttttaatatgattttacttcatatttattaaataactatcttattattttaagactttgaaaggccaaaccttatcatccccgtgtttctgtttttatggattttaaaagtcacaccagtgctactcgttacttctgttaccctttttttttcatttgcttgcttgatttaccactgtttttattcattcttcttgaaacctttaaaaattggaccttatagttttttgaatttattgtctcgttaggttttgcttttataatttttagaagtcccgtcaaacactgccactgtactcctctatggctcatccgctccctgctctctctttttcattgggattttataaatcaaatataattatcgtttgggttctctctctttttaattgggattttattaattaaatataattatcgtttgggttcatttttttacttagaagtcccgccaaaccatcagcggcttaatttgcctctctattcctctatggctcacctgctgcctcccctctttattgttattgagatataaaatcaaacatgattatcattatttttatttactttttagaagtctcgaacctttaaaaattggacctcgtagtttttatagtttgttctctcattgggtttaatttttataattttcagaagtcccgtcaaacgctgtcattatactcctctactgtccgtctgctgactcctctatttattgttattgggattttaaaaatcaaacataattatcgtttgggtttattgttttgtttctagaagtcccgccaaaccatcaacaactttgtcactgtactcctatacagctcgctcgctgtctcccctctttagtgtcattgagattttaaaatcaaacgtgactatcattagggtttatttaattaatcttgtgttctaccctatctagactattctttttaatatgctttattttctattttgaattttaattatttataaattttattcctgttagaactcttcattattgggattttaaaaatagaacctgatcattttttggttttcttttcatagtttgtagaagtctcgctagccgtcattgccaatttcctttgccaccctcatcttgtcctcttaataatgcaataaaattcatttcttcttttattctatatattgtagtttactttcaatattttgtctttctaattctagttatttttaattgtattcttacttgaacttttattgtttttctagtttgaattttattttatttttcatttagagtttaattaatctcatgttatgctctagatagactgatagttaaatatttgcttaaaaagagcttgtctgttgtcagtccttgcccgatggggagttcaaatagatagattcttgttttttaaaaccttatttttatatttttcttgtatttttacaacttgtgagtaggatttgcccggtacttatttctgggaaatcattctcaaccgttataacatatgtccaccatgaattggtgcaaattgtttgttgaaaaaaaattggtgcagattttttctttttctttttattacttattaatttggtaatttatagatatccttatgtaatatttggatgtattattaattgtatgtgccattgctgcatgtagcgggcagattgccaatcaaaaggccggatagattttttgtttaatgagcttctctgataaaaaaaaaacagaaaacatgttagttgtcagccttgtccggatgggacttgggtctgaatagaacttggacttttttttttttttgctgtacggtttttttttttgacaaagtttgagtaggactcttatatctgtccaatcaatctcaatggttaaatgattgatctatcataattcaatggtgtagatttttcactttttcttcgattaatgtggtaatttctagcctccacagtgaacgtggtgcctcctttcaaagctgttttaataatataatagatcttatcaaattttggcattatcaaaattttggtacagttgccaaaattttggcaggatttcttatatagttaccaaaatttggcagcaaactaaatataaccattttttagtaactttaccaaaatttggtaaggttgaaaatagcatcagagtaaacatatcctgagatcctcagtgatcaaatgcatcctctgtggtctaagtaaacaggtcctgtccaagttgatggtgaacgttttgggttttagacgaaatttgatggtgaacgaagttgatgg

SEQ ID NO: 58037 - DNA, 2780 bp, Oryza sativa
aggccttctatataaaccaattgttgattttgttcacctgcaattgaaatttcattagttattttgtatgtatttctggaaatagatagcccgccgtgccaatgtgccatactgattaaaatgctgcaggtcaagatgcaaatgctgggcatccgtctcctcctagctgttccctcttaagtgctggaagagtaagtctttttgtgctgttatttggaacttgaccaaggatcgaatcttcttatcggtgttgtttatggaactgaccagaccatatgcttgtaccattctttcagtgttatgctggaacccagaatgtctctactatacaaaaagaagaagcttggaaagttaatgtgcggatcaatgactgtgatcttgaacagggttatttatgtggaacaatggaagcagttaatgttcccttagctgatacccctgtgagctactacttccttttccactttgactctgatctttatgttccaaattgttcattcgtatactaatttagtaggcaaacagtttgttccgataaaatgtaaaataatgctatgttttacttcttgttaccattatctgatttgcgtagcaatttgtaaataatttccataggtggtaacattctgggagggggagatagtggatgctaaaaattatacatttttcactggcaagtgggaggcatcgtgagtagttaactatttatgttttatccttgatactatcatctacttgttttattaattgatgccctagtttagggtaacagtccaaacttactcatcaaacattattcctgcttatgcttttgcagcccagaggatgatattagacactggtccaagttcccatcatttacacctcttctggtattctgttgcctatcttcgtgttgttagttgccacgatttgttaggatacatttctcacttatgtttctccacagagtcagatagagacagatggtggcaagtctgtggacttcagcaactatgcttacatattcatggtactgcaccatctgacctttcatgtatgtgccccatttattgaaatacaaagtcataacaacttagcattattctgatgctacatgtagagatggaaagagcagtactttgtcaatgttggagtggactgtgggttgaccatagctggtttctactatgtctgcttttcatgtagcgatggttccattagcgggtattattatgatccaaacagcaggtaatgtatatttcgctggcactttttattgcgatgtaacaactaaattctattgaggaattgaagtgatataaatatttcctgctctctcaatttacagtccgtttcagaagcttgaactgaagtgtaccaatgagaaagattctggatttaccttttcatcctacgagctgcagtgagagactgacaggcctgttgtcattatagtatttgcggatgttaatatacacaatgtgtgtactgaactcataattttgaatggcgtcccattaaaagagctgagatggcatgtttgtaacagtgattttgagcaagatgtattttattctctttgtaatatgattataagctggtaaaatttctaatttgaacctacctgtgtgttctttttgtgctaatcacggcatggttatgtccagaataaataagacaagaatgtgagggctagttgctcgttcaaagaaatatatatacttctttccagagtaattgtagttctgcagttggaggatttttgttttctttcaatatttctgtactgcctacattgtggaatttgtggtcactgattgtgaatctaatatctgatactgagctttatctgaagagacacttaagattgaaatcttgtacattagtttctggtacacagccacagaaacctccttttggtttcacatgcagccattgtaaggtatgatgtaattctatgaacaaagtatacttgggccgaacactctgtcttcgcctccggtcttcggacattgtaaggtaaacatctctctacttatcttgtttcatagagtcttgatctcatgcttcaagccgtagtcaattctctaatgagtaaaattcttctgcatctgcattgcacaggcttcaagttattgctaaaccctataataatattctgcagataggactacccttgcacacctggtgaagcttaccttcatacacacaaggatgggtggacagtggaacaggaggtaactcttctctcctttctggcagaaaccaagaatacactttctttgccctctgtaccaaaggcctctcaacattctcacaccaggcgtcaaacatatcgaggacagcctcagtaatgacttctgagagtactttatcaccttctccaggtgccagcttcagcatcatgtatctcttgaacgatacgatcttctctaacatttgccttctgtcaatattatatgatgacatcgcgccttggattatagagaccatcctgaggactgcctcacagactatagcatatgcatgactgaatatctcggttgctgtttctgacagttctttgctgtgccaatcattttttacaggttctggcccctgttctaagattggcgcaaatgttacagtcttcggtttggttgtgttgacacggagctgctttgattccctcagcatttcattggcttccttcatttctgactcaaacctgctgctgaccttgaagtatggttgctccttgtgtgcagttgggctcgggagtggggaattctgccttgatgatgcttccaagaaaacct

SEQ ID NO: 58038 - DNA, 47062 bp, Oryza sativa
  unsure (1)..(47062): unsure at all n locations
aaaataatagatgatctcagttagaacagtcaatagtgtatgaatcatgaagcacattagaatttggaaggaaataaaaattttctatgttaccttcctcaagcaaagccatttgttcgctgtcctcttcaacactaacatagtttcctccacgaagccaatcattagcacaaacaagacgctcaaccattcttgggggttagtgaggtcctaaagtcatctagagttcgcccaccagcactgaaggctgattcagaggcaactgaggtgataggaattgccaaaagatcacgggccaaatgagataatattgggaatcttgttgaattggccttccaccactttagaatgtcaaattttggtgtgtcggctcattatcttctgatagatacttgtctacctcagatttgatagttccacttccaccctcactgttaagttgctgagtaattactgacatccacctacaactcactcttttgctggtttcagctgtagattcagattcagtaggttgcggtgccttatcttttggggtatacatttccttgtactcttcaaacaaagcacgaaaataggtattcactgtttcccatactttttctcctactgtatccccaaacatcaccttaattcccattctaatgcaatttgatagtttgtatctaggatcaatagcaacacagaagaagacagtgaagttgagtagttgatcccccttatctttctctcctctcttctctctgtccccctgcctctcaccatacttctctccccaatacttgtagtacttcattagcattcttgtacccatttccttgctcaacttgtcttcactatgagaccattctctcaacagaagtaatacatcagcaatctcatggaaataagtgtgagatgttgtacgactttgtacagaaacacggagagtgaggtcataaaagtgttcaagaaaatcagccatcttcctagccttctcccaatctgctcttgttggtacccctggaccattctctccttctaattctaatttgtagtatgggtcttcatcactatatctttcaaatgctttttggtacttctcagcagcatttaacataagataggttgagttccatctagtgcaaatatctaagtttagaaatgctttgctctgtaccttggctaactcagcacatttcttaaattttaccaacctagatgttccacatctgataaacttaacagcagcacggacacgttgaattgatgtaccaatttccttcaagccatcacctactattaggttgataatatgagcagcacagcgcatatgaatgtactctccttcagcaacacaaccttttgactcattcaagacccttctcatatacttaattgcattattgtttgcactagcattgtctactgttattgtaaaaaccttgtcaatgccccactcagccaagcagttctctaatgattttccaatgtcctcccctctatgtcccttaaccaaaaaaaaaccaataattttcttctgtaggttccactcattgtcaatgaaatgggctgtaacacacatgaagttttggctgttcttagcagtccatgtatcagttgtgaggcaaactcttacacaattgtccttaaaaaatttcttaagcttttctttctcatcttcatatactttaacacaagctctagtgattgttcttctagatggcagaacaaatcgtggacatgctaaagtcataaatttcctaagaccagaacgctcagataggacaaatggttgttcatcttcaattatcatctcagcaaaacaccttctaagtttatctggatcaaatttccaagtggtcacagtaccaagagtactattgccatcacatggtgtcagttgcaaagttccttgattatcaactactggtttgttaggattctttttgcaaatcttcagatgagctttcaaggatgacgtaccatttgttcttgagccgcaatgaaatagcttggtacaccacttgcacttggccctctcgtccccattagcaagtttgaccttgctgaaactttcccatacatcagatcttagagccattggttttctttttctggattcttcatcagctttctctccatccttggactgctgctgctcctccttgtccttgcttgcatctaccactccagtagttgacactccggtttcagtgtcttgagattgagtgtgattaatctcacaagcaacagtttcatctgtgtcccccatctagatcaaatgtttcaaatcactaaatcagaacttaccaacatagaacagcaatacaacactcattcactcaacatggactcaactagaacaaacgaacaagaagtgaagaacttacataggaggactgctcggtccgcgccgccgttgtcttggtcggagaactccacgagggtgttgccggcccgccgccagcagcccgtttgccggccgccgagttagggtttgggtctttgggcgcagggggcggtgtgctcgcgggcggctcgccggggcctacagctgctgctcaggggaggggagtgtggcgctgcggccgtgcggcgtgccgcctcgagcccgcgacggcgaggtagggcagcggcagcgctgcggcggcaccctgcgcggctggcggccgggctagcggctgcgccgagtgacgagtcgggggcgtgacgactgacgagtcgggggcgtggcgtagggttggccttgcccttgatggcctgatgggctgcgaactggtgggccgtgggctgcgccgccgcgagatatgtcggtttaatcggttgttcggttcggtttctctataaaaccgccgccgcgggatatgtcggtttaatcggttgttcggttcggtttctctataaaaccgaagccgaagccgtacaccgaatagcacaaaaacagaaaccgaactgacaaccgaaaaccgaaaaaaccaacaattcggttcggttcggtgcggttcggttcggtttgcggctaaaaaatgcccaggctgaaaacagacagatcaagatcagaagatgttgccaggatgttattcttgggattgagatgcagtgatccaatagtgaagaatcatccaatcctcgccacagaaattatgccccagattaattcaatgaagagtagtgactctaagaaggaataaatgtatgtacaaagcgggccaaaaataaaaaacgaatgggacaaagatactggagggggaaacgaaggacaaaagcctaatctcatactaaatttggcgacccttctccattcacagggagtcagggactaccataacggggattgcggctctagccagccgccaaagctctgcttcacccgtcataacccttacaatctccgcccatgttccgctcttccaaagctctgcttcacccgtcataacccttacaatctccgcccatgttccgctcttctagttgaagacctgattgtttctttccttccaaatcgtccacgctactagtgttgcgatgatgttgaatccccggcgatgttccttgaccatcttcttacggctgtcacacaaccaagaatgaaaagagggctcattgagcggtaaacactcggaatgcccaatagctctaagagcaatccaccaaagttgtcgagactccgggcatgcgaccaagagatgatcaatcgtttcctcgcattgatcacaaagaacacagcgatccgggtgcgacaaaccacgactccgaaggcaatccgctgatcccgttgaaggcagtctgctgtccaacaattctgtccgtcatttattccttcttaatacaatgatgtgctcactctcatacttagaggtgatgggttcactgtgtgtgtaggttggccaaaatatagtttgttcaacaaagggaagaacatatatattatcggacttctgttgtaatctgtttaagttcaattcttctctctttttttttgaaaggatttaagttcaactcttgaatggacatttcctgtacctcgtgcaccaccagttaataatttcgacttacatcagacctgaaaccttgtaactaggactcaattatgactgattgtgatcttgaagaacaattaagattctagccctaaccccataatttgatctgataaatataatacccaatactaccaatattttgatctgataaatagaacagccaatgattgatatatctgctacgctcagatttctggtgaaaaatggaaaatgcagtgagtaaagatgtcagctctgcagatttgtgacaaaagtacatgtttgctgctgtagttttgaactgtttgtcaatctgatatttctaggctttatgcttggcaaatcttcatcatcagctcccattggtccatcactctactaatctagcccggaccagcccatccaaaatacactgatgcttgctggctacatgtcaggttggctgtgcggctttcctctttccttttgaccctcttcgattctccttttcatttgttcctactttacctgcaatcctgcacggctgctgcaccttctttcatctagctagtagaatttgagtttttgtaacacctaggagaccatgtgggcccctccacctcctccccgcgttccccgctggccatgtgggccccgacgaagacttcctcgccctccatgtacctcgcacagagtcggccactgtggcaggcgtccctttcatttgttcttgatttacctatagtcctgcacgactgccgcaccttctttcgtatggtagaatttgagtttttgtgacacctaggagaccatgtgggcccctccacgttccccgctggccatgtgggcccccgacgaagacttcctcgccctccccgtacttcacatagagtcatccgctgtgtcaggcgtccctttcatttgttcctgatttacatgtagtcctgcatgactgctgcaccttctttcgtcgggtagaatttgagtttttgtgacacctaggagaccatgtgggcccctccatctcctccccacgtgccacgcccccgacgaagacttccttgccctccctgtacctcgcatatatagaagccaaccattgtggcaggcgccctttcatttgttcctactttacttgaagtcctacacaattgttgccccttctttcgattggtagaatttaacggccctatccttaaaattgaagctgattttgatgttttttcatcaaaatttatttttcaacctttacttttaggtcgctaagaacaattatataaaaattttattcacaaattacttctcgtttataaatgtgctgggccgtgagtttttttttacacctaggagaccacgtgggcccccccacctcctccccgcgttcttcgctggccatgtgggccccaacgaagacttcctcgccctccccgtacctcgtacagaaccggccactgtggcaggcgtcatcgcgtcggcctcatgcatgccgacgctgccnnnnnnnnnnnnnnnnnnnncctcgcctttttttcccgtcgtccgtgccgcgccaagtcgccaacaccgatgcacccggtgcaccgccttgccttctcgcgctccaactcccgcggtcgacagtccacgccgaaagtgtgagccgagctcacccacgccgcgtcgccactgtcgcgtcgcctcgcctcccctgtgccgccatgcctccttccatcccctcgaagccaccgcgtcgccattcgccatggctatagaagccacctcgctccaccatcctccatctttcgccattcccatcgccactaccgtcttcgctctcccctagtcggcccgaggcgcgcggtcgggcacttcgaagccgcacgccggacccgcgcaccgctcggccgcttcaccgccagcacctccatcgccgcctctgctccaccttcccgagccagctcgccaccagtgccgccatcactcaccccgccatgccaccgccttctggctaattctctcgccgccatcaccctcttcgccgtcggccagggtgccgccgcgctcggccaagccggcccccgcgcgagcgccgccctacggccgattgctcgcccgtcgccctgaaccccggcgctccatcggcggagcttccccagccgcctccgcctccgcttggccggagagccaccgaagccgccgccgccgccgccgtcttcatcttgctccgggccgccgtcgcgccgcgtcgggagacgcccgcttgcgcacctcccctcggacgacacccgccgggcctctccgtctcctcactccggctcctccgtccagccgccctccgccgccgccccgagccacgcctcgctctcttccgctcgggcgcgcgcgcgtggagaaagaaaagcggatcgggtaaagaacgagaagaggagaaatcgaggaggagggggagagaaagaaaggaaaagaggagatgcgacactgacaggtgggaccatcgagggcttaatgattccttaattaatcctacacagtaatcatcgccatcttaatccgcttctactgtctcaatgacatgtgggcccggttgtacttaatctctaactaaactcccttttaactcttgagtcacttacatgtgggaccacgattccttaaccatttgcgcacccggtccacatgcagacatgctccttgtcactgacccttgggccccacacgcactgaccatggaccgtgagccggtccaccacctcacctcacggtctaccgtgcgccgaccccccggtgccactgtgagtgggcccacaaaggaatattccttcggaatattttttccccatgaaagaaactctttttcctttgctcaaaaatttatttaatctttaaaatttcatatcttgcaaatcgtaactctgttcgactccgttcaatttccataatttttctaaaattgagatctgtccaacggcacaattagtttataatagttattatctactttatagggttttgaatggttctctcttttcaagtgcgtagtggatgttttgggggttcaatggatgcggattctctcgaagatttgaagatcatgaactaaggcaagccactcttcaatcatattgtccctagtttataatatgtgttgattacaaattgcatgattggtgtacatctttttgtaagcagcctcactctatgaacatgattgatggaccaacctagtagttgaattattttctataggttaccgttaaacttaacccttgtcgtccaaccaaattgaaccatcacatgacacacatgcccccaaacaggacagcaattaaaggtaacgagataaaagaattgaaatgaacagatgatagaatcaaaccgtataaacaaagcaacacatgcgagagaggggggagagggcacctggaaaaggaggaaaggattgctgctgcacaaaaggagagggagggccgtgcttatttctgagtagtgatttttttgcggggatttctgagtagtgattacatggttttttttttaccgaaaaggtagagaggctctaccttataaccattgtattaatggtgagtcaaaatggaacaatgtcaagaaacaggaaaaggggatagaaataaggataaaaggataaaaaaggaagaaaaaggaagaagagaacaaaaaaaaataaatatagtaagaaaaatatgcagagaaaattcaaaaggtgaaataagaaggaagatgaggatattatcgcaatcacctaggatgtgttcgctcctcctggttgggaacactcccctctggtatggaaaacagagcagtctattagcgcgtgattaattaagtattagctatttgttttttcaaaattggatcaatatgatttttttaaataattttcgtatagaaactttttgtaaaaaatacactatttagtagtttgaaaattgtgcgctcgaaaaacgaggaggatgggtttggaaaacagtgataagaacacaaccctagtcttgaattgcagcttggtgacggtggttgattcggtgttcccaaagttctagacaatcgatgatctgatatagtatgatctgattagcgcaagtcgtgcgcatttctggcccacgtgaggctcacaccctcgtgtagccatctctttcttttttttttcttttttctcgcttatttttttcgtcgcagggaggccgtgaacatttcttgccattttttccgtttatttttttattttagaaattgaatcttttatctttaatttttgctgaaagttttgaatttgagttgaaagtttttaagacttgagttgaaagtttttaagttttgagatgaaagttttcaaattcgagttaaacattttttaatatgagatgaaagttttaaatatgatttgaaagttttcaaatcttaacttaaatagttgaatgtttttaagatttgagatgaaagattttaagttttgagatgaaagttttcaaatttgagttgaatgtttttgaatatgagatgaaagtttttaaatatgatttgaaattttttaaatatttagttgaaagtttttaaattcgtgctgaaagttttcaaatcttgacttgaatttttcaaatctgacttgaaaaatttcaattcaagatttgaaagttttaaaatctgagttggaatttttaaatttaagttgaaagtattcaaatcttgacttgaaaatttttagatcttagttcaaatctagacttgaaagtttttaaatcttagttgaaaagtttccaaatcctggataaatatgagttgaaagtttgttgcagtcaactaaacaaagagaagaaacagacacagcaaatttttatcccaaaaaaaaagaaaccatataaaaaggatgctaagcaccgttagcgaaaaaaggggctaagcactattagccctgctaaagtgcgtgccgcctctgttcgtagcgcggaacaggaacaccccccccccctccccgggcaacctgattttaggttagcaggccccactgtcatcgtatgctgcacaaattgcaggatgtctttactgcggatagcttgttcatagaagtttaacttcttccatactcgctcagctagcttgcaacgcaaaataatatgatttgtcgtttcgatggttgggcaaatgctacaatgtgggtcggaagcccacgctttttaacccagctgccattggtgttgagtctatcacgaaatgctagccataagaagatcctacaggtattagggattgctttcaaccagatgaatggtgccggtggccagagcataccatgatgcgttatcaggttaattataacatatgctccagtcggcagtcgtgattcccattgagcttagaagtaaggttcgttcatctggcgaatcgttctggatctgttgagttgatagcagtggcataagcaattgtaattatgcctgtgcttgttctgataacactagatggaggtcaatagaccaagagccattttttctgaactgcgatgatactatgcagttggggttgtgttgacggaaaacacgacaacctggggaaactgcttaactccagtgcaggtcaaaggtttgcctcgagtgtgctaagggcgtaccagctggtttgatcctgcaaccagcaaggaaacaataaagcatgattagtcagccgatagccgatcggccgataggccgatagcatattaatggtggtctcagccgatgtagaccaaattggctatagactagatagatcaaagaatataaaaccctaaacatgcctcatcggctgtaacattgctaatcaagtttaataaagaagttcaagacaatattacgaaaatagccaatgaaaccgtatttagagcagaaaagatagataaagatagcgtaccagctaatactctagtacaaacctatatatgcaaatcaatctatagtaatatatcaagtagggatcaattgtcaaattgatagcccagccgatataacctagacttgatatattcctataaggtgatctgtctatatggatgacaaatatacacgactagggatgatgcagctcaaagtatgaaaagaagcttagagtctaaacaattaaggaattaaacacctttcaagatggtagatgccttagctaatctaatctagcaagacgatttagccgataccggcagaaaccctaaagcgagagacaactgatagagctaaatcgagatagtaaagctagattaactaagacatatgatatcaatggtcatgatacaaggactaaaatatctaaagcgatataatagccctaatagcacaagccatcgagacagattacctcttgtggatagaactcaccgaaacaagaaaagtaaaagggtggcgatgtgccgaagttgtattggattgttcgtcctctattgcaattctatggggtttatatttatacccccgagtatatgcaagaatttaatttaataattcggaattaataagcctcccgtatagctcttttcatgatttactcattctaaactaaaataatatagtgttgtattcggtgagtggtgatgggctacaatttattcatgatttactaattaattccaaaatttatatttaataatgttgaattgtacttggtttggagtctgaatatctcattgatttagtaattacaaatttcaaaataaagatatttatatgattttcagaaccactacagctatttgtactcatgttggagtcttaattcaatattttacttaatttattaactctaatatttgaaataaataattgtgagttgtacttggtctggagtcttgttattagatgttcagcgacacgttttatcaatcacgtaaattggacatatgctctaaaagtggccagatagctgtagtaggcatagcaaatgttaaatgattgaagtgcctcacaatgtcaaatttgaatagatttcaatcttaaaagggaaaattctgaagtttttaaattatatttgtcaacggaattatttattggctgaaacataacatatataattttttgcatgaaacatgcaactgatttattagtgtgattactcgtatggaaaaatgacatatgtggacaaaaacgcaacgacacgatcatcatcggtaaattttgctacactgctattttatggttttagctctaggacaccatctgaatcacttttggggaaaacacttcataaacgtggtaatttgccaatagacaccgtgccgattagaataataatttccggtggaagagaagagagaaatcgcgtgaaatgtcaaaaatgcccttgagcccacatgtcagctctccatctctcttctctcttaatcccctccttccagcgccgcaacgcatgccaccgcttcgaaacacctccttctcctccacgctccagtcccaggcgacgcggacgacgacgacagggaacggtggcggcggcacgctccaaatctgaccggcacagcttcggcgacgccgccctcgtcattctcctcctacggccgaccttctcggacctgctccatcgtgggcggctcgcgcccttccttactctgctccgctgcgctgcgcgcacgccagcctcaccgtctcattcgtcgtctcgagctcgtcgcggcggaggagatggcgaggacggcgaggagagtcgcatcgtcgtcgccaactgcggccactcccacagcggaggacggccaggacggcgggggcggcggagaacgtggagaaggagacggcgaggatggcaagagcggccgccatggcactcgcggcgggagcggcaaaggatggcgaggagaaaagccgcgtcaaagtcgccaactgcggccactcccgcggcggaatgtctccatggtgctcgacaccagcttcacctctgccgccatccgcgatgttgacttgtaccgcgccgagccctgggacctcctaccgccgcgttagtccatcgtcatgcacgctttggcctgagatcgactgcgacgacattgcttgcacgaggagcttcgggtgcccatcgggaatgaggacgaacagggccacgacgacatgaacaggggcacctttccttcatctcccaaggtgtgacatgtgagagaggagagatagcaatgctgacatgtgggcccaaaggcatttttgaaatttcacgcgatttctctcttctcttcaaccggaaattattattctaattggcgcgatgtccatcggcaaattaccacgtttatagagtgttttcccccaaaagtgagctcgggcggtgtccttgggctaaaaccacacaatagcagtatcctgtagcaaaatttgccatcatctaaaatggacaatacatgttctcagcttaaaagtgaacatatcttatgcatacatgtagatggtatataatatgatacatactacatattacatatgaggtttagattttattacatgtaggtgtccaactatttgcaaatgctccctccgttctataaaaaaaaatcaacttttggatatgaatcacgtcatgtctggattcgtaatcagaagtaagtctattatgggactgaggcagtacatgaacaattttcttcatataactctttaatgacatttgctagttgatggacgacaaaatgtgcacgcaaagcttagttgtatgcacgaagtgtgcaacaaaaaagggcatcggttcatttgtgcccaagagtcagaagaaaactagagaatccctttgatagaatatttgaaagatcctagtcttagggttgatcaaaaaattcggcggcaagtattcaaatatactttgcttgatgggagttgtatcgtcgaaatataagttgggtgttgttaaagtgcttagataatgatcaatccaaggttgctatgggagaagtgtgtgaagggatttgtggaacttatcaatcagcccataagatgaattgattacttaggagagcgggattttattggccgaaaatgattgatgattatttcaaatattataggggatgcgaagcttgtcaatggttcggcactgttcaatcggcacttgccgttgtattgaatcctatcatcaaaccatggccgttccgaggttaggctttggatttcgtgctagtcgcaacggattatttcactaagtgggccgaagccgtgccactcaagaatatgacttatacagaggtaattgactttatcttgaagcatattgttcatagattcagtattcctcaaactttgactacaaatcaaggaccttctttcatatccaaggaggtgaaaagttttgccaaatcttatggtattaagtagttgagttcttctccttactatgctcgggctaatgaacaagccgagtcgagtaacaagacattgttgaaattggtcaagaaggagattgaagaacatccaaagaggtggcatgaggtgctttccgaagcattataggctcataagatatccaaatatggtgctaccaaagttatccttttttgagttggtttatggacaagaagccgttttgtcggtagaggtgaatctcggatatcttagatatataaagcaagacgatttgtcgattgaagaatacaagaccttgatgggaggcaatcttgatgatgtgatcgataagcgtttaaaggctttggaagaaatagagaaagagaaaaagagagtagctaaggcttacaacaaattggtgaaagcaaagttgtttcaaataggagatttagtacggaagacaattttgcctttgggttctcgatctaaggagttcaataagtgatcacctagttgggaaggtccttatcgagtatatggaattgttcgagcaaatacatactttttggagacacttcaaggatagcgtttttagagagcaatcaatgggaaaatacttgaaaaaatatttcccaagcgtttggcaagacgcttaggaggtcctatggtcgttaattggattatcgtcataagatatcatgttctatgcttttaggttcacaatgttcaccaaaaaggcagcggggcatgtgtttacacccaaatttggcacctaggttcaaaataaggaaaatcgccaagatttgggaaagtcgtcagtttcctctacagggccgatctgaccaccgtgtattgcccggtcagatcgttgcttgaggaccggtttgaccggtggcatgtggccggtcagaccggcagtccgaaaccgactctgttttcgtcgggtcttgggatttcttgcttgggaaggcatgtggactggtaggaggcaagaccaacccctatttaagggccaaggccgattcgattaatccctctcccccaaacacaatcaaaacgttcttttatctctacttttagccatgttttctactttactctagttttagtctatctttatcgatttgtgccgtaaatcgtccgccgtcgctgcaagggtgtgattacccctttgtaagtttatcccgtaaaccttccgtttgctcacgagatgtgtagttatcctcatataaaactaaatcggcttagaggctgattttgatctctaaatcggctccgctagccggtttagccgttttctagaaaacccaccttgatttgtccctttggctagatcggggtgattggtgattccatattaccacaaggtgtttaggtgtcctgatcgtgattgtcttcttgtcagaaaagttgccaacaaaaatctcaagatccttaaatcaggtggtggccatgtcttcaaggaagtgatctctgttgatgtcaaaaacatcaactccttacttttagtttgaagagaaggtgggccatggttgaaggagtttgaccaccacacttctattgccttgtactgttcatggatcaggacaggattcaagttgatgctcagcactgacacctttgcaaatggctccagggagagatggcccatatcatgagatcttcaccactacgcttccactgccttgagtaaaccatggatcaggccatggcaagggctgagaacctaagaagacttgatctttgtatcatagaactgccactccatggtggtaccagttgagagctagctatgcatactgagcccaatacaaatgcaacagtagagtacttccaacttacatgaaatgaaggagaggccgataacaccaaggtcacggctcaagcaccaaatcaagttcctgggaggaattgcattgagggctaaccatggatctctgcagcataattacacaggggtgaacctggtatcaagttcaatgagctcaatccactcatcgtcggccatgtttttgccatcatcatcaaccaactagttcttacacttcattgaacaatcgatggttgtccccatgccaagcttgacagagtcaatatggttggttgagtcggcctcagcactgacctccaatgcgatggaagttggatcagtgttagtgctcaatgttgccacatctctagtggaatccttgctcacgggtgaatccaaccttggtgtcgtgacatgcctccagcactcgatcgatcatggccatcatcttgatgcacaggtcttgaatgatcttgtctgagttctccaccgccttgtccatttcagtgtcggccttcatggcctcgatgagagaagccgaagtcgttgtggccgctgatgtggttggggctgtagatggactcagtggttgggaacacatgttctggtgtggtaggagtgctctcggcattagactttgtggtggcacatcttggtaccagtgtcaaacacttggtaggcgcagtgtcggctctgtctccgagcatggtcggcacatgttgcacatccagcacgcagcccccatcatagatgttgtggccgtggaggtcaaactgagccctccccacgtcgcaggtcgcccgaaaccaaatgattgcctccacacgccatgcatcaaccataagcatctgcaccgccactactccataggggttgaagacttggtgcatcacgtcggtagaaacagggtagatgaggtggctcacttggacatggagtgcagcacttgcaccacatcccagccggctcggtttcatcgaacacttggtaggtgcctccatcactgacgcctccatgacccaaatcccactcccagatgttgccactaccatcacgcatcgcccacctcgtctccttgctcggaataccatggatcggtggttctgatcccatattgtcacgaaccaagcaccacccaaccaattctcaacgcacagaggcctcaatagattgcaaccactccaaatacaagtgttttgggatacaaattgaggggaatgagaggtatagactaggaagcgaaatcagacaaagaggaagcaggagattgggactagagaaaagtaatttagaggggaggcggcagcaaggaggaagaagccattttcatccaattatgttcgatccttctccaactacagttgcctcttatatcagcttcccttccagccatttgggcctaggcatgcccttgatgctccgcccaggaaccctgttaggcccatatcgtgacagaggtactgtaatatacggacgtattacaggaatgtgtgtttgtcactaggaggataatatagctagtgcatgcgatgtgaatttatttttcctttttttgcggggagcttgtgaactcagcgaatcatactccttttttttttgtcgaggagcacgtgattttattttattttatttttttgccgggagaatttatctgactagggttactaatcactcgatccaaaattcgttcctgacagctagcacgagggagccgcggcacggtggtggggcaaaagtaaagatgttagacgctggtgctgtgatctcagatttcttcttcaaatggggtcaagagaaatacatcttgcttcgcttccgagtcatagtgccaaccctcattgttgtgtgcccgttggtgcagtttggcttaatagatgacttaaacaatactatcgatccggccatgaagagcttcttgtatgctgtgtctgatggcatactgatgtatgttctaggggccatgcaagcctctcctgtaaaatatgcgctgtttccagtgtgggctcttgctctagtcggcttccgttctatcttggtaggcctccacgggaagtacgacatgcaggcggagctgggaaatgtggccaaacttttgatcgtggcgtatatgaatgtaacacacggctgcgagattgggcgtgtccctttctggatctactggagcattttggtcgtcaagtgcatgtacaggattgtgatacgccatcaagcatccaagaccttatggcatagccggagttcagagcttcttcaggcgtacatgggtcccaaccagccccagagcaactttgttgacaacaattcaagcccaaatggcgccatggaagggtgcaaatacttggtctttggagagtcagagcaagaacaatgctcctgcagaattagccctacgagacatgtaaatattaataaattgaggtctctagttacattacaaaacatttgtcaatgccttaaggaggacaacatcgtgaagaagcaagctgaagtattgaaggatgtgtgcctgtcctttgcattgtctcggttactacggtgtaggctggaaggagcaagattacatgcaggcatagattccattaaccggaagctactgattggcagttataaggaacgtctcgaccgactattcaaagtcctgtatagggatgttaagtttttcaaggactgcctcttcagcaattacccgatgatcttctcggaagggtttctctcactcaggtttgcttttgcgcagcttatgatcaagttacctgtgggcttatggctttccagtgatctcttttgggcagcaaggcacctgtcccaaaacaggcataatttatctgctaccgatctgaacatcgctggggctgccatcctcatcgtagtaaatgtggatgattatggaatgggcatcaactttgtaaactggacgagcttgtctgctgtgtgctggttggttcattgcagaaacaggagaaagagattgaggcttgttaggtggtttcttggtaggttaaattcgcaagaggtgagaggtggtgcatttagaggccctcttgataagttaataaattcgcaagaggtgagaagtggtggatgtagaggccagtatgccttcctgcaatcatacaaatacagtgcgtggaagcgtaggctgttgcactcacttactatgggaatgatcgcaagtaaggacgatggcacaaactttgccacctccctgactacgcctgagaaagtacgtactaccgtactctctcaagaactccaaggactagatctacaccacgatttttctagcagcgtcgacgacaaccattccctaccaagagacttctttgcaacagtgcagcacgacgccaacaaaccagcagaagcggaggagcagtactggtccgagatcatccaaagtggggcacccagatgctcccatgttattctgatctggcacattgcaacaagcttatgtgagatcaagcttgcccaagaacatgatcattgcaatggcagccctggattcctgcactctgccttgtcatgctatcgccgtaggcgcaatccttacagaggataccttgtggataagttgctggatggtgacctatgggagacctacatggtagcgaattggttgtcgcggtactgtgcgtacctgctggtcgcaaagcctgacctgctgcccgggagcatttgggttatcaagaaggacttccaacaaacaattcagtgtgctcgtcagatgctccatggttgtacctcactcaagagcatctatgacaagctcatcgcgacaataccatcccagttggacaaggctggacgtccgattcccttaagaagaggtgcatcttatgtcgagagacagtgcactgatagactacaatctccactatgaatacaaaatgaatcaatgggagatcatagccaaggtgtgggctctcttgcttgtgcatctttcacctagctgcgatgcacaagtgcatgccaagcatctcaggtccaacatggagtttatcaccatcatctgggcactcttctcacactgtggcatcgacaagagtgaattgtgggattatgtgtcaaaacatccaagcaagatgcccaccttgacaacatccgtccagatagtgatggagaaatacaagaaactagtggagcatccgagcaagacgcccacatacgaacatccgcctccggtccacctgccaccaacccactggcggtgaccttgaggatggtggtggagaaattcaggaaatgaaccatggtaactagtcgtcctactccctctgccacatcctcaaactcccctggtgcataagctctgatcccactaagctttcagcaataaactttttttttcgagaagttttgggtaacactttcatcccatatttcatttcattcagacaatttgtgtttgtcttactgtgacgagtgaaagtgtggttgctgcttgaagaacatggtgtgtgattgtagtgaactgaactatattgttgtgtgtggattgctattgaatccattactgtgagttcaaaaccctttggatttgaataataatggtatgcacgatattagtttcttggtatatataatttatcattgttacattctagggttttttagataatggatttaaataaaacccggcatctacatcccaagagatgtacacagccattgttacattctagtatatccttgtgcatcagattagttgttcacttgccctccatcctatgaggaggttaattaggatgggcactaaggactgttctctgtgtcttttctctgagtcaatgtgtgtaaactgtaaaatactgatggttggcctttcagtcaggtggagtaaagggctcatgacatggcctacactgtggtagtttgatttttattcatagacaaaaatcagttacaccccgcaaataattagctagcctacgcaattcagaaatattgagctgcgtcctcttaccacttgggaggagcaagcagcagcagctgacccaaaaaaaaaaacattactgtgcatggttgctttgccttgtcctggagaagcagttttcattttgtaatcatttcaacctggttatatccagataacaatctaaaaccacatgtttcatcaatttgggttatgaaaggcctcgcatagattagtgattccaaggattacactcagttgatgtggacccccgtttttataacaggaatcaatcgtgtaaatagtaccatttccctggatcaagtagtctggtacacacgaactcatagctgaaatatcaagtgcacatacacgagagtctagtacgaattattacatcataagcccgcaggcacagtcttaaatcatcggaccgagcggtccggaatacattccaaaaacagaagtaggtaaggcagcggagttaaggcagcggcactccattgccacaggcaacgaccgtaactaagacctactgggcgccatcgtcttcatcaccctcctggtagtaagcgtagggattctccgaagcttcatctccgacctctgattaagtttgtatattgcaagagtgagtaccaaccgtactcagcaagccaccacagcaacaatgcacatgacaagggtattcaaaggatggctaaggttcttttgcgcaaagcaagttttgtaattcttgtcacaagcctaagacttagcacagactgatcaaattttagtaccagtgttttcattaaacaacgacggttctgtccaccatccattgtgatcccaaggatagcttcccgccattgagtcgtcatggttttctgaggacgtccacattcccgcctctcaggaagtggctccatcagcataaaaatcatcatgtaatatcccatcccacacaagttaaagaatttagagtctagccaagtgtaatacatgtcccagtgctcaataaccgcgagcacagctattcgaatatatttagtttactcacactgcagtggatgtacactctacccgtactccgcgactgcccaacacatgagcctcgtcccaacacatgagacacgtcacggcaaagcttttcgataacctcgcattggcagtacccgctccatgaacttaaatcctcatgcactctaggcgtccatgtttctagcagtgagaggagttctggcgctcccgggaaagagaagtctcacacacatattaaattatggttcaagttaagttctctctctcacacactcatggcagtcctaccaatggcgacaccgatgtagggcacgcctctcggccctacctcaacggctgtcccaccgtagcgcacctgcctcactcaggggtgaaccatctatgcagggatactgcctccgctcgactatctaatccgctaggtctatacccatacgagaagtacggttgtacgggggtcgtttcatgcttaacttcatggctcggtccttaattgaccggggacggtactagccttttccagataccacccaaatcctctatccgccccagtcgaaaacaattgtttaattttatttctcctttcacaaatcatgtcatcaacatcatggcaatgtggtgctcatgtctccacatgccgcatctcaattaccttcccaaaggtaattgcccaagcatatagcatttgataaatatgagtatgcatgattttagaataacatttctaagcaattgtcataattgactagggactcatacgtaaacatggttacgaaggaataaaagacaaacaataatcaaggcatggcataatcacaagtaggatgttcatcattgcatgcaattttatttgtaaacaaaacaatttcgcaattgggatcaacatgttcaaggaatagtgatgacttgccttgctcaaagtcttgcggttcttggtccttgcttggatccgtaactccctcgggctctaaaattacgtgcgaagaaacgatttgaattcggttaaaattcaaataaagatccaataaatccaaatggaagtcgaatgcgaaagttgattcttttatattaactttactattcgcgaactagggcaaatccaatttcgatttatacatcctaaactattttgcgggtataaatattttgttagcataagcttttaatttaatctacccgagcattatatccatataataggttagaaattttctatcgcgagctaaatatcggacggaatccaaaaattatcttataatattatatgatttaatttagcctatgactaaccgattaaatataatatacgtctaaaattcctagtgattaaatccgaacttctaccgtgaatcgattacttatagagattatccaaaactaatctgtaatagtctataaaaattcatctaattgtttagtcgttaattacatctaaactactaccgcgaattgatttcttttagaaattaccaagaataatctataatttatattaaattttgcaattctatgaccataattaatctataattaaattctaattattttagatttttcttaaactattaacctccttaatttcttcctaattttctatttatttatccttttctttttctccattctctcttctctttttctttctttttctttcttctctctttttctttcttttctttcttttctctctctctctttttctttcttttctctctttctctctttttctctctggcggcctctcttttcctctccctctctctctcggctctctcccacccgagcggcggcggcggtggacgcgagggggaaggagggcggctcaccggcggcggcagcggcgacgacggcggcagcgacggtggcgcacggtggcgcgggagcggcgacgacggcggcagagcggcgcggcggcacgagagcggtggcgcagtggagagggaagaggggaggaagggtgagatggggtgggggaaaatggagagagggggggtatttgtagagaggggagaaggagagggggaggggctgcggcgtaatggcgacgcgacagcgacgctcggggcgggacgacggcgacgcgcgggcggcgacgcgatggcggcgcggggctcggagcgacaatgcgacgggcggcggtgcggggctcgagacgggcgacgcgacgggtggcgtgaggctcgacgcggcgatggtgacggcacgcggcgatgggacggcgacgcggcgatgggacggcgacgcggcgagtggcgagtgagcggcgtgacaggcgaggcgacgtgacgcgcgcggcggcacggggctcggcgcgatggaatgggcggcgcggcagcggcgcagggcgacggcgaggggacgggcgcgcggcggctcaaggcgcgatgccgacagcgacgcgacggtgacggcgcggtagcggcggcggcacgcgcgacgggcaggtgacgcggcgcacgcggcatgaaaggggacggggccagggggaccacgatcgaacatctatgccgcaatgaacagtaactttttcctatttatcccgattttagcccattttctatttaaatatagccctataaattctaatttttgcataaataaagtttactccatatttgtgttatcctaactaaaaattcaccctaatttaatatcactcatattttgtttatataatttatttgaatttttaattagggttaattctcattccatcgtactaaaatttaattattgctaatatggtcgcgataatattttatttatttccaatcccacctaatctttattttaatttatattttaattatttatttagccaacttgatttttagggtttattcctagttagttattcattattcgcgattaataaattccgagatcaaaatccaatgaaatagatgaataaaatcggcatgatgcaatttattacttaaaaagtttttgaaaatccatatttttggtgttttgatttcgttggtcgaattttcagggtgttacagttgatgagttgcaacttaagctgtactaaaattcctcacctgtgctccgtggattttgcaagcaatttctagtagggggcaactacaaactacaaacccaactacatccatcctactgttcgtcgcataaccgcaaatcaaactaactaagaatcatatactagcctagcctgcatctttttcgtcccatcaagagagcatccattagggggaaggatttagccagatcaggagacgcacctgactgattcgccgccccggaatggcagccgcggcggtcatccgtgatgcggccgagctgcgccgcgccgcgccgcgctgcctctgctccgtccgcggatcgagctagggctgcccccgacggaaggtggcccccggagaagaagcctctgcgaggggagcccctctggccggagcaagggcacgtacggcgagagtgatggccggaactggagcgggatccctcctccccctccgcctcgcccccatcgccgccgcccgccggtcaccggcacggcggcgcctccggcgatgaaggaagtataggacccacgttggcagccaatccaggcccatattttttggtggaaaggcgggttttccatatccaacccaactcaggcccatttcaagcacacgtgaagatttgtagggtggattaggttcactaccttaactagtggcctaatttaattcatatccctaaaccacagtaccggatattatatttcgacacctatatatgcacctgcactcatgtgtccctgtcaaggtcactgacaaggaggctgtcaagaaggcgacatccatcagagagaccggtgcagaacagaagcaaaagaccgtgccggttgatgaacaggagggagcaggaaagaacttgaagccttcaagactcgttaagcccaatcgtcgttttgttgggccagaatgggccgtgtgaacttgtaagctggcgtgagctggcagctatcttgagagaggggtaagaactgagagagagagagagagtataagaactctgtatccgaattgaatggtgaattttggcaatccggtggcgaatggcggcggcagctcaatcctgttggattggagtagtaataccatagtggagattgcctaagttcctcgtgttcttctgtgtgttcttccttgttcgattcttccagttcctctccctgtgttctcgttcaaggtcgttaacagtcccaccttccgcatgagcgtgacctggatgaggagcgaagctcaacactggtgtttccctcgcgtttggctcaggaggctgttttacacgcatggagtcgggcccgacagctgtgcaggtaaccaaacgaccacctcctgcacccgcacatgtgagccaccctcccatgtagatgaccaaacaaatccattatgctagctaagttctcgcttcccttgcgtatttcggatgtagattttcatccctcgtggatatgtcctcttgttgcttgtatgtcattaaaaatattaaaaaattaaaaaataacaagataaattaatatgaaacatatcactacacaaacatgcagggtcaaattcaatttctacaagttacaacaaaaaaaattaattaaactaaaaatagttatcatactttagcagatatatttgttatttttgttacaacttgtagaagttgaatttgcctttacatgtttgtggagtgatatatttcatattaatatatcttgtattttcttttttaaatttttttaataactatttaggtaatatgaatgaaacgatgggatatcccctcgagggatgaaatcattttttagtgtatttctgtattatggtgaggtgttgctgcctagcttgggtataatgtaaatggtgggaaattgtaatttccgaaattgctgagctagcatacatttacttttagcattcaaagtgatgttgcttgagcaataccatctaagaaaatggagataaacccaggaacaaaatatgaatacgatttttttccaatctttatcactacatacatgaacaatcctgatacctcctaaatatataatacgtactccggttaccagagggtagttgtgttacataaatacagaatcttgggctttcatatagctggaatgtacaggacatcgttgaggtcagctgggtctagcatttgctcgccgtggctaccgcttccaaggaatcctgcgtgggacagcaaagcccacaggtgcgtcgtgagttcacctggcccacggagatgcacgtcgtgcttggccgccttggtggacgcggcaaggtgaagcaggaaccccctccaaaacctgctcaggtctctccacagcgcgacctgctcgtcgtcgccgtacgccagcctcagttgctccgccagctgcgcgcccatcttgactatcgacctgccttcactcccgtccggagttcttgccatccttgtcaggtttctgtagatgtctgccatggatttgcaaccagaaatggcactgctggcctctttctgcacaacctcgtagaccttgttcatgacgaggccattgtccggcaccagtgactgagtgaccaagtatgcgcagtgattggacaaggtgactgcagctatgtaatgttcccacagatcatctgcgataattgccgttttcttcacaagaggtcttgttattattccgaagctgtagatcgtccgcgccgatgcctgatcggagaggttgatctcacacaggcaggtggcgatgtgccagacgagtatcctgtgggtgtcggcctcaagctcatcccctgcccacgagatatcgctgacaatgtcctgttggttggttctaaatgcaagcggaaagtaggattccagatcattgtcattcgcgtttcgcagtgcactgaatgactcgaacaaggcgctcttaacctctccctgcagctttatcttcacagggagaaatctccctttgagatgacgatatgcgaacaggacgcttctttcttgaagaacatccaccaagatgttgtactggccgattcgctgattccatttggcattggtgattagtctgcagaaaaaccccaatgcacactcaaacagcggatgacgcaaccttgagtccttgacgtacttgcacagcaccagtactttggtccactgcgaaagaacgtaaattgcaatctcccagacctctttgatgacgacaaggacgatgatacagtaagtcacgaacaacttgctgtccgtgtccgggctcttggataagcgatgaacaacaaatccaagatacatgactgcactaaccagagatcctgccaggagcatcctccaacccgggaaccccttggcgaacatgattgcgtgtttgctatagtggaagtctctgagaaaccgcagctccacctcggtgacgcggaacgccctctcgtagtttttgctacctctttgcaggatgtaatcgaagacgagtctcttcgtcttgggttgccgggcctcgtgtatgggcaggttgccgaacctacgccggagaagcttgtacagcgcaaacgagagacaaacgtccttgagccggttgtcttgatccactcctccaccaccgagaaaccggctgccgcgaagactccataccctctcaacggtgaccatctcatcagggttcgtcacgtccagctcgagcttgaatactggaggctcgaccttcatctcctgcttgccttctcctaggaccaaatacctgtaccctgccatggtggctggatccacatcctcggggttgccaagttcatgctcgtatctcatgtagttgcttacgagcctcatgttgttggtgtggatatcaaatgcgctattggaggagatgaagaaggcgatgatccgcagcgcgttgacggaccagatgaaccagagagggatcttcaggctcagcacggtctgggatctgatgaggttggctgcccacagggacatgagcaggtcgatgagggacatgtccttgctcttcctgtacgggatgccgatcctcacgctgtactgcagagtgaccaagaggacagcccatacctggaagaagtcatctggtttttcgtcggacgatgagagctgcatgagtcccagggtgtagtgcaccaaggagtagttcaacagcaggatagctcggccggcgttgttcagtggcctcaaggagtagtacagtggcgcgatggcgccgacggcaaacttgagccgcaaggtcaccatggtcaccaccacccagaactccacaccaatcgtgccagtgctctcatcttgcttgaagatccctcggatggtttccacaaccatctgtctgaagatgtaaacagcaaacatcactattgatattgatcctatcagtaatttgggggatataattcggcccgatttgcacttcggatcagcctttcgatcggtttgggtggaaggagtactacgcttctagctttgggctctgccgggagatgagagagggataggacttgtatgaggatgcttgcaggaacgatatgtactggacgaagggcagaagcaaatatgcaaatactaattgtcttacgagaacatctatctatctatctatctatctatcttctatctattactccctccgtttcaaaatgtttgataccgttaactttctagtacatgtttgaccattcgtcttattcaaaaaaattaattatttatttattcttttcatatcatttaatttattgttaaatatactttcatgtacacatatagttttacatatttcacaaatttttttaataagacgaacggtcaaacatgtgctaaaaagttaacggtgtcaaacattttgaaacggagggagtatatactaaaagttcattaaacatcctataaacactcctagattgccatgtggcactctacaaacgctcttaaatcgccatgtgtcattctaataaattaaaaggaaattcaagaaaaaacaaaatatctaaccgtagatttttattaaatctggtggacccattatttacaaccgttagatctattttaagaaaataaatatatgcctcccaaacctggccccacccagagcctatacttggacgtacgtacgtacatcacgtacgcccctatccctcaatccctttctcctattttccttcaattatctctcctattttcatgctatattaagttaaaaagcataatttgtgttaaaaattaaacatatctgaaaataaaaatttgtacaatatattgaaattcctacaatatattcatagtagatacttaaaaatatgaataaataatagcttcatgactaacctaataatgttattttgacttatcataatttcagaatggggagtgtaatttttttaaacataattttactttcattatcattacaggactaattaattgttgtgaagctatatatgtaggatgataaaataatatcaattttttatatttttatataattgtttgaatgacacgtaaaaatcaacaaatataacccaaaagtaacacatttctttgaatgttaacatatagtgaatatgggcctttaactataaatttagacatagataatataatttaacaaaataagtggataaaaagtagttgtataatttcattcctattgtttttatgaatttttattatcacaaattttgctttccaattgtataataagaaaataggatagggaatagaacatacagataaacgacatgaataagggggaggggcggacaatgggactaagcatgaccacgcgccatgtatagtcctgtgtagggttttagatgtggattttttttaatctattggttgaaaataatggatttatcatagtattaaattaaaattgatgcctagatgtgttttcatataattcgtagaaatatctcataatatattgaagtatagtatcaggtggtggatgtgaaattaattatgaagtaaattatttttgcaaggttattaatttttatgtggtggctaagtatactaattttgaattatgcagcaaattcttaggttaataataataatacatcaatttttaagttaaaatacatctcaatatgggtcttaaattgcatcgtggacaaagacaaagttaattaggtaattatgcctctctgcggcaagcttgcaattgcaccaatctccagtagtcataattttctatgatgaattacgtcagctatcaatcgattatgtctgctagtaaataataaattaattattgattttttacacgaattggtagaacaattaattacatatggttgcatacccaatatcttttatagcaaagttttctctcttttcaatagaaattcaagagtcagatgtcataggtaccataaaacccaatttccagtagataattttataaatggcataattgaattcatcatgcaatactaacagagagaacagagacaaatcgtacttttgaaatgtgttaggtattattccgttagtatactactaagtttctgaaatgctatctacgatatatgcccgcacgaatgcgtgggccacttttctagttttcttaattatggctagcagacagaactcttttgcagttgacttgatttttttttactatttatagtcccgtgagtcgttataacggtttctttattcagtttagctaaacgatttggatagagttgatttattggttttctataccatggttggtctttttaattaagaaattggttgttatggtatgaaggtagtttttaggagaaagtgggcgccgcagagtttctccctgtggaaggagaacgactttgcttcttgaacttgatacatatatactactggttatcgtcggtaacagcgctataggtagactgatatttatgtagcggtttcgcaggagacgctccgtgcagttctcctttgacgcgtcctatccagggctttccatttcggaaagcaagaaaatttcagtgggcactgaaattccaaagtttcggaaatttttaaaagaatcgtatattttgaacgagtttttttgaaattgtaacacatttttactgaatttgaaaaaattataaccaaaatcacaaatatttaaaaattttcaaaaaattcgctcaaaatatttgcttgctggaggggttcgaaatttcgaaccaaaaattccatccttggtcctatccggctcatgtttgacggtgcaaactgtgcaaggaccgagcatggaaagatactacttcttccgtattttattttaatgtatgacggcattgactttataaccaacgtttaaccacttgttttatttaaaatttttatataaatataaaaatacttatgtcatgcttaaagaacatttaatgataaatcaagttataataaaataaattataattacataatttttttaataagacgaaaggtcaattgtttattaaaaaattaacgggtatcatacattaaaataggagggagtaaaaagtactacaagcattatatacatcacgtaacacgctatctcaataccggggccatcgtcatcggctcggcgtaaacttacagtcacagagtatcattgccgcttcaccgtcattttccttttcatcaaaggggagaagccctccatttccattaatagaagtgtagaagtgattacaacaaaaaaaaaaagaagcgacccaggtccaaaccgataatgaaaccgatcaaaccgtggcactaattaagaactatagttgaccatccgtccatgtctcaattaccatcatgattaggtcaatggaatcgttgcacatccaggtttgacaaaaaaaaacaaacatgattcagagccaacagtaatccattatctatgaaacaacagaacatggggaccacaaaaaaaagcatgttgcacgctgcaaattgcatgatcacttctatagtaaactgcaaattgcaaacaaaaagtctttaaaaaaatgaataaataaactaaaccaaatgtcagcttccacaaattgaaaacaaattaaggttgtgtttcagaagagaggaaggacaagattgaaaagatacgtatgagttaagccattagcattagcatatgattaacgagtattaattattttaaacttaaaaatagattaatataatttttaaagcaacttccctattgtcacatcacaatctggcaccgccgtacaacggcacctgataggagcgtgttgtaggaaaaacgacgcgaaccgctttctacgaaaccgcgatctcagtaccagtcccaggacatagtgctggtacccacagtgacaaatatgaatcattgcaatccttaaaataaatagaggacttatttaccttaacttagattgcagctcagaacagccagagaatgcaaccgacgacacgaacgaggaaacaccaacaacagcagcagcagcagcggaaccaacgaactaacacccaacaccacaggcgacggctgggaaccaggacgaaaccctaatcttcacttcacttcacgacggaggaactatatatatttatatagagcaaggatgagtactttcgtacttagcaagtcacgagaatttaggtgtttaatgcaagcttagaagagaggcaaggttgttttgcaaatcctttatttgaaatccattttgaaaccactaagtgatttatttctttttaagtttgggtcgaaaagagacttgcgtctcaactcgacttaagagatgcttttcaacaactcaattggtaatgtaccgacctcccgggtcagatcattacttctcggctcccagagccatttcacttgattaatcggctcccagagccttttcattttctcggactcccaaagtccagctgcccagcagcacaacaatctgcttccactcgggaagcctagtctatgatgcccgtagacatcccgaatcacatagattcgttccttgaccactcaagtcatccatctgccacataggctgattctggtaacgattcccaaaccacaacaacttttcacaaagcattggcaaacaaatctacgctacaggaaacacctcacatccgcccatgaccgtgggcacggctgttcgaacagttagttaacctctgcagagggggtacactttacccacacgacattactaacccggatcacccagcccgtgagatcaaccacatcgggagaccttaaggctttcatgacaaggcatttcgaaagccgacacaggtttaccatacgccgacaagaggggtcccagaccaacaacaggttaggtcccagaccatactgtgccaggaagcccaggggtcctacccgacaccaccctggagaatccacttctctcggcatcaaggctcccctgattagctacttacttagccaggggtgtcccatttcacccatgtggtcgcacttgttatatgctcggatgaattccccacaggaatcggtccttatatgcgaatacgggacagtgccacacaggcacaacccccgcatcgcgagttttcataatttattttattttcaaacacgccgacaccacatgtcgagttttcaaggcttcttaaacccatttcccaagttttcgacaatcaacggtgtatgtgggatatttggtatacgcgctcagagagcacggataccgaagtaccacaagggtggagcgacaaggaaattagggtatattagcctataggaagtagtgcgactactgggtaggtccatcggtttggcacgcaaaccaaggccaagcatgttatgagtgtgttgctaattgttgtcgaaacgacaaccgcatacgtcaaaagacatggtcacccaacagtggttggaaaagaagtaaagtgtattaatttgagaatttttcttcggatccccctattacatggccctatgagactatttatagcccccattacagattcttactactagggttttggttatacagtggaatttacatggttgcccttataaagggacatttacatgggtacatagtgtaattgaggttcatgggcccctgatgggccgtcgggcgatcatcggcccaatagcccctaggcttgatgggccggaaaagcttcttcggtcctcgctggggcgaacttgctatggcgaagtcgtctcccttcggcatatattcttcgccctgcatccttcgcccaagaggcctctggcttggcaaagcacccgcgcaatccctcgcctctcgccgtccctgttccatagtcttcgccatggggggacttcgccctgactaactttgacgtctcgggcttgaatccccactcttcgcatggtttcggtaggtttggtcgaagggcctcatgccataccgccaacaagcccctcatgggcaagggtgagattggagcttcggccgagaccatgcaaaccatgtggtatggtatgtggcgccccctttcgaccgatgctcctgccgaaacctacattgttcctgcaaatagagtttgttgtctgtgcggctggtatcgttttgccgctcttcgcctcctgcggacggtggtatattatttttatttttcccgggccgaaaggaacagtaatgggccctccctttgtggctttttactgtgcaacttggtcgatgggaatttactgtttcacctaccctcgcgacacgtggcgctttattactggtgggtaggcgaaacgtcacctgggtgggctatatattctctccccgttcccttttcaccgctagacccgtcactttcaccgctcacgcgctcttcctccgtttttgctttcacggcaccccttggccctttagacccttctctcgccccctttgttcgccactgcacacacccttcgtcactgcatatatccttcgtcatggctccccgcaagcctaacccctctttggcgaaagggccctaccccggtcggattgacgacgacaccaccgcctatttagggatttcactcatagacgacagcgagttggcgaagttggtcagctctggggcattagtcgaggggtaggctttcgccccggggaaagctgttgtaccgaagcccgtcgacaaccggacggtggtgttcgccgtgttttttgaggcggggctccggtttccgtgcaacgagttgttgccaaagatccttcgccttttccatgtggagctcccatagttgagcccgccggcgctggttcggatcgctatctttgactaggcgtgccggacttccgggtttgagcctagcgccgaactcttcggtgccatatttttcgccaccgtgaattcgaagacggtgattaccccggctagaacgaagaaaacagtgtttgggagtgtgaactttaatgttcgccccgagcggtccgatctctggccggtgaacgccgccatgtcgaagtgggaccaccattgatggcgaggtggttttaccacaccatccccttcgaggctggttctgactcagcgaaggccctccggtgccggcgcagggcgattgcgccgaaccgaaaacccaagatcgccgtggacgccgctatggaggcacgattcgctctgctgcgtaaggattgctcccgccttagctgtcgcgacttggtggaggaattttgtatgcttcgcatctttcccctctcccagtcgtggcaagtcgcagttgatcaaggcgaagaggttgatggtttgccgaagttggttctccctgagggaacgaacggtaagactgctctttcgctatgcactcttgcgctttgttattttgctttgttcgacgcttaatgtggctacaccctttatttttgcagtgttgaccctcgaccaggttgacgctgaagctcgtaggatgatcggcgacgtgtcggtcgtcgagtatagccagctgctaacacgacaaccagctggccaggcgaaccgagtttacaacggcgaattgcctccccgggcgaacccccacaaagccgacgacgatgcagggccttcgcgaaagcgaacacacggacaagtgaagcttgcccctaggaaacgaagggttcctacttcctccgattccgacgccgacgacgaggacgacgtcgaagagcgtgacggcgaggacgaaggagaggaagaagaggaggcggaggtcgcagccgaaaaggccgcggacgaggcggtcgaaaaccacgtcgacacccctggctatactcctactccaagtccaggtcacaacaagaccggggtggagtcgaacagctccccccttcgtcgaaaggatttggagggggcgaaagcgctagttgcattttcggcaggcaatgcggcgaagggaggtccgatcaaaaagatctccaaaaagaaaggactcgtcgacgtcgctcacgttttcagcgatgacgagtcctctaacgagactccgacttcgcccgctggccgcagcctggatctttcgaccgcccccattctttcactcggcgctgatggggcaggtggtagcgccgccgcctgggcttcggcctccgcagaacggatcgtgacagctgcggcgatggtcttcggtagccctcagcgtcagccggttgtttcgccgctagtcaaggcgaaggggaagggtgcggccgtcgaaacttctgcctcggaatattcccttgcggcgccccacttcgcccctggcgatttcgagacccgggcggaccttattccctttgtcgagggagtaagcaatcttgtcttacctgccagcaccccaagcctattcaccgaattgaatgagttcgattaggggtgttttgctattaaaagcttagcagttcgggtatgctttttctctcttcttgattttcctcttctttttacatgtctcataattaacatttgctctcttcgcctgctcctatcttgcacctagattcttgcggctcactgttcgacagagcgaaccgtgcgggcccgtcttgacggatttaagaaccgtcttcgggccaaggatgacgaaataggccgcaagaacttggagatggaagccctcgccaacaccctgaaagaggcaaaagccgaaaacaagcagctccaatccgagttggagaaaggaaaagaggcgagggccgaggttgatcgcctcaaggccgagcgggagaaagaaaaggctcattccgccatgctgaccgattattataacctcactgagccgaagatggaggctcttcgcctggaggtcagcaaggctaaagcgagcgctgtggaagagtcgcagcggttttcgcgggagatggcaaaaaccaccgaatccgcgagaacggcgtgccaaactctccgcctcgccattactgacatgggtgcaaaggtgagcggggtccctgccgaagatgcctcggccttcgacttctccgagtggacccagcaggctggtggttcgatttcgaactgcgccactgtgtacagcgattgttgtgcgtgcatatcggcgacctttactatgggccttctacaacagtttggctgcgagcacgtcgccgagttccccaactatgcgaagggggactgggagatcagtgtgcagaacatttcgcgcgcgcttcgtgcgtggcgaaaacagttctggcagaaagacgccggtccgctgacaaggcgcaccttttggagcaactggcgaaggcagaggcggcagaccagtgcgaagaagaggacgcggcagccgaagggggtggaggcgatgcccaggatcacccagaggtgtgaggccatccgcccttttcttagattttcctagtttcccttcttcttttgtgtttgccgatagtggcgaacgatgtatattcggcaagccaccgctaaccccccttattgtagccgaaaaagggccccttggatatttggaatatatgactcacttttagccacctttttgtggttgaagtctttggcgcattatgattacgcccatttcacattgtgcagtactttctcttttttttttctttcgcctattcttactatgcaaatcgtcttttgccctttttgcattgtctatcagggtgttcgccgaaagttgtgcattcagcctccttccgggagttggcgaagccaaaacgagaaatttgtggcactgaaggatttgtcgaaggtacgatgcccatttcggcctgtttatcacaaaatggtgataaacggccgcagctataaggtttttaaggttgccgggtggctgcgggcgcaccccgggcgaaccttagaagactacgagcttgttcattcaagacgtttcgaggatatggctcgcttttggcgaaaccatcggaagactgatcggcaggaggtgatctcccagcgtcgttacagtctagtctgtgtttcgcccccttctcctcttagggttgtgtatgatattagtagcgatgacgaacctagttcgcctgatcattccttagagagagagtgatcgcaggggcgaagatgtaatttatctgtaagctgagttgtaacgccattgctcttttcttatcacttgtaccattgtgatgggtttgtattcttcgatacatttttattcaaaatcaataaaggtgcgttttattttcttttcgctatttttgcattgtcacttcgcgtgcttttcgttgggtcagaacgtgtcggcccctttgcatatattagcgaaataggttttgacttttcagctttcggcttccatttttgatcatttttgtaagcacgagtgctttccttttgatcgagtgtaacggtgttcggctagttgttctccgaaacaagctgttgcggtttcaaagtttggcgagcgatgcttcggccgattcgtttcgccccctggcctttttcgctgatcaggcgtttgccttggggtttttccacaaattatcaatcatacaaacaaacaaaaagaaggcggaggacacagagattttatactggttcgggcctccgtggtggataatagccctacatccagttttttttgtcttttttcatttttcctcttttttttttcttttcttgacggaaggcttacatagtgccgaagggcttacattgtgctgaagggcttacataatgatatatacatttttacaagttggcgatttgggtgccacccgttctagacatagaaatgcttgaaagagacagtgttccaggaatggtcgaactcttcgccttccagtgtcgccagtcgaaaggaccccatccgggacttgtgcttgatgaggtacggtccttcccacttcgattcaagcttgccaacggctaccgggttcgccttcttccttaggacaagatgaccaggcaacagctccatcggtcgaacttttttgttgtaagttgccgaagtgcctgtggcgtacttgcgtatgtgctcgagtgcttcgactcttaccccctccaagagttcgagcgacacctcgcgcccctcttcgtccccagagaacatcacccttggtgagttagcccctagctctgtcggggtcattgcctcatcgccataaataagcatgaacgggctgaacttggttggtcttgtgggggtcgttcgaagggcccagagaacagatagcatctcctctggccatttgcccttcgctgccccctcaagcctttttttagtgcttctaggatcttaccgtttgtgtgttcagccgccccatttgactgtgggtgcgcgaccgatgcgaacctgatttccaggttaagcccttcgcacatttctctgaacttgtcagagtcgaattgcttgccattgtcagtgatgaactcttttggcaccccaaaacggcaaacaatgtttttccatacaaacttctgtactgctgccgaagtgatcgctccgaggggttcggcctcaatccattgagagaagtactcgacggccacaattgcgaacttgtacccgtttcacgccaccgggaacagcccaatgatgtccagtccccatctggcgaagggccagattggtgcgatgggctgcaactcatactggggcgatgtttggcttcggccatggcgctggcagctttcgcacttcttgacttgctcaacacagactttcaacacagtgggccagtaaactccttgtctaaacactttggaagcaactgttcttgcggcttggtgtgcgccacatagcccctggtgtatctccctggccatttcctcgccttcggcaaaagagatgcagcgaagcaagggttgaagtaccccggagcgatagagctggcctgagaccatcttatattttgtggctctgagttgcaggcgctttgcttctgcttcgtcttccggaagccagccagtttcaaggtgttttacgaacggggttcgccagtcgtatggatcttcgcccagtttctcctagtcgattgccatgacctccaagctctccacaggcacgcttggtgcaaacaggacttcaaaaaaggtgccaggcgaatgcggtccaccacaagcagcagattttgccaaggtgtgcttcctcgttctggcctctaggtaaatgttcgaccgttatgccggtgaaacacttttccatagaccgaacgacctccaaatacctcttcattccttcttcttttgcctcaaaggacttgtcgacatggcccgccaccagcttagagtcggttcggattagcaagcgccgaacccctaatgctttcgcctttcttaggcccagaagaatggcttcgtattctgctgcgttgttggtcgtgtcgaactgcagccttgcggcataccgaatcggcacaccacttggcgaaatgagcactgccgcaatgcccgcccccttgtgcgaccacgaaccgtcagagtacatcacccagggctgtttgacgggctcgggctcgggggcgagtgccggtgtccattcggccacgaagtcagctagcacttgggacttgatagcagtgcgggcaacaaaatgcaagtcaaaaggggatagctctgctgcccacttgctaagccggccggtaacttctttgccccagagtatttcgcccaaagggtactgcgatggcactatgactttgtgggtctggaagtaatgcttaagcttgcacgaagccatcaccagggcataagcgagcttttccatttcaatgtatcttgtcttcgctccttgcaatgctttggagatgaaatagaccggtttctgccctgaatctatttcttggacaagggcagcactgactgccactggcgaagctgccaggtatagtagcagttcgcttcctggtgctaggctgatcagagctggcgggctttgtaggtattgcttcagctcgccgaacgctgcttggcattcgggtgtccagtggaatttttccacgccccggagggtcttgaagaagggcaaacctctttcggctgcctttgagaggaatcgattgagtgccgcaattcggcctgcgagcttttgtacttcacgtacgctcaacggaggcttcatttgctgaatggcatcaattttctcgggattcgcctcgatgcctctttcagaaactaggaaacccaacaacttgccggcgcgaacaccgaaaacgcacttctcaggattcagtttcgtacccgccgcgcgcaagttgtcgaaggtctcctgcaagtcggacgcgtggtcgaaagccttgcggctttttacgacgacatcgtcgacataagcctccacatttcgccccaactgcttgtaaaggaccttgtacaccagcctcgcgaaggttgctccggcattcctcaggccaaaaggcatcctgaggtgacaaaaggtgccaaatggtgtgatgaaggctgtcttggggatgtctgccgggttcatgtggatctggtgatagccggaatatgcatccaggaagctcatgagttcgcagctagctgtcaaatccacaagctggtcgatccgtggcaagaggaaatcgtccttcggacatgctttgtttaggtctgtgaagtcgacacacatgcgccattttccgtttgacttccgcacaagcactggattcgccagccactcaggatggtcgatctcttgaatgactccagccttgagcaatttttggacttcggcttttgctgcctgttggcgatcagcagacatcttgcgtagcttctgtttccttggcttagcatctggcttgactgccaggtgatgcatgatgagatctgtcgaaacacctcccacttcatcagagccccaggcaaagatatcaatgttcttcttgagtgcctctaggatgttctcagcttcttctttgcccatgtcgccccccaacgatacgagctttgcggggtcggcatcatcaatctatatcttgattatcttgctgtgaggggcgggctttggcacatgcttcgcccggtcatgcggttcggcctcaacattgtgcactgctctgttgattatggccagatctccttttgaagcagccaaaggctgaagccccttgaccacgatcactcctgccgggccgggcatcttgagcttgagataattgtgatgagaaatggcttcgaacttgttcaacgttgcacggccgaagatggcattttagttgtatgggatgtcgacaatgtcaaacaatacttgctctgcgcgtctgttttcccccgtgccgaaggctaccatcaactgtgcttggccgagaacttgaactgcttctccgccgaatcctcggagcgatgctggtgctggggtaaaggcttgggtagtcaaccccatcttggcatatgcttcggcaaagatgacatcggccgaacttcctccgttgaccaggactcgccggacctcgaaaccagctatatcggctgagatcactagaggatcttgatgcgggaacattaatccttcggcatcttctggctcaaaagagatttgctggttcagatactgcggagcccctgccgaagcgatattgtggaccgttcgcaggtgcatcttcttctgtcgcttcgacagttgtatcagtgggtcggcccttgtaatcacttggatcactctgcgctgcgcatcatggcgttgttcggccgggggtgcttgttcttgagctacttcacgagttgcttcgaccgctgctccctgttgcgtccttggatcttgcgcgttgctacgttgccgaatgtttcggcattgcttcgtggtgtgtgaagagcgtccatggaaggcgcagtagaggtcttttcagaccttcttgcggacaggttgttgatggttgcttgcttgctgggcgtcaaactccttgcgaagggcttgcactccttcgacagccatcacagccttgcccgcatggttggttctgaacttcctccaggtcatgggggcttgaccttgccttggcagttgtccttagatcgccggctggggctggcgaaccacgagaggaggtggttcggcaacttgaacttgttgttgggcttgagcagcggcgacggaggccttatcgtactcggcttgtattgcttgccgtcgcttgcaatcctccttgccccttgcgaacccgtcaatgatgtgaagtaggtgctcaagcgtttgcggctccttgttggcaatttttcttgtgagttcgccctcgagtagaccagctgaagcggcgtttatgatagacgcatcggttatgtcttgaacttggcaccgggcttgcgagaagcgacgcatgtactcccttatcgactcccccggcctctggcgaatgctgagtagatgctgctgcgtcttcggcttctcataggtgcctcgaaagttaaggacaaagacatcgcgcaattgctcccatcagtaaatactattggttggcaaattgaaataccaagagcgggcgatgccgtctagggcgagatgtattacctttgccttggtattttcgtcgccatgagccgcttcgatcgcggattcataaatggagaggaattcctttgggtcagtttcgcctaagtagcgtgggacgggtgagaacttgaactggggtgggattggatgggtcttgattcccccactgagcggtagccccttttcgccccctgccctgttcacggcaccttgctgcgggtacggtgtggcgaagggcaaaatcacgacttgcgcgtgtggttgggccatggcattcggctgcccggccccgattggtgatgtttgctgagccgccatggatgggtcgaaagttggttgtgaccatgtcatggtgacctggtttggtgcttgctttgctccgaagcctggcgttggtgtttgcagccgaacggttggcgcctgagcaacattgatggagtcgaactgcagtccttgactccacggcgaagcccccagacctggctgattcgaaggcaaccaactaggtgcaccatgacttgtattcccctccgggtgagccgaaggggcagtacttgaaatgttgtggggttggctgagctgttgaaggaaagcttggagctgcgcctgcagagccgaagccccttctgccattgtatgtggcacttggccaggcggttgaggatgtacttgggcagcaaccggttgagcttgcagttgcacgtgaggggccggatgcgctgctgcggtcgatggctgcccggcgaagtacattggcgcttgtgcggcttgtggcggaaggggctgggtcggcacttgtggatagacttggggtgggacatagcctgccgaatactggaggattggtgccgaagtgaccttggaccgccttgccgcctcgtacgcttgctgctgttcctgcatttggcgaagcatgtcttggagtcgtctcatgttctgtcgcatggcttccatgtcggcttcggtttgtgtctcggggtcaaggttgacttgggcttgcgcagcggcgagcgcagttggggccactgccggctacgatggggcggcttggggcaccagcaattggcttgtcgaaaggatctccgtcctggtttggagtgccctcgccaccgcagccaccttcgccatgtcagccgcgttcggcacctgcacagaggcagtaggggccgaaggcggtagtgatggcgcaggtgcggaagcagatggcgctcctccatcttcggcgacaggcgccgaaggctctgctccctcttcggcggccatatccgtcccggcgtcgctttcctttcgcctcgtaaccttctccttcacaaccttcttcggtggcattcgctctcagtggtttcgctcggaggtccccacggtcggcgccagctgttgtcgaaacgacaaccgcatacgtcaaagacgtggtcacccaacagtggttggaaaagaagtaaaatgtattaatttgagaatttttcttcggatccccctattacatggccctatgagactatttatagcccccattacagattcttactactatggttttggttatacaggggaatttacatggttgcccttagaaagggacatttacatgggtacatagtgtaattgaggttcatgggcccctgatggccgttgggcaatcgtcggcccaatagcccctaggcttgatgggccggaaaagcttcttcggtcctcgcgggggagaacttgctatggcgaagtcgtctcccttcggcatatattcttcgccctgcatccttcgcccaagaggcctttggcttggcaaagcacccacgtgatccctcacctctcgccgtccctgttccatagtcttcgccatggggggacttcgccctgactaactttgacgtctcgggcttgaatccccactcttcgcatggtttcagcaggtttggtcgaagggcctcatgccataccgccaacactaataatgcgagttgcaaacaaattaataatgattttctaattataggagcaattggttaaagggtgacttgccttgctcaagatcttcacgaagcttcacgaatcttcgagaaatcccacgatcgacaaaaatccggtaaccgcaactatacgcaaacaatcaaaacctaaacaaaagaccaagagaagatcctatttagactaaataatagtgacattagatagatctcaaatttacggaattattggaagtggaacggaggttaatcggagttacggatcgagagatatgatttttggaagtttaattggattttctggacatggggatatatttgtggaataaggaaaattgatttatggaagggaaaaaaggatttattaaatttatggaagagaatatttgtggattattggaaaagatattctcgagaatattttgactcattgacaagtggggcaaacaagaaggtgagagcgtaaattgagagggagcagatatggactttagctcatgagggatggacactgggcttggagggagggactagaagtggacttttcttgtttccttaagccgagaagggaggccggccaatgggccaagcccacgagcgcggagagagagaaggggacggctgactgggcaggggttgactcggtctggtggggtcggcagatgaggtggcgtccacgtggatgccacgcaagcgcaagggaaagaggaggccggagaccgcatcggacggccggcggcgcgcggagcgtcccggcgaacggcggcgagacggagcgaggcgcggacacctgtggcgagaggaggagatggggaatcggttcaccggcacggattagagagaggaggcacgacggcggccggcggcggcagcgaagctcgccggatgtccgacgtggatgcgcgagggaagggccaagagcgcgcggggccaggcttagccgaaacgattcggcattgcgacgcacacgcgacggcacggagaccgatggttgccggacttgggctcgcggtggcgctccgcggcggcggaaggggcgacgcggcgaaaagggggagagaggagggagcggccaaggcgatgtcccggggaggctgctagggacgcggggagggtgatggcgatgggattcgtagggagaaggaccgacggcggcgggagactgcacacggcggcggcgagaggggaggcacggcgccggagcggaaggggaggtcggcggccgagggaaaggtttggggaggtcgagggggtcccgaggaaggcgatggcgagccggtttgaagagagggagaccgacggcagcacgcggccatgcgcggcggcggcgagt

SEQ ID NO: 58039 - DNA, 11302 bp, Oryza sativa
aacaattattcaatttgacgataaacagtgctttgatatattattatgcaatagtgttttatttttctttaagctattcttccgtgggttaataatcttcatatacggctttgtttggatggactacggccagccggaattgaggcgcaacccatgtatatcattctacccaaggtcattttctctacgaagactgttgggacatttggatggagccaggttggcaaaagtcccagcacaatccgccctagcccacatagggaagaagtctctccacggtgatatgaaactcttttcttgcgtcacacttagggcatccacaatgtagtctaaaactagtccataagcaataaaatatttcattcagccacctaaccacattgtggaacagtccatagcaagaaaatagcaaaagccacccataagcatatgggttgcccatatagaataaaatatgttatttgtctctatttcctctctccttttaatactagttgctatctatatatattgtcaagatagcaatagttatagtctatatatgtgggtaccatctatatggactacttttgctatatacattgttgttgcccttacagcattacactcgacctttttctccttcatagacaaggtgaattccaccgcgtcatgtgagagacgatgtgccacctcctatacgtgcataggaaagagaggaagaaatttgggtgttgtctcctgagttggatgtgagtaccgttgtatgtttggatttcgatttggattttgaaaatttgcttaatggctgatctggatttgtgagaggggaaccgtggcctaaggattgtgtttcctagattattaagtttttgttttccaacatttctgatttttcactgtatttttttcagatggttaaaaactttatcttaatcttctgggtgttttctgaattctatatgttctgaattttgaataacaacaatcccatccattccacccactatacaaacaatgaaagggaaggggattggcagagatggatttggcgagaggatggggaaacccacccatgtgagcataacctctacaccaaatattcttcatctcaaatattctgttgtgacggactctagaataaaaagtactctctttctctccgtttgaaattataagtgttttgacttaaactgctccaagtttagtcatatctgtagaaaaaaagtagtaacaatatcaacccaacacgaatatattatggagatgtattcaattatagatttaatgaaactaatttggtgttataaataatactatatttatgtaaaaactaggaaggaagcccgcgcagatgcgcgggcaatttatttattgcctacaaaaagaatactaaaagaaaccatatccaccatattcactataagaaatagaccattgattttgatatggagtaaatgatcaaaatggttatcatatccaaccaaaactcactttatcccaattatatataaattcaacattcaccacaacttattaactttgttttgaagtatgaatattttcttaatcgatggaattgcagctgtatcgaaaaaaactcaatacataattaataccataagaaattaatctccacatcatacccaagtgcccatgtctcacagatccaaatctatatataaatatttaaaaatatcgcttctaccaattaataggataaaacaattatacttatatatgaatgctcctctcacgatcgggtgaagccgactatagccgctaaggatttttctctaatgccttgattcatgggtcccacattgatatagtcgtgctcctcaacggtaacataattttattggtaagtagcaggccagttaagcattattgtcaacggtaacatcttacttggaccaccttaaccgaataatgcatactcctatatagttactacaatgtagccagttgagatccatacttagcatcctttatggaatgagtgaaagaagatggaggtgataaaaaaagtttttttttgtcttgagttgatttattatatagagtagacataatttgtttaaggtgttaatcaatagtactaaattttagttgtatagatatattttttttaaaaaaaatagcagggttgatcattcaactatctaatagcttcagtgatgaggaccacgtaaaaaatatttgctcacgcagtgatcctttgctaacttacaagttaatataagttttgattttttttcttgtattatacatctaattcacctatgcatgtatgcgggggttaatatgcgttggaatttgagctaatttttaaaattgtttggatgaggatgacaaaaaaatagatataatgtagttatatgtacgttttttttctagcgaatagtagtctctcgtacatacattcctttttatgaacgaatatttttctaacatagggatatggtgcacgtatgtgtattcattgtgtgcatctgcacatatctatatgagctcatatgattgacttttacattcttagtaaaaaaatactttcaagaaaattgacgagatgagagtgaagcaatgggtggcgtgaggcagcgctgtggcatggctttttttaccacctcgctaggagtggttgctatgtttatatatcctcaatttgggaaaatcttagagcggtaaagaaaaagcaaactaccagatgggacgaatcatatacagactcttcttttttttctttttatctcttgtgtacgtaattatataggagttgtgtatatatgtagagacagattttcatagattatctctaatttattagagtattacgtgatatcttaggagcatttgtagaagtgtagtaatggtattacttatagttgtaatctacttgtagtcaactattgtttgtatcgtctacttactctatagtttgttgatggttgcgcactttgtatcgccatttattttcagtgttggatgacacacatgctcattgaatataagctaatttttaagtgcattgtgcatggataccttgtaaataatattatttagcgatcagtggatagtggcttatgaatagaacttagatacatggggatcactgaggacataggtttgatattttaggctatgattgaccaagtatacaaatttattgtatattatatattaatgttttagtacctaaataatacatttaaggctatgttctaaagtaattattggattggctactcccttatttatatcgagcatgtttcccaaactattaaatggtatattacgcggtgcgtgtattgcaagtacttttttatgtataatttttttaaaaaaataaaataaatttattttcattatttatatttaatactcaattgatcaaatgaagtccatagtgggagataaaggacaacggcacggtgtcaaaataatatatttgatatttaatatctaataatatataaataaataaaacacataatacattataggataattgattcggtttttatctcatgtgcgtgaaaaagagaaaaaagaaaagacgtacgttcatgcatgtatgtgggccttttaaggataaatctaattggctattttattatggatccaatggttaaaagtaatagctccaccagattaaatgaaaactgatgattagatttttttttaatttctctaaatttattagaacgccacatggcggcatagaagtatttggagagtaccatatggcgtagtatataatacattgatttagaagatagaacattgattggatatttattatagatcataatttaactaaatatatttatattagtgaagtaatatattttatgtttataatgtacaaaatcatattttaaacaccatcgatttttatggatctatgttttatttatgtctttttatgtagatgcgtatggttttttttttcttctggccaacattatgtaagcattattgttttcaatcgtgtatgtacatacgtacggaagaacaatagtagtagcgtttgtatagtataaagtcatacatatgggatatataatatgaggaagttattactttttaataatagttctaatctaatggtgtaaaataacggacccaccaatttaagttaaaatcaatggcgagattagatagtgccatgtggcggcttaggagcgtttgtaggagtgccacgtggcgatttaagagtgtttgtaggaaagttaatggacttttaatatataactaggaaggtagcccgcgcattcgcgcgggcatgcgtcgtacgctaagctagatacactataagagcaaaatattaaccaaagaacatctgccatgatttctccataaattatttttgtcggcattaattgcttttataattctctaacctatgagctttatcttatatcatattttagtaatatctacaagtgattatttataatcttcttcatcatttgaaaagaaggtagaatttttttctttagaaaacatgtcaacaaaagataaagtaaggtgtttttctctttttttaattgcatatatattatcatggtttaatagaggagaattgggtaggacatgaagatccactaaatgtatgggtttatatagcctaatatagctgatgtattttgagaggtgatctatctaaaaacatttcatttagagtaggtcaaagcctccacacagcttaacgtgaatactataatgacaaaatataattgtgcagtattagttttgaaatgttatagtattcatattactatagcatgaatacacgcttgttttctatataagatagatataatgataagaaatgatggttccacaggtttaaaaggcataggagtattccaaaattgtagcttaaaaattatgtttgttttaatactcaatattattgcaaagtgagtgtagctcaactggttaggttccttgtagtggaacatgccaccgggttcaagtcatagactttgacatgggtgctcgtatttatgactaattattttttcagtggtaggtgacgtatccatcgacagcgagacgtccatggtgatttcttaaatctcaaaatatgtcgtctaatcttttggacatactcaaatggggtaagctatgtgtttgtgagttcataggggtgagtgtgcgtccgttaagttgtgagcgcctacgtttgttgtgtgtttctaaaaaaaaattcataggggtaggctatgtgtttatgcattcataggggtaagtgtgcatgttttgtgagtgcctgtgtttgtaatatgttcctaaaaaatatccaacattgattgtttttcttttagtttgagagctaaacaatatgaaggggacgggctgtgttgtgcaaatgtgagggcgaggaggaggtggaagagattttatttttgtaatttttctaaacgatttaagtgataaccgatgatggggtgtttcattttttaaagaacttctaacatactttctttgttttaaaggatgtggcacatggcgatttaagattatgtttaagaaatagatttaatagttaaaaatattggaataatggatacatcaatttagttgaattttttttagaatcttaggatatgatagccagtgacttatgagcgctcaggagggagtttaattgatttttgttatatacaatgatttactataacatactatatattttcaattaatttttggttgttaggatattatttttctaatatagatattatgggtcctagttttgagttatatatttttataaatacatttaattttagatctattagaaaatactttgggtgttgtattttctaattaaaccacttagattgttttaaattgttctactggaagtacatgttattaatcagatcagaaggtttaaaaatctacttgatattttcttcaaaatgtatgaatcggtgaacaatagttagtccgtataatatatatgacacaaagtaatgaatttctttaataatatacttaacttggatcttcagttttaaattttatagtaaatattataatggtgtgcacaaaaaaaagtagatatatgatttagataatatagttgtttaaaattagttttcataaaacatttttccatctaactaaaagagaaaaatacgagagaaagaaaataggtggggaggcacgtacgtactgaatgtgaggggtggatatgcagtgcttgttttcttatcctctatttgataaacaaatctaatggtagaaaataatgggttataaaatattttttccatctaacaaatttaggaaaataggagaaaaataggagagaaggaaaattgctgggactggggaggtacatactggtcggggtaagtacgggagaggtttgagatatgcgggtcttttttttgtttttatccttatctatttggataaatatccattgtatattagtgaaaatcgacggatggatgttttatttattctcagattttttgtgatttttaaatttattaaaatgccacgttgtggcgtaggagtgttaaaaggagcgccacgtggcaatttgagagcatttatagcacatgtgcggaaaaagtctgaattacacccttaaactacaacaacagtacgaattgtcccgcttatatataaactcatctatcaccatcgttcctaaacatatgagttaatatattttttgttttgttttttcttttattatacatttgattcacttatgcatgttcatgggtatcataagatagaataatctatattgtcaaaattatttgtgctaattattaacattatatagatgagaatgacataactaaaaaaagatataatatggttccataagacactttcgattgaatgtgtatatgttttttctggcaaatactaagcacgtactttttcctcttttttttggagacaaatatttttttctcttagggtaggtgtgcgtatgtgtatttatatgatagatgtgcatacgtttatatatgcgctcgtgaatgccttttatatcattagtaaaaaaatactttcaagaacattggtgagatggagtgaagtggtgctgtagcggcgtggattctttgacaacctcgtcaggagtggtcgctactcatatgcacaatttgaggaaaatctatctcatagctgcaaagaaagaaagaaagagaaaactactcgatgcagctgatcgtatacacactcttcttgtttttttccttttatgacatctcttgtgtacgtatatagtgagggattacttgaatatatatatatatatatatataatggttgaaataatatatccacaggttatgtataaataaatagcttgattttacctttttaaattttttttcttagataagcacgggttatgtaatatataatacttaattaatcgctaatgatatactttgtttcgcgtgtcctagatatgctcttccaatgtagaccaaatgattactaaaagataaaaggacatccacatgctgtaaaaaaatatatgattgttaatttttttaaaaaaatatatgaataaagaaacatataatatatgaaaaatacattcatggcgattggatatatcagtattacacagtatggagtgagtaaatttttagagagctactcacaatttaaattgtttttattttgaaaatataagtccaatttaactatgctcttcagtgatatacaatgatataatccacaattttaatttattattattattattatttgtggatgatttgatgagatgcgctatttagaataaaacttaaaataacatataattttacaacttaaaacatatggttaacatggatttttttgagttttttctctaatatctactactataaaagttgaagatgtttttgctggtacttcggtacgtcatccgtgtacgagtcggttttttaggtttgttcgctttttaaaatacgtatttgagttgggttttaagtttcgttcgctttcgaaaatgcagaaggagtcgtataagaaatatttttaaaaaataactcgcatgctaacttcactcctaattgtagctcatgattttcaccttaactaaaccatataacaataataaaatcaaaatagccttcacccgttgtaacacacgagcattttttctagtctaagtatacatgcgagaaggaaaaaggaaaaaaagacatataggggatatgtacgtacacggacgtacggacgtacaggtccatggggacacgtacggccaggtaacgtgggtttttttagatagatttatttggtattttctttaaataaagatctaatggttaaaaataatgggtccaccagattaaatgaaaaccgatggttagatgtttttctttttaattagaatttctatgatttattaaaacaccacgtggcgatctaggagtatttgtaggaacgccacgtagcggcttaggagcgtttgtaggaagtttaatggacttttagtatataatagatagatagatagatagattagaatttctatgatttattaaaacgtcacgtggcgatctaggagtatttgtaggaacgccacgtagcggcttagaagcgtctgtaggaagtttaatggacttttagtatataatagaaatagatagatttaatcttaaagtagtttaattttgacgacttataatctgatatggaagagtacagatacttagcccctgatgatgtattctacttgtgattcgaggagcactaattcgcctcgtgaatattctacgggctggatccacttatactacaacactcctgttcctacaccctgatgtctatggcgttctccgacgaggatgacgatgcgtccacggtcagcgtacgcacggcggacgacacgagcgacgggtgggtcaccgtgacgttgtactcgccgtgcgcgaggtcgagctcgacgacaccgtcggcgtccgtcgtggcgacggccacggggtgcgtcctccactcggcgatgagcttgtcgacgacgtcgccgacggcgaggttcttgaactcgtcgtccgtcaggcacatcacgtagcacgccgtggcgtgccacgccgcccacatcaccatgccatccacgttcgggtgcccgtgcccttctctcaacacctcctccaaatgctgcgcctgcacgtagaacaatagattacgattttctcattttcataatgaaatcttgatgatgaaaaagatgtaattatacaatttgttacctggtttgttccattggcgacgtcgatctcggtgagccagatggggagcttgagctgcgcgagcgtgtccagcgtggcgcgcatgaaggggatgtttggggtggcaccgaagtggctctcgagcccgacggcgagcttcaggccgccgttgccggggaaggaccgtatctggttcatcttggcgacgtacttgctggccatcgccgccatgtccaccggctgctccacggtgttgaactcgttcatgaacagcggcgtctcgccgtcgatcttccccacctggtggtagatcgccggcgacgcgtccgggccgagcttgccgtcgtagaagctccagtggaggttctcgttcaccacgtcccagccgatcaccctgccgccgccgtaccgcgacacgacggacctgagccgcttgtccatggcggcccgcagctcgtccggccccagcgacctgacccacgccatctgcgtgctctggtcatcccagaacacgttgtggccgcgcaccctgacgccgtgccgctccgcgagcgccagcatggcgtccgggacgcggtagtcctcgtgcccctgcctcccctccgtggcgtaccacttcatctcgttctcgaacgtcgccaccgtgaaccgcgacgcgaaccactgctcgtacgccgggttgtccaggatctcccgggtcatcgcgttgccgaaggggaagccggggcggaggagctcggcggtcaccgtggcgttcggcaccggcgcgccgtcggtgccgcgggcgacgacgacaccgagggtgctccgccgcgccctgccggcggattgttgctggcggtgcgcgtcccactcgtcgaaggtgaacggctgcagcgacacgctgtccacccagatggccaccgctgcgtcggcctcgaagtagagctggccttgcccggaggagtaggacgtcatgccgcccttgatcatgctccagcagccggacttggcgacggtggcgccggcggcgacgaactggccgtcgggagtcctgaccaccgccatcacgttggccgtgccggcggacacctgcaaccacgctgcacggccacacacacaaacacaacaacaacaatggtattaaaacagcaaacacatgtgacacagaaaattaggaagcactagtgattgatgatgaagtaatgggtgcataactgtattcaccgaaatttaaattctagtgcttgtgaatattacacacatgtagataagatgtagataaggtttcaacaggattttagtcagatcagtgatatatttttagtttttgtctcttataacgtaggttagggacgcatatacgggacaacgagtgtagtgatttgtgcgcgtgtgtgtttacgctgtagtcgaaaaaaaaataggtagacatgtatctttttgtacctgagagggaatagtgggtgttgggctgtatctggaccgtctggtacacggtgcgcgacggctggccgtcggtccgcgcctcggcgaacttgttgccggacgacgagctgttcacggtggcctggacgcccaagggcacggtccagtccgtcaggcctacgttgaactcgctgttttttatgacgcctccgctgtacagaggtatcatcgggttgctcaggcactgcacaacacaaattgaaattccacaataaaacattgccttggttgagtggcggagccagaaaatcttcacacctaaaattaagctaataaaaacttagatatttctacaaattacattgtattttttaattaagattataatggggattatgaagttaggtatggggctcaggccatagttgccccatgcttgtttccgtccctggcttggttaatccgtctaattttggaatatgcttggttatatcttctctgtttcaagctataatgattttttacgcttttcaagatgtatctattcatatgatgtctaatatattttgtaaatcatatacaaattcttatattttagaatagagggagtatttagggcctgtttggtacagctctaactcctaaatttagctccaagagttgggtctggagtggagttg

SEQ ID NO: 58040 - DNA, 7593 bp, Oryza sativa
gtcgtcaaggattgcctgtggaatggaatcgcccgctgcgggagtcaagtcttcaggcttagctcgcttttatctttttccgctgcatttgtaatcttttgtatttttgtaagatgtggatctgtatgtcaacaattgtcgtttgtgtaccctggctggtcctggacaggggtttaatacacattcagcttagagattctggttcgtgaatttctgggcgtgacatcactgaccggccgcctcgtctaccgccgactggtgtcctcgcctgcacggatggcctattatgccgctgtttttgggcgcctacgtcttcaccgccggcctgcctccgtcaccgccgactggtgtcctcgcctatacggttggttggtcacatcaccgttgttgggcgtctacgtcttcaccgatcggttgcctcgtcgccgccgactgatgttaccgcctgcacggctggcctattatgctgtcgttgttgggaaactacgtcttcaccgaccggctaccacgtcgccgccgactggtgtctccacctacacggatggcctattacgccaccgttggtgggcatcttcgctttcaccgtcaaccgcctacgtcgccaccgactggtgtcttcattgttattgctggatgactttgttcccacattggccacctctgccattaccaaggggaatattacaaagctaagtcatcattgattttctttatatgatattttcctcttcctctgcctcgctacatcaactggttcgccgttgactagtgagtcgggggctacagatgttatatcatattttttaataatttttcatagtatttatcttgattgcttgcgacataatctgagtacaaaagtgcctatcgagttatggagttctatcttcctatgctttccgtttggtttgtcgatggatagttgcctttgggccgattcctagcacccgggggctcgttggatggaccgagtaacacaaggtgctaagtattattcggaataaatcaaaagcacagagataagataaatatattttctgctctttacaattgcaaaagtacccgagcagtaaattttgattcgtgaaactttgttctattactgacgaactcatgtcactcacacgcatgtttgggaagtgtctaggctggctcccgatgcttggggcctatgactagtcggacagagtgtttaaacgtgctgagtcatctgctcggggaaatcaaaattgacaagaggagaaatatatatttataaatatttttaaatacttgaattttcctcgagtattatatttgtatcagatactactcatcctatatgtttgttctacaggatccagatccagatatgcataaaagggattcatggctttaagcttatctcctacgcttcaggaatggatcagccagaacattaccaccggctcgccgccgtcgccgccgactggtgtcctcgcctatacggttgggtggtcacaccaccgttgttgggcatcattgtcttcaccgaccggccgcctcgtccgccgccgactggtgtccttgcctatacggttgggtggtcacaccaccgttgttgggcgtcattgtcttcactgaccggccgcctcgtccgccgccagctagtgtcttcgcctatacggttggttggttacaccgccgatgttgggcatctacgtcttcaccgaccggccgccttgtccgccgccgactggtgtttccgtctggacggctggcctattatgccgccgatgttgggcgtctacgtcttcaccgaccggccgcctcgtccgtcgccgactgatgtttccgcctacacggcaggcctattatgccaccgattgtgggcgtctacgtcttcaccgaccggccacctcgtccgtcgccgactggtgtttccgcctgcacggcaggcctattatgccgccgatgctgggcgtctacgtcttcaccgaccggcttgccttcgccgccgtcgactggtgtctctgcctgcgcggctggcctattatgtcaccgttgttgggcgtctacgtcttcaccgaccggcttgccttcgccgccgccgactggtgtctctgcctgcacggctggcctattatgccgccgtttgttgggcgtctacgtcttcaccgtccggcttgccttcgctgccgccgactagtgtcttcgcctgcacggctggcctattgtgccaccgttgatgggcgtctacgctttcaccgagcggttgccttcgccgccgtcgactagtgtctccgcctgcacggctggtttattatgccgccattgtaggacgtctacgtcttgtccgaccggctacctcgtatgacgccaactggtactatcatcttcacggcaggccacgtcgtagccaccgcaaataggcgttatcaccttcaacgcaagctgtctacgtctgctgccgactggtttcttcactttcatggctagcctattatgccgccgctcaacctaccggagtatctatcttcacaactacacgtcttcgccaccggtttgcttctgttgacgccgactcgtgttcacttcatcacggctatgcaactttgccaccatggtggagcgacttcatcttcggcacctgtaaactttattgcctctactttgcaagctttgctacttcatcgatcacgacgtctacaagagcctcgacatctcggcatgcgtcaacaaatataatgctgtattattttactacaacaagtggtgttccaatattcaatatttctactcggacatcttctatgcgtatcttcactcaagcaatgactactcgacgacaagaagctacagttcctgactctatgttcagttgtttcccaactaaccaaagagtcgggggctacacaaatacaagactctcaaaattcgacaagctgaagcaatcaattaatccaggagtcattttcttcatctttgcttcggagcagacgttctacttcagcaacttcaattatttcatcgacaattttggcttctcagcgtgatgagggatatattttctctttctcagcgctgccataatctactccaaaattctcaagtatcaagttcaagatttaatctacatgtttaggagtatggagttatcaaccaatcaactcagattcgatgagttagacaacaacatctactttcctccaagtgaagcttctgtaatagctataacaccatgttctactgccatctttacaaatcaaggggtgtggcatcaatcttcgttatgcacacatcaagaaaattacttgagcttcgatgtcttctcaacagtttgatggattattgtcattgacatcatcaccagcacctatacttcatcggccagacgtctccgccgttactaatgggtgactacatcttcgtctccggttgcttctgtcattgccagcttgttatttcgccttcacggttgatctactacgcaaacgctgatgagcgtatttgtcattatcatcggctactacaccgctattgattggatcgccgacaacgtcatcttcatcaacatcctgtcaaagcttatttaacatagccaactctattgctattggtgggaacttcatcatcatattcgatcatctctgttgctgctaatcgtcattacggtcggttgtgtttgtagtcatcgactattttcttcatcttcatgattgatggatttcgccatcagcgttgatgcgcgtctacatcttcatcgtcgggttgctttcgtcgccaccgactgctttgtcgttgttgttgggcaccttcatcttcactaatagctgacttctctgttgccgactggtttcttcgcctccatggctatgcgacttcatcaccttttattggtgtcattgtttttactaccaccaacatcttcgtcagctttgatggatgatatcatattcatgttggtcatttcatctccatgctgactgcatcagttactatcaatggacaaatgtgactacaacagaaggataagttacatgcttaggggctcatcagcacaagcacgaggattatattttcaatttggacttcttccggatacattcaacatgaattcatgatcatgggtctattttctatgctcaaagactggactatttattattccccgtaagggttattaactaaatacttgcgtcagtcgggatttaattattatatctattttggagtataccataagggataatcacttagatcataagctattcagatgagctacacttggtctacattacccggaagatttattactcgggagcatgttacatgcgtcatcctttaaagggtgtcctaggcctaatatgtctgtagcccatattttcaggtgtggcctgtcacgttcttttagggacttaggcactttttgcttagaccaaagtgcgcgtgatcaagtgcccaataccttaaaatccttttataccgcagttactcaactttttaggagttggtacaatgcatcttaaaaggtgtcaaacagtaaagctatatagctatcccgctgacttttttatataagtcaaggtgctgtttgggttttcaagcaattgattggatataatatcgttgctttttgccacgtaagtgtgcatttttattgaccaatattatggcttaggctgattatatatcttggtcattttccaggcggttggtaaatcctttatgagtttatttactcggattttacaccacatatgccgtatatttccgggtatggtgaaaccatgtgtcttttagggatttaagcacatctgttaaagcagtgtgcgcatggcgtatgctcaatactttagaaatttctttattcacggcattcaaacttttttatagctgttttgctatgtgaattttcaatgatgtagtcaactttaggttgcacgcatcaatttttacaaagcagtcggtatatcacttggatcatgttattttggggattcacaccgcatatgctatatattaatatcaagtcacttggttgactatatttaaattattcatcagccctccacagtctttagatttggtaaaaagtactcgggagatcatggcgaagatgattgaagcactcggctttggagtaatctagttcgagagaagattatctttttgactgtgaaggtctcaggggctactgtggagattatgggtatcccatacccacacggcatggttatccgactagtcatagggatagcttatatctatggaatatgtaacagatcatgacttgggtattacgtttccatgtatattatggaacggcctaaagtcctggtttgataatagatttaggaaaccgataccgtattggttaaggtttctatcttataatcctgccccccatcctatataaggtgggcaggaggccctctagggggcatgagacaactagatcgtcagatctatactacacccggcggattcaaatccccaaacaggagtagggtatacctctcattgagagggcctgaacctgtctaaatcctttgtctccgcatccatccacttttaggtctcgtgcgctacccccttttcatattgccgaaaatttgtttcgacagtcatcccgccgcaccaatcgccaccgcaactcctttcctccactgcaccgattgccgccgcagctcctctcctcctccacaccggttgctgtcgtcctccacccgctacgccagtcatcatcatccacccgttgcgccagtcgttgttgtcctccacccacttcactggtcgctgccgcagccacctctcctcccctgctgctcgctaactccccccccccttcaccgccccgcctcttgccaccagatttggtggcacctagcctgtagcccccagacctggtggtcggtggcggaagaagtggcagaagaaggtgcaggacggcagcgattgaagaaggtggccaggtggcttgcggcggcaagccatgccctccgttgagctcgtcaccgtgccctcccttgagctcgtcgctaggccatcacctctggctttgctctgtggccaggaatgaggagaggggaaagggcgggacggtgaccccatcgcgcgccccgtgcacgcacgggtgcaacacgctgcatcaggcgggccaggacgagctacgaagctcgattcccgtgtttctgctcagcctagccaagaggccactttcgcatcgtctcattctggctcacgtgctggtgaaggctaccaaacaaacctagtggattcctcacggtcacgcttcaagacaacaaaggtaataacttcaaggtaaatggtcatcgcttaagagttttcctaaatatagttgaggggttatgataggaaatacacttagtggatttggtcctttctctaaagtccatcctaagcctattgcaccctgcctgagccggggtgctctggggcctagggtggtttggccgaaccaagcctggtgtcaccaacccccaaccttcactcatctcggcctgctggtgtcccccttgctatcactggtggatcataatcaccctgttttcaaacttttcatcagtctcctctgttcttttcttccacctccgagttcatctttctccccttctcaatttctcttccgaaatccccaaatccatggctgggaagtgtcacgcccagaaattcactagtaatttccgaactaatttgtgcataaaatcctcgtccaggaatcagccgaggtacacaaactgacaattttaatatacaaacccatcataataataacgttacatacttacaaaagaaaagaaaacaacagcggaattaacggtctagcgatggcttcagctccactcccacaggcagctcaactggggtataagccaaacgtcttctccttctggatcctttatcttcaactgaggtttgatgattattgcaagaatgagcatatgacatactcaacaagccacacagcaaatatgcaagtgcacaaggataccaaagaatggcataatataggctcatttgcaaaagcagcatttagcaaagatttaagataagtaaaacagtagagtaattaatcatcaattttaatcaacactgaacagcacacccatgctgctcaggcccaaccaaacctgaacaaccaaccccggtcgtacagatcaaacctccaaaccaggagtcaaattaattctcaccttattaacattgatgagtagtgtgaaactaatcacgaaaaacattgctcaactcgcccataaccgcggtggaggggacggactgttgtcagatgcaccgttggcacgtgctccattgatcggctcttcgctgccactggcgttgttcgagtcgcgtgaaccattccttatctccatctgaaggggataggtagaaatatgagaaaaggaagaaaaacagggggctcagaaactaatcttgcttatgaatttaagtgcaattatcttaatcttgattaaaacactgaaaaagaggcacgcaactcctaattgaggcagtcataccactgacacatgatatcgaccgccgactaacccacaagcaacaaacctaaacacgaaaactagcaagcaaacagactaagaaggcgataaaact

SEQ ID NO: 58041 - DNA, 17466 bp, Oryza sativa
gcctaaacccagctccacaactctagttcattttgtgagagagctccacccagctccactcccagttttagtggagctgaaactgtttggctgagctccagctccaggaggggtagagctggagctggagctgtgccaaacaggcccttagagccgaacagtttgaatagctctggtgtaaaatcggtaaagtttatactatcaaagttaattaattagatagatctgatcgtgcagatcaactataggcaaatctgacatttaaaattgcacctggaataatagccccaaattaaatattgaacaattaaagtgattttttttctgaaatggcattcaatgcagtaatggaggcaaaagaaacagatgaaggatctcggagccaaagatattaaacgagaatgcatttttgtatttcgcaaactgctccacaaagttcggaaacgtaaatccatatctgattgagcagtgtgcctctagacttatcgatagcgatatctcttcctagtgcctaggccctctttgtttaggcttagacttattggcctagacttttaagtcagcttattggcttatatgatttataagccggtggatttaatgtcttaagtgtagtagttgagtcatacatctacctcacataagccaaaaaaagcttctccaacctagtttttggcttaatagtgttagagtggcttatggcttcaaaaaagccaaacggaaaaactacttgtttgtttagacttagactttttgacttataagttgtcttataagcgtaacaaagagggccatagtatactactcctggatcagttttgaccaattcaccatcgtaccattatttcgtggttttggagagactgaaatgaaagataaaattgatcatttttatccatttgatttgttcaaaatacacgaaaaggaaaaaatacatgaataaataactaacttagtcgtgtagtatatgcatgtcttgcaacagagctcaaattagaattatttgcgtcacatggttcgtactaaatattgaaataaaatttcttgtgttttttagatccagaagctactaagttcaatctttcaccgaagaatttatagaatggaaaaaaaatgttatgctagggtgatctgccatccaatgcttattactatttgtagaaagaaaccatgaaaaaaaaattcacaaaagagagaaaaaaaaagcttgcctcgatgcttgccgtatggtcataaggaaccgattggaccatctgacctacaaaaatcatggaggaaaatgatatgtatgtgcataaatatccataatcttttcgtaccattacaaaaaaaaacaaaatgaaatatgccaaatggtgtaactgaaaaaatgaacagagcaaaaggtaagtctgaagataacactacaagcagtgcacctctccatataaaaaaacgaatttcgtctgccccttttcatatgtgaaagtttcctccttccacatactgacatctcccaaaaaaaaatccgaggataaaaaaactaaaccaggaggggcggttggtccgtactctctctacatcatgttgcgaaaaaaactgacctctgaaggagagtagcaaaatgattccgagtttctccatgaaaaccttcatcgtgtgtcctgttaccactaatatttgtttctagctacaaatctggacagaaataaatttggatagaaatgaagtctttttggacagatggagtaagtatatacaactagctggatgccagctatttcctaacttatatgctaggatgtcagaaaaatgcccataaatagcaagacttaacttaatccagacaatcggtgtactgctaaattaccgtttcaaatcaaacggataagtatattattctacggctgtatcttcgacgagtattaattacaactactatctcgttgcctataaattcatttttctcctctggcaaaacggacctcaatcaatctatctattaaatattagtatagagatagtatatatcaatcaatcaatctatcttctatttatatactaaaagtccattaaacatcctataaacgcttccaagctgccacgtggtgctctaataaaatagagaaaatcctagaaattctagaaaaaagaaaaacattcgaccgttgattttcatttaaattggtggacctattattttgcaccattagatttatcttaggaagaaacactttccatcgttagattagattgatctaacaggactcatggtcaagcgcacctcgcccctttccgtgcgtgagacgcaccgtacacacacctcctctcctctcttttgctgcccctcccctcccctctccataattctcttttctatttgtaagaaatattttttatcaagaaatcaacagtttgatgagttcaaaataattactatagtttttaatatattttgaaagcaaacaatcagatcaagaaaatcctctcatgcacctacccactgctgtgtcaatataagcgatgcaagcaacttccatctctttgtttgatctctcacgccttaccgtgcttgtcactttgattccatgtaatagtaatagtacagaaaggctatctttgatttcacataaatttcttgaagcttatggaaaataaataaattaatttttaggcatttgggttatcaggtggttttcaagcaagggtgccctacctcttcctacgtatgtgcctcccttgcctttacacacttataagtcttaacttatacatttgatttctgatccgtttaaaacatcacattctttacgattaaatcaacaattaaaaactcagttttgaatatattttaaatcataaagatataattttgcatactaaaagtatattaaactccctacaaacgttctcaaactgccacatgacgttctacaaatgcttttaagacgtcatgtggcgctctaataagtttgaaaaaaaattataacaattctgataaaaaagaaaaaaatctaaccattaattattctttaaataggtggacccaataattttaaccattagatcttaaaaaaatcaggttcccccaccgtatgtgaccacacacgtgcgtattccttcacccttctactctcctctaggatcccaatctcctcacctatttaatttctagctaacttttcctattttctagctaatacaaaatatataaaaaataacaatagctaaatgatcatgactctcaagtcatgtgtacttttctcattttatttgattttctatgttattgataattaaatacatactccacgatccatagtgcccatatttactatataaaaattagataacttggttgttctgactacaaatatttgagcaaaatataactttgaaaatgatgaatgaatttaaatatgtgaatctaaagtccaggttcaatcactaccaaggagcttggaactgtgatacatactctgaactcaaaggaagaggagctacaagacattattagccatgtggacaccgatggcaacggtagcattgacttccacgagttcctaggcctaatagcgtgctagataattaggtgaaggaaaagtaatgagaggaggggaagagggagatgttccgcgtcttcgacaaggactagaaaatggcttcatctctaacgccgagccccgccacgtcacgtgcaatgcatcaggagaggctcactaatgaggaggtcgacgagatgattcacgagaccgatggtggcaggtggatcaactacaaggagttcgtaagaaaattcagaaaaaaaataaaacaagcaatttgattaaaatatacattaaaaaataaaaagaatcattaaaactataaaaaatacaacaatattccatgtagaatataaaatattaagagtccatataaaagtatgagttataaatagctaaaatttggaataataaaacaagtattacaagagaagtccaaacacaacacgcaatgagatcaacacgctatgagatcaagtacaatttaaaatccctaaaaagacaatttagagtaaaacaataatttgatttgaatacaaatttgaaattagaatcgaataactaaattcaagatacattaaatattttttaaagaatctttctatctttattgattcacatgtataacgaattgcatatatatgaagcaattaaagagagcgatagcagggtgggaaaaatacatttattacagtttatcgacatttcttgagaaaaaagatacaatgaacactcaattaaaaatagaaaaaaaatgttactttaatttaaatttattttgtttgaactattttcaaaataaaccaatacgcatgcccgcgcgaatgcgcaggctatcttcctagttattatatactaaaagtccattaaacttcctacaaacgctctcatgccgccatgtggcactctacaaacgcttctatgccgccacgtggctctctaataaatttagagaaattaaaagaaaactaacagtcagttttcatttaatctggtggacccattatttttaaccattggatttataataaaaataaccaattacatttatcctaaaaaggcccacgtacatgccccacatacgtgcatgaatgtacctacttcatgcaccaagccccacgttcctcttttttttctctttttcacgcacctgagataaaaaccgaattaattattctataatgtattatgtgttttatttattcatatattattagagatttaatatcaaatatattattttgacaccttgtcatttcatttatctcccactttagacttcgatcaatttcattgggtgagcttatccaatgcacgcagaatggtgcaagtcattagcacaggattaattgagtattaaatataaaaaatagaaataaattaattttatttttaaaaaacttttatataaaacatatttgcaatacatgcatcgcttaatataccatttagtagttcgggaaacatgctcgatataaataagggagtagccaattcgataagcactttaaaacatagccttaaatgtattatttaggtaggaaaacattaatatatacttcctccgtcccaaattataaggcctatatttttttacatggtcttcaactacatactttgaccattaatttattcaatgttatattcccaataaatatgaaattaacatcacatgaaagcactttaaaatataaatacagtgatataacatgcataataattagcatatactccctccgtcccaaaatgtaagcatttttagctatgaatgtggacaactgtgtgtccaaattcatagccaaaaattgctatattttgggacggggcagtatatgattagtatgattaatagtcaaaagttaccgagtttgatttttcttaaaatgaggacatcctatattttgggacggatggagtaatatacaatatatttgtatacttggtcaattatagtctaaaatatcaaacttatgtcctcaatgatccccatgtatataagttctatatataagccactgtccactgattgctaaataatattatttacgaggtatccatgcacaatgcacctaaaaattagctgatatccaatgagcatgtgtgtcatccaacaccgaagataaatggcgatactaagtgcacaaccatcaagaaactatagagtaagtagacgatgcaaacaatagttgactacaagtagattacaactacgagtaataccattcctacacttctacaaacgctcctaagatatcacgtgatactctaataaattagaaagaatctacgaaaagttatctaaaaaagtaaatatctatccatcaatttacacttaaatcgatgatccattattttcaaccattaaattaaattagatatatgaaagtaatccctctgtcctaaaaaccatataatctgtctctatatacgtacacaactcctatataattacgtacacaatagatataaaaagaaaaaaaaaggaatagtgtgtttatgtgattcgtcgtagctggtagttttctctttcttctcatttcttctcagctctaagattttcccaaattgaggatatatatacatagcaaccactcctagcgaggtggtaaaacaaaccatgtcgcggcgctgcctcacgccacctattgcttcactctcatcccgtcaattttttcgaaagtatttttttactaacaatgtaaaagtcaatcatatgagctcatatatatatatatatatatatgtgcagatgcacattatgaatacacatgcgtgcaccatatcctatgttagaaaaatattcattcaaaaaaatgaaaaaaaacaaacgtatgtacgagagactactattcactataaaaaaacatacatataactacattatatctatttttatgtcaccctcatccaaatagttttaacaaattagctcaaattccaacgcatattaactcccgtgtacatgcataggtgaattagatgtataatacatggaaaaaaaatcaatacttatactaacttgtaagttagcaaaggataactgtgtgagcacatattttttacgtggtcctcatcactaaagctattagatagtcgaatgatcaaccctgctatttttttaaaaaaatatctatactgctaaaatttagtactattgattaaccccttaaacaaattttgtctactctatacaataaatcaactcaagacacaaaaaaaactttttttatcacctccatcttctttcactcattccataaaggatgccaagtatggatctcaactggctacattgcagtaattatataggagtatgcattattcggttaaagtggtccgagtaagatgttaccgttgacaataatgcttaactggcctgctacttaccgataaaattatgttaccgttgaggagcacgactatatcaatgcagaaaccatgaatcaaggcattagagaaaaatccttagcggctatagtcggcttcacccgatcgtcagaggagcattcatatataagtttaattgttttatcctattagttggtagaagcggtattcttaaatacttatatatgggcacttgtatataatgtcgagattaactttttatggtattaatgatgtattggggtttctttttatacagctgcaattccatcgattaaaaagacacacatacttcaaaacaatgataataagttatgatgaattgtgaatttacatataattgggataaagtgatttttggttggacctgatagccattttgatcatttactacataacaaaatcaatggtctatttcttatattgaatatggcgagatatggtttcttttagtattctttttataggcaataaataaatttcccgcgcatctgcgcgggctttcttcctagttatataaaagacgagcattacgtaccgagctagctgtgaaaatccatcctaatggattaatggctgttagagacaaagttacgttcggatgtcgcaaccctcgtgggattgttgctgatgcgcctccctctacattatcaacatgatcctccgatcaaaaaccctgtctaggtctccttggcaagctacgatattttcaatgtcgtaaccttattggaggcatcgttttagatgtgatgtttgtttttgtagcttttcagatcatgggcatatgggcaatctgttaagcatagcagcgtacggcttgatgctaggctttttcctcgttggtgtgcgggtttttttttggcacatggcgaggactataaccttatgatatttttcatgctatatcaatattaaactttatattgtttcgtgtgatgtgtttaaaagaatatattgtgtgaagcattaaacgcaggccagcatttatgaattttcgggtaatgtcagttacaatataaccaagtatgaaatgtgctgtatatctcataactaagtaaaacttgtacccatcacgcattttgttggtgggttcaactgtaagcgagtaaattttcaccgtctagtgctagctagtgaaaaatatacattcctgaaaaatgatttttgacggctaagcctctttcactatgtaggtggaatgtattttcagctccgaaggcccacctagtgctcttcctccgctcggccgcgcccccgttacaccggcactgccgccgccaggccacgccccgctacacgggtgcgccgctgccgctcgcgacacccctccggccgaccactgtttcgtcgtcaccattctaatggagaaattttttttgtgtgtgtggtgatgcgcgggggcattctaggcatttcgaaaaaaaattcaccactttcagccaggaaatgataatgcatccggtgtactaaggaaaatttcacagtttttaagtgtcctagagcagtgtcacgttttcgcggtgtccctcagctaattatacaattttactttttttatttttttattttaaaaataaactcttttaaaactttttttttgaccgggaaacagtgggggaagcccccacggttaattttcatttatatagaggaaaaaagaaactgtacagaagaagatacgaaccttttggccactagcgtagcaaaacaatactgtcacacatgtcttgctggtataatagtgttattcggccacgtcggtctcgctggcgtggcagagttatttggctacgccactttgactgacgtatcaaggcaaaactgtcacgcccgctacaggtgatgtgtcagtgttatttcgtcgtgtcaggaagggctggcatgttcaaaaggtttagattttagaaatatatttttgtaagggtttattttgaaaatttaaaattaaaaacgttcaagaaaataaaaaaaatctggttgaacgtggttagcatctgaattaggcaaggtacattggttaatgcagagctatgaccggaagaaagaggaagaaagcaagtgtgacatgggaagtggagggggtacacggagctacggagaggcgatttgagcgaggaagctccactaccacgtacggcggcaagccggcaatggagccggccaatccggcgagcgccataccaggcgagagatgctcctatcgacgaggcgccgttgcatctgagccgagaccgcacaggagacaggaccgtcgcaccgagtcaacgggctgagcagaccgagcaacgtgaaggagaacagagcaggtgaaaggaagggccgggccggcacagttaggaaagcccaactagaatgctaggaggccttcaaaccaacggacgggatttggctgtgtgtccatgtgaacaggctgccatgttagaaacccgagtggtaaaagagccgtggaggaaaaggacctcaagtagatataagttgggaaatgccaggcgccggtgcatcgggcgcgcctaccgcgcggggggccccacgcctgtgctgcccatgtgcgtctgtgctgcttctccacgtgtcttcaccatataatcaattacaacaaatcacccacatattttgaaaacactctattaaggtaatttggtttattttttgttccacaaaaaatgtttcatctagcgtactcacaatgtttcactatgtatggataatgctacagtgaactgaaacattctttcgctatttgctgaaacattgtttttatataaagtgaaacaacgttcgatttaaacgattgaaacatttttgatctacttagtgaaacaattccgaaaaacctggtggaacatcgtgcaacatttaaaaaaaattcaataataagctacaaaaatttcgtcagaatatatccatgtgtggttttttttaaaagatttaattgcaacgaatttaatggttcaatcggatcatgatttggataaataatttttaagaaaaatttgttcatgctgacgtcagcgttcgatttttggagatttggatcgggcgaccgatccctagtcacctccatataaagtttgtcatgttattgttgaaactagaaagcattatacttgcatgttagaaaccagtcgcgctttgttcagtacggagcgctaggaaggattcagagcaagtataagagcaggtacaatagaaggccataagccagctataaacatattttaaagaaaaaaagaggagagagaatggcagcaactgtagcacggatatcaaggtgcatgtgtgtatgataggtgggaccagatattaattatataatatatgtttataggtaactattgtaagaattggctatgaagttgactatagatgatttagagccaacagttggctacactattaaacttgctctaatagtgagctataagcttacgtggagtataaaggtagcaaaaaattaagagtgttggctctcatgcaagagctagtttatcacaagttctaagacaaatacattaaatgtataagtgagagatagagaaatgagaagaaaattatagccaaccttacatgctaatagtagaaagtgagctctattattatccttgctctcaggaattttgatggctctcaatggtttctcaagagatgatgaacacaagcctatcagaatatggcatccatattttattttcttgccatttgtcttctaagaaagtgctgtggttttctgcatactaatatggaaaaggcgcatggtgataaaccttaaatgtgcaatatttttttatttaagttcatgcaattgttcatggtttcttttcatcctttgatagagaaatgcaccaatggatttgtgtgcagactatcatgtgccactgtcactgtggtctgcagcacaatttccctgcagaccttgcttgaaatttgggttaacaatggcacagcttccctgaagctggtctagagaaataacctgtgtactgataattgtgcatggctgtcctatgcccttaacctttctgatgaatacttgaagtgactgtccttcttgtttgtaaagtttgcagcagctgccttctccaagaaatatttgcaacacagacccaattcaccaattcagagggaagatattggaaaccataaagatggaagagtatcacggtaagtacatcggagcttgttgcgctccacagagcaagtcgcaattccctgcactcaagattatactgtacgcttctgtattgaggaagcttgcagcaaatacatggaactcatacaagccaacaaaacgttggcacaagaacattacacagcagtatttgtacagtagacaggctaattttgacaattttgaatgttttacaggctttcactgggacggtgaaacttgctcggtccgaaccttaaacacgggcatcatcctcttccattcaaggtgaatgaagatggagatggcggtgtgcagttcaggcagcagctagcttgatctccgttcaaggaagatggtgatgcagcgtctccggcgacatggagatcatctgcagcaggctggagctcgagaacgtctcctcgagggatatctcgatcttgctgctgctcccgatgttgttcctcacgatctgcatcagctccttggcgacgccgagcatgcagagcccgttctcggcgctcagcaggcacgcgacggcgagctcgaacaccttcctcacgtcctcgttcggcgccggcagctgcttccccgccaggagcgtcacgtcgatgacctcgtgcagcctcccttccctcaccttgggcgccaccgagtcgaacgggtgctggtgcctcatccccgtcagtagctcgatcaggaggtggccgaagttgcgcacgacgtcgtggtcgtacgacggcgcgtagtagtagtaggcgaccggcctcgcgagcttgtagccggcgatcttggcggtgaggttgtcgtcgaggaagacgtcgctggacttgaggtcgtggaggaaggtcggggccgtgtcgtgcgcctgcaggtacgtgagcgcgctggcgagctcgatggcgatgttgacgcggtggtaccagctgaggagccggcccttcacctgccgcaggtggtcctccagcgtgccgccggcgaagtgctcgtgcaccaggagcagcgcgttgccggtgccggagtcggcggcggcggtgcagcagaagccgacgacgcgggcgatgttccggtgcgagacctcggagaggagctccaccctgtccaggaccagcctgagcttctctgccgtgtcgtacccgatcctctgcaccgcgaccacggtgccgtcgtcgaggacgccggcgtggaccgtgccgccgccgtccacctgcacgttgacggcggccttctcgctgtcgtcgaacctcttggtcgcctcgtccagctgctcgtacgtgaactgcctcgcgttgcacacgccaccgaggatcttggggatgcacgccgggtcgatgtcccacagggtgtccttggaaggctgccttaggaacaaccaaaacgagacggccgccgcgaggaagaagagcgaaacgaagaaacctgtttttcgtgcaatgtggatcatcagctagtggagattgatgtgcaaatgtgatgcaaccaatcgatgaacacacgggagtgtatgatttaccggcaagagcaactgacttcttggagcaaaaccttccctggcaacactccctgccgtcacttgcctgcccagaattgctgcacgctaaaacatgcatacatacaagcaagagcatcatgtatttgggctggaaatttgtcgagctcgcagtcatggagtacttacatgtgccttttgagcagccggtgccatgtgcgaagccgtcgccgacgagccccgcggcgcacgcgcaccgcacgccgcctcgcaccgccgtggcattgacggcgaccgcaccgtcggcgcacgccgccatctcgctgcccttgggcaccgcccactccacctcgatccccctcacgacacccggtgcggcggccgaccggttcttgacccagctcgagaacccccggcatccgaactccgcgaaggcgccaagcccatcgccgggcttccacacgctgccgtcggacagcggatagcagcaccccgacttagcgcccgcggcggcgccaccgcggccgcaggtggcaacgtcttcgcagccagcgcggcagagggaggagtcctcgcaggcgtagaggcggagaacgttggccggcgtgacggcgaggaatgccgcggcggcatcgagagcggccgccggggaggacgggcgggagaacgcggcgtacgcggggtcgcacggggacgacggcgacggcgacgcggcgggggcgtagtcgaggaggatcgatcccgacgggaggaagccgaggacgcggaacgtcgccgagccgagcggcagggtgagcgtggcgttggtggtgtcgcaggagaggcgaaagcgtgaggaagagttggtggtgctggagacgcaggaggagttgaggtggaacgggaatgggaggaggagatcgccgcagcgttcgccaccgccacagctgctgctgctgctgctccgatcggcggcagcctgggcggcggacgtcgcaaagaggacgagaagtacagtgaggtgtggcagcggcatagggggggacatgggtggcggcgagccggcgacgccgacgcggatgccgcgagcgactcgcgctgtcacggattgagtctcagtgtcagtcacatctgcgtgcttctgatggttgagcaacgagcttaattagcaggcacctagctagcaggacgcgcgtgcaactaggcagtagcacatgatatgagcacgtcacacgcatggttcatagtgcagtacgtggtagctagcttaattgggtgcttggctacttaattaggcaggcaaaagcaaatggtgtactagcaggagccgagtactaagacaagcaggacgtaagagatgaatcttaatgaagtgatttgcattggagttggatcttcccagcttatttgccccgctcttttctgattaacatacatattttatctcgattttcgttagcacatttttcaaccttctacacaaaagttgatttatgatatggataaatctatttttctttcaagtttgtaataattaaaacttaattagtaatgcgctaacggctttttaattttctgtgctctaacttcagctgtatttttggaagaaccgaacaacactatctagctagctcttgctaaaatttcaagaagtccatgcatcaatagacttacccaggcttggaaaattttatggctctgacagtggatgccgctacagcttgctgagtgtcaccaccaagatcttcctggcggcaaagtgtgtcactaaaccaggaacaagcctcagtggaagtgagtcaactgtggtattatcagccgtgctttgttcagttcgcagagggaggagatgatgaaagcttgaacctatatatcagaatatggcatccatccttttgttttctctgccattttatcttctgagaaagtgctgtgattttcttcctactaatttagaaaggcaaaaggtggtaaaccttacatgcgggatttgaaatttcggtaatttcagcacccaccggaaaggtcaaaatctccctgaaattttcggtttttgccaaacatttgtaaatttggtcaaaatttgttcaaattcagtcaaaatatgttataaattcaaaaaaaattggacaaaaaattctaaaattactgaaatttcggtgatttcggttgtttcggtccctagcggcaaaaacacaatttcggaaacaaaccctgcttacatgtgcaatatttttgtacttaagttcatgcaattgttagtggtctctttccatcctttctttttcaatatttgatggaaaaatgcaccaatggatttgtgtgcagattatcacgtggcacttcggtttgcagcacaagttccctgcagaccttgcttgaaatttgggttaacaatggcacagctttcctgaagctggtctagaaaaatagcccgtgttctggtaattgtgcatggctgtccaatgcccttaacatttctgatgaatactgcaagcgtctgtacttcttgtttgtaaagtttgcagcagctgccttctccgagaaataagttgcgatggcctattcaccaattcagagggaagatcttgggaagcagaaagatggaagagttaccacggtataagtacatcggagcgcttgttgcgctccacagagtaagtcgcaattccatgcactcaaagattacactgtacgcctctttattgcagcaaatatatggcagttatactagccaacaaaacattggcaccagaacatacacagtagtattgtacagtagactggcttttgacagtttgaatgtttcgcagggtagaggcttgactgggaaactgaaacttgctccgtaccttaacacgggcgtcatcctctcctttcaaggaagatggtggtgtagctccatcagcagctctcccttcaaggaagatggtggtgcagcatctccagcgacatggagatcatctcgtaggattgaaaatcacaagaagtaagcctactagagaggggtgaattatagaaattaaatacctaaaaaccgaaagcttttagcggaactaaaagttatcctcaaacttgatggtgattcgatctaaccgacatgtgagcacaggtttgaccgtgtgccgatgccgccggtctggctagtatggatgcttctgtctaaccacccttcgagccgaaatcgtctgtcgtagttgccagtctaatcaccaaaccatcagtttgactgtcgtcaaactattggtctgaccgccatgcactcgctagtgtgactgccaaacccgaggtaaaacacaaatcgaagaactcttgaaaatatatcaactttattgcttctaattgtatttacaaagtgcaacaacagcactcttactcttctttcagcttttgactaaagtaaaaatatagactaagccctaatttttctctcaactatactctcacaaaaatcgataccgagatacctgaactcctcttctacacacaatataacttaactattgacaattttctccaagaaaatttatacacatgttttttctttctttttataacgtgcgttgcacatgataatataaaaagtagtggttcactttttcactagatgcacccagcaaaacaatatataaaacaccattatcccttttcttagccatccgatgtattcatcagatggcaccaaactatgtaggcatcaatttcttaggatgctacattgaatttatcgattgccccaacgagtggaatgcacaacgtactcctcccgctgacaccgccgcggtgctactccatcgtgttctcctcaccgccgagctcgccccacccccgtcgctcccaatgcatcatttgcaaggaagaattgaataagatagggaaggaaagaggaggagctaaatatgtagcagacctagagcagcgcctcacgcaggcgtggtgcggccttgccaggaacaacgaggccgtcgcgggtaggagcatagcaacaaagaaatcggggttggtgtctgcagcatagctcggccaccaacaacatcgatgctccggtagtcaagctacctgcctccgcggtggcggcggcaacctctagccttaaccggcaagcatggcctaggggacgacgcccttcgagtttggagttgggaagcaaaccaatggagagagtagatcaggtggtgagactggaggctagaggtgatggcgttctagaggagggtgttggtatttcttaatgatattactaaaaatataattcccagcaatggcgcagaaatagtcttgatatatttatggttacggaagtgatccgcaagcgcatggatataccattgtagcatttcacccggaagtattccaaggtattatatttatttaatcccaagggaagattaataagagaagactatgctaataatttacatggtacttgtataagttagagtctaagcagtggttaataattcaaaggtagagtgacacgaacaagaagaactaagtactctcattaaataaatccttggctaagtggagaaagaataaaaaaagaattcatcataatacttctaatatacatgtatctttaatttacactctttagtatacaatcatgtagccaataccccctaactatgctctcttagtgtttcgagagaccgcgcctgactgccgagttccttacgacaacccgtcatggtcatctaaccggaaatgaatacggaggagtacctataccaggaaattaacttatgactatatactaaatacccgtactgagctatcaccatcagcggcccacctctattgtcccgcatcatatacccccaaataatgatatttaataatctaagcaccatgcttacattatcaaatactactctatatccgctagcatgacataaatcaatcatttgcatgaacattatacccacaccattgcatat

SEQ ID NO: 58042 - DNA, 29445 bp, Oryza sativa
aggaaaaaaaggaggaaaaaggaaaaagaaaaagaagaaatgatttttcctgggattaaaattgcactttggtgatttttaattggttaaaattatttccaaggctctgaaacttccattaaaaatcttgttaatgcattggagcatggggaactcaagaaaaattccaccacaccgaattcaattattaattgcatttattaattagggaattagctctaggttaattaagataatttcttcggacaatttatttaaccaattttttttaaagcaagcaaaaggggaaacttccgggcgtgacaaacctaccccccttaaacggaatctcgaccccgagattcggaagagctggcgaagaggtgcgggtgggtggccttcaactcatcttctctttcccaagtggcctcttcctctgagtggtggctacactgaaccttgcagaatcttattactttgtttctggtccttctctcgctggtttcgaggatacgagtcggcttctccacatacgtcagatcttcctgaatttcgatgtgatccggacttgcctgttcctcaggaactctcaaacatttcttcaactgagagacgtggaacacgttgtggatgccaagcatgttggagggaagctcaagctggtaagcaacttcacctctacgttccaagatcctgtatggtcccacaaagcgtggtgccaactttcctttggtttggaaacgatgtactcccctaagcggagtgacacggagatacacataatcccctgtttcgaaagcgagctcccttcggcggttgtctgcatagcttttctgccgagactgcgcgattctcaatctttccctaacagctctgactttctcttctgcctcatttaaaacttctgtaccaaacaattggcgttcccctgtctgatcccagaagagcggagtacgacaccttcgtccatacagtgcttcaaacggtgccatctgcagactagcttggtaactgttgttgtacgagaactcagcatacggtaagcttttgtcccatgctccaccaaagtcaagcgcacatgctctcaacatatcctctagtatttgattgactcgctcagtctggccatctgtttgtggatggtaagcagtgctgaaattcaaccgggttcccaattcttcttgtaatttctgccagaactttgaagtgaattggcttcctcgatcagacacaatcttcttaggtacaccatgtaaacacataattcttgccagatagagttctgctaatttcttccctgagtaggtagtgtgcaccggaatgaagtaagccactttggtgagtcggtcaacgactacccaaatagaatcatgccccgatgacgtcctgggcaaaccggtgatgaaatccattccgatttcttcccacttccattctggaatctgaagtggctgtagcaaacctgctggcctttggtgttctgcctttactcgttgacagacgtcacagagtgctacgaactcagctatttcccttctcatgctgacccaccagaacttttctttgaggtcttggtacattctggtactgccgggatgaatggaatattgagtttgatgagcctcggttagtatcaggtcttttaattccttgttttcgggtacacacaatctttctcccatccagattgttccttgttcgtcctcaacaaaacctcgggcttttccaaccctcatgttctttttgagctctgctatttcaggatcacttgcttgagctatgcgaacctgctccatcagtgtgggctgtgcctctagggcagccacgaatccgcgctcaactattccaaggttcaaatgttccaaatcacgttgaacctcacagcatagttcctctacccatgcgacgttgcagtaactcttcctgctcaaggcatctgctaccacattagccttgccgggatgatagtgtattcccatatcataatctttaattagctccaaccatcttcgctgtcggagattcagatcaggttgggtgaagatgtactttagacttttgtgatctgtatatacctcacaacggttactgatgagatagtgccgtcaaatctttaaagcatgaacgactgcggccaattccagatcgtgcgtcgggtagttgccttcatgaggacgcaactgccgtgaagcataagaaaccactttgccatcctgcatcaacacacatcctagcccctggcaagatgcatcacaatagacctggaaatctttcgtctgatcaggcaggattaagactggtgcagacaccaaccgtcgtttgagttcttcaaaactcctattgcattcagcagaccagataaacttttcttccttcttcaatagctgtgtcattggcttagcaattttagagaagttctcaatgaaccggcggtaatagcccgcaagtcctaagaaactccgaacctgagtgactgtccttggtggggtccatttggtaactgactccacatttgctggatccacagctactccttgagcattcacgatgtgaccgagaaactgaacttccttaagccagaagtcgcacttgctgaacttggcatatagttggtgctcttttaacttttcaagtaccagccgaagatgctgctcatgttcttcctcggacttggagtagataagtatgtcatcgataaaaaccacgacaaacttgtctagaaattccataaacaccttgttcatcaaattcatgaagaaggcaggtgcattagtgagtccgaaagacataactgtgcattcgaacaacccgtaccgagtgatgaatgctgtctttggaatatcctcttcgcggatcctcaactggtgatagcctgatcgcaggtctatcttagagaacacagtagctcctttcaactgatcaaacagatcatcaatccttggcaaaggatacttgttcttgatggtgacctcattgagtgcgcggtagtcaatgcacattctcttggttttgtctttcttctccacaaagataaccggagcaccccaaggcgacgtgctcgggcggatgtatcccttctgtaactgttcatcgacttgcttcttgacttccgccaactcgttggctcccattctgtaaggcctcttgtggatcggtgcagttccaggtaccaagtcaatccggaactcgatatccctctttggtggcattgttgtcagatcgtccggaaaaacctctggatactctctgactatgggaatatcctccagcttcttagtgattttctccactgctacctcttgttcttcaccagcagcctggtttaaactaatccctggcttccgcggcactagagactgggaggttaccacctctccttttgcattggttaacttgatggtgcggctggcgcaatcaatcactcctctgtgccttgccaaccaatccattccaagtatgacatctaggtccttggattcgagaagaatgaggttggctggaaaaatcaacccttgaatttcaactgtcacagatgggcagtagtgagttgtggtcatgccacctccaggagtatgaactcgcattggtatcttaagcttcactaaagataacccatgtgcaccagcaaaacgcttggaaataaaggaatgggttgcaccagaatcaaacaatattactgccggtgtcgagttgacggggaatgtgcccaatataacctctggtgctgactgcgcctcctctgcagatgcatgattaacacgggcctgaacgaacttgggtccagcacgtcttggcttcgggcactttccaaccgtgtgtccgggtttgttacaattgaagcagagttcgggtttttctcccaacctcttgggctgttctggcagagctggctgaactgattgagctggaatctttagtgaactcggagtagggttgagactgtgctgctcactgttgttgtgactgccactatggtggttcttgttgaagctacccgggtggtagggacagtgctgtcggataatcatggtggaaggtccaccgtgacgtcccatcgtgaaacgaggcttctgactcttcccctggggagtcctgaactgagctgccttcctcttacggtttattttgttaccgtgctcctcctgacggatagccttatccaccagcttctcaaagtcctcataatctctagagatcaactggttagtcaattcatcatcaagaccagacaaaaacttctcctgcctctcggcatcggtacgcacgtcctcaggggcgtagcgcgcgaggcggttgaactcatgcaaatactctataactgttctggttccttgttgcagggaacggaactctcttcttttgtgccacaattccctcgggaacctgtgctttattgaaactatgacgaaactctgtccaagtaacctctgccccagctggacgggtcaccatgtagttgtcccaccaaatagaagcgggaccttgtagctggtgtgtagcaaaagcaaccttctcctgctcgttgcattgcaaaagattcagcttcttctcaatggcatgaagccagtcgtgggcctcgattgggttggtggtgcttgagaaggtgggcggcttgacacgaagaaattctaacaatttggactgaggaggcggaggaccaaattgcaggttctgctgctgcagctgtgcttgctgctgcacctgctgcatcacctgatggtactgttgctgcatctgttgcatcatcattgtcatcatctgagtctgattgtccaacacctgagcaattgttgggttctcgggcggtggggacggactgttgtcagatgcaccgttggcacgtgctccattgatcggctcttcgctgccactggcgttgttcgagtcgcgtgaaccattccttatctccatctgaaggggataggtagaaatatgagaaaaggaagaaaaacagggggctcagaaactaatcttgcttatgaatttaagtgcaattatcttaatcttgattaaaacactgaaaaagaggcacgcaactcctaattgaggcagtcataccactgacacatgatatcgaccgccgactaacccacaagcaacaaacctaaacacgaaaactagcaagcaaacagactaagaaggcgataaagctaagggcggcgactctgaagctcggggcggcgcttgcaaaagagggataggactgacatctaaagtagacaagggataggaaccaattcatgctcaaatccaaattaaacaaagcaaaagaagactcaaataagtaaccgagcatgatgatttttatgcatagaacatttttcatgaactcaaataaagacactaatgcaactaaacagtaaattaatgcatagactagttgcatggaaaatgatgcgcataacattgcccccatcggatatagacacgacctaatgcataacccccaataaattcccgactgactgtcgaataaactccaactaaaatttttctaaagccctagactgagctaattttttttaaaaaaaaatccgatctgaaagaacgaccaagatttttcccgcaaaccaaagaggcaaaactccaaattttcccaaaacaattccaggtgcaaaaaggcatatgcagatgaaaaaaaaggggttcagagggctcttagggtttccagttggcttgtcctacggtcaaggtcggctctgataccaacttgtcacgcccagaaattctcgaaccagaatttctaagctgaatgtgcattaaatccctgtccaggaccagccagggtacacaaacgacaattgttgacatacagatccacgtcttacaaaaatagaaaagattacaaatgcagcggaaaagataaaagcgagctaaaccgggaagcttgacttcagcagcgggcgactccactccacaggcaatccttgacggcagcgacgaaaccaactttgacaaaacagctccaactaggaagatcttcagctctggtgtgggggaaaagagagcaagactgagtactacccactgtactcagcaagtcataccggaagaggaggtatgatgcaggatataaccaaaggaggctagaggttcttttgcataaagctagcatttaaaagcagtagttgaaggcagtaaaacagttgtagtaattaatcaatattaaccaaacactgtccaacgctacaccacgttgcaacaggcccaaccaaccacctgaactacagcagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaattgccatgggtgcgaccagcaaaaccatgcacccacaacccaccattcaatgtattttaattaactaacaccattgcggtggcaccaatccaaagctatgctcatagtcaaagtctatgtaataatgtgatccccatgtgtgtgctaattgaactaagcatggctaagcatttcctaaaccaacatctagtcattttgatacccaagttatcaatggcataaggtaaacaataaatggctgagtattaggacccatcccacatgacattgtaaaaggatgcaacatttaatagaaatacgggatatttgtaaattgggtacaatatgatcaaacgtattgcatgacttgccttgctctcgcactgacgagacctcagcaacgtcttcgagaaaccgtggatcgacgaaacggccgaaacctaagcgacgaacaaagcacacaagcaaaacatgctataagactactgaaacaggaaacaaaactatttttaatggattctttgcatttttcttgatttactgagacttgaatggacttaaacggagctcggatgaattacttatgaattttagaagataaactgtgtttttactaataaagaaaagtccttaatcaatttattgcgcaataaagcccagggctgacgtcagcgaggggagggggcggcgccgacaggcgggccccactggtcagcggcactaagggagggagagggggcggctggcaagcgggccccactggcagcggcacaaggggagagggagggggcgtcggcatgtgggccccactggtggcggctaaaagggaggggtggtccaccggctggtgggccccaccgggcagcggcacagggcgggagaggggcgtggctgttggcttggcacggctcaagccggccggccatggcgaggcgacgacggcgcacgaccgccggcggtgaccggcggcgcggggagacggcggcggccggcgcgaaggcggcggcggcagccgaagacgacggcgcacgcgcggagggcggcggcgctcacgggggagaggaaaggaaggaggaaaggggattcctcaccgaggcgatggcggcgaccggcgtgggaagagacgagcggcggccggcgcttccgacaacggcggacggggtcgagcacaacctgggaaaggcgatgaccgggttaggggaaggggaggatgaccacggccactagagcggccggccggagttgggtggaaatggagagctcaccggcgtgcgagagaagcggcgtttcggcgacgattggcggcaaccgagcggcggccgaggtagctctcgcggcggcgaagctaacggcggtggcgggttggcgcggcggcgaccctagcggcagtggcgcgcggccgaaggcgacggcaagcggcggcgctagcaacaagcggcgcgagctcggtaggaggcacgggaggggacgggaaatgggtgaaacgagagaggggactccgggaagggtttttatgggcgaaggaggggcggacgtggccggggatggcccctatttggccggcgatgtggggagtggagggagagtgagagaggtgggttcgaaatcgaatcccgccctctcgagcgcgcgcgcgggccgggagatgcgggggaagaggcggcgacgtgggggggacgcgggagcggcgcggcgtgggcgcgggaagagcggaggaggcggcggcgtggcggattcggcggcggttgccgtcggaggcgggtggctggaggaaggggacgacctgacaggtgggccccacctgtcagcgtcctggagagagggggaaggagaacgggccggccaacaaggggaggccgagcgcgggcgacgggtggactgggccgacggcccaacaagaggaaaaaaaggaggaaaaaggaaaaagaaaaagaagaaatgatttttcctgggattaaaattgcactttggtgatttttaattggttaaaattatttccaaggctctgaaacttccattaaaaatcttgttaatgcattggagcatggggaactcaagaaaaattccaccatgccaaattcaattattaattgcatttattaattagggaattagctctaggttaattaagataatttcttcggacaatttatttaaccaattttttttaaagcaagcaaaaggggaaacttccgggcgtgacagtacagttgcacgctcatcactgaactacatcaatgacgggaatgcaaccatacctacacacaaaacaaacagcagcgttctaccctactaactattcttcaaagatagtttggcggcataggttctaaggtaggatccaaacttcattccatcttgaccacttggcacttcagatcgatcatcacattcatattcctcgatccactttacttaacctccataagtagacctcattggcgtcttcaagtttcaacaactagtttcagaactactcaagttgaacgagagaggagagtagacaatgaaacaatttgcaaagaattctagataaggaagaaaggagaaattttcacaaatcatgttttcggaaaatttgtccttaaggtttgaccatttggcttatcctacagtcgagatggctctgataccaacttgtcacgcccagaaattcactagtaatttccgaactaatttgtgcataaaatcctcgtccaggaatcagccgaggtacacaaactgacaattttaatatacaaacccatcataataataacgttacatacttacaaaagaaaagaaaacaacagcggaattaacggtctagcgatggcttcagctccactcccacaggcagctcaactggggtataagccaaacgtcttctccttctggatcctttatcttcaactgaggtttgatgattattgcaagaatgagcatatgacatactcaacaagccacacagcaaatatacaagtgcacaaggataccaaaggatggcataatataggctcatttgcaaaagcagcatttagcaaagatttaagataagtaaaacagtagagtaattaatcatcaattttaatcaacactgaacagcacacccatgctgctcaggcccaaccaaacctgaacaaccaaccccggtcgtacagatcaaacctccaaaccaggagtcaaattaattctcaccttattaacattgatgagtagtgtgaaactaatcacgaaaaacattgctcaactcgcccataaccgcgggcacggctattcgaatagttttactctggccagaggtgtaccactgtacccacaagacacgattccacacatgttgccatgccccgaaataccaccacggcattgcaaagggggaaatcgtgacaatacccttcgcacaacacaactcactacagtgcaccattcctggatgataatcacccccttataaaacaaggcatggactccccagcgacccccacggacttctcgccgcttcacagtctggcacactataatgaaccatgctatacaaaaggtaaagccgttgcccatgctggcttgtggttggcacggtaaatgtttcacaacagtagctcgcgaaccggtccttaattgtcatgagcacaaccatcaaaaccatatgctcacaacccaccttaaccaggttttaattatcaattaattaacatcacacgattaatcatcgtgagctaccattaaatataaccataattaaaataataatgtaacatagtttctaattaatccctttagttagctaatgtttctaagcatggctaagcaaacttacatatagcatttagctgaaccaatccaacatataaggttcatgctaatcaaattataacccataggaaaataagatcatcttcggccattaattaacggggaaaggttcaccacccgatgacattaaaaaataatgcatagttgaaataaaataatagctttaaacgggttcaacatgctcaaagggttgtttgggatctgtgtgacttgccttgagtttccgcaaacacttccgaaccttgctcaatgaaaacgctctccttcagaacgtcggaaactaaagcaaaagaataaaaatcaacaaaacagtacaaaaacaagcataaacagtacatgtggatatttttaacatgtagatcttgattttagaaaaatttagcaacttgaaccactcgaatcggatctacagttatttagttatgattttccgaagatttaatctattagaaaaacgggaaaaagaaaaaccgatgatgtcatgatgacatcatcaaaggtggccggctcggattggcgacctcgccggagctagggtggtcggccgggattttggagaacacctacgcgtagaggacgacgagacgaacccaacggtactcaccaaagcgtccaacgacgagagacggcggccgacgacgagcttgtgcggcggcggcggttcggtcgacggcggcgacgggtctccggcgaccggcgacagcggggagagggcggccgaggttcctcacctccgtgcgcacctaacggcggcgaggggaagcggcggcgacggcggaatcgacggcgcggcgcggctgggcgtcggccggcgacggcggcggcttgctcggcgtggcggcggcgctacggagcacgagagaactcgggagatggggcaaacgaaagaggaggactagggggtcctatttatagccttggattgaagagatcggactcctcccgcaagaaatcgatccgggaaaccaaaaactcggttttggagataaactcaaaaacgagttcgattcggataaaatactcaacggtttgctccgattcttgggggaaagaatagagcaggataagaggaatatttcccctcaactaattttgcaaacggagctccggatgtggcggatttaacggaggaagcggcggctgcacagggcacagcacgggcggctcggctctgtccatgcttgaagataaacagtgccagggaggtaaattagactttcggctgggcttctacttccaagcactgattaaaggaggtacgcaaaacagacttcaggaaagagaggaaaagggctgcaggctgagaggagactgggccgagagtgagaggacttttcctaattcggcccgaaaaggaaaaggtgaattttaattacttttccaattaaattaatcactgaaatgatctttgaattgttaaaaatacttccaatgctcaaataatttcaagaaaaatcctgaaaatacttggacactcaaagtacttaaaaaaattataatcagaccatttaatgattaatttaatatttaaataattgctgaactgctctttgtatgattaaaattaataattgagctccgaaaaatccgagaaaattccagagagtataattaaccatggagaatttaataaaaattaaatccatccatgctttatatttaggaaattttatttcccacatttaacttcacttgtaaattaatgaatataaattctgataataatttattaaataatttataaatcctgaaacgaaaatcagggtgtgacaggaaggtcttgatctccctctccgattccaactccactttccgcctcgagaggagatcgaacccaccaatctattggtcttaatgcttgaatattgcgaaccacagatactggaacccctagcgatcttgcctctggtcaagcgcgacaaggggtcgggtggtggccacgatgtttggtttggccgaacctggatctagccccctcggcaccctattcaaccgtgcactcgccttcactgaggaggatacaaaggggtccagctgaagcatctatgctcgcgttgttaattttgataattaatgataagcgctaattatggactaactattctatttgagttatgcattttgagttaggactacatgatgcatatgccatggatgatcaccaaggattaaaattaatggcgcaaagaaatggaaccaagacggtgaatctagcgttttattttaaattgatcgagacgttgagcgatcaaattttgctaggtttatttctaagcttggtcatactattaagagaggtaataacctaagcaaaaagatgatcaaaatgccacattagatcatatgtattgtcacttggttcgactacatatttcttttctccctctctgtggccggtctgaccatgtgccacatgccggtttgaccgtgcgtgactggccggtctgatcggaccagggccggtgtgaacgagcggtggctataccgaatggtgtggcctcggtctcgcaagaccgaggcgccagtgccgtcaccggtctaaccgagggccaccggccggtctggccggcatgtccaaccggtgtgactgtgctcagttcggtctgaccaggtggctgccgtgtcttttgtgtggccttggcctatcaagactaagccgatgagagccgatgttggtgtgaccgagctgaaggcattctgaccggcaggctgttgccagggcattaaatgcactgtaacgactacttttctatttgttatatttgtgggcggtctaactagccaccccatggcggtctgatcgataggcaacagaagttggggaatttgaccccaatggcttgtttttgtgggcggggatataatacccccccctagcagcaaggggactctcttggtacttgcttcatttgcatacatcccttgcatctcctcacacacatccttgagcttgtgttcatccttatgtggtgtttgagagtagtttgagcttagagtcaagtgcattgcttcattctagagctagtgtggcctttgatcatctccgagctaggtcatcgcttattactcttggaggtcgccgcctcctagacggcttgtggaggtgcttgcccgtctccaaggagattgtggagaaggctcggtgccggttgtgagtggtttggagttcactaccttcggagtgaaggaagaactaccctaatgatcgaggcttgagtagtccacttcgtgggtcggctcccaccttgcccaccccttgacgaaggggccttgcggtggcttcgtggttttgagtggttgtcacgcccagaaattcatgaaccagaatctctaagctgaatgtgtattaaacccctgtccaggaccagccagggtacacaaacgacaattgttgacatacagatccacgtcttacaaaaatacaaaagattacaaatgcagcggaaaaagataaaagcgagctaagcctgaagacttgactcctgcagcgggcgattccattccacaggcaatccttgacgacagcgataaaaccaacctcttcgagacatctccaactgagaagatcttcaactctggtgtgggggaaaagagagcaagactgagtactacccactgtactcagcaagtcataccggaaaaggaggtatgatgcaagatatatccaagggaggctaaaggtcctttcgcataaagccggcatttcaaagcagaagttgaaagcagtaaaacagttgtagtaattaacccatattaaccaatcactgtccaacgctacaccacgttgcaacaggcccaaaccaccacctgaactaaccagttccaaaagctaactaggggtgaaactaatcacggtgaatctggtcgaccgcccataaccgcgggcacggctattcgaatagttttactctgatcagaggtgtacaactgtacccacaagacacagccccacgacacgttcccgtgcgccgacatgccaccacgacataccggaaggaggccgtgacaggaccctttgcataaccccctctaaccgatcgcaccacaccttagggttcgcccccgtccccagcaggcaacgggcagcccccctttcgtgccgcagtgaatccggtagccgatcaaccggacaccccggccgacccaactccatcacgcccaccctcgcctgggtacgtcggctagagaaaagctacactacgagcccagccgttgcccatgctggcttgtggtaagtacggtaagttcttccagggcatcccgcgaaccggtccttaactgccatgagcacgactagcaaaaccatgcacccacagcccaccatgacgtgtattttaattaaccaacaccattacggtggcactaaaccaaagctatgccgataatcaagtctatgctttaatgagatccccctttgtgcactagttgaactaagcatggctaaggatctcctaaaccaacatctagtcattttaatacccaagttatcaatggcgtaagggaaacaacataaagctgagtaataggacccatcccacatgatattgtaaaacaatgcaatatttaatagaaatgcgggacaattgtaaattgggtacaatatgatcaattgtaatgtatgacttgccttgctctcgcactgatgagaccacagcaacgtcttcgaggaaccgcggatcgacgaaacagccgaaatctacgcgacaaacaaagcacacaagcaaaacatgctataagactactgaaacagagaacaaaaccatttttaatggattctacacatttttcttgatttactgagacttgaatggacataatcggaggtcggatgaattagttatgattttcagaagattctctgtgtttttactattaaagaaaagccttaatcaatttattgcgcaatattgccccagggctgacgtcagcaaggcgggggcggcgccgacatgcgggccccacgggtcagcggctcgagagtgagagggaggggcgccggcatgtgggccccactggcagtggcacaaagagagggagagggggcggctggcaggcgggccccaccggccgcggctccaaaaaaagggggggtggaggcggcctggctcggctcggcttcaagccggccggccggttatggcgagggcggcggcggcaagcggccaccgacggcggcggccggcgagaagacggcggcgcatcacggcgacgcgcacgcgaggagcggcggcgcgcgcgagaggaagagaaggggagggagttctcaccggggttcggccggcgtgggaggagacgatggcaaacgacgacggtgagcgaccggagggcgacggcgaacggcggccgagctccgggacaccctaagagaggaagtgagagaggttagagggggagagggtgtccacggcgagcgagagccatggccgacggcggcggctatggaagggctcaccggcacgcgacgaacggcgggctccgatggcggaattcgacggaggaggggtggacgaggtagccctcggcggtgcgaacccgaagacgacgacgacgcggctcggcggcggcgttagcggcggccggaggagtggaaaaggcggcggcggcgggtgtagcggcgcgggagcgatggagagctcgggagcggccgatggaaaaaggaaaaaggaggaggagaatgcggggatggtttatatgggctcgggaggggcggacgaggccgggaggcggccgaatttctcgccgacgtgggggagtggggagagagagttgggggggattcaaaccgaatcccgcccttacggggcgcgcgcggggcgggaaggcgtggggaagggggcggcgacgtgggcgcggcaacgcgggcgcggggcgcggagtggaggaggtggggcgccggcggttgccgaccggctggaggttggggaaggtgctgacaggtgggccccacctgtcagcgcccgagggagtgagggggaggcaacctggacttcgggagggggcgggagagatgggccggcggcccaaaggaggaaaagagggggaaaaaggatggaaaaagggaaaaagaaaaggaaaaggatttccagggatttaaatattgcactttgcttattttaattggttaaaattatttccaatgctctgaaaattccactaaaaatcctgttagcatattttgacatgtagaatccaagaaaaattccacatgccgattccgattattatttgcatttattaatttgaggaattagctctaggttaaattgaacaatttcttcggatgatttattttacaaattttaaagctagtggtgaatttggactcgcctcaacggggattagaaaaccagcaagtttccaaacctcgggtgaaaaattccttgtctcttgtctcatttacttattgcatttacttttttgcaatttacattcatagagacatacttgagcccttatcaccctagaaatgcaaaacataacttagttgcctacttagagttatccttcaccatgcctagcaacttgggttagttttgttagatgtaatttaattttatatcgcctatccacccctctagtcgacattgtgatcttacaccaaccccctaccaaagaccaacatcagacaatcggccataagaagtcgatcaacgtctggtttttctaggggaacgacgtgccaatgtcgtcctgtaggattggtgaatgtcttgccgctgcagcgttcaccgaatcggagaaagggaacagccgccagaacagtagggacgcctcgtcctactcaccagtcaccggaaagtcctccgcgaaagccccacattcgcttcacgggtgtgcaaacacccactagacgtgaaaaggtgttcatcccagcattgatacctagtgtgaagctgaagatggaggcctctcatgagtcacgactccccgctgattggacggcgtctttctccacctcccattaagggtgcgctcggttgtgccaaatatagtattgagttttatcagtacttcatgagtactgtatatagccagtaattaatgtggtggttggatgaatagtcagtaacggtggctagatggatattaacgccgcttgtgtcttccgtgacgtcggcgatggaggagtgctgcagccgatgcagcgagctgatggaggcatgtcgggaagcagttatcagtaatgagcttgctgctcatgtcggcgaccgctgggactacaggcgctggtgcatgtggtgctgaagtgagcaggatgcaagggaggcgagaccgaaacaattaacacaccatttagcaaatgaaacgttgattgaatgtaaaatgactgattaacaatacttgagtgcacataattattaataaaattgcgatgcacaattttgattacacgaacacgatagaagttactcgtacagggaacacacataattggctaacatgggaatgacaagaccaaagactactaatttaatcaggatggaaagtgatgtaagcctagttgttgtaaacttcatctgcaatggcgtcacgaacagctcgcatccccgctgcactgttcggtgcgtcgtaccagtcgcgtagtggtggagcctgtgggatgttggggtacctgttgtacaacggatgctatgtcaggaaatgtgggtccgcactgtcaagcctgtagttgtggagagcaaaagcacagtgtatgatcttcgtttgggtattctgcctagggaaaaatggcatctccctaagaatcctccactgactcttcataactccaaaagctctctccactgacgtacgcagagaagagtgcatatagttgaaggtttcttccctcccatgcggttgaccagcaaattccataaaatggtagcgtatgtgtgggtacggtggcaagaacccgcaccggcatgcgtatccagaatccacaagtagatatttacttgcacaattagatgaatcatttctaaatgtaaattaaagagggattaatttcaggagacatgtattaatggatgaaaaaaaaactaactacggtacttgccccatggaagccttggaaaaatgtagggatagttgcgtacagcttctgtgagcaccctctggtcgtggacagctccaggccatcccgcatcagcaaaaatgacacgatcgtcccatccagtcacaactaatacattccatgatgtgatttggtgacgattgcggtgtacattggctttttaaactgcaacacgaattgggatgtgggtcccgtcaactacacctgcggccccggcaaaaggaaggaaatttgcatcttgcataacacagttatgcactctgcgaaaattaggatttgcaggcttgttgatatcagcagccatggcataaactgcattaagcactctatggaagtacttgcacatggttgacccagaccaagccatcctataatttatgcaacctgcatgttagtcagcataacaaacaaataccacgtacaattaggcagaataataagatgattcacgatccagctaaattatttagagctacatcaaatcaaatgtgccgagaatgtttcatcctacacactcaacagaacaaaacagttacgttgctcgagacgaagtcgagcaaaattatttggacagacaacacgttcgaaaagctctagctcagacacactcatcgttcgaaaggatctagcagtaggtccgatcggcatgaggtcaaaacattgcataaccagatagatcataacttccaggtcccaaccccaataaagagcacccacataaccagttcccccgtaacccgcagcaccaccatcgccatcgtcaccataatcatcatggccatcaccagcaccatctcctccctcgtcatcgccatcgccatatgcttcaccatcaccagcatcatcatcatcatctccaacgccatctccttctccatcaccagtagcagcatcatctccaacagcattaatagctacagctccaagaacagcatcaccagtagcaccaaagaatccatcaacacagaaggcagtaatatgtacaaaaaaaggactgactgaagttgtgacaacagcaacattgatatatattggttaatgacactagcaaattaacatatttatttgtgaacaacactcaaaaataccaaatcatgtatggcaccataattataacctatttcattgaaatttgcagcaaactaacatgattgagtagttaacagcacttgaaaataaggatttatgtatggcaccatcattgtgaactatgtcattgcaaaatgcatcaaaataacatgaatgagtttgctaacaacacttcaaaagcaggaatcatgtacggcaccatgattataaactatgcaattgcacaatgcaacagaccatgcaatgagttcaagaaacaaaccggcaggagctgactggatgtaacctccaaatccaggggggaaggggctggtattgagccgtgtcttggtattgggattggatgaagtacaacctcccctccggagtgtggcagtcgtccaagaaaaactccctgaggaagccatctcgaaagaccctcagagccatgtggtaaataggatccctcgaggtgtaaccgtcagccttcagaagctccatgcaggccttggcactctttgcttgctttatctcttccattctggttctgctatcgtttgactgaaccccgaggtccgccaaacggttgagagcatcgctagcagaagagcccctggacctcttggagcttccgccagaggtggtacctctagtcagtgacctcttcccatgccgtggagtctgctcagatggttcttgtagggtgtgctcggtgaggtcctctatgtcgaggatctcggcctgctgaggcactgcgttgatgggtgttctgacaggaactccagagcggttcagggtacaaaccctacccctgaaaaccgcatggtgctcaggaatatacagaaggggaccattccggaatgcacgtgcgcctctcctcatctgcaaaggcataaagagaaaggaatgatttgtgaccgcagtaatatcaaagggccttatttgtgtacaaaacaactaacttatgactatgactatcttaacagcatgaatggccctgtgacttcaatgagggttctgtagtgaatgaatagcaagtaatgggttattgcttttaacctagtacggaaaattatatctttctttgctgcattgaactaaacacattaaatgagtattgttgatccaatattcagataacgtaatttgatccaatgggtaattgattttaacctagtaccaaaatagattgccttaacctagctttgtgacgttgataagcactatgtagtgaataaacagcagctagtacaacatcaactatttgtaacttaataggctaatcttacgctttatgactttaatgaactaaacaaattaaatagtaatgttcatccaatatgcagacaactaaatagcaaggaatgtgatattgcttttaacctagtaccaaaatagattgccttaactaacattaccatgaaaggctttgtgactttgatgagcattatgtagtgactgaacatcaaatattacaacttgaagtgcttgtacaattactcctaattaactaacataagcatgaatggatttatgactttaatgagtattatgaactgaatgaacatcacatattacaacttcaagtacttgtagaattactttgaatgatctaacatgcccattatttcaagtactacatagtatgaataaataacaaaacagtaccgcaatgaacatgttgtacataacaaattctggtttataggcttgaatttgttctggttgcaactaatctggtctctaatagcaaacatgttgtacaataccaaacaaatatggtctctaatgtgattcgtctagaagcatgagttagttctgattgcaacaaatttcattatgaacctaacatggcactggattcagaaaaagctcaaaactgaaataaatacatacatgatccatccgagtccaccactcagggctggctaggatattgccggtgaagggacagcaaccaagcccagtggccattgactcgagccagcaccaagtttggaactggcggcgacatgtatcccataaattgtttagctggtgccggttgaccaccttctgcaccttctggaacatcttcacctccaggttgatgtagccttgacggttggggcaggtgctggtgattgtgcgtgcctcaatctcttccatgcacgcctccggaaaagctttcatctcggcctcgttccatgttgtatgccccgcaaccatctatgaaccaaagtcatgcaagcaacaaaaggggaaaaaacatcacaaaaattttggctctaccttttataggtggtcggagtcgaggaggtcccaatccagtgttgaagcaacgttccccggggtgaggcagcgcaccaactggcagattgcttctgggtacttcaaggcgatgcggataacggcacgtgctacagcttgaacatcttcttcgagggtggcggtgtaggcagcgtcagaacgaagggaggtggaggaaccctcagaagattctagatctgaaggtacccttctccttctcaccaaagtgatgggtgacagaggtgagtggaggaggcgatgggtgggggatttgtcgacaatgagcttgcgcttcacggctaccgctgccattgccttatatagagctggatcgaccacccctcagctcctcctttcggcaatggcaatgcaagggcgccgaataccttttactatgccgcacgagattggacctgaccattctctgctcttgttgccaggattctagaatcggcgacctcgatgctttccctccactcgatgcagcgatgcccctgagcagagctcctttctcctcctccgatgcggcagaccaatgtgggaagtggatgcctacttgattaggccaagcagcctacgccatgcgcgtgctctgccaggcttggccggtctggccaccaaggcgacgatgcagttgacgaccgctctctgcgcttgctgcgaggattctggaatcgacgatcgccggtgtgcacaagaaagctagcaatgtcgagatatcctgtgtgcaaatggatgcggcggcgcttggaggaagaacaatggagggcagagtaagatctttcgggcaaaaggatgagctcgagcttggaactccaacaatgggggtggggtgctcagcaaggaactgtggccaaaacacagcacgcaacctatgaggggaaagtgatgcacaccgtaaaaaccactgggtaatacgatgcacgggaggatgacggaaagtggagatggtgacctaactctcgtcaggaccgtcacctctccatcgccagcccacgttattgacttcgccactcctatccgcgtggtgcacagtacactggatgactgactgcgcggctcagccctaccagcactaacgagcgcgccctaagaggttggcaggggactaatgagagtgatggggagaaatctccatgtgagcctacagtggctcgtttagcctacttttgtatagggtaaataaacaggatagaccccaatgtcaatcatagctaaataatcttgtgcaatacccatgtttctcttcttttgctttgtacataattatgtaaatactttttatattaatataccgcagtagaagcctctcctgctgtttcttctaaaaaatactacagcttatagggtggtatttacaattttccctattttgtttatttcaattcggtgaatagatttcaataatcaaaaaacatggataataattattttacgatgcatattattacattcactcatcagaatctctccctgaataagtatcgaaacaaaatcatagtgatttagcagaaaattacacatagggtgtatttacggtgaatcatttgactccgacaagcacaaaggaagaaaagaaaaatctcctaggtgctagcgccaaatactagggatgcaactgagcagacaagcgggattattatacctgtttatcccacttctagtttttttttcttctaaatttgtattattatgtgagaaatgaactagcaagcgggtttttatatgagagtgagattgcccacttacatccctaccatatacgcacgacagatggtagagtagtggccttaggttctattctagcccttttggtttaggcttataagccagtctataagtttatttggaaactaaaggtgccaattaagattaagatatttttgtggtttttttcaaaggtgtcattctaacaaggataatttagtgagaagaaattggaatgtgagtcaaagatattgtttttatatgtataatgagattattcaacattttttttattgccatattgcaaaatttgtttggagaatcctttggactgaaaccccccgatagtatatctaatatggttggaattggctaagtggtattgagtcaaaactaagaatctcgtatttgtcggagcatccgctcaatgttgtgctctgtggttgggtagaaatggtgtagtttttgataaatgtccaaataaatcttatatgcaaatgtaggtgtttttcagggcaacttactagctccggttttgggcacatgttcaaaagtgtgaagagaacaaggagctcatatattctacatatcgaaacttagaatttacggtaatgcagattttcactaactacggatggagattcacaaatagacttcaataattgtttactccttatgtgttggctttattatttaaattatttttggttgcctgagtgtttgctctctttgtaacaattggttgtagtttctttaaagcaaaggccggatttaattccattatcaaaaaaagtcaatccataagtaaaaaattctaaatataaacaaacaagcatcctttttgtttggtttatttaaagctaaaagccactcttatactattaagtcaaaagttagatcggagaagggttttttttttttttttttttttttttttttttttttttttttttgcttatatgagttggagatatgactccaccattaaacttagaactttaaatctgttggcttaataatcatataagctaaaaagctgacttaatagtctaagtcaataagtctaagcctaaacaaagaaagtcaccgggtaaaggcaggtcctgattgcatggagacgcaagagtgccgcgctcctctaatgtgatattagacttcattttaataatatgaaacatattccaatatttctattagatcctatttttaaaaaaaaacaaaaggccataagaaacaactccatttcaattgtaagcactctagtagttctactaaaaatagatttcatcttatatttttgttgtatgtacaccctacccctctatgagcatctccaaaaaaaactggtccggtatatcttgagattaacgaagtcatcatagatacctcattatcgatgggtacgtcacttatcaccgaaagaacaattaaccataaatatgagcacacatatcaaatctaggactgtaaattggatagatggttccaccacatgaaaaaattaataagttgagctaagctcaataatttttttaaccaactacaacagggcatgcctgtgctggtgatttttttttcattaacaaatgggggtgaaagtgtatgcaagaagtagagggaataaagaagggaaagcaagaatctggtaaagtccgaaagaaactggttttccagtctagactggcattcgaaacatttttcaacaatttagatccctcgtggttgactatacttttaccccacaaattttggaacttgatataaaatgtttcttacaaatgtttaacaactttgatgtggcaccaatttatcaaaaaatacaacctcatgcgtagtgaggataagctcaactggttagcctctggtggtgaaattctagacttgatacaaatgctgagcatttacagttatttatttttttagtattagacgatgtatctatcacctgcaagacccttttagtaatacatgatgttcctgtcaacaacgagacagctatgtgaagtgtatgtataaccgtctgtctttgtgtgaggtgtacgtacaggcgtttgtctttgtgtgaggtgtacgcataggtgcatcctgtgtggggtgtacgtacaggcgtgtactgtattagcctatatggtgttaaaaaaatccctcctcattatatcgggtatagattacttcttgaaacaagggggaaaaataaatggtttcaaagttgaggggttttgcttagtcatcactcatcagcgcaataaaatcttgaggggttttactaatacctctggtagtactgagaatcaaaaggtgttttccttaaaaaaaaaaagagaggtgtttcgaacaaatgtgatagttgaggtgttgatatggactttcctataaactttcagtgccaataaatcttcagtgcagataaagcaattttgccaaatgaaaggtatcaaaacataacaggcaattgctgcctttcatgaaaaaataacttctattgtcttcggggtattgtaccctctttggagagttcgatatccatgtctaccgtaaaatggtgctttctattaaacactctcataatcgatgttaaaccaccggcaaacaatcaatctctacggataattatgcactcataaactcataaatgattctaaactcatattataactgtataatcaccaaaaaaatatcgtcagcacatgtaacgagctgattagttctgcatacacaaaactgtacatcaccatagttaagccaaaggcggatcacacaaggcttcttttctgttgagctgtagtagtattgctagtagttcttgggtcactgtccacatatggtagacatcaaaatattattggggaattggcagtaagccaataaataattttataaatgaaactagtagcagtgaaagcaatcctcaatttatggaacacagaccagcacagataggcaaacaaaccaagaacgcaacgaaatatcttaaatgcttgtttggatcagtcctcagtgggagttgcagccaatcactttgatgagaggagattttcttcgacttgaaaccacaatccgaagggattggggcattcagcaatactcctttgcatccaaacaagccttagaatgaaactttttgcctgccagcagaaattttctagagagttcattatttagaactccagtattttacaaaatgaatcatctgatagtcaattccttgagcacaaaaaaaagggactgcagaagtcttgacaagtcctggtactttataagccccgatgttgatgtgattcctaaccattcaaatcaaacgggggatggattcaacaaccaacaaactcaacatcgaaataaccagttcgaaaacaatgtatgcaaacggcaaacctatcagagtacattgtgccaaaccatgtttttgttttttgggggataatggaaatcaatccagcctctacatcaacatgtatctacacagtgtcaaaccatgtcagtatcacctcaataaagcctttccagaagacataatgaccaggttgaccctcatactttagatcagcaatagcaatcctgcagaatagactacgcatggaaaaagtaacatgccaaagcaaaaaagagaaaagcatatccggacatgaaaagattaaagacaacataacatcagtgagttgtgggcacactccatgaacagtaggggtataccagattccagggggccaggagaagcactaccttctatgcttatccaaattccaaaaccaaaagcaagatgcttcacgatacaccatttcaaaaggtggacatcccctcctcagggtcacttaagtcctctccatagtactaaatccacataactatctgtctgtgattaaggtttcagagaaatataaaaaaaactgtgggcctgtgatagcacatgtgatcaattaggcaatgttgttgtcaattttgagttcaggtcggcattacctttttccctagggaactttatacagtagtgagtaaaagaatacataaaataggaacttgaaccaaaagagacatacattaagggacaaagttaaagctaccttttgcatctaggtaagagctaaacaaactcaccgaactttctttcgggacttgaaagggaacccaccaggtggagacggtgagaactccaatgggaggtgcggaggttctccctcgccagacagcattcggagtacctcctcacttgatggtcgacgagctggagacctttggatgcaaaggagtgcgactgtaatgcagagtaaaacctcatcacggttcacatcctgtagggctggatcaacaagatcaatcaagcggctcacgcgcgcaagatgtttcgcccacgatatgaggcttgccttctcaaactcagacatgggtgaggccgtcacttgcaacggccggcgtcctgagataagtaccagtagcaagacaccgtagctatagatatcgcatctctcagacaaaggaccaccaccaccgtattcaggagccacatagcacaccgtgccgcgcatgctcggtgtgctgctcaccgcgccactactcttgggaacgaattccccacttgcccaatcacgggtgcttcttgcaccattgacccaccagttaatactgccattgccgttgccattgccattgccagtgctgccattgcttctccgactccagctcttcatcatactccatttggatcgtccctttgcatccaagtcatcgtcaatatcccgctcccaccattgcaaccctgcctgctcgctctttgatttagcaagtgcacgtcgtttctgctttttcgcaagctcatcagcatattcttctcgccaccattctcgtgccctcctctttggcttcttcctgtctgcagctggattggtaatagctgcccctgcaatccagtcattcttggggcgctccttcttgatctctgatctaatccactccatcacataatcttttacaccattgctgcccccaccattatcctgcttccaccaccagtcactcccggtacctgatcccatggtacctccggtgcgtgaccctccaccgttgcagctgcggctattcataccactctcaacactggtccggtcaaacccggaagtggacgcagcttccgccggtgatgccgatgtgaagccatcgtcatcctccggtgatttggggttcccctcaccattcaccgtggtggtgaccgtgctctccgctatgacagaggcgtcatcatcacatcccccatcgacgtcacatccttccgcaatcgcgccgctctcaggcttgccgtccgcatctgcgtcggaattgatgcgggagagaccaaagtcggcgaggcgggcgcggagatccgtgtcgagcaggacgttgctgggcttgacgtcgccgtgcacgaccggcggcttaacgacggagtggaggtaatggagcgcggcggccacgtcgcgggcgacggcaaggcggcggggccactccgccacgagctccgggcagcgccgccccagcagcgcgtcctgcagcgacccgttgggcatgaggtcgtacaccagcatcatccgccgcggccgcccctcgccccgcgccgcggacgacatcgagtacgcgaacggcagcagtatggagtcccgccccttcccacccggcttggcggcggcgtcggggacaggaggggatcccggcgcggacgacgacgcgaggaggtgggacgcgacggcgatctcgttgtggaactcccgctccccctgcagcgaccccgcggcatccatcaccgctcgggcaaagggcgtcccgccccggtcgccgcggattgctcccgccgccgtcgtcgtcggcgggagcgcgccgcggaacacggggccgaaccccccctgcccgag

SEQ ID NO: 58043 - DNA, 2219 bp, Oryza sativa
tctcattgagatacatggatatgtgcttgttgttgtatgtaggtggatgcataggtttccaaaaatcagtttgtcctggagtgcgtgtgcgtaggtaggttcctttgtgctagacatgtgcggagcaagaagggcggcatcaacgctggcagtggtaccatgccgttaattccactggctgttagcatttgcggatggcatggacacggtgccgatgttgattttcatgattgattaggagacatgatcagtaaaagttgttatgcacgcgtgcatgaagaggcaatctatatgtaagatacgatgggtgttacagcgactatgcatgatttaaccaaagcacaaagagtaaaatggataaaatactgacgttacacactttttagagaagttaatattaaggagtaacaacactactctgtctcatgcatatcatgtattaggagatgtattaggaggttttggtttgtaatcatccaagtatccctgtctcacgccgacaagctctcaaaactcctctctctctctctctctctctctctctccctccctccctccctctacctccctctacctcctattaggcgatatcttccaagcaccatcttcgccgatgaacttgcatatgcagcttcaaattgcctcatcgagtgcggtcccaaaggtaacaacccctgccgcttttatttcccaccgttttctgctgcattatgtagattgaatctagctttcatccttttttttcttatgtgttcttcatgttcacctttactattcctttttttcactgtagaatctgccaaaccatatcatgtttccagacttaaaccgtccgaccttttattatatgggtccaatgggtgacaaagatcccatagatttgattaatgccgaaaccaataggatcccattcaaacaatctagcatggccactatagattgttataatagctttagatctggccatcaaagttgataggatggagaacttggtatagacggaatcttgccaccaaacatgatctgtgaaccgatctaggcatcgttcaatgcattggcctctcctgagctgagatggataaagatgaatctttcattgtaccggcttgctacttccggcccgatacattgaacgccttcctcttcagtcatgggcaagggcgccaaacctgatggaggtcactatgatcagcggccttggtactaaaaatgccgacggttgggccaactacattactaggcatgcaaaaacttttggaacattttccaaccgagagcaagttgccttccataacttatggcttgaaagatttgtcttctgcggatcaaccttaggttcgatagcaaatatgcaacacctagcataagcctcgctaatggaaggactatgcccttgggcaaatatttcgtaggggccacttatcatctgctgcatcaagtcgaaacaaagctattggttagccagcccatctgccatatatgcggtccatggtagtttatctagttatggctaaagctttacaccgttgaagttgttatgaaaatagatgcacaacagagacacgaatttttacgtggaaaacccttgcgggaaaaaaccacgggcgccgaccggcaatgatcactatagaggagatgattacaaacgtaggggaataacaatgggaacgtcaccccttcccgtacggcttacaagagtatatataggggataatagaaagacacctaataggaaacctaataggaactcctactaggaaactaatcctactaggaaactaatccgaatatattgtgggcctaaaattcggattacatatttaacaatctccaccttgagacgaatttcctcttgtagcataaaaacatcaatcaccaaaaaatacctcatgtaggtaaaatcaccgcgcgccaaatagtctctaggactatactgtaacaccaaccaagcttgagcaaagctcaaacttagtagcaggaactggctttgtcatcatatcagctgggttttcatgagtacttatcttgcataccttgacatcaccttcagcaatcacacctcgaataaagtgatatctcacatcaatgtactttgttctctcatggaacatctgatcctttgtaaggcatattgcactttgactatcacaaaatatattatgcaagacgtaactccacaaagctcagtgtacaaacctctaagccaaatagcttcttta

SEQ ID NO: 58044 - DNA, 2017 bp, Oryza sativa
ggtgctcagaagaatttcatatcactacggcgtatcaggatttgatagagcaatttggtatgttcggtgaaagtcatacacatttgagcgattgtacagtactcagaaattggtgttttatatcctctggtagttgtggatcactgtattgaggaatcaacctgacgtataattgccgggtctgtaattttgtatatgtggagactggtgtgtataccaattttctgctggaatgtcatgcaatgaggcatgggcaaattctcttgtagggctttcatcgttcattgagtttaacatagctataacagtactgttttatatgacaaaataacagtactattttctatgacaaaatttgtgattaaactgtgttcacgatttcttttggttgtgcagaaaacaatgaactgataaaacatcctagagttagtgaattttgtgctggtgtaactgattctgaaagcttggcagcaagagttgtcaattttgctaatcaagttaaacttgtgctcgggtgtacaaacctgacaagcattatgcttgtgattaactgataagtaatgtaggcatgtagctatgcatatagtttttcgggtgagttggtggtggtatgtttggtttagaactgactcggtggaacattttcagacgtcgcatcagctgtgcgtttgttgggccgtacattgacgtacttgggccgtgggccgtgggctgatctgtggagagaacatcctggtcacgtctatctcttccccctcggccaacaccgagtttttttaaagagaagggtattttttatccggtctctacatctaaccggatatatacgaccattgaaataggaaacttatccccacaaacaacccaatctgaaattcgcgggagctaacaacgagatgcaggggccggggttggagctcggtggtgacggggtacacgtccatggcgcaagctcaaattcagcggcaagcaactcgtcgttgatgatctggtacgtacgccacaccgcctcctttgagattgactgctccggtatccgggagggaggtgcggacgtagcagggggagaggcgaagaaggtggagtggactgagtcgtcattgcagcccgattgagccgccgtggtagagcagccatggcgatcgatcgccggccgggagcgatacatgcatgatagtccctccgtttctaaatattcgaccccgttgattttttttgaagtatgtttgaccgttcgtcttatttaaaaaatttaagtaagtattaattcttttctggaaagctatgttacttccttgctggaaattaaacagtgcccccgagcgaatacagagaaaggaaaacatgtggtccacttagtttctaataagtccaaactagctaagaagaatcaagggtgcagccctcgtcgctgggagaaaccacacgcggggtggatgaagctgaatgtggatggatcctttgacttgaattcaggttcaggtggtttaggtgtgatgctaaggaatagttctgtcaaatctattttttctgcttccggattcattgagcgctgcagcagcccattggaagctgaactgatagcctgcaaagagggcattattatggcccttcagtggaccttgttgcccatcattgtggagtctggttgcttggtggcggtgaatatgatccaggctgcgaaagaggagaggtctcagtttgctcatctgatccgggacatagggaatttgatctcaggagacagggaagtcttaatccagaaaatttatcgcactcagaactgcattagccatttcctagcaaataaggcccgtgctaaactctgtacagagttttggccggatgaaacttgtaatatcatctcacaatttgtttgtgaggaggctgcttctgagtaatatatttccctttccctgcaaaaaaaaatatacttatatgtatacatatagttttacatatttcacaaaaaaaatttgaataagacgaacggtcaaacatgtgctaaaaagtcaat

SEQ ID NO: 58045 - DNA, 2982 bp, Oryza sativa
ccttgtgcacaacattggcactggactgcccaccatggcccttagacgcggcatctttttcccgagctttctcctcaacatcaagagacgctatcaacccctcaacggagtattcctgtctcttgtgtttgagtgcagtaccgaacttctccaagatggaggtagttttgcaataatgcacccggccacaaatttgtcgggtaagacacacttaaggagttcgagttccttagccatggtttgtatctcatgagcctgttcgactacagaacggttgtcagccattttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggctcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtacctataataaggtttttggattgttgagattatagacatataatgatttaatctattccataaataaatcatgacattacagatgaaaactagcatgaacgcaccattagatctacacatgtaaactacacagtataacaagaacagatcaaatatgcgcaacatattgaacacgtaccgaggtgacggaaagaccggctgcttggtcgaaacttttcgcaggtgtctacgaaggcacgaaacacgcgagcgaagaggaaggcgagccgtcgcgaacgaacaaggagcagtcgcgcgaagcgcttcccaaaaaccttattgccgccttctcccggtgcaggacgtcgaaggcagaggttccagagacctgctctcccgatcgccggtgcacgccggcaagcgggatggagtagtctacgagcgacggcgcagtacagagtaggaggcaaaccctagattgatttcgcgtgtgttgcgtgaagacggcaggtcggtttatatagagaagggtcgcttgatcagggcgcctgcacgatctctactgcgcgtaaccgaaccggataagtcgcgcgtaacttatccggactccacgccgtttgcacgcaccggatttttcggaacgtttccaaaacaaaaacgaatccgaatttgcagcaaaacaaaactgcaaaaggaggctgcatctgcgtaagggtgaggagccaatttttcggaccattcgacgcgtacgtcgtgcacgcgcgccgcctgcccggccaggcgaggcgagcgagcgcgcgcgtgtgtttcccctcttctctccaccacacatgcttcaagtgactaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatatactgtttatataccagcggttcgatggagaccaattaaggttgagcatccacctagaactccaagctacacttactcacaacttgaacaatggactacgccttgaattgcaagtcttgtgcaagcaagtttcactcaaagtcttacctggtactagaccgtctgtagactacccctcgggtggagcgtataagtcatactcctaggtctttagtaagcttcctagaagattcacccaaaatctttatagactgcgaccaacagtcaagctcacaaaggtgagttctttcaagaatgctctgcaggacaacatcttcgctaattaaaaccaacagaactcattaaggcatagccaacctgccttgcagctcacgagagtatatgcatcttcacttggagagggtatatatattggtactctcctctagtttattaatggtttgttcttcccaggatctaattcacgggatctccgatcacatagactgggttaccaccatagtataactcacatgggtctcaaacccatctccttcgatgcattgtctatcacatttcgtgatagtcccttcgtgaagggatctgccagatttctcgctgtttggatgtaatccaacgttataactcctgagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcctcaacagtagcagtatccagtgccgttagctttgcttccatggttgacctcgtcaaaatggtctgtttgcaagacctccatgaaacagcaccaccacccagtgtgaaaacatatccactagtggctttgatctcatccacatcagagatccagttagaatcactataaccctccagtaccgcaggatacccagtatagtgaagccccaattccacagtacctttcagatagcgcattactcgctcaagcgcacgccagtgatcatctcccggattagaggtaaatcggctcaacttgcttacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggaccgcaagaggggaatcc

SEQ ID NO: 58046 - DNA, 8828 bp, Oryza sativa
tcatgcagccatgggagtgaagaaactagtcggcagtagacgtagatagcttgtgttgaagatgatgacgcctattagcggtgatggcgacgtagccagccgtgaagaagatagcatcagttggcgtcataataggccagacgtgcaggcggaaacaccagtcggcggcggacgaggcggccggtcggtgaagaggtagacgcccaacaacggcggcataataggccagccgtgcaggcggaaacaccagtcggcggtgaacaaggtggctggtcggtgaagacgtagacgcccaacaacggcggcataataggccagccgtgcaggcggaaacaccagtcggtggcggacgaggcggccggtcggtgaagatgtagacgcccaacaacagcggcataataggccgaccgtgcaggcggtgacaccagtcgacggcagacgaggcggccggtcggtgaagatgtagacgcccaacaatagcggcataataggccagctatgcaggcggtgacaccagtcggcggcggcgaaagcaaaccggcagtgaagatgtagacgcctaacaacggtgttgtgaccaaccaaccgtataggcgaagacaccagtcggcggcgacgacggcaagccggtggtgatgttctgactgatccattcctggagcgtaagagataagcttaaagccataaatcccttttatgcatatctggatttggatcctacagaacaaacatataggatgagtagtatctgatgtaaatataatacttgagaaaaatgcaagtattttaaaatgtttataaatatgtatttctcctcttgtcaattttgatttccccgagcagatgactccttacgtttaaacactctgcctgactagtcatagcccccaagcaccgggagttggcctaggcacttcccaaacatgcatataagtgacaagagttcgtcattaatggaacaaagtttcacgaatcagtatttactactcgggtacttttgcaattgtaaagagcagaaaataaatttatcttatctccatgcttttgatttattctgattaatacttagcaccttgcgttactcggtccatataacgagcccccgggtgctaggaatcggcccaaaggcaactatccatcgacaaaccaaacggaaagcatacgaagatagaactccataactcgataggcacttttgtactcagattatgtcgcaagcaatcaagataaatattatgaaaaattgtttaaaaaatatgatataacatctgtagcccccgactcactagtcaacggcaaaccagttgatgtagtgaggcagaggaaaaggaaaatatcatataaagaagaaaattaattatgacttagctttctagtctttcccttggtgacgaccgaggtggccgatgtgggaacaaagtcatccattaatagcaatgaaaacaccagccatagaagcagcttgaggcaactgacgatgaaagtgaagatgcccatcaacggcggcataataggccagcagtgcagacggaaacaccagtcggcggcggcgaaggccagccagtcggtgaagacgtggacgcccgtgaacggtggtgtgaccaaccaaccatataggcgaggacactagtcggcggcggcgaaggccagccggcggtgaagtcgtagacgcccaacagcggcggcataataggccagcagtgcaggcggaaacaccagtcggcggcggcgaaggccagctggtcggtgaagacgtggacgcccgtgaacgatggtgtgaccaaccaaccgtatagacgagaacactagtcggcggcggcgaaggccagccggtcggtgaagtcgtagacacccaacagtggcggcataataggccagccgtgcaggcgagggcaccagtcggcagcggacgaggcggccggtcggtgaagatgttagttggcaacagcaaaggtagccgacacgggtacatacaaaataaatcaatgaacagatcatctgcttagtaccacgtaaaaaaatataggtataaagaagcttgtgcatgtatgtttgcatatatcaatgcatatacacggcttgcatatattgattaattagccaactaatctcctgtggcatgaacgctagacacatccacacatcacccgacaggtcctgccatgcgctcgcacagatcgcaggtccgagtccagatcaaatccccgtcagaagcttcttgagatggggatcggacacgttcgactagtggtgcatgcaaaataataaaccacagatcaaatagagattagtagcaaaaagaaataaaaaagtatagatgattatggatgttaatcgatgcatgtatgtttgcatgtagatcgatgtgtagaagaagtcggtgtgtcagccagcttgccaggaaaagcattgattagctattaaaagaaaacagatgctttacgatctctatgcatagcgttattaggtaaattgtgcatcttctccatagcttgcatgcatgctcctgtttgcacacgctggctgtgcatgcatgccgccatgaacgttccagtggacatgtgcttgtttgattcgtaaatcaacaaatgcacgaatttgcttctggtcgtcgggtgttcctatgccgaacctgcggcatctccatctgcaaggaaaggagcactcggacacggctaggcgccaaagtaggcgacggcgatggctgtgtctcaattttagccagaacgtgaaaataataaaaataacagtagattaaaaaatcaatctcataaaaataagattggaacgacaaacccgattgaagattagagccactaaaatcaataagattgatctcagcgtttcttctgaagttgattccatcgcacttttcgacgggtaattcgacgcaacccctacctggcgcgccaactgtcgaaacatgaattcggcaataataaaaggggtagcgcacgagacctaaaagtggatggatgcagagacaaaggatttagacaggttcaggccctctcaatgagaggtaataccctactcctgtttggggatttgaatccaccgggtgtattatagatctgacaatcatatgtgctcctgccccctagagggcctcctgcccaccttatataggatgggggcaggattacaagatagaaaccttaaccaatacggtatcggtttcctaaatctattttacaatattatcaaatcaggactttaggccgctccataatataaaaggaaacgtaatacccaagtcatgatttgttacatattccatagatataagctatcccctatgactagtcggataaccatgccgtgtgggtatggggtacccataatctccacaccaagatgttccattctattttgggtgatcgcacattttgttcctactctgacagtgacgatggcacaattgaagactctgacccaattcatgggagtttcgctatcttcactggccttcacatggttcgccctcgtggtaaacatgatgatgtccagatgatcaagcacaagtccatgtactaccaatttttcgatgattacatcgaatgggttatctgaagctcatgattattttgctataagcacagctagcatatgtgccctaaattcactttggtatttgaagcaacgcagctttaatctcatatacatatgtccatgtttctagctacctagtggtctatatatcagagactctacttaattggattggagtagtaattagtaggattgtaagagactcttctaaattagtagtggtttctaagcaattaatatttctaaattaatagtacctaataagtgccacatcactgccacatgcgacgaagacctagtcaaaagaggcacgtaggttccacgttagtcaaaatcggggccaataccgccagagggcatcgtttgcactggttttgtaagtttaagtttggagatacattgtatccgttttacggttcaagaatgattttgtaatttggtgataagaggagggacctctggtgtgctttttccttaaaaaaatggagcaccgtaccactcgagtaaaaagtttgtgggtccatgggccaaagacagctgagcaatccctaaaagcgacgattttcttttatattcactactacaaaacgattttcctgtacatgcccctctttagattgcaaacgaaccgtaactggccgcgtctgcaaaaatcgtactctattttcgtggcgggtccttaagaggaccgcacggaaaaatctaattctgcaaacaacacttaagtggacagcaagcaaaaatgaacctattttcgcaggcggacctcttaagtggaccgtacgcaaaaatacagtttttttatcccatcccctctctctcttttccctctcactcacttcaattttttcaccttctctctctctttctccctgcctttcctctcctctcctctcctctcctccaatccaagcgcgtggggcgcgggaagcggctagctctccgccgacgacgaggcagcggccgagaacaggcgggaggccgtgcggcggttggtgatcggcggccgagcactcgacggctggatccatgctgccgccgctgacgacaacgattaggcggctgggaacgatgggctcaggagcggcttggtggatggcggaggccgtcccccgcccagatttgacggcggtggcggcgagcaggcgggctcggacggtagggaggcgtggcggcggcagatccggcaacggcgacggtgatgacagcgaccaggaggagggcggcgacgacggcttctagggttagggtttcggatttttttcttttttttttttttttgcatgtgggcaacataagcacccactcgcgaaaatcagattttcgtgtgcaggtgcgccacccgcacacaaaaatagcgattcttctagaccctatggcgcgtgcggttagcccttcctcacacgaaaacccctttcggaccgcacggaaaaaaatccttttttagtagtgatttattttttaaaagatttacaaaactaaattaccagttcgaagttatgcagaaatgtactccttatgtcctaccgtaggacaagacatataaaacgagacatataaatcatcctatgcttggacgagaaatgtgacttggcaaacgaccggataggcgtgctgtttaaattttgcgagcaaggtgctgcctctgaaaaggcatgacgaaatcgctctttgttagggcaatctactgttgcaatggcttatctagaaaaaaaaataagttgggtggcaacggacatattttacaagtgccccctcccggtaataaatcgctctgcaggaggatgagtctcacatttcctattctacggtaggacgatttatatggctcaacgcaccatagagaggaggagtatattcatgcaaaatttcaaaacggtaatttaatttttattttactaaaaaaataatataagaaaaaatcgcgactagcaggacccagacggccctaatccgtgccatcgcgctgaggctgagcctcggcagccgccgccatccttcctgacttgtccaaccctcctccttccttcctgtagattgcacgctgcccctgtagatcagcagcttccatctgatctgcatcccggccgactgtcacagattgcaaggaattgaaaggaaatccacatcctttgctgctgctgctgcaggtatgggtttattttgctccatccattgttgtttcgttctattggttggtctggttgctcgtcgtgttttgttcagggttctaaatctcccgctaaactgccgctatctcccgctatagctctttcagaagagtttcagctatttgctctcatgtacaatttaaccgctatagatccatttagcccgctatagctgtttgagaaactaaccgctaaataccttagcctgctatttaaaacattggttttgtttcttttattcctttacggaattactaaaattgtgtctccacaattcttggctgattatagtcagatttatcaacatcatatcgattctcagattcgttctattgcacgcatgcaagcccgttttgaaggccgagttaccaactgctcttagctggcatttttcttcggtcaatgtagtgtatgataaagataaggttaaaaggtagtcacatcaaatttgaactacaattacatgtcacttacattacagttacaccgtattaaaaaatgtaggtttagttctatgtgcatgtaaatttatatttttatctatttttgcacagaccttgcctgctagctttggtttttagctatgcagctagtagttatgctataagttcagtactgtcaaattgtttcatcagtaatgagcttttgttttgtgtgttacaattgttttgtcctggccgttgatctgtaatggtgaaaaactgactgtttttaggctgaaattgtggcaacagttatataggcactcccacccaacaatagaaatatagaatcatcccatcagataagaagatcagttttggttcggaaaaagatatggggaggcgatttctgaaccttgtggtggagaacgcccgcagtggactgtattctctgcgccgcatacctgcaaatcatctcttctacccatcaacaagagcagctgaagaggccacggcaaagtcccaagaatcattcaacgcgtacgttaaggagcaccatggcaggaaacacccaggcctccacaccttggagatgttggggaagcttccctctcccatgctcaacttcgaaccaaccccctgggatggccagcgtcgatataggaatctcgagttcgcatctctcctcggcaatgagaacaggatcctctttgccgaccacagtggacataccatcgtctttgacgccgactcctccaccgtctttgcctttcccaacctcatttctgacaagggttgtgcagccatttccctctccatcaaaaacaacaacaccaataagaacattagtggcggcatgtgggatgaagacagcctctacgtgatgtcccagagtgctgaccctgaaaccaaggattactgctttgaagtgctcaactacacttcttcctgtaaggattttcgtgggaggactccctattggagttctctacagccgccgcccttcgccaactacatgcatgccgacattacttcctacactgtggttgacagctccactatatatgtttcttctatggagccagatgctacttatgcctttgacacagtggggcatcagtggcgtcgcctgggctgctggacaatgccattcgatggcaaagctgagtatgtgccggagctcaagctgtggttcggactatccgtcaaccacccctacagcttatgcgcttgtgatctcctctccgatgcagcaaagccacccacggtgcagcagcagcacacttgggtggacctcgacatacctgaatcctggttgccctataacattgacctcatcaacctgggcagtggcaggttttgcgtcgtcaagattttccgtcatatggcagatgactgcactggtttctccgattacgatgacgatgacgcaatggactctgacctgattcaagggaaattcgctgtcttaactggcctacagatagttcgcccttgtggtaaagatggtgatgatcaaggtggtgtccggatgatcaagcacaagtccatgtactacaacttttgggactatgaaatcgaatgggttatctgaagctgagggttttactataaaaaaaatgggaccaatctagaaaggactagattgattttgaattaaggagggggtgaggctcgaacccggaccggctagctcgcagcttgcgttgctagccgggaagaccccaggcctttctcatgagggttttactatcaagcagctatctagaatatgtgccctaatttcattttgatatttgaagcaattaattctagctttaatctgataagctttatatcatgcacgtttctagctagctagtggactgctgtaaaagaccctagttaattagtaattaataggattggatttctaaattagtagtggtatctaggtataatatttctaattagtacctgatatgtgtgtacccattctaacgcaaatcgaattggttctgaaactaatatcattttgctatatatgaagcagaatgggttcgcctaaactgatttcattttcatatgaaacaatatgcttcatttgatatgcaatttatcatccatatttccggtggactgtaagggactagtgagtaggattgaaaatttggaactctaaattagtgcatgatctgtaagagtctactttgctaattgtatgaagcagtatcactcttgctggttgtatcttcaagagagctatcttgtcagaaatggaaaggcagagaaaacagtggagactgaagatttttccttgtcagctgaactaaatttggccaagtgttctatctgaaactaatattatcgttatgatttctatgaatcagccaatatggcctaatcttattcattttgatactctgaaaactgaagcaatgcttttatctgatatgcaattttgcgtccacatttctagtggactataagagactaatgatcaagtaaattagtggtggtatacttaacagttaagtaggattggaattctaaactagctagtggcatgaaatattctagtgtcttttggccataactgaatgacattactgggctggcgtgtcattgtgctagctagttagtggtacagcaatatgtatcttactgtcatctcctgattttcactacctctctgcaaccagaa

SEQ ID NO: 58047 - DNA, 3460 bp, Oryza sativa
catgtgtagatctaatggtgtgttcatgctagttttcatctgtaatgtcatgatttatttatggaatagattaaatcattatatgtctataatctcaacagaagaaaccattaatatcaccacggcagatcatacatacaacaacatcgccgaggattacaactgcaatgtgttcattcgaatatggccgatggcaggtgcagacctgcagtaccacgcttacatttttcagatgttttcagcaaatgaagttttatatcaacttgaatttgctttcgtgagatatagtgtgatggtaacacaaaaccttatgtagaagcaaccttacgtgctcagatgaaatcatttgtatcatgcgaagtgagtatagctcaactggttaggttccttgtggtggaaccagcccacctgggttcaaatcctagatttgacacgggtgctcgcatttacggctaattattctttcagtggtagacgacgtacccgtcgacagcctcctagttaggcgacgtacccgtcgacagcctcctagatttgacacgggtgctcgctgtggtgacttcgtcaatctcaagatatgccggcacgttgtgagcgcctgcgtttatactgtgtttctcaaaaaaaaaagaaatcatttgtatcatggagctcttcttattgcctccaaacaatggaaatgttttttttttttgaaacaaacaatggaaatgttttgcatagacaggggtcggagaattaaactccgaacctcaaccacgcgatttattcgtgctcaactggatcgccactttatggtccattaaagctttgggcatcgtttttggagatttttgtaagcccaagtcagcccatgaaaatatggatagctgcccaagtcagcccaagtttagttgggccgagctcactgtgataattggatcatgtccagactgcggggatatgcacaacatgatctatttgtcgggtgatttctttgaaaaaatcacctagattttttctacccttaaatttacatccaacagactacaaaagaaaataaaaatacatatttagttacacaatacttttatcataattacaatgcacttacatgtcatatcaactgaatttacaaatgtaattttagttatataggattgtaattatatatattaaagaaaataacaaatagatatttactcacacaacattgttatcgaaatttcagtgcgcttacatgtcatatcaattgaatttacaaatataattttagttagagtaaagtccatcaccggtccctaaacttgtaccgttgtgtcatcccggttcctaaactcgcaaatcgaccgttcaggtcctcaaacttattcgactgtgtcaccccggtccctaaacttgcagatcactcgtttaggtcctccaacttgttcagttgtgttaccccggtccctaaacttggatttgaatatcatctgggtcaaataagacagtctaaagactttatatttaaaaataattcataactttttcatgtgaactctaatgaagaaaaactttatatcaaacttgtagccctcgactcgatctacaactttgtagttgagtttttttattctaagtcattttttgtcccaaaatgtaattttaaaattaaaatttcaaaatatataaacatgcaacaatattttgggactaaaacagttttaattcaaaaacttttcaactacaaagttgtaagtcacgtcgaaggctacaattttgatataaagtttgtcttcattagagttcatatgaaaaagttataaattattttttgatataaagtttttagaccgtcctgtttagggaccggggtgacacaactgaacaagttggaggacctaaacaagtgatctacaagtttagggaccgggatgacacagtcaaacaagtttgaggacctgaacggtcgatttgcgagtttagggaccgggatgacacaacggtacaagtttagggaccggtgatggactttactcttttggttatataggactgtaattttatattttaaagaaaataacaaatagatatttacttatacaacattgttatcaaaattacagtgcacttacatgtcatatcaactgaatttacaaatataactttagttatataggactgtaattttatatattaaaaataacaaataaatatttacttacacaacattgttataaaaattacagtacgcacttacatgtcatatcaactgaatttacaaatgtaatttttattatataggactgtaattttgtattttatttttattttagtttcaattgagagagaacgagagagaacagcgtgcatatcaattttttagagcgcaaaaaaaaaagaaattagcgcctctaacccgcccgactgaatcctatgcggattcccagcgctatatgtgcacgaatcttgtcacttatcgaacagcctaaaaaagacaaatccaagagaaaaaatcacacgacaaatctatagcaaaatcggcacaacattacttgatattcattctcgctgccaaattttcagattcagtcacagcatcacaatgcactaaatcacgaatatttagtgcaatttagtcataaattttgatatacaaaatggtatggttataactagtctgaaaagggctgatggttgcacacaagcaacggtaaaagcctaatattagaaaggagattgagcatccctctcctaataacaaatcttccgattattacatgacatgccaggaaaactgtcatacacaccagtctctccacatgtgaaaaatacagaaactggcaaatatacaaaagttgggttcctcaatatatatgccagtgattcacaattaccagaagacagaaaatgatgcaccaaacaactgcacaattgtttaaagagctttcacacaacataccaaactgccctatcaaatcaaattctgataggttatcgctcacactgtgaaattcccttaagcacctgttgactgatgtctttctttcacaacatgaccacagccaccaaaatgcatgtaagtatgtaaccatatgtaattgtaagggcaagcagatgataacctgtatgaaccactaaaatcagaagaggtggctgccgtgttcttacaagtcaacggctgaacggcgcacggccatcatagcatccacaaatctgtttgcaataccacagccgcgatgccgaccagatcctggccgaggtccgccggcgcaggttcacggcgagggggtggccggaggacggcttccggcgacagtgatcggatcgtggccgagcaaaatttggcgcgccgtcgtttcctcaccgctgcacaagatctagcgaattgaggcagagaggaggtaagaggatgtagttaggaagccggagcagcgagatagagactttttgggcgagggcgagggcgaaggcgaggtcgccatggccgtggccctct

SEQ ID NO: 58048 - DNA, 14285 bp, Oryza sativa
atattttgtgacagaggtactttttagtagaatttttcattgttggatttggccatatcatctatagaattggtatagagcatacccccattagttttatgtttcttgctgcagagcttttttcattttgcagggttagccattatatttgtgtcattttgaggtgctatcttgtgttttgctgactttgttcaccttgttcgatttgtagaacttgtccaaagacaggtcaccttctggacgaggcggaaggggaaaaactcatttcctgtcacataaccatcaaagaccacaccactacggtagagctgatatgtcagcagatttgactccttcggaggaattgagacatatttatgatcctgatgcaaatgacttgggaatcccctcttcactgcacatatcaataccttctccatcttcggaatctccaagggaaattgtgcatggcaatggttttattcagcctccagctaagaaacttgagtttgggaccttgggagcattgcctttggaagttacatcccaagagcttggtattaacagattgaatactgcttctgacagccaaccttctgcatctgcaagccctatgtctctggcacataatcctggaattagttctaatcaaatgaggtaagtatgtttcgtttttttagctgtcagtcagcaacgtgtcaacgccaagtgtttatcagagtcatgccataactaataatttcctaaagagaaattgcggtccacatgcattttccaaaaaaatatggtatggcaatcatcagtattttcaatctaaacatgaaaagcatatttaccgaaaatgaaaatgctgttttcccctcttttccttcatattacctcattcaccttgtaacttaacctattcagttctaatgaatttttaagaaattatgttgcataattcctcattaaacaatttacaggaatgctcagccatatcatctcaaggacaacggtgatttcccaccgctatctagttgatgccatatagttcattgcatatcagaggcaacttggtccaagaaaagatactgataaatggtgcgagcacttggtgcaacaatagcaggggttattccacaagacaaacatcatccatcatgtacatcctatcattaacttcacattctcctatcttcaattcacccttgctgttgctttccaaaaaagaaagaaaaaaaaacagaaggctgatgcatcgcagcttgctctgccataacattccctgcaaaggaaatatggaggaaagatagaagcacaatgtagatacttatgttctctttacctttgtccccttgaagagggaacaagtgtggtaaagtcaaaaaatgctagaaagagggtgagctgtgtcttgctctgttgttttgacctcatgagcattccagttactggagggctcattgagtgtgctctgttttggtttggagaggccttctgttgaaaggccccattgtttgaagtaacatttgctgcctcaagcaatgggtagttataggggatagatatgtacgaaactttcactagatttactgtcttcatagaagcagtttagttagtctatactagctcagagtaaaaatgatccttttactttgcctgttgtgcttcacatgtctttttttttgtaactaatttgacttgtaacatagttttgctctgctgttgttagctcggctccaggttaagagaaagtggtatgattttgagtaacacaagcatgatttctatttacgttttgattagcatagttttgctcttctgttaaatcggggtagtcatttagcaagtttttcatagctccatgtcagtaagatcctaatgtagtgttgagatggccaagtcttgagatgttcagtcgccacgtaagcaaaccaaggtggttttggtttgaatggggtataaaatggacatcttgagaagtttgaggtcgtgaaatgtacgcttttgtagtttaaggtcgatttctaatctttttcaagagcttaggtagtaaagcagactaaagttgaagtcatgtcgctttcaagatgggaaacttcaaactctcgatggaactacaattagacgaatcatgaaccccatcttgataaaagataagactgtcaaagcagagcagtactcaaggacatgtttggagtttttcattggatgattagccgaaaaaattaattaccgctagtcactgactctatttctgttatatgatttcacactagatgccactctacgtcgtagcaatcttacaattatttctataaaatatttctgatggtagcattaaactacatgaattattgtattgatacccaattatgtcacttcttatattttgctttggtggctgggaaataaatagatttggcagatcaattattgtagtcaacttcagaaagctgaagaagtcaaagctcagctcgctaatgtgtatggtccttcgttcttactttagggtattaatttaggttgacaaatgctcctactagagtttaagggtaggttacttaccctttgtctaactctgaggggctgaagaaaaatgagcctaagatgtatattttgtctctggactaattgacggtataaataattctcgtttcggagtacaattctcggtaaaatcaagaaattgtggcacacgtgtttgttttccagctcttacattagctttttataagtacgaggacaaaagtaaaaaaaaatcaggttcatttccacgagaaatacttgtgatattatgaaatttatgtactgcccttttgtttaaaaaaagttagtctcatgaacaattgaacgtaagttcacaaaatccatagaagaatgaaccattcacaaaatccatagaagaatgaaccagtcaattcttatcctggcgactgatgatgtatcattctctaggagtccttttccttttctctgaaaaacgcaccaaaattgcatttaaaaaatgtataattgaatcgttgactttgtgctaaatctgtcgcagcattctgctagtggataataccttttgatctttagatcggatctttctgaattattgagagacaagctgattgtcatcggccatcattgggacccagatccattttgcctgttctcattctaaaccactcgtatgctgagtttttgtccaagtgtcatgagagctgggatagaatttttctaaagttgaaatggcatagctcctgcccgcttcctaaaaagaaagagagaatttttctaaagttccaaatggttgcagcaagataacttgtcagtttttgttagcatgagtgttttgacatgcataatagactcctttctcccaaatcatgcgctttcctatgtgtataaaggttaacatagtttgaaggttcgtattgttcctttttaagagaaacaaatatgagtatatataagcttagtctcttttcttttctttctttttgttttgttgttcctttagttgtggactacttgagtctatgtattcctgtaatccattatctaaaaagaaaaaacctaacaagtactccttaagtagtctgaagatgcttacttgttaatactactatttaattagttaatcaggtgtcaatcttaggagaagcgtgtgttccggttgaagccggtggtggtgttactagcaccctggcctacaagggaggttggacatgacaaggactccaggaaggagaacctgaaacccaaaatgaagatagaaaaaggaaaagagaaatgatcgtttgtctgagttcaagatacaatattcagtctagtcaaggaaaggaatactaccatttataacaatttattaggcatgctctaaaatttgtgaatactcaaaggagttttttttttcaaaataagagtatataagatacccctgacattgcttaagctaagataaaacgtgaaaacaatatgtcagattttttacgaaaaaaataagcaaagtcaaatacggatcatgtgaacatattctgaaaattcagttgtggttggtcttgtgctgttccaacgtaaccaacctttcctcctcttccctctgcacatctgaattgtcaagcaaccacaactctttccatcctctccaatcttaagcaggataacacaacgaattcttccttcccattcccattcacaatccttccttattcaacaatttgtctgatacttgcatgcccacaggcagctcaaaaagctagctacttgtttctgacttgtatcatttctacatagatagctcaaagcctctcaaaatcctgcatttcttgctcaaatggatttttcaaggcatagattcttcaaattcagatcagcagctgtctccttcctctccatgtaactaatttcaagctctcaagatcagcaagttcagcaatcaccagactagctaggctcactccttccacatatagtcacagctgctctcatcaatcaatctatctttccagcttccaggtgacaatcgagacctgaatttctgaacttttttttccctctcgtcacttcgtcagtagaaatccaaggtttatattcctctgtactactacacaacagagtgagcgtagtacgtgtctcatcagcatcaaaaagtgacatactgcaagcacgccacaattgaggccgattgatagaatcgaattccactcaaatttgcacggtggaagagaatcccctgcgtgcttgatttgatcaggatttatattggaggcatccaattccatcactcaaccggagctgtctgtctgtagctatcgccctatttctgctagctcgtggcgtgctagtttaatttcttccaaaattctccggcctcacctcgcgtcgtgtcgtgtcgcgtcgcttgcgttaggaggtgcctaagtactggcttgtcggcgtcagatgagtgcagggccgtgctgctcagaggcgcccatggcgtggatcgactgctccctcctcgcctggctcctcttccgcgtcgtcttcttctcctgccacgccaagcagttcagcatcttctaacactcgatctcagctaggctgaaaccacatatactccagcatatatacacagcaactgattaagtaagctgttgctcgccgacggtggccgagcatgtccggtgcacggcggtgcggtgaccggaggtcggagagaagttcggtggtgggcgacaacaggaatggatacgtcgagactgacccaactggtcgctatggccgggtaatttatttacttcttcttcttgcaatctgaacttgctcactttcttattccaaagagaaatttgacttgtttcctttcaaagttcaatattatcatgattgccaaatgatcagcaagcaattccgagctattcagggtcaattcagttcattgcttttttttttcgttcaaaagaaaagaaaaatcagttggttgcttttgattctacttgaacatggattgtgcctatcatgcacgagtttagttgttcagttctatcatgttctttagatgtgggctggtaattagtaattacatttcaatacacgttgtaagcatcagttaaaacatgttggcttcattctctttcagaaaagcatgtaggctttatgttctttagcataattttctagagtagattccatgttgatgtacacatcggagctaacacctctaaactatgcaagacacaattattgtgtcttcagtactttcatcggatccatttggcttttgctgctatctatgggctgcataggacaattgaatactccatccggttttattttaattgacgtttcggacaacgacacggtctacaaaatatatctttaaccttatttttctattataatatacaaaataaataaatgcatgtttactttattatagtgctttgaaagacaaatctatatatgttgttctagtttttttaaactaaatatttttaaagtgattgatggtcaaagttataaaagtttgacctcagccttatccaaaacgtcaattattatagaaccggagggagtattgcacattgaaacatatcaggtttgaggcttcgttattaatcctaagccattgctgtactgaaagatgacatcgtttttttctatatttggtcaaataacggaagtgcatcataaatttgagatgatgagcgagaattcaattatgatttctcttccaatccaatcagggaaggtataaggtgttccttatcaaacaagctagagttgttgtttggttggcatttgaagtttcctaatatgttggatttgatctgaatagataagcatgttccatgtgtcaatatgccaataatcagatgttgaaaaagtttcaagagtggagtatatgccctatctggtcatgctcatgcccaacgatttgatacgatcctctcacctttttcttagtgggttgaagacgtattggcaactttattagttcatctttttttcagtagtttctctagggttagaggtgtacttaccggcaacttatttgtagttatgcgagctttgcaaaagtgtcttacttttataaatttgacaactatccactactttgagttaactttttatatgtatagtaattttaacttttgatcagaagtactggttctttagtgctaaattagggagagtagttaattgaggtgctaaattggttctcgtaactcaaaagtgttgattttatttgactagagattttctaggcattactgtagcaaaacccgtttggaatctgcatttttcacttcagaacattatgaaaagaaaacttatataagattttgaaatcccatgtaaaattaaattttaaaagatgactataaatgcgcactacaataaataaataaataaataaaatttatcgcattctcttgaagaaaagcaattcattaattgcactttctagtgtagtagtacagtacacaagaatattgttttctgaccatgtgctcatgatctataagtatatattttctctacatatgcaagcatgtttgtttcaaaaactttttaaagtgcacgaagtataaaatatttagaatttagtgaaaggaagcatttcgaatcaaaattaaacttgtcaattcagaataaagtagtctggcttgcttgacaatatatagataaattatttcgctacgtgttagcatgcatatttctgacatttcagaaatatcagaattttcggatcaatatttcgctttgcactttctgctactatttcagaaacttgaggaatttcgcccccgcccccccccccaatttgaaattaatttggctgaaaagaaaaacatttattaattaagcaaattttaattaaaaactttaacgaaaatatgttgaaatttcaaccttttcggccttcgatttcctaaaatttccgaaatttcggttctatcgaaatttgttcaaattttgtactgtatacaatatgtgtgcagttgtcggaggtgctggggaagggtgcgatgaagacggtgtaccgagggttcgacgagctgcggggggtggaggtggcgtggaaccaggccaccatctccgacgtcctccgcaccccggacgccctccaccgcatgtacgcggaggtgagcctcctcgccgacctccgccacgacgccatcatcgccttccacgcctcctgggtccacccctcccgccgcaccttcaacttcatcaccgagctcttctcctccggcaccctccgctcctaccgcctccgctacccgcgcgtcagccgccgcgccgtcgccgcctgggcgcgcgccatcctccgcggcctcgcctacctccactcccgcggcgtcatccaccgcgacctcaagtgcgacaacatcttcgtcaacggccacctcggccaggtcaagatcggcgacctcggcctcgccgccgttctccgcggtgcacctccgcccgcagcgtcatcggcacgccggagttcatggcccccgagatgtacgacgagtgctacggcgtcggcgtcgacgtctactccttcggcatgtgcatgctcgagatgctcaccaacgagtacccctacagcgagtgcgacaacccagcgcagatctacaagaaggtcaccgccggcaagctccccgacgccttctacctcctcaccgacgccgacgcccgccgcttcatcggccggtgccttgtcgacgccgcccaccgcccctctgccgaggagctcctgctcgaccccttcctctccccgcctcagaaccacgacgatcacaataccattgctcatgccactgcgccgccaccgccattgccattggcgtgcagtaattccagtgaggagcaagaggaggaggaggcgccggcagcaaagacgacgggcatggcgatcaccgggaagctgaacaaggagcacgacaccatcttcctcaaggtgcagatcggcggcggcggcaacgtgcggaacatctacttcccgttcgacgtggcgaacgacacggcgatggaggtggcgacggagatggtgaaggagctggacatcgccgaccgggagcccacggagatcgccgccatgatcgagcaggagatcgtgaggttggtaccagggtacaagcagcacgagtattcgtacgcggatgacgacgacgatgatgacgtcaacggacaacctaatcccttctactacctctcctcttcgccgacctcctctcagggatctctctgcggagtggggcccacatcgtcagaggggtttcctggcccacatggaaaagttgactggtcaagaggtataacaaagtgttttcatcttactttccaatatatcaaaaataacgtgctattctaatctaaatatggttctagctatagaagataaaaagttgggttttctacaaatcacttgagaaggtagaagaaacttgcataaacatttttacatgcagtttggaaatgataaacatttgttcagaaaaaaaaaagaaatggtaaacatgacgtagtagcatgcatgcagatgataatattgtggcaccaacttccaaatgcatgtatacaaacatgtagcttttgttcatttgcccaactgcttttgttcctagctaggcaagaaattaaatttcctagtcaccatatatatgaacagagaaattggaagtcagacgtgcaaactactagaggtagttagctagcaaggtggttgatatatctttgtccatttgtcgttgctattcgtgccaatcctgtgacaccaatacatgcgtcagcgttatatcgatcgttttgttcctagtactagctagtggcagcttacagacagccatgcattaggttcgtgctgcttaattgtggctatatatcactgtcacaattgatctctgcagagacattttagacggataaaaattgcgttcagttagtcgtgttacaatcatcatcccggcggccagcagcataaatgtcaaatggaatattagtcatgtaacatacacatcaatcatatatcctaggcactatacatacacatggtacatatatagctcgccatttcactgtcatcgaccgcatctttattcatatccattcatttcatgcgcacgttattaactgcactaaccagctagtggtagtacttgtagtagatgatgttttgaattgactaatccgtttgatttgatgcatggtgtagattactgttactaccctccaagcagcgtcagcgtgagcgacgacgatgacagcagcacgagctcactctctgctgcagtcagcgcaatcagcctgcagcagcagcattgttcggcctcttccagcagattggggccagcatctgcatcagcatctgaagacggaggaggacacgccggacggccacggcagcgagagggggaggaggagcggcggcggaggaggatgagtcggaacaggtcgatggtggacatgcggagccagctgctgcacaggacgctggtggaggagctcaacaagcgcctcttcttcaacaccgtcggcgccgtccacgacatcggcttccgcgaccctactacttacggatcgtcgtcgtcgtcttcttcgtcacagcatcgccggagaagcagcagcaaggtcgaccacaagcaccactacatgttctgaataaactttttcagagcaaattagtactctaatttggtatgtacagaatgatcgatcagatgcagagtacgtaagtgtgcagctagctatctagcccgcggccacaaaattgtgtatatttggagagaagtgcatatatgagtgttgttcatgacaattttgccatgcgacatgtgaatgaatatatgagtgatatttgtacatatggtatgagtgatatttttcccaaaataggtaccccagcatatgcatgcgctgctgaccagagttttaactgctgaacagttcccctcaattgcactccttttgtttttaagtttcgattttgctattaaaattggctctcttttttgtttaaagtgttttaaggttaggtgagtttgctggtcgttctccgaaatcttttccaatccaagtattttccccgaaattgattgtggaaatcacgaggtgcctataaatcaagcgcccaatttttttttcaaaagtcgggcgctgtttcaccgagtagatcgaacatgtttcactaaatagatcgaaaatgtttcggtcttttaaaaagttgaaacacaaccaaataacctcatgaaacattttgctacaacgtatgaaacaacggttttcaaaaaaatcagagttgtttcaccctatttaaaaataatgtttcagcaaatagcaaaagaatgattcaattcttagaaaagtgaaacacggtcagatcgctagatgaaacaatttggttcaacgtatgtaacaaacgatttgattcccgtgtacatcaacaaaccacgtgtccatcaagatagaaaatattaaacaatataaaacccactacaatatttcatctatgcatagtgaaacatcatgagtacacttgctgaaacattgttggtggaatgaaaaatgaaacgaattctcttaataagacgtttccgtaatatatggtgatttgttgcaacggcgcgtgtggtggggatgacgcggaggcgcagtagagcgcgggtgcccgatgtatgcgtgccagcatcgggcgtccgatttgaggcatttaagtggaaatcaaccaaaattttctacccaaataatcatgggctctggacacactgatagccctcccttccggggccacgtccatcgatctctgggctgcagtattgggccttggcccatcaccgcgcgtgtgcaattactgcaacgcgtaaacacaccctgcaacttgctgtatctgtatgcgtgtcgccagcttcagagggcggcacggtgttctcaaaaaaaaaaagagggcggcacggcaaagatccacagtcaacggtcaaatgttccccatcccatttgcatctctctcttgatccaatgcattgtaccaccaacatcttctccaagcacagatcctaaaatgcctaattgtttcctcttttttttatgaaatagaaatcaagtatttgcctcatcttctcaaggtgttcaatgtgtctcagatatcgcgcgttgtcaaggaccaaattaagctacatatcttgctaacctctttacatttgtatctagctgatcatctcctaattaaaaggtagtaaatttgatctgtaattctaacatcaatgtgtatctagctgatcatctcctaattaaaagatagtaaatttgatctgtaattctaacatcaatgtgcatcacagcagtcagaaataattcagaaaactgcaggggaaaccaaagaataacgttccattaattgttgcgaactaactagcaaatcgatctcatgtgtatatatgtacatagtttctgtatatcgaacaaatcaacaaaaagaatgaaacaagaaaaacaagtagcgtgtgtcatacactcatacatacacaactaagatagaaagcctacagaggagggagaggaagagggcaaatacgagtagctagctaagctagtttgtgcgcttgctggggctggatggctgtggcctccctctgggcttcatgcttctcaaccaagacagctgctgctgcatcacttgttcttcagtcgtcgtcgtcgtatctgctgatgctgtctccgattcgtgcttcagctgtggctgcatcggcgtcggcgacggaagaggcagaggcctgctgcaactgccgtggtgtgcgaagaagacgagcaggaggagcagcacaagcagcagcaacgacgacgacgagctgcagggcttcttgttgcttgacaatagcaatgtggccattgttgtgatctccttgtgttggaagctaatatggatggatttgcagaggaattgaagcacaggtagctatccgggatataaatacaagagataggtagccgcagagcgaagaaaagggggcgtttcaattaaagtcaatggagaggagacgatcgatggaattattaactcaagctaagacgtgtttcctcttccaaaagattagctctcaagacgtgtggaatggaaatatggaatcaattaagccagttttgcaagctggaaggaagaagcagaagaagatgtagataaagaagacttggtgtgaggggaggcgtgcggatcaagttgaagctagctagcaacgatcgatggagggacgacgcgttttgagtagcaagctccacctggcgagaccgtgtagccgtctacacattgatgccactagtatactgtacattcttcttcactcataggctgacaggccacgtaccgactttctatcagcacacctctagcttgtaagcacgcatctatcagtaattccatttaatttgtaacgaaaatgtttagctatcgtgcaaaacgctaggccccataggcccatacgatcgaggccatgtcttaccgataatgggagtattagagttgtaagcgatagaccacaacaacaggattgtaaaaggtctcagataaaagcccaatgtttcactggaccagtagtgactatgtctttgggtgtgataatcctattgagagcgttgtcgaggtacacgttctctttctgtgaggatttttgggtgaacaccatattcagtgtatttggacgggcgacaacaacgtcttttttatcgcaaacttcgtggagacatcgtttttttagtcttctttttgtggtgttgttgttggcctagtggtgaccaacctcgtatatcagtggttggtttgggctcggtttctctcttagcagcttatgtttgtatggttgatatgtgatgcagggtatgcatgtactttgatgcacattcttcttgacaaccggttggcgaaaaagaaagaattatattcgcaatcatatatatatatatatatatatatatatacatacgtatatatacatatattaaaaaattatatatattataaaatattgtcaattaaacacctcaaaatatccataataatagctgatacatctcaaaatatatatacagaatcactgaaatatatatatatacatggagaagtcaggtggatcagcacgtactcaatcaaacagaacgagttagtgactaactaaatcacaaatagttgcccttctatctcagtattaatcttctaccactagtggagaagtgatttttagtcccagttcgtaaaccccctgtagtcccggtttttccaaccgggactacgaatccgggactaaagatcgctatctttagtcccggttcaaataaccgggactatcgctattgatttcacaccatcccctcccatatccaaatcatcacatatcacaggacatctccaaatcctcaaatccttgaataaatcatctccaaatacatcacaaactcttaaaaaatagatcatctccaaatacatcacaaactcttaaaaaaattacatcacagggttctaaaaaaaatcatcacagattcacatctcacacaaaaatacatcacagattcacatctaaaaaaaaaaagaaaaaaatccggccggcggccactgccgcctcccctcctcccctccgcgccagccggccggcgcctcgccgccgccgccgcgcgccccccgcgccgccgaacaagccacctccacgcagcccccggcgccgcccgccggcccgccaccgccgccgttgccgcgtggccccacgcgccgctgcgcaggccgcctacgcgccgtcccccgcgccgccgccttcgccaccgcggcgccggccgcctgcacgctttttcactgtggggtgaaggaaaaaagg

SEQ ID NO: 58049 - DNA, 8799 bp, Oryza sativa
tatatatggacggcatggtactggaccccggacctcctagaacataaagtggtcctaactcatctaaaatggtcatagcacatacctgtaataacaacaaaagtggtcctaactcatctacctggtcgcgggacgtgttgtaacaaaaaaatacggcatggtactggatctcctcgaacagaacaaaaaaaaaagtgagaaagaaatcacattgagcacatggcatcgcggcgccaaatctactcccactgacacagcgggaccagagaccagaggccagaggccctaatcgtccgctagtggaaggaaattgctggtagtagtattgacgacgtctttatcaacgaagcttcgtgccaacccgctcttccttctccagtttgcttcaacccgattatttcccgtcgggcgtcgggccgtcggctacacgttggggacgccatttcaccggcttttttttttttttttgcggggggcatttcaccggcttttgtgtcagttggagcaaattcaacccagaaatcaatgaagcttcattctagaggtgatgcctaggcaaataagacaaaacagtttactaaagaataaaaattaatttataggtaaaatttttactgcctttattctaaaatatgtatagctgtcagttaccgtgtccaatgtttgaccatccgttttatttgaaaaatattgatgattagtatttttattgttattagatgataaaacatgtataatattttatatgtgaccaatttttttaaataagatagacggtcaaatattggacacggaaaccaacaattacgcttatattgggacagaggtagtatatatttatttgtaacaacctaaaactcaacgctaaaggcttggttttaagagctttcttcggatagcactacggctcggacgttcgatatctcaccaaatatcggacgcccagccaaacaccgagcgtatgtgcatgtgcatgttgccgcactttattcttcactcctcaatcatgaagaatcttctcatctgacgtcccatgtcctaaagaaaattggttggtcaaatgttctagttgaccattgagtgaaacatcaaattatatatggtgaaacaaaaaatcagcaactgaaacatttaaaaattttatgaaacatgatgaagatatacgttgaaacatatcgctatcacatatgaaacaatagtgttaacggattgaaacatatgtttttctttcatcaaaatataatcatgtgatatcttgttgtaaagatttaattacaacgaatacaacggtgtgaccgaatcatagattggataattagtttatgagaaaaattattttgaagctcgctaaaatgcatacatgcatgcatgtttgaggtggagagagagtagtgagatatagtttcatgaaatttgtgaaacatgcataagagacatattgaaacatatctatcactatcgcgtatgaaacaaagagtgttaatggattgaaacatatgattatttttaatcagaatataatcatgcgacatcttgttgtaaagatttaattacaacaaatacaacagtgtgatcggattgtagattggattagtaatttacgagaaaaaaaatgttttaaatatcgttaaaggtacatgtgtgtaggcttgaaaggatgtgtcagagtcagcccgtccaatttttctccttccgtccggacgtccgagttgaagcattaacggttttcttctcaaatcaacctatattcggacgatgttatcgttccgttgacttgtgtccttctcaaaggcttggttttaagagatttctcttgttagattgctatttttagatttagtgtatggttttgaccagttttccataattaataagattttaggtctgacttttcctataaactagataactctcttctccctacccgttccctcaaaaaaaaaaaaggggcggactaaggcttatttatatgccagtaaatcggtaatatggcgatgcagaggctgaacggtaggcgtgaaaaagtacactcacttgagacaactgtcgctaatccgagtactcgatcaatagggggagaaatagattttgtaaatcaccaatcagaaaaaacaacattccgagtagcaattctaaggcttacggaccttaagaaatgtgtaatacagcttagaaaccataagtttgtgttccttgcaattttatcgaattgtaaagagggatccaaactgcgggtgatgcacaacaaaacatagttctgaacataagttaggaagaacatggtacgaaaagatttcactagtcatcgtccttgattcttttcagcagcctagcggcccaccggcgtagtcttctcttcagtgtgaagcccaccacgacaccgactgcgaagctgacggcgctgatcttcgtgcaagttgatagagagacaacacgaccgcaatcccatatggatcatgaaaaacaaaagcttccacaaatctgttgcaataccacccacagccgcgacggctacgggcaaacggctcgccggcgcaggttggcggcgaggggaagatggcagcggaggacggattccggcgacggtgatcaggttgtgaccgagaaaattttggcgcgccgtttcaattcaccgcttcacgcgcgaattgagaggcaagcggatgagttagggcgcagaagctgcgagacagagatacttggagtgggtgggcagggcgaaggcgaagtcgccggcgccatggccgtggccctcggccgccgcagccgcaaatccgcgacccttaccctctcctcctccactaatattactcctactcctatcctacgtggcatgtgtggggtccactcatacaaccaaacattatagtagtaattcaatcagaatcttgattaaacatagatacaaaattcactaaaagaacccttttgacagcggctatcttcccaagggagaacaaggaggcgggccggccgtacggtgcggcgtgcggcgtggacgtacggacgccacaccgtcgccggagcggtagacaccccgccggcagcggcgaggaagtggacgttggattggtgatcacgagtgctccaaaattccaaatactccctaaattagataatttctacaattagttgatttgccttttctatatggacttaaaacttgcatcatcacatgttccatcggtccaagcattgatcaactaacacaacagctagcacagcagcaagcggtggaggaaacgaagtgatcgatttattgtagatatataggcgaggtgatacacaaaagctcgatcagtgacccaaacagcaagaaaggagcattacacaactgaaacaagtaagatcgatatagatacattcgcgccgatctagggagaagctggcgcgggaggcggcgatgtcggtgtagttgaacgaacctaggtgtaattaccagagcagagccgctccggtgaggccgacggcgacgacgagcggcgcgatggaggcgatcatgatcttcttgccgacggcggcacggcgaccgcgtgggtcgtcggagacccagatggccgcgccaacctggcccattccggcgaggaaggaacccacaagagcgaggtggtagtaggtgttaccaccgtaggccggcggtgggtcgcacgcggcggccaggttgatgatcagagagaccgtggcgacgccgaacagccccagcgccgccgcgatcttggaagaagcagcgccgtcgacctccgcttcccggcgagcaatgtcagccatcacctgtgatgtatggatcttcctattattcagaatcaaataaatctaggaaattgagaaggttggagcttggcaattagcagagatgctagaaagatcaagctagagaggagtgttgtgcctgcgtgccttcagttttgccctggtttatatagcggaggggaggtgaggagagatgacgggcatgtggcattctgtcccctgtcgttttctcagtctcatatcttttgactgtcgaatggtctcgctcgtttcttatgtaagaaccggataaaaatttagatactcgtggcacgttttttaaactgttgaacggtacgtttcgtacgaaaactttatatatgaaggttgttctaaaatattaaattaatcaattttttaagtttgtaataattaaaacacaattaatcatacgttatcaacaccttattttatgtgaaacacttaatatttatcttcatttcatcttctatccctacgagcggtttgtttctatctgggaatgatgtcatcggtttgtttctatctgggaatgatgtcattcagatggtacagacttccggacgtttcagatggtttttacataggagatcgtggttagtaccatagaaattgatagcgataggagcaccatattgactgggagactttcctcgaaaaaaggatatcttttataacagcgtgtgatgaattttcacatttcctcaaaaaaaaaaccgcactggactacgattggtgactaatatgttccacatttctctatccccgtcttgatcttttggctaatactccctctatcccaaaatatttgacgccgttgacttttttaaaaatgtttgaccgttcgttttattcaaaaaatttaagtaattattaattctttttctatcatttgatttattgttaaatatacttttatgtatacatatagttttacacatttcacaaaagtttttgaataaaacgaatggtcaaacatgtttaaaaaagtcaacggtgtctaacatttagagaatgagggagtacttccttttatcattttgttgtctttccctatcgccatctttccacctttttctattaattgtccccattgagggacctagctagcgtgtggatcgcttgatacatcccatcgccatctttccatctttttctattaattgtccctattgagggaccttagctagtgtgtggatcgcttgatacatcccagggtcaatttttcatcacaggaatgcgctttacatagcctaccatgcaacgcaactgctgggattttagggattatgggaatggtatctgaagatgtggatactgatagagtcagcagaactaaattaggcagcataacccactttctccggtcctttggatgaaccacacttagggttgaaaacggagcagatagtttctgtccgctccggaggaaaacgaaaacggatacctctcggatcggatatttctcggatagttcggatacggatacgaatacggatattttcttccggatgcgaatacaaatatggtatcggggtttccgtcggatacggataataattcggatgtccggtgaacagtgctattcagatatccgcagaagccatgagacatacctcatttctttataactttatgaccttcaatatacctttttacattttaatagtagttcatctcttaaatctagtccacactattaatattatttaaattttaaaaaatatttataaattatactatattttatataaaatgagctaactatatatgttgatatttttttatattagaagttaagttggttttcgtgttccgaaaaaaaattgttttcgtattcgtgtccgatcatattcgatacttatttgtattcgagataatccgtatttgtttccgtattcgagctatccgtattcatttccatatccagcaaaaaatatgaaaacgaatatggtatgagcattatccgtccgtatccgctccgttttcatccctaaccacactgggctgcaatgtcaaaaaaggaaaaaccacactggactgcgattggttttttttttaaaaaataataattcacccgggagggggagtttccccacctgtattcatttgaaaagggagagtccaaagggtttagatcgtgaggattgctcccatccagcaggtaccacggtactagcccagttccaaatctcagccattcattcagctcgatcggacggtggaaattatgcggtaactcagtacatatttgcccatgaggtggtaccagaatagttagaggggtggaagggtaatgttgtcttttcacgtagggatgcgttttgagtggtgaaactagggtttttacaatccatctcgattcagctctgatccgtgagaggtggcggcggtgctggacgggagcaacgctcggaggacagcggcgaggtggtccttgggaggtggcggcggctgatccgtaggcggcggcggcgaagtgggcggtggcgacagctgattcgtgggaggcggcgagtaggtggtccatgggaggcggcgaggaggtggtggctggtccgcgggctgcggtggtgaggtggtgttggcggcggtgtccggtgcttgggcccgtgtccgcgaggtggcggcggcgatggcgtcggcagcaggtggttcgtggcgggcatccttcttcaacctctggttattctgtagcactgcccacagctcaagcactcaactgttatgttgagaaaacgaaggcagaagagagaaaatgaagctagagctggaaatggctgaccggctttcagacatggaaaattcattcaagaagttgtccaagcagaaaaaagagactgatgacattagaaattggttcataggaatagtagttgtagctgtgttccttctcatgaagctatttgataatatgtactatgcttgccattgttgattttgtacatgtcaattaccagaattaatggatggggatcacccagcatgttgatgtctcagcaaccaatccatgtgaattttgtttatctatctcccattgtctgaaactctaaattacagctttttgagatgggttgtctaacttatccttcagttttagattcttgctaagtcctagttcgttctgtttggctgaaaatttgcagaactctgtttatctatctccctgttatgaaaatagatgcacaacggacacgaattttacatggaaaacccttgcgggaaaaaactacggacgccgaccggcaatgattactacagaggagatgattacaaacgtaggggaatcacaatgggaacgtcaccccttcctgtacggcttacaagagtatatataggggataaaagaaagacctaatagaaactcctactatgaaactaatccgaatatattgtgggcccaaaatttggatcacatatttaacaatctccaccttgagacgaatttcctcttgtagcataaaaacatcaatcaccaaaaatacctcatgtaggtaaaatcaccgcgcgccaaatagtctctaggactatactgtaacaccaaccaagcttgagcaaaactcaaacttagtagcaggaattgtctttgtcatcatatcagctgggttatcatgagtacttatcttgcataccttgacatcatcttcagcaatcacacctcgaataaagtgatatctcacatcaatgtgctttgttctctcatggaacatttgatcctttgtaaggcatattgcactttgactatcacaaaatatattaatgtaagacgtaactccacaaagctcagtgtacaaacctctaagctaaatagcttctttacaagcttcagaaatagccatatactctgcttcagtagtagataaggcatcagttgcttgcaaacttgccttccaactaacagcacatcctccaatagtgaaaacataacctgtgagcgatcttctcctatccaaatctccagcaaaatctgaatccacatagccaacaagtccatctctagatctcccaaactgcaaacaagcactagatgtaccacgtaggtatctgaaaatccattgaacagctttccaatgctctttgccaggattagccatgtatctactgacaacactcaatgcatgtgataagtcaggacgagaacataccatggcatacataagtgaaccaactgcacttgaataaggaactctagacatgtactcaatatcataatctgactgtggacataaatctgaagataatctaaaatgtgcagctaaaggaatactcactggttttgcatcatgcatattgaaacgacgaagaactttttcaatataacctttctgactaagatataaattgccagaatgtctttctctagtaatttccataccgagaattttcttcgctgcacccaaatccttcatctcaaattcactactcaattgtgccttcaactttgctatctctgatttgtcttttgcagcaatcaacatatcatcgacataaagaagcaaatatatagctgaaccatcaacaactttgagataaacacaactatcataattggatcttctaaacttctgagaaagcatgaaagagtcaaatctcttataccactgtctaggtgactgcttcaacccataaagagatttcttcaacctacaaactaggttctcttttccaggaacagcaaaaccttcaggttgctccatataaatgtcctcttctaactccccatgtaaaaatgcagtcttaacatccatttgctttagttcataatcatgcattgcaacaatactgagtacggtgcgaattgaactatgcttcacaacaggggaaaagacatcattgaaatcaatacctaaaatctggctataacctttaacaactaaccttactttgtatcttgcctcatcacttggagatatacattcctttcttttgaagatccacttgcaacggataggtttcttctcctttggcaacttcaccaattcccaagtatgattcttttcaagtgactccatctcatcatgcatagcagtt

SEQ ID NO: 58050 - DNA, 27344 bp, Oryza sativa
ggtgttactaaccgggactaaagatcctaggaccctaacacggcctgacatggaatcaaccgggactaaaaatgaacttgctaaagatcatttttagtcccggtttttaatggaaccgggactagtgtggatttgggtcgaccgaccaaagatggtttctctaccagtgtacgtaagtacaagatactagttaatcagccaattaatcaatacagaattactacatacagtgacatattgcagaatactacaatatacaacatgttcgacattcttttttcagtacaactgcatggccaaaattaaagcgaactctagtacagcacaatccatctgctatctgaatttgggatcagtttcatcagaaatagtgtcatgttgatcgtgacagaggagcactctgcacgccaccatggtctcacccaccttcatccccggcgtcacggtgaatgcaactccatctccttcgccacgaccagcatcggcggcggcggcggcggccacgacgctgtccatgtactccgccgcgtacctgctccctctcctcgcgtacaacatcctgacacttccacggccacaacatcgccggcgcgccgtcaccgccacccgcagcgcccacgccgacctcgccatcgtcgcgaacgccctgtagaaccacgtcctcgggtgcccgcctcgcgacacgaacgccctcacgtccagattatttctgaacatagctgcctccatctctgacgacacggccgctaagtactttgttcgacagaacctcgcgaagctggagttggggtgctccatcaacgcgtccagagggtcacagcatctcatgattcgatcgaagcgagcaagatcgagttcgtcgtcgtcttcagcaccatcatgtactgcaagcattgtccgtgacaggtaagcttccagtgagtacctcttgtatggtgaatgttcgtctgcattgttgggacagcgatgatcaggtgaggaaatcaagctaaagatcagctctgcgaaatcatgcaccgatgtcgatgcaaccttgaacagctccaagactgcactaggcgtcgtcaattttttcaggacaatggagtaatccttatgatggttaactgatggtttgctgctactgatctgtttattcagtctcgaattcgcactcttcagaccatccagctctcttctcaacagcataatgtctgaatctttcttcctcgtctcggcctccagttcctgcaccagcgaccatcgatcattgataagtgacccaacgctgccattccaactgcataagctctgtagagcagtgaccgagtcgagctcgtaggtgatgatctcgtcggcgaaggcaatctttggacgattataagggatatgagctttctgcagcttgatgtaggttgacttgagagctccgatttcctcaaacagtcttgtgataactagcctctgatcatatccgccacaataatctccaaattctgtcttcgtgtcagcaaattcaggcgcggcacaaatctttgtgattttgcagagtttggagaagcctaatacgagtccaggaacattacaggtgctccttgcaactgaacttcttggtgttcttgactccattggggctgattcagtgcaaaccaagaaacaaaagaagaatctttgagacgacatgggagagtatggtaaaattatctacgagaaaatcaatgtaatcgatggtttgaacttgctttacttctctaatttgatagaaagactaacaaacctctgtttatgaccacagaccaaatgcagcaatatctttcattttctgagatgtaaacccaagaggaaaccacagactacatgggcatgatgcaaatcttgtgctccatctccactgttgaacatgaagggtagaagagcaagcatgcatgaagtacctgagagggaggctgggactgaccagtgaagtgctgaattgaattggtgcagagtgaccaagaggatagcctggtttcccccggctaaaattgaaacatttctaagtctgctgctgctgcttgcaagctatgcagagaggaaagcgaaagagcaagcaggagcagtagtacaatgaaggacaagaaatggacatggcagtggcattgggaacaacaaaagcaaaaaggttgcagagacaaggtttttgcgatgcattgtgggcactggaatggatagtgtgtgctgtcccctcccctggtggcccgttgtctcaaagcaaaagtgaaacaaagtggtaaatgaacgtattgagatgatctttcattccaaccaaaccttttccaacatttgactacttcaaaatcaaatttcagacactttccgatatactactagtagctaggtaaatatatatcacttccaacggtgatatcaaataatggactcttttctattgtcataataatacagaaatttaagtgtatgtaaccaaacttctgaagcttccaaccaattaattacatttttttctaaaaatagaaaaaatgtcagctatacacctcaatatactcttgcgtgaaattcatctgtcaattatacatctcaaaatatacttgtataaaaatactagcggtatgcataagcactgactgcacatatgtataaaggtcaggtgcatatatatatatatatatatgctctcaatcaaatgagttagtacttctctctccgttccaaaataaatcaaaatatgattggataagataaatctactcttctagtttgatttattttgaggcggtggtaggatagagttagtgaaatctgagatagcgtcagaccatgttatctgcggtgctaataatgtcatctgcggcggcgacggcgacgtcagaacggcagagcgggcatgttgtgcggttgcgcagccacttgacgacgcaatccttgtgaaacgcgtgcgcgcaccccggcagcatcctccatctcccccgctcgccgccgccgtcgtcgacatcatcctcgctctccgacagacagatgacgcactgctcgttgtcttggtcgtctttaggtcgtagcagcagcctctcgatcagcatgtcgtacttgttattggcgtcgtcgttgcggcggcggatgagtccgaccaccgtggcgatggtgagggcgaggaagcagagggccacgccgatgcaggcgaggaggaagaaaaagatgatgccccacatgagacagtccacgatatcctccgcgtccatgcctgccaatgcactgcacacacactcgactcgatcgatatgtctcgattttcttgtgtacgtacgtatatgtcgatggatcgatcatcgactctgaattggattagcaaaaagtaaatccgattctgacacgtgaccgtcctcctgcgccgcagccacggccacccttttgcttctcctcctcatcatacattcatactcatacatggacagggcctcgtcgcgcctctggaagcagagcatctcacagatcgatctttttttttatccggtgattaattaaagatccaatcaacaggcaataataatatcgtagttgatccatttctttcttgtatgtatgcagatcataacaatatttttatctcatcttaaaaggattaaaaatcaagtccgagctaacaagagatccatatattgtgcgtacagatacctaaaatacactgatgctactattttttttttgaacggaatgctactattttaggatctgcatatatataaagggtgcaacatatatagctgattgatgcttgcaacacattattacgcataaatgcatgggcggcgcagaacacaattcaagtggaattggaaaaacagaaaataaacaatactatcaagatatagttgcgcgatgctgttcttgaaagagctgcccatctggcaagcgttcgggttttccttattcacaggggccctcgccggcagcatcctgtacgccgtgtgcgtgctcctcctctgctgcgtcgatcgccgacgtcgacatgccggtgcgccgccgcctgatccgaagatctggctgccggaccacgcgcaccatcgccggcggcgggatgagtcgtcggagatggagtgcagcatatgcctgggggaactggaggagggggagaggtgctgcacgctggcggcgtgcaggcacgagttccacaaggaatgcatctaccgctggctcgccaaccgcaacacctgccctctctgccgccacatctccctcccccctgcttcatcaccaccacctgcgccgccgcctcaccatgcttctcctcctccttccaatgtactggctgctgctcatgtttagatcatcatctgaagagattttgtttcttaaaataaactaaaaaggtttcttccggcttaatttgttttgaagccaacaaaaaaaaaagaaacgtctggaagaaaaactggaagcactgatggacgattgctcttttacgtgatcatatatgttcaaaaactttactattttgatataataaaagcttagaaaaatacaacttgtgtgtgatatatggcgtcggcagccactcatccatttttgggcgttatgtaaaatttcctgcgcagcgccggcgcccgtccctctcttgcgcacgcgtaattagcaagaggactgctacagtctacagtacaagatatatagttagaaagctacactttaataaacccttctcttttctctacctgcataagcaactaaccaactacgcgtaaaacacaatgtaccaagagataattcaaggaaaatcaatagaaataatttcaattctaggaaaaatctaataaaaaataacaacaaactactcccatagccagaaaattcctacatattcccattgcccctaaaaacaagcaatcaagcgtaggaaaaagcacgcaaagtccttcaatatgactagctaactcaaatcaatgagcaaaactagcctgagaaatcacctctaaaaaatgcttaaaaaccacacgaaaaaccaacaaaaaaaacttgccaatccgattcgccaccacctcaaaaaagcctcaagaatggcccctgcgatttcttcacctcgagttgagttggttttccacaacagcacacaagtcgttgttgaccacacggactgatgaccacatggtgctcaccgcccatgagccatgagggtgagagggggaagggggggagagagggagggagggagatggagagagggggggaggggaagaagaaatacagggataggataagaccaaatacgtggtatactgacatggataagatgtttaagtagatgattatttagtcacatgcatgttcggacgggagactgttctatagtattttcagattagcaatttggaaaagctagatactggtatcccgcgcctagcacccgcgacggtatcgtctccctcattccctagagcacaagcgtaggcatgcggcaacggagcagcgcaggcatgcggcaacggagcagcactggcatcgggcatgcggcagcggaggaagaagggagagaagggagctcactggagaaggcccccgctgcctcgcctcactgcttcgtcggggagcacatcaccggagaagatatgcagcaccacgggtgatgagttccggcatgggactaacgagcctcggcgtggggcgtgggaagacgcagccaccggcgaccagccctggcgtggggcgtgacaacagaggacgcggtcgccggcatcgagccccagcatggggcttagacagtggaggacgggctcgatgtggaggacaaggctagcagtgacaacgtctcggtgaccggctcctgatgcctagtaggaaacacatgatatctggcaggtatcgcgctctggtatcgacgagtatcaagtggtattaacaggtatcaacatctagtaccaatgggtatcagtcaatacctacaagtattacctgatacctgacagaaatcgtatgataccggttaggtatcagaggatatgatgataatggttaaatgccctgatacttaataggtatcaaatcctgatacttaactggtatcattccgtccaaacgagatttattgtatagcagtttagatggtctatctttttctctaatagagagcttgaacaggagatttgggaggtacagttgaagcgatattactacttgataggtggcaaaatttggataagatagggatgcgatacacgttatcataagacccttcaaatgtaaaaattaaaatcatatataaaagtaaattcaaatgttaataaaaaaattagtttatcaaataaaacttaatttgtaataaaatattattgatcaaatatttaaaaatttgaattttaaaattcgtatgtgtcttgttgagtggatcgagcagagggggtaatattttgctcatcacctagacacttgttaagagaatatttgtaagttgtaacaaccaagacgggttagaatatatccccttcatccttaaaaaaaaatataatctatgagaaaatatgacatagtctaacgacgaatctaaacatgtataatctaacaccaattcaacttctcctcgtcggagctacaaaacccctacaggaagctggtgtgggggcatacgccgcaccatgccctagtgggtgggtccacgcctaatactcatatgagcacgtgtatacatggcgatctgactcatcagcgtcagcgtgacagcgtgtacagtacagggatcttctactacgtggagtatatatgtacatgcatgatctagacatacgtatactctagaaagaaattaaggaagagaagagagacgaaaagtcagagttgtgtggtgcggaggtgtacacatgcatgtgtgcgtgccgtgcagacgtggcagtgatccagcatcatcgatctatatgattagaggaatttttgtcactattttcattattgcgacgaccctatccaactgcagccatccatttgttcagtgcatgctctagtatattctcaattactagtctcttcccgtttcttaaagcttcgacattaatgtattcaaccatgtgaaacaaatacaaatcctagtttcttatatttggtatatggagggactatgttatttgcttcatccaaaaaccgacgggtaaaataaatttatttatactacaacacctacatatgctcagagatgataaatttcagctatttttatttgctctatccgtaccaaaatataccaactagtaataaattagatataataagtacattgtgtctaatcccgtatttactatattttcggatggtggaaaaaattattggtaaattatttatgctgatatgtacttattatacggataaattaaatattttaggaaacaaacttgcaagaaaagcttaaaacaaatagtctaaataatttaagtaaaagaacttttctttgagaaaacatatatttagagctgtatagcaaataatctattgcactgacctgatgaacaagcttgaaaaaaaagccttagaattaattaatggttataactgaattttgcacaaataaaaaaaataattacctcctcttattgcttttttcttaggaaaatcgtttatcattaagcaatgtttgtttctcttcttaggtacgtttgaattttgataccccaaacgttagttttgttcattttccattgtcatgccattatgttggattttgaaagactcaatgtgtcagtattttttttaaaaaaagatggtaatagcgttatttctcttcacatataagtttgcatgatctttctcagtgtgcaagttatgtccaactagataaaaccctgcacgtggtgttgcgcgagttttgtatgataatagtataaacaaattttaagatagctagacgacatacccttaaataatttgcatctttgatcaatcattttttaaaaaataaggtgatgatatttaaaaagtaaaattaaggtgagttggcttcataaaagaaaaaacaaaaaggaaggagacaatatagattggtcattcaaaagcaaaataaaaatgatattgctttatgagaaaaaaaagaaataatatggatcatgtattaataaaaataagaaataatttggataatgtattaatcatcaagtgctagaaacagtgggggtgagagaaatgcactactacgaaaacagtttttctttgtgggggaaaaacagtttttacgtgcggaggtggcgctcgtctgcccggaagtgtctgcaaaaataaggatttctctgtgcggacgcgaaaaataaaaatctgaaaaaaaaatcaaaaccctagttgccgccgcagctcgtcatcgtcgtagccgtcaccgccgccattatcgccgtcgccgaatccgggcggcggagggcgggagagaggtgccaccgccggatccgggcggcggagggcgggagaggggcgtcgccgctggatccacgcgggggagggccggagaggggcgccgttgcggggagagcgcggggatggccgccgtccgcctccgctccggccaccacctcctcatcggcggggcggcgtggattcgtgggaccaacggcgctgctcccggccacctcgtcaacggcggcggtcggtgccctgctcctctcgccgttgcccactgccgagccgcccacctaccgccgtacgtgagtgtgtgagaggagaggagagagagcgtgcctggcttagaggataaggataaggaggtgagagagttggaggaaggatattaggatgtaatttttgaagtgttgaggaaaaaatgagggagggtattttcgcgtgcgacggtcttaaaacgcccgcatgcgaaactcaattttcgtgtgcaccctattaagaggttcgcctgcaaaaataggtttatttttgcacggggatccttaagaggctcgcctgcggtcctctcaaggatccgcacgtaaaaataggaggacgattttttccagacgggactagttacggtccgtctgcaatctaaagaggaccctgtacaggaaaatcattttttaagtagtggcggcatcaattatgaagtgaattaattgacagactgaaaggcgcattaaagtacataaaaacgcaattgagatcccctgtagtactgcatttgcagctcactggcatgacatatgggccccatgccagtgagcagtaatacacatgcagtactgcagacgacttgcatccataaaaacgatcaatccacgctttcctgagaatagatctgttgatccataatcataatagaggaaatgccatcttatgaatgaatgaagacggaattcactcgaaattacttcttgaggcaatggttcattgattcctaagaccgtggatagttcttgaggtggatgaatgaagccaggaatttggtgcacatgcatgtgctgattcgtgttccgataaatgtaccacataaaaccatcggacgaatcaagccggggttctagacaagattcaatgtggggctgagatcaagttcagcagggggacaaaataaatcatcagaagcaacagagaacaaaatcaacatcaataatagatgccactatatcaagattgttcttacttgatggaatactccatacccacgtagaaaaaaaaataaaaatgcttgatcgtatttaataagctagataggagtattagataaaaaaacatttagtaatcactattatgatattttttggcccctaagaattttttcattgtaactttgaaacctttaattcctcgccaataatttaatgaaattgcagttctcctgcaatttaaaataaaagttactagcgcttgtttcttttcaacatagttgttgctctgagtaaagataaatggtcaaacgtcacattaagtcaacaattaatggtgttatctattaaaaaatcaagagtaacaatctacaaataaaatgggttgcttgggaagtgtgtgtagcttaactggttatattccttgtggtggaattaccccacccaggtttaagtcctagactttacacgatactactagaaaaacgatttttaccgacgttagctttttaatttttcaagaggacaaaaaaaaaaccctcttataaccatttgcgaaaatagctaaagagcatctagatttaactctgcctgcgaaaatcaattttttcagtcggaccccttaagacgtccgcctgcgaaagtataccttaagtggtccgcctgcgaaagtattttcgcaggcggaaccttatgtggtccgcctgtagagaaaatatctaagtcccatccttatattctcctccaccatccttatcctctccaccactcattttcctcccccttctctctttctctcatcacacgcctgaggagcgtcagcggctccaaggaggtttgccgccggccgtgacaacgactgggtcccaccgccagctgcgatgacgacaacgactccgcctggatccaccgccggctcgcctcgggcacgcggatccgctaccggccggtctcgaggaggggaggggaggccgcggcttggctgctccctctcttggcgatgatggtggctcaatgacgaggagtggagcgcgtcggccgtgaggaggaggtgaggcggtggttcaacttctccctctcctggcctggcgacggcaaagatgaggagggccagcaatggcttggtgatgaggaggggaggcggcagtcgtgctccaatccccccttcctcctagatcctgccggcggtagaggcgagctagccagcagtggcggcgctctcctcgggcagtcgggcagcagcggcggacggcggacggacggacggacggcggacggagggggaagggctagatggggaggccggcatcggcgccagcgagcaggggtggtggcggcggatttttttttgttcgctgaaaatatttttgtaggcaggtggatctaacgtctgtgaaaatcatttattttcgtaggcctttgcttacaagcggtcctttcccccacttgaaaaaattattttttggcagcctaggaaaatggttttcctagtagtgtgggtgctcatctttatggctaattattctttcagtgctaggcgacgtactcgtcaacagcgagacgcctgcgatgacttcattaatttcaaaatatatcggtccagtctttcggatgtgctcataggaatagggtgtacgtgtctacgtttgtaaaggtgaatatacgctcgttgtgagtttctgcgtttgtattgtgtttataaaaaatgggttgcttggtttaattggatgaatctgataagtaattggtattttcgttgattttgttggaaggaataggacatgtaacgattcgtgttgtatgtgacaccacgacgctgttgccattgcaacgtaaggtgtacattcaccagcttccctttccgttttcgagcagcaaattccaaatgtaattccttttgtcacacgcaggcaacacaacgcatgaactccacaaatcgtgtgcagataattaattttggacaaagacatttcttggaagtggcacagatttttttcactgtcatgaaaggcttgattgatgcaaactaattgagccgtcatcggctatctgtacattatccgtacagctgccaagtttgtattgatcggttttcctcgaggttaatttgtaacttgtatgtttttcttctagtaacttaagtaattatttttaaatctaaggtcaatatgcataacaacatattcagaaaaacttatgaacaagctgattgttcattggtaaaatatagatatgccgatgtcaataaaaaccgacgatgcctgaccgaaacaaatactacatgtctacatccatgctaaaattaaataagttcacttctatacatgaatttgactatattcatatttatgtaaaaaataaatttatttttgaatggaggaaataagtatatacggtgataattgaataccgctcaccaaagatccagctagtagcacacggataaatggctgcaagccaccaaccatttccggtggtccaatacctgaagaacagccagcccattgatgagtcagcaaaggatcagatcgtgagagatgagccaatgccatgtatttgagttactccaaaccaaaacacaccatcacatggaaaaagtaattaatctaacaaatgcctcaattaacattggttatgcagaaaataaagctgcagttaacggaatcagattaaagaaggaaacaactgctcattttctgtaagacagcatcacggccttcagatctataaataggattaggcaaggtgattagtgatacattatgtgctgtacctgtttcaagaacacaatgatgagctgtaccatcatcaattgtgaaataattaattaaattatcattaagccccaaaccgagccaagccaagccaaatgaatgattgctgtggtgaagggcgacgactagtcagggatgagtcggatggatatgctctttatgtgatgcggtgcccaggaaacgcggcccaaccaaatcagggtcattaacgtcaaatcattctctgctaataatgcaaggcaccattgtttcttctccaactctctccctggcggctgcctcctctcctcttcttgctcggttccccctgtataaaagagaaccccgtcttctcgctctcctcgcatccactccacatactaccactcaaaaactctctctctctacccaaacaggttttgagaaagaagtggaggacagatccaaaaagttcaccttttgattatccaaacaagtttggagtttgttacctgaatctcctcttcttcctgtcaccggaaggtatgcagttcctctctccatatcatcttctagcgtttctttctacagattcttgattgctcgcttttttccattattctcttttgctccaacgtaggggtagggccacatcagttggacaagtagaaattgatggcacatcaattgagtagatgcggaaatttctggtttttagttaaagtttagaccatgccgatgccaaagtgctgccgtttaatcgaatacaacgatatatactcttgcaatggcatgtgtcatgaggtgtttgggtttggcgaggctcagttttcattgaatttcccctccttcccatgtggccgtatcaagcctaatctttgaaaaatattcacttcatgtggatgcggaatcactagatgcagcttgactccatgcaaatcctaactcctgccatgtgcccatgtgcctgtcccttatcctgatttgcatctgaattcatttgctcagtaatttgcttgttcagtgcctaatccgatagacgtccaaacaaagttttaattaggagcagaagatccagcaatgttattttttctgaatttgtaatgtcttggtttctgaattcgtaattgactatttttattaatcacctttctgaacctgaacgaaagatgcataatgattcacatcggttgcaaatttactgaatatttcctcttatttctagtgtgttattcatagagttccgaaactcaatttcccttttttaaaaaagcttctgatttaccattccagatttctgataagtacttagttaaagttccttattatattaattatctatattatctattacacaacacgttgaactcatgtaagttctgattgattatagggaacacttatattatataagtagtaggtataattatataaaaatgcagttagtactacaataagctttcaaaattcttcgtagtgacttttgtttggttaaagttcttacagacttccagattattatacgtaccttgttagcgacattcaattactgaatctgatgcctggttttgtttgtgcagggaaattgataaaaaaaaagcagtgaaagcctcaaggaatgctgaaagatgtgcttgcatagaagaaattttccgtgtgagataaagcagattgctggttcactagtgctactgatctgctcaagtcttgatgtgagtgatcaactttcctgcactaattctacaccatttagactccgaaacgacgatgatataagaatgttgttctccattcatgatcatgaccttggggaggatggctaaagaattgcagtccatctgattggtggtcaaaacatagtgctgagatttatatctttgtgggcatggagagtagagggaagatactaatggagaggtatgagttgggcagattgttggggaaaggaacatttggcaaggtgcactatgcaaggaatctggagtcaaaccagagtgtggccataaagatgatggacaaacagcaggtgttgaaggtcgggctttcggagcagatcagacgtgagatcacaaccatgcggttggtggctcataagaacattgttcagcttcatgaggtcatggcaacacggaacaagatctactttgtgatggagtatgtgaaaggtggtgagctatttgaaaaggttgcaaagcgtggaaagcttacagaggttgttgcacataagtacttccagcaactcattagtgcagtggattactgccacagtcgaggtgtgtatcaccgggacttgaagcctgaaaacctgctgttggatgagaatgagaacctgaaagtctcagactttggactgagtgcgctttcagagtcgaagaggcaagatggcttactccataccacctgtggaacacctgcatatgtagctccagaggtgatcagcaagataggatatgatggtgcaaagtcagatatttggtcttgtggtgttatcctgtttgttcttgttgctggttaccttcctttccagggcccaaacttgatggaaatgtatcggaagatacaacatggtgaattcaggtgccccggttggttttcacgcaaacttcagaagttgttgtacaagatcatggaccccaacccaagcacaaggatttcaatccagaagataaaggagtctacctggttccggaaaggtcctgaggagaatcgtattttgaaggaaagaactttgaatgaaaacaccaccaaaaatgttgctctggtgcttggtgtgagacgcaagaaaaatgctcatgaagatgtgaagcccatgtcagtgacaaacttaaatgcctttgaaattatctctttctccaaggggtttgatctctctggcatgttcattgtaaaggaatggagaaatgaggcaaggttcacttcagataaatctgcctcaaccataatctcaaagctagaagatgtagcaaaggcgctaaatctcagggtaaggaagaaagacaatggtgtagtgaagatgcaagggaggaaggagggaaggaatggtgttcttcagtttgacatagagatatttgaggttaccacttcctatcatatcatcgagatgaaacaaacaagtggcgattcattggagtaccgacagctactggaggagggcatccggccagctctgaaggacattgtcttggcctggcatggagatgaatagcagcagtcgcaagagtagattttgatgtctcaagcatttagtttccgctcctcaaattcattaggttttagctcaaatgaatttatttgtcttgcctatgttctttttagcatctatgtttttgtatctggagagttcatgttgaggcaatctatgcacaatttagatggagtctgtcgagagtaattttatgagaagttgagctgcaatataaaagttggctttgagcctttcaagctttcttcatatattcgtccttgtcctgtcataaagctatgcttgggtgcaatgttgtgacaccattagcaaggttactgcagcatgaagtatgcaattcttggtattcaccagtcgctcaagaatttctagagtttttaactttttattaccaacttgttgacgaaaattctcatatcaatagtgctacagaggtataccttatcagctattgaacataagtctttatcaaacaaataaaagaaaaaccgaagcgacttctcattctgcggacgaacaagataacacgagtgcgcaatcctacaagatagtagcaggtaggcaacgaaataccaaaaagctgcagtttcattggaaggccaaaaaaaagatttttttttaagaataaggatatccttgtatttgccaaatagccacagagagcgaagttattggtaaacaaaagaaaatataatacacatgttgaaaaatctgaacaaaagctatttaaacactagttgtgaggaaaataaattgtccctgtcactgaggatagatccaacatccaagagctcatttttcacggtactaattgatcacccaacatctttccaagatgttaataatactgctaatcagactgtccaaatgtcgactggatttggttaatctcaacaacccaatcgtagctgtgacaagttgtacatatgacaaagactacactcttcataatttcatattgcaacttgcgaatttcccacctagatgcttttgtcctttgtaagatttgagaatttttttttgctttgagaaataatactgagatatcattatatcaatgatagattcctgataagatcgctgtaaattagagagagggagaaaaaaaggttttaagataagtcatgttgtcatgcaaaattcagttctagtgttctactactatacatttatatatctttcagatgttgccagtttatatacattagtgtttgtcttgataggatatgttaaaaaaaagtctggccgacaatatgtgatgacgatgaggtaatcctttatagctagtaaagcagaacagagggaatagtagtctgaatttgcaagagatggggaaaaaccttgacctgctctgctgtcctgtcaccttgaccttattatcctcttggagaggagatggaagaaggaactaggctttgatctgtacagcttgcgtgccattgatctctgcaacgcggagacaccgccaccctgagtggtgtatacctggccggacctcgacatacctcggtcatggttgccgtttcagccgaagctcatcaacctcggctctggcagattttgtgccgtcaagatcttcacttctggtggttactacaacgactctgatgatgacatgattcactctgattttgctgcggattttgctgttttcactggcctgcagatgctgcgtccccatggtaaagatgatccaagacaggttcggatgatcgagcacaagtccatgtattagtacattttcaacgcctataacattgaatttgttctctaagaaactaatttcgagtttttatagatgagaattggtgtattgaaagtaatattatttttctatgaatcaatatgattttctttctatggaaatctatttatgatgcacattaattaatttccggtggactcacagactcacagtagcctgtaggctgtaggagagtactgactactcactactcagtggagtcggaggctgacgattttcttttcctcttgcagacgcttttacaagtggcattagtactactacgcacctagacacccaacaggttaattcagaaacagcaacgggcaagctactttgaatcgaagatgaacaaagtaagaagcctatattgaagtagtataattttaaaataaaacgttactgtccaagcatcatctgagaaaactaggttacagtccagccattttattcaaaacattatctgttgcaaggaggaaattaaaatgaaatttgcaagtggagtagtagactggggcccccgcgtcgccctcccctgggcggctcgggaggcgacgcgcccgccgccgccttcctctccccgcctcctcctccgcctcgccgccgcctgagcgggcgccggcaaagccgcgtgccgcaaggacggcggcggcagggcctcgtctcacccacattgcactcagaggccgggggagctgtgtgtggcggcaacggtggtggccagatccgcgccgtgtccggccagatccggcaggggggtggccggcggcggcggctgacggtggtggcggcggcggcagcgctggtggcggatatggcggcgaaggtgatggtgatggcgacgacgacggcgggccgcggcgcgtgtcgcgacgccggccgggctcgtcaaggacctcgctgccacgagacctctggcgcagcaccctcgtcgacgctccctccacgacgccgatgacccgcgcggcgcggatggcggctgtggcggcggcggtggcggctggcgacggtggcgcctgtggcggtgatggttggcaggccatcacgaccgaaggggctgacggtgtgtcgtcgtcggcggcagcatgtggaggcgaggaaggagtctggcggcggggaaggagaccaggtgtaggcgtgacgttgacggtgggaagatctgtggcagtggcctaggccggatcgctgaagggacaatattgtcgaccggcgatgatccttcttgtgcggattggttgtgggggtttggacagggaatcgctagcaaaagcctcgccgagccgtttggccggctgatgacggcgacaccttttggcgtcgttcccctccctgaaggcgtcgttttagcgtacccctctcctttccctaccattctccaggtgaaaaccttgcttcggcttccgaacgagcggtggcggcgatccacgtcgcgtcctccttgggggcaccgctttggagaaacttcttcgtgcaaggatgtcgttgatggtctatgcatttgctttgaagctttttagccctagcttttgatgaggccttctatttctagctccaccttttgttttgcggtggacgacctcgctctttttttgattttgttaggtggagtcggagctgctttgtccgagtgacgaagctgggcaacgatgacacgctgcattttctttctaggggttttgttgttggccgtgaatagattgtggcgcttaggcagctttggttgatgttcatcttgggaagtcgaaaccacttgatcatttgcagcatctaggttccgatggtgcatccggtttgaagtcgaagctgctgtgtcgcttggcggcaagcttggcaacgatgacacggttgaaaagtcagaaccccctatgctgttttggtcaaccttggtaacgacatcctacgttgggctccgtcagtggtttcagctgttagtgagttctggcgtgtgctgtgtaactgttcagccagtcggtggttggtttttcttttcttgtaacccgtctagggtttttactactacttattgaaaatataattggcagctctcctgccggtttagttttttttttaaaaaaaaaagtagagtagtagacttcacctatcgtgcagagttggaaaaggacggcccattgggcccaataatgaggagagttatgttaatcggaccaaagaccgcaggttcgccttcccctagcgccggtcgtctcggactgcacctccgccgccgcccgccgtcgatctccagctccactgcatacaatactacgtacctccataatatttggtgtaaactccagggaaggaatttctgctggtcggtaggtatgaggttaatttcttctttaatttctctctccatttattattgatcttctcgttgctagctgtgtttgcatggtgtgtctaatctggattagaatcaggccggataaataagtatcgtctcggcgtttggagcagatacgtaccatgggacgacgacgatttgtgaacctggtggtgcagggcgccggtggactctattctctgcgccgcatacccgcgaatcgtctcttctacccatcaacaagagcagctgaagaagcaacggcaaagtcacaagaatcattcatggaggagcacggtggcaggaagcatccaggcctccacaccatggagatgttggagaagcttccccgttcgacgttcgccttcgagccggcccccgtggatcgctaccatcttaggtctctcgacttcgcctgtctcctcggccacgagagcaggatgctcactgcagacaacaggggaaacaccgtcgtcttcgacgccgactcctcctccgtcctcgccttccccaacctcatttctcccaagaggtataacgccatatccctctccattatcaacaacgatggcagcaacaacaacaacgggttggaaccaccgccggaggacggcctctacgtgatgacccggagtcccgacgtccacagaatcaaggatggttgctttgaggtgctcaactactcttcttcctctgccgatttccgtgagatgacccctcattgggtttctctgccaccaccgcccttcgccggctgcatgaacgccgaaattacctcctacacggtggttcacggcaccaccatctacatttcttgcaataagccaatccattctacttatgccttcgacacggttagccatgagtggcgccggctgggctcctggacaatgccattccatggcagagctgagtatgtgccggagctcaacctctggtttggactgtctgctcgccacccctacagcttatctgcttttgatctcctctccgacgactcatccgtcgcagcaaaaccacccacggtgcaccatacttgggtggaccttgacatacctcagtcctggttgccctggaacattcatctcatcaacctcgggtgtggcaggttttgcatcgccaagtgtcgaaacatgaattcggcaataataaaaggggtagcgcacgagacctaaaagtggatggatgcagagacaaaggatttagacaggttcaggccctctcaatgagaggtaataccctactcctgtttggggatttgaatccgccgggtgtattatagatctgacaatcatatgtgctcctgccccctagagggcctccttcccaccttatataggatgggggcaggattacaagatagaaaccttaaccaatacggtatcggtttcctaaatctattttacaatattattaaatcaggactttaggccgctccataatataaaaggaaacgtaatacccaagtcatgattcgttacatattccatagatataagctatcccctatgactagtcggataaccatgccgtgtgggtatggggtacccataatctccacagtagcccctgagaccttcatagtcgaaaagataatgttctctcgaactagattactccaaagccgagtgcttcaatcatctttgccatggtctcccgagtacttttaccaaatctgaagactgtgtagggctggaaaataaagtcaggtgcatcgactagatgcacctaataggtgtgtggttaattgaacaaaccaagcatatagtcaaggaaaataatccaaccaactgagtgatttcgataatcgtagtcaaccaagagacttgatattaatatatagcatatgcggtgtgaatcccccaaataacatgatccatgtgatataccgactgcgttgtaaaaattgatgcgagcaacctaaagttgactacattgaaaattcacatagcaaaatagctataaaaagagcttgatgttgtgaataaagaaacttccaaagtattgggcatacaccatgcgcacactgctttaacaaatgtgcttaagtccctaaaagacacatgatttaaccacacctggaagtatatggcatatgtggtgtaacatccgagtaaataaactcataaggatttaccaaccgtatggaaaatgaccaaaatatataatcagcctaagccataatattggtcaataaaaatgcacacttacgtggcaaaaggcaatgatattgtatccaatcaattgctttataaacccaaacagcgccatgactatataaaaaagtcagcggggcagctatataaagctttactgtttgacactttttaagatgcattgtaccaactcctaaaaagttgagtaactgtggtataaaaggattttaaggtattgagcacttgatcacccgcactttagcctaagcaaaaagtgcctaagtccctaaaagaacgtgacagggcacacctgaaaatatgggctgcagacatattaggcctaggccaaaaaatatgccttcaacaccctttaaaggatggcgcatgtaacatgctcccgagtaataaatcttccgggtgatatagaccaagtgtagctcataagaatagcttctgatctgagtgattatctcttatggggtactccaaaatagatataaaaattgaatcccgactggcgcaagtagtcggttgatagcccttgtggggaataatgaatagtccagccgttaagcatatgaaatcgactcgtgaccataaattcatgttgaatgtatccggaacaagtccaaattgaagatatgatccttgtgattgagttgataagcccctaagcatatatggcttgtccttctgtcatagtcaaaattgtccattggcaatagctgatgcagtcgacatgaaggcaagatgatgaacatggggatgatatcgcccgtcagaggtgacaaaaatgttggtggtggtaaaaacggtgacaccaatcaaagatgatgaagtcgcatagccatggaggcgaagaaaccagtcggcagcagttaggtcagctagcagtgaagatgaagacgcccaacaacaacgacagagtagtcggtggcgacgaaagcaagccgacgatgaagacgtagacacgtatcgatggtgatggcgaaatccaccaattatgaagatgaagaaaatagtcggcgatggcaaacgcatccgacggtaatgatgattagcggcaacagagatagccggctatgatgacgaagttgcccatcaacggcagcagagtaggctatgttgaagagacttgacaggatgttgatgaagataaccatgtcgttgatccagtcaatagtagtgtagcagtccatgataacgatgagatcctctatcggcagttgcatagtaggccaaccgtgaagacgaaataacaagtcggcgatgaaagtcggtgatgacaaaagcaaccgacggcgaggacgtagtcaccccttagcaacggcggagacgtcagggccgatgaagtaaacgtgctggtgatgatgtcagtgacaacaatccatcaaaccattgagaagatatcgaagcttgagaagtttccttgatgtgagcgtgtgcataaagaaaactgatgcaatgcttcttgatttacgaagatgactgtagaacttagtgttacagctgttgtagatgcttcacttggaggaaagtagatgttgttgtccaactcgtctaaaccgagctgattggttgataactccaaactcccgaacatgtagattaaatcttgaacttgatacttgagaattttggagtagattatggcagcgctgagaagccaaaattgtcggtgaaataattgaagttgctgaagtagaacatctgctccgaagcaaagatgaagacaatgactcctggataaattgattgcttcagcttgtcgaattttgagagtcttgtatttgtgtagctcccgactctttggttaattgggaaacaactgaacatagagtcgagaactgtagcttcttgtcatcgagtagtcatcacttgagtgaagatacatgttgaagatgtccgagtagaattcttgaaaattggaaaaccacttgttgtaataatataacacgacatcatagttgataatgcatgccgagatgtcgaagctcctatagacgtcatggctggtgaaatagcaaaacttgcgaagtagcggcaattgagtttgccgatgccgaagataataaagatgaagtcgctccaccatggtgacaaagttgcaaagccgtgataaagtgaacacgagtcagtggcaacagaagaaaaccggtggcaaagacgtgtagttgtgaagatagatactccagtcggcggcggcataaccagtcggcgacggaagacgatgatgtccattagtagtggtagcggtataaaccagacatagaggcgagggcactagtcagcaacagacgagacaactagtgatgaagacgataaggccaatcaacactggcagaatcatgcagccatgggagtgaagaaactagtcggcagtagacgtagatagcttgtgttgaagatgatgacgcctattagcggtgatggcgacgtagccagccgtgaagaagatagcatcagttggcgtcataataggccagacgtgcaggcggaaacaccagtcggcggcggacgaggcggccggtcggtgaagaggtagacgcccaacaacggcggcataataggccagccgtgcaggcggaaacaccagtcggcggtgaacaaggtggctggtcggtgaagacgtagacgcccaacaacggcggcataataggccagccgtgcaggcggaaacaccagtcggtggcggacgaggcggccggtcggtgaagatgtagacgcccaacaacagcggcataataggccgaccgtgcaggcggtgacaccagtcgacggcagacgaggcggccggtcggtgaagatgtagacgcccaacaatagcggcataataggccagctatgcaggcggtgacaccagtcggcggcggcgaaagcaaaccggcagtgaagatgtagacgcctaacaacggtgttgtgaccaaccaaccgtataggcgaagacaccagtcggcggcgacgacggcaagccggtggtgatgttctgactgatccattcctggagcgtaagagataagcttaaagccataaatcccttttatgcatatctggatttggatcctacagaacaaacatataggatgagtagtatctgatgtaaatataatacttgagaaaaatgcaagtattttaaaatgtttataaatatgtatttctcctcttgtcaattttgatttccccgagcagatgactccttacgtttaaacactctgcctgactagtcatagcccccaagcaccgggagttggcctaggcacttcccaaacatgcatataagtgacaagagttcgtcattaatggaacaaagtttcacgaatcagtatttactactcgggtacttttgcaattgtaaagagcagaaaataaatttatcttatctccatgcttttgatttattctgattaatacttagcaccttgcgttactcggtccatataacgagcccccgggtgctaggaatcggcccaaaggcaactatccatcgacaaaccaaacggaaagcatacgaagatagaactccataactcgataggcacttttgtactcagattatgtcgcaagcaatcaagataaatattatgaaaaattgtttaaaaaatatgatataacatctgtagcccccgactcactagtcaacggcaaaccagttgatgtagtgaggcagaggaaaaggaaaatatcatataaagaagaaaattaattatgacttagctttctagtctttcccttggtgacgaccgaggtggccgatgtgggaacaaagtcatccattaatagcaatgaaaacaccagccatagaagcagcttgaggcaactgacgatgaaagtgaagatgcccatcaacggcggcataataggccagcagtgcagacggaaacaccagtcggcggcggcgaaagccagccagtcggtgaagacgtggacgcccgtgaacggtggtgtgaccaaccaaccatatagacgagaacactagtcggcggcggcgaaggccagccggtcggtgaagtcgtagacacccaacagtggcggcataataggccagccgtgcaggcgagggcaccagtcggcagcggacgaggcggccggtcggtgaagatgttagttggcaacagcaaaggtagccgacacgggtacatacaaaataaatcaatgaacagatcatctgcttagtaccacgtaaaaaaatataggtataaagaagcttgtgcatgtatgtttgcatatatcaatgcatatacacggcttgcatatattgattaattagccaactaatctcctgtggcatgaacgctagacacatccacacatcacccgacaggtcctgccatgcgctcgcacagatcgcaggtccgagtccagatcaaatccccgtcagaagcttcttgagatggggatcggacacgttcgactagtggtgcatgcaaaataataaaccacagatcaaatagagattagtagcaaaaagaaataaaaaagtatagatgattatggatgttaatcgatgcatgtatgtttgcatgtagatcgatgtgtagaagaagtcggtgtgtcagccagcttgccaggaaaagcattgattagctattaaaagaaaacagatgctttacgatctctatgcatagcgttattaggtaaattgtgcatcttctccatagcttgcatgcatgctcctgtttgcacacgctggctgtgcatgcatgccgccatgaacgttccagtggacatgtgcttgtttgattcgtaaatcaacaaatgcacgaatttgcttctggtcgtcgggtgttcctatgccgaacctgcggcatctccatctgcaaggaaaggagcactcggacacggctaggcgccaaagtaggcgacggcgatggctgtgtctcaattttagccagaacgtgaaaataataaaaataacagtagattaaaaaatcaatctcataaaaataagattggaacgacaaacccgattgaagattagagccactaaaatcaataagattgatctcagcgtttcttctgaagttgattccatcgcacttttcgacgggtaattcgacgcaacccctacctggcgcgccaactgtcgaaacatgaattcggcaataataaaaggggtagcgcacgagacctaaaagtggatggatgcagagacaaaggatttagacaggttcaggccctctcaatgagaggtaataccctactcctgtttggggatttgaatccaccgggtgtattatagatctgacaatcatatgtgctcctgccccctagagggcctcctgcccaccttatataggatgggggcaggattacaagatagaaaccttaaccaatacggtatcggtttcctaaatctattttacaatattatcaaatcaggactttaggccgctccataatataaaaggaaacgtaatacccaagtcatgatttgttacatattccatagatataagctatcccctatgactagtcggataaccatgccgtgtgggtatggggtacccataatctccacaccaagatgttccattctattttgggtgatcgcacattttgttcctactctgacagtgacgatggcacaattgaagactctgacccaattcatgggagtttcgctatcttcactggccttcacatggttcgccctcgtg

SEQ ID NO: 58051 - DNA, 2369 bp, Oryza sativa
aaccccctgtggaaggcagctacgtctgagctaaacttggatatggaagtcttctttcgtttagggtgaagtaagaccaagctcatgagcttattatcctaggtcggaacaaattagttgatagtgataggatcccctttttgacgtccccatgcccccccccccccccgtgtggtgtggcggcatggggatgtcaaaaggaaagggatggagtttttctcgcttttggcgtagcaggcctccctttgggaggcccgtgcgacgggctattagctcagtggtagagcgcgcccctgataattgcgtcgttgtgcctgggctgtgagggctctcagccacatggatagttcaatgtgctcatcagcgcctgacccgaagatgtggatcatccaaggcacattagcatggcgtactcctcctgtttgaatcggagtttgaaaccaaacaaacttctcctcaggaggatagatggggcgattcaggtgagatcccatgtagatctaactttctattcactcgtgggatccgggcagtccggggggggcactacggctcctctcttctcaagaatccatacatcccttatcagtgtatggagagctatctctcgagcacaggttgaggttcatcctcaatgggaaaatggagcacctaacaacgcatcttcacagaccaagaactacgagatcaccctttcattctggggtgacggagggatcgtaccattcgagcctttttttcatgcttttcccggcggtctggagaaagcagcaatcaataggacttccctaatcctcccttcctgaaaggaagaacgtgaaattctttttcctttccgcagggaccaggaggttggatctagccataagaggaatgcttggtataaataagccacttcttggtcttcgactccctaagtcactacgagcgccctcgatcagtgcaatgggatgtggctatttatctatctcttgactcgaaatgggagcagagcaggtttgaaaaaggatcttagagtgtctagggttgggccaggagggtctcttaacgccttcctttttctgcccatcggagttatttcccaaggacttgccatggtaagggggagaaggggaagaagcacacttgaagagcgcagtacaacggagagttgtatgctgcgttcggaaggatgaatcgctcccgaaaaggagtctattgattctctcccaattggttggatcgtaggggcgatgatttacttcacgggcgaggtctctggttcaagtccaggatggcccagctgcgccagggaaaagaatagaagaaacatctgactctttcatgcatactccacttggctcggggggatatagctcagttggtagaactccgctcttgcaattgggtcgttgcgattacgggttggctgtctaattgtccaggcggtaatggtagtatcttgtacctgaaccggtggctcactttttctaagtaatggggaagaggactgaaacatgccactgaaagactctactgagacaaaaagatgggctgtcaaaaaggtagaggaggtaggatgggcagttggtcagatctagtatggatcgtacatggacgatagttggagtcggcggctctcctaggcttccctcatctgggatccctggggaagaggatcaagttggcccttgcgaatagcttgatgcactatctcccttcaaccctttgagcgaaatgtggcaaaaggaaggaaaatccatggaccgaccccattatctccaccccgtaggaactacgagatcaccccaaggacgccttcggcgtccaggggtcacggaccgaccatagaccctgttcaataagtggaacacattagccatccgctctccggttgggcagtaagggtcggagaagggcaatcactcgttcttaaaaccagcattcttaagtttaagatcaaagagtcgggcggaaaaaggggagagctccccattcctggttctcctgtagctggattccccggaactacaagaatccttagaatgggattccaactcagcaccttttgttttgagattttgagaagagttgctctttggagagcacagtacgatgaaagttgtaagctgtgttcgggggggagttattgtctatcgttggcctctatggtagaacccgtcggggaggcctgagaggcggtggtttaccctgtggcggatgtcagcggttcgagtccgcttatctccagcccgtgaacttagcggatactatgatagcaccgaattttgccaattcggcagttcgatctatgatttcgcattcatggacgttgataagatccttccatttagtagcaccttaggatggcatagccttaacgttaatgg

SEQ ID NO: 58052 - DNA, 1069 bp, Oryza sativa
attcccttcccaggcgttacactattcaaggaattattgtaagtctttcttcgtgaacattaatctcttttgtttcaattaataattaataatgctagtttcaaattgattttgatgtcaggattattgggcaatcttacaagagaaggataacacttggcaaacctttgaaaaggttgaacattaaatcttgttcacattagttttattccaggtgttgcatcataagcaatgtagattacaccttgcaattaactgaagagctttatgttaactttttttaggttgttactggaacttccactaaattgattgcatatcttccacaggtacataaattattatttttccacagattttattttgtacaggtacagacttcttttcgtggggctgtgtcattacttaattatatatgtatacttttacagttttggagggatacacgatattataaacatgagtactatgacatcgtcagggaacccttaaaaaaggtatgtcttagtcactacaaaactttttaatatattgcgtttattatttttgtatttactgtcatgtttatggatgaaacattgaaactacgagcctcaagaaatcaacacaattttgaggtgactgtagcatttccttgatcaacatagaaaacatgtccagcaaaatgtaggtcttatatttactaacaatcaaactagaataaatagaaaacaaacatgacctggtgtaataatagcgtttaccatgttgttttttgtataaaaaatgattttcagctgtcctatttatgcaaatttcttgacatgatgacctatataatccaaatacaaatctcaaatatcgtgagaatgagtttatggtcctcatttctaatatatgaattttactcaaaactatttccctaaaattgttatttgggatcacaggactgttgtttcattggcacgggttggaaaacagaatatcataaaacaatgtgatcgatcatctatagttatctgaaaagcgttcatttgttgtgttttttgtggtagtctatgactctgtggattagatgtgacgtacatgg

SEQ ID NO: 58053 - DNA, 1639 bp, Oryza sativa
agtcgctggaatcaatcaacatgcagagtctcttcgattgtgtctgtagagttgatcggacggcatacacggcgcccgatatttatctctccgatcgggcgaccgacatatagttgcttccaaacaaacaactaacaacttattctatatcggcttattataatccaccttatagtaatatgactcaataacctagattacaataatcttaaactgagacaaacaggaccaaagtcgatggcttctctaggaagccaaccgggagagtccacggccacgctccgttccggctgaacgaatattaaagtacagacaaaggatgtgttcgtaagtgctccttcccaactcccttcgcagttttttatgcgcacgcttcccaaactgctaaacggtgtattttttaaaaaaagtttctatgcgaaagttgcttaaaaaatcatattgatccatttttgaaaaaaaatagctaatacttaattaatcacatgctagtagactactccattttctatgcgcactgttccggttgggaacaacaagcagcgaacagagccaaatttatactttctactaggtaattctagcaattattaaaatttaaaactcaatgtacaagtatgttgtatcattatccattagcaattattatttagatcatctgaaacaacaagatcatctaaaatataatattgtagacttccatatgaggcaccatggtgtccgggcaacaaggtatgaaatacacaaatacactaaaaaattttcaaattgtgagtatatacctagacataagaatttgattcatacatacctagtaacaaaaataactcaaattcaactttatttcgcgaagtgagcgtagctcaactggttaggttctttgtggtggaaccagcccacccgggttcaaattctagatttgacacgggtgctcgcatttacggctaattattctttcagtggtaggcgacgtacccgtcgacagcgaggcgcctgtggtgactttgtcaatcacaagacatgccggctcagtctttcggaggtgctcataggggtagggtgtgcgtgtgtgcgttcataggggtgagtgtgcgcatgttgtgagcgcctgcgtttgtactaagtttctcaaaaaaaaattcaactttatttcacaatccattattgcatacctaactaattatatgtttggatgctatatatctagaatcaaaatctaaccaaaagatgttcaaattcagttcaaacaagtttgaactcgttagtaaataagttaatgttcatacctaaacattttaaaaaaaatcatactcatttgaattaagtatatactcaatttgaatcttggtgcccgggcaccatgaagccccagctaattttactatgtatatatgtgtgtgtgtcaaatcatcttcctcacatcatttttaaaatatttcaatattcatcatttctataatatttaacgtatattcatccatttatttcacaccaaagcgcgggatatcacctaataaataagaaagttattaacgtatgatttattaagtttaattattttaaacttttaaaaaatatctaatatttgaaataaattcccatatagaaagttttcacacgtaatacaccatttagtatt

SEQ ID NO: 58054 - DNA, 1588 bp, Oryza sativa
cccaccggtcaaacccgcctactaactccccccaccacccacctcttctcagctctcgtcccaggatggtgcagtaacacgacgaccactgtgcagtaacgttgtgtcttacgtgcagtaatggcgttaaaatatagttgaaatatagtcatgacggatctacttttgataagctctttttttctaacatcatggtgcaaacggttttaaaaaaccttacatcacttgggagatattgttcttcaaagcttgacttttttgcaatttgtctctctacaagtagtaatactatactattacttgttattacttgtctgttgtacgttactataatcacatcacgatgttactacactgcgttttactatatttttgggtagtgttactgcataaacacgtggtaacgtgtaccttccgtgcagtaacacttttacttttgtgcagtaacaagtatatggttagcatctgagacttttaacctatatatttttgtttcaattcctaatttactgtaattcaccacaatattactgtcacatcttacacatgcagtaacgctatattggatggaggagaccaattttcttgagaagagggaggaagaacggttcttgaggaggggagtacatagatgcatcttgaagtttaatcctccacatgcagtaacactataacatcatggtggaaacggttttaaaaaataatacatatcttgtgatatattgcttttcaaagattgacattttgaactttagccctccacatgcagtaacagaatgtgtaatttacgtacagtaataggggtatatatatgcagtaacatggttttaccaaatgtataaaattgttcaaaacactcctacatcaatcagacatcgctcaaagccacctacagactttacctatggcccacctatttgatcttcatctcgtaaaaatgacatagtaacactgcatttatcatgcagtaatatagctacttgaaagtggtaacatgcacctattatgtagtaacacttctacttttgtgtagtaacaagtatacggttagcatgtgaggctttaacccatatatttttgtttcaattcctagtttatgtagtaatactattcaagaaatgcaagacactttgttactgcaaagcttattgtctttactagactcttatagtaacgttgtgatagaactgtagtaacgtgtaacgtacagttgcaacaagtaattctattgtattactacttgtggagagtcaaattccaaaaagaaaagcttttaagaacaatatctctgatgtcatgtatggttttttaaaattatttgcaccatgatactagaaaaaaatgcttatcaaaagtagatccatcatgactatatttcaactatatttgagcgttgttactgcacgtaaaacacagcgttactacacgatgaccgtcgcgttactacacagtttcacgagacgagagctgagaagaggtgggtggtgaggggagttagtaggagggtttgactgagctttgaccggcgggagggggaggtgggtgtatatatatatatatatatatatatatatatattatttctata

SEQ ID NO: 58055 - DNA, 10093 bp, Oryza sativa
agaggtacctatgctcatctacataggtgtcggttctactattcaccgtcaaaagctatcataattcttaaggtttaggtgataaaaaaatcattgtcacatcttaacaagtgtaaagaaatattgccatatcttttttaaagtcaacaacatatcggacctacttggttatatataacggaatattatcctgactatggctgtaaccaaacggctaccttcaaacttgtctaatcgtagacgctacacactgcgttaaaatgtggatgcaaccaaacaactcctacataacattgctataaaaatattctctatgtttcaaaatattagtatttataggttatcatggtgggacagtagttcttatattttggaacgaatagagtatttataggcatgacatatcgaaatgggtagttgggagcaaaacgagaagaaatttgaatgtgaatttgaacgaatagaataggtgtaaaatagaaagtttttgaaatcagcgtgttttatgtatgtgtagtaagaataatccgtcgataacctatcatctacaataaaaatatagggtcatttttctacccgatgatatgataaggacacgcctacgctgtccgagaatttagcccgatctttcacggcacaaaagaatatgaaaatagcttctctgaattttggtccaaaataattcagccttaacaatattgcactctggagctcttctcggcaatattgtaaataattgagtgtatgaatcctcacggcaaatataatatatttcataataatttaattggataataatcaatggcctcaactacagaatatatcaatatccagtgactcagcaatagtagttctcggctagaaaaaattatccagcgaccaaacaaaatcagattattaatgtcacacgcacgtatatcaggctcccaattgacgcacgtacgacaaaataagaccaactaatctgattatccaaatcaaacaagagcagtagcaataatagatgtaacgatagcagatggatttgtcttgcagagatgcaatccaaaccctagataaatcttccacccgcggtcacgacgaaccatgatcagaagagagggaattccaaaaaaattccgatctgaacccaagcagtagcttgatcacgaccttctcaatccaagttggatcggcagcagatagatgtaggaggatgcgcctccagggttcctagtgttccagcacagaaccacgaagaatcaccaaaaaaaaaacaatctccccttcataaggccagacctagaccatattaattaaaactagcaataatcgcgcagcgtatgtgcgtaagatgatacataatatatggttgtcagtgatatttttaattatacgtaagatgaaaaacttatatgtaagcaagcataatgattgcacacagctggcacttgacaaacattcatctgatgaacaaaatatatacacatctccagattcctgtaataaaacatatctccagactccacatatatatcatgggcatttattggaatcccatatgccatcagctccaattgttttggttatctagttaactacaaccaaaggactttcggaaaagacaaaaccattaatagtattgattggtaccatcagagaataaaaggagatcataaataagacggttaatatcaagaacacatcacccgtaaggcacatactgaacttggtgatttctcaacctggtgataacaattgagaagagtatgaatctactacagacattacatctcttgatctatctctgctctcagtggtacacacatatacatatacatatatatatatatatatatatatatatatatatatatatatatagacacacacacatatacagatatattctaatctctcccattaatgcttataactccaaacttatgtattcaatttctaattaatctgtttgaactaatgttttatataatcaaatatattattttcttctaccctatagagtccaagagatgtaagctcctcaatgactgatcaattataataaattaattagatacagtaatcattagtagtacttcagatatatgtgacagggcgatcgatcagtcacgtcgcgttggaatttcagatatattcgcagtggattcagatcatgtgcagtactgcagttatagctatgactgcaacttaagaattgcatgcaatttcagccgtccatttatattatcaacggttcagatctagtgatacagtgaccgcactaacagtattctgtgctacagtatttatgctacagtgctatgaatagtgcacctcgctgatctggaccgttccatctgcatccgttgatgaaaactggtactgcctaagttgcagtcccagtagcgactgcacctgatacggattcatgtgcagttgcaggtttctgttgtttaattattaatgtttgttattactgtaatgtggtttttacctccaaattgtttccactaattagtatttatattaggccctgtttagttccaaaataaaatttttcacctgtcatgtttagacacatacatggagtacaaaatgtagaaaagaaccagttgcacagattgcatgtaaattgcgagatgaatattttaagcctaattgcgcccaagatttgacaatgtggtgctacattaagcatttgctaatgatggattaattaggcttaataaattcgtctctcagtttcttggcggaatctgtaatttgttttgttattagactacgtttaatacttctaatgtgtgtccgtatatccgatgtgacacgcaggggcaaaaaaatttgccaactaaacaatgccttatttattattattattattattattattattattattattattattaaccttatatagttaagtatagactcttacgtccccacccaatttatcctttaataaactatgataatatatatgcaattaaaaaacaccttacttttacttttgttggcatgttttctaaagaaaataagtctaccttcttttcaaatgatggaaaatattataaataattgcttatagatattacttaaatatgatataatatgaagctaacatgttagaaaattataaaagcaattaatgtagacgaaaacaatttatggataaattgtggcagatattctgcggttagtgcttacttttataagtgtctcaaacttagcgacgcatgaccgcgcaaatgcgcgggctatcttcctagtttttatagaaataagaagtcaaagttgtgttttggagaccgtgtcgctatccaaaacgacttcctttacgagtacggagggattacgtattcaacataatggtttctttatattaattaaagtatattatgaccatattaatctatactttctatatagttggtaccactaacttctaaagctcaacatgcaaatgtgccacatcatcatccactagcaattaatatctagagtattttagatctcatgcaaacatgatatatcatttgtaacttaatatacaagcaatgttaaatcatcatcttcatattatttaaatatatacatctaatatttttataatgtataacataaattcatccatatatctcgcagaaaaaaacaccactcaggattctagcatgacccaagtaggctctaattagcgcatagctggcccattacaggcatgtcagatccatattaattaaaatatagctaatcattattaataccggcaacatatagaaacatatattaaactatccggccacgatgcaaatctcaccattagcattagcattatgaacctcgtactagcacttgcatgcagcatttttggtcccaaaaatggctcatgtgaagtcgacctgaatgcaaccaatttggatatattttctttgcttcttttcttcccttttcttgtgaaaattaactcctcaaaaaaatatatatttgatgatagacaagcgctagtaaatttctccatatttttgccaaatttctcatcaaaataaatagctccaaattaaagaccagatgatattagagaattaccaactacaatatttaaattatcgctagtcatgtctccatgaacatcttgacgagtcatgggctcatcatcctcccttccttgaaacaaagcgacggtttgacttatatttaacatcttctaccttagccggcctcactctctagtgcaaccttagaagctttgattgtagtctcggatagcatagtaaaatcatatttaatggtgcaagcggaaacataaaaagaattgccatcaaaattcccataagtaccaataacattcagaagtgcgagcaattgcattctcacctgagctctcataagcaataattttagaacgtacggtcacatcattctctccctcttgaagtaaagccgtcctcggctttgaggtaggagcaatagcctttttcttcactttcaaagcagcaaacacctcagccttaagggcaagtactatgatgcttaatgtgttgcccctaaaaatgtcatgtaggattgaatgatgaggtggaagtaataattgaggaaagagaatgtgagccacctctcatgcaaggggcaacctccacacaaaccccaagaaaaaggagatgaaagaaagaggggattggacaaacaaataaaataaaattatttgggttataatgagagaggtggtgtagatgtggtgtattgtatatatcaccgcttatcttacatggataaaattagatgtgacaactacccctactataaaacttgccctaatagcagtatccggcatcggtttgagcacatgatatatgcccttgtacataaaagaaaaattattggaacgaccaccgtgagtagcatcgagatcaaactgccgaggtctacccaacaataaatgacaagcattcattggtgcaatatcacagtccactatatcaacataatttccaatggagaatttaactctcgccttatgagtaattttgagtgtaccactttgattcatccattggacattacgcggcattggaagcctccgcgtagacaaagacaaagcatgcacaatatttgaactaatagcatttgtgaaactaaccaccatcaataattactctgcataccttatcttgaattttgcacgcagtctgaaatatattagatcgctgccctttcacatcaacaggagtatcatcactgtgtacttcccatgccatcatagataaaccatctgaagcatcattagtatcatcaattttatggtcagactgaatatcacaggaagaatcactaacatgcaaccccaatgtagaagaaagattaccactctcatgcataactgtctggtcaagcactgcaccctttagcaataactgagaatcttcttcatggaattctttagaactatcagttggcttggtagctagagattgtaggatagcagcagcaacaaccttttccagtgaatctgttggaaatttagtcataattcggcatattttaattcaaaataacaagataataaacatgatatttacaatgggatttgatccagtgatagtggtgaatgtaatcaacatgagcatgcttaatgtagaataagcatcaacaatcacataataacacaatgttgacattgcgatgaacattaacagtaaaacttctaattgaaataatgtaagaaggttataccccaagaatggtcctccgctggagtttgaggcagtattgcctccgttggtgttgacgggagcctccttctccttgtatccagtgttgccgttgtctccagtgttcgacatattggtgaaggtgaagtagatgttgatgaacagtgagtagtcgcgccttgcgctccccaaaaacctgatcgcccgcccgtccgtgcaaacgtcgcagcagcgcgtggtttcggaggcctactctcccaacgcgtgtgcacacactcgtcgggataggattaccacagcagcaacagcgttggaaaatggatgaaagtgtgtctcacaattctcgcgggagatcaaatccattctcattttataagaggaatggaagatgaagagtaagagtcatggaataggaagaggaatagagcaactaattgtcatcaactagccatgaaccatcctccactacacaaccatcaaccaacaatcaattaggagtaattgatgtaagttaccaatggaataggaagaggaatagagcaactaattgtcatcaactagccatgaaccatcctccactacacaaccatcaaccatccatcaattaggactaattgatataagttaccaattccctaaacaaatggattaattctcaaaacttttcatcctattgatatcctataaaagaatgaatacacatgaattcctagcataatgaaccttggaatttatttgatttaattgatttaaatggatcaattacccaattaaatctaacagaatcaagtgaataaacaaattttcgtcgcaacacaaatgtcatatcttcccatgtctgacaagggtcatccacatgaagccaccatagcaaaacatctttatcaaatgtctcttctgcataatacatctttacgactgattgaaaaccacggccctcaaaaaaattctccatcgcatcttgccaatcaaaatactcacgaggacatgtttctagagatagctttggcatacatttcattttcttgagcaaaggaaaatgatccttcttaccaaagaagccaaaagaaataccgagctgtaccatgagcaacccaggctatgcctacgctgtccgagaatttagcccgatctttcacggcacaaaagaatatgaaaatagcttctctgaattttgaaccaaaataattcagccttaacaatattgcactctgaagctcttctcggcgaggtcaaccgggttttggcacggttgataactagaggagacgtggtgttgcgattgcgggactcagtagcgtgttcgttcagaagccggatcgagttgtgtcgcgactccacccaaatcgactgtttattagtacctatcaaaagatcgagacctaacatcctcatcagttggtatcagttggtaagggtgtaaatggctaactttgctcctcgtagcttctcatagaatctccagctattaaaagctccccaaccagtctagattttcacctagattctaagaagctatagttgtagaatccaaaaaatgaactaaaagacaaatgattctcacaagcttcttttcataattttaagctccttaaacatggtctaaaccactaaccaacttatgttgatatataagtgggttcacgggttagtcacttatacacccctactgataggtttgtaggctttttgaacatacaaagcaaagaggctttatagtttcaaaagaaaatttttgggtattacatcagacgtttgaccagatgtcggaaggggttttcgtacacgaataaaaaaactaatttcataacttgcctgaaaaccgcgaagcaaatttattaagcctaattaatccgtcattagcacatgtgggttattgtaacacttatggctaatcatggactaattaggcttaaaagattcgtctcgcgatttccatgcaaactttgtaattagttttttttaatctatatttagggcatgtttgggggagcttaagattctgagaagcagctggttagaaatcagcttctaagaatctggaaaagctggttttccagcttttgacttctagttcattttctagattctacaattatagcttctcagaatctggaccataagctgtactgtttaggggagcttgtgattttaggagaaactgcaacagctagaagcttcttcaaacaagcccttaatgctccatatatatgtgaaagattcgatatgatgtttttaaaaaaaattggaactaaacaaggtctaaatggaagacagataaaatcgatgtcggagccacggacgcattagtgccctgtccagttccgtcgcctaaaatagtttgtactactaatcgttttattttttttaagtggtaaaaacccatattaaaagaacatagaacatttaagcatctctttaaaacatagcattgagaaaacgtaagaatagaaaaaaaaaaggaattttttaagtataaaatagaggattgtaaaacataaaatcataggaaaaacgtgaaaacatagaggagagataaaagactcgaagaaaagatttcatgagcttctacctcctattattttttccttaaaatttgtatagcacgaggtattccatagaaatactgttcattcctttgcattcaaagggtcatctatgaaaaaattccgtaggataaacaagtttaatggtatagccaactactaactccaaatcacttatagtcaacttaatagccaattcatacaatagttatatactacactattaatacctagtctcacctattatacacacattgtatcttaaagtccgtgctataactgactataaatctgtagtccgctgcttttctctctgttttttcatcttcttaaaatatatttatagctgtcttatagcctgttattgtaccggctctaaaacacctggtatacaactttcatttaaatcaaacatttgtgccaccataccacaactagcctaagagcaggtacaatagcagactaatagccagctgcaaacatattttaataagataaaagatgagagagaaaagcagcgggctatatatctgtagccagctgcagcacggaccctaagacgcaatatgtgtatgacatgtgggaccatatattaatagtatagtaagtaattattgtataaattagctattagattagctatagatgaattggagccagtagtgggctatactattaaacttactctaaacttagttatggcaaagttaggcatcaaccaaacatccccttaaattttaagattggggtcatgagccaatagggagttggatgaccaaatgaccaatccatggaagggatgggattctgagtggacgacctggctcatatcgatatggcgcttcattttcacccttttctttgagactaccgttatcatagctcgccgtaccctttcaaattcgtgtatgtcactgcaggtggaccccgcggtctccgggccccgccatgtcagtgggagctgggggaagcacggcgaggtgcgtgaagcaataagcttcacctgtcgccatcaccgtctcgggacagctgcctgctccttctccatctctctcaccgagcgccgcgtcccgcatccttgctcccggggccgccgccgccgacgacgcctagcagcttcgggttgcagcggcgctgagggcgagggagggagaaggccggccgtcaacgaaggtggcagttgggggtgcgcgctccggtcgctagccagctagggcaagggccggaggccgcgagcgccgccgccgccgcccgtctgccaccacctgctgccgcgggtcgtcgttgcgggagccgacgtccgcgggcgcttcgagaagcccgtgcgtgagcacgccgccgccgaggaggcggacaagcgcggttctccagtcgtacgccgcgtcgcgtcgctctctggcgcggaggaagccaggaaggccctgccgaaacgtaccggccggccacctgctgctccctctgctgcgtcacgcgccggtgagggagtcagggtcgaagcgcgcgtccgcggcgctgagcttcccacactgcgcgtcaagtcgagggaggagaaacctgcgcccgccctgccgcgcgcccgcctcgaggcacaggtacgcactgatccgctcgtccgcctgccgcgcacaacacgatatgcgccgccgccggccatttcgcgcagcttctgcgtgtgcgtgcgactgctgcgcttatgcgctacgcgcgctcaccttgtcaatgcagtgcccgtgcctcatagagaagagatgggtggattggccatcaggcgaagcaaaacagctacacacacatactgcagccacgcctagttatttctgagttctgagcgctaaaacagaagacaagtttggttac

SEQ ID NO: 58056 - DNA, 597 bp, Oryza sativa
gatgtggatgcagcgagggtgatgaaaagggagttagtacaagaggggcttgatctaagtgaacatttgtcggcgagtgttcattggtcgtcgtacggagtcaaccctgaatacccgacagaagtagcaggccaatatgtgaatccagatgattacttttatgtcgaattgagtggtggtcacgattctgtctcagtagaagtcaatagagatgatgttgacgaggaggcaagtgttgagcaatatgatgttgaacttgctgaagactctgatgatgaccgtccattccctccacttactaataatgacaagttagcattagaggaatgtcgtgcatttgagaaggtgtttgggaggaagccggacattcctgagtttagggacctaacacatgcccatggtgcactagtagatggcggcatcaacctagatcagttgccagaaccattccaggtggatggtctcagaaagggtttagagttcccatccatggtcgcattgaagctatggctccaggagtacgccatcgtgcaccatcgtccataccgtgttgtcaattctgccgcaaataggaggtacactgttaaatgtgaaaac

SEQ ID NO: 58057 - DNA, 50047 bp, Oryza sativa
attcctgcagccctgcgtgttagtttctgtttgtgtatgtgtgtgtgtgtgtgtgcgtgtgtgtgtgtgtgtgggtggggggggggttcacgcacccaagtgtgtgtcggtaaccggcacaggagcaccttgacatgcagtgacaatgtcaggctttgcaacatagagtccatgacgagaaaagggcaggaggatagattagcggtgaacgacctagcccatatgatgatgccatgccacacaaggaaggtgttgtgcttgacatgcctctcttgcgtctcttggatgtccatgttgatggcggtgtacatggcctccgccatggcctccacaattcaaggattgatgtgtatggtgacgcttggcgatgacaaacacccgacaaactcagacaacaaatggagatgttccgcactatcttgaaggggattggtttttctaagagcttttagatagaagaattttcggtggctaaatgcctagtagtgcttggttgatgttccgttggatttaaacaattagaggggtgagttatatgtcataagagggaaacttgaagtggttttggattaagcattcgctaaaacaaagtcaagtgatttttggacttcatttttttcaattttgctcactgtacagtaaacttaatttatatgattttgtgtatctgagtttgcgtgtgtgcgtgcatgcgtgtgtgtgtgcacgcgcatgtgtcggcgaccagagcaggagtaccttgacatctagtgacaatgtcgggcctagcagcatggaatccctgatgagggaaggccacgaggacagataagcagtgaacgacctcgcccatgtgatagttccattcagcgtgtggaagatgtagtgcttgacgtgccttttgtgcttctcctggacgtgcatagtgatacatggcatgtgccatggcctccacgttccaagcattgacatgtatcccaccgcttagcaatgacaagaaggtctggaggacaggtcagtggtacatggcctcgccagatgatgttgttgtgtaccatgaggaaatatgttgtgcttgacgtgcctcacttgcttctccttgatgtccatggtgatggtgatgtacatggcctttatgttccacaggttgagcgtatcacgttgctagcaatgacaagcacccgatgaactcatatgacacaatggagctatgccacaccaactagattggtttgatttctagtagagtatttttcgatggctaactgcctactagtgattggcttgtagttggagtggacacatgtgcatttgctgatattaaataattagaggggtgagcgatatgcgaagcaagtgtaataagtagtggtattaaataaatgatttcgctaaaacatagtcaaatgattttggactagatttttgtcagttttgacacaacacggtcaactctatgattggtaggtgtgagtagacgtccaatggcattgttgggctacgtgatgatgactccttgatgacgcatggccatgaggacaggtcagtgatgaacgaccttgtcgagatgatgatgccatgtagcttaaggaaggtgtagtgcttgacatgcctcgcctgctcctcttagacatccatggcgatgtacgtggattttgtgatggtctcgacattccatgggttgatatatatattgttgtgtagtggctggttggtggcacccagcatgatggagcccctcttcccggcataccgtgtagaaatagggtatctagttgagcccgttgcagatggcgtggatgacgcaacactcgacaacagcacaataaaccaacttactagccatggtagttattgcccatgcagccatggtgggaggttaggtgaggccggggaagttccctcgttgataggaatggagcagaaaaccacgacgaagaggaacggcaagtggggggaagaagctgatgcaggagaatgtacacctatggcgaatgaagaggggagcagccagaggtactaattgactaacaatggacgaacacaaggtcaccatcatctagatagagcaactcgatgatgccaacttgtacttccaagtgtggcattgagagagtggtatcgatgtccctaaagggtgacaaagagaggttaacggaggaggcaagggaagagactagagaggatgaagatgggctcactgagatgtgggtaccactatatattttttatttttttccctaattgcaatgccacatgagtgacatgtaaggcatcacatcatatgaagaccaggtaaacgtgtcacgtaggcactacataggatgaaaccacaatccacgtagcttgcggaggcaaaacaaaccatttcaatagttgagggatccttcatatctagtttagaggtctgagggaagcgaatgaggctcggcccatagctgaggaaggcaaaatagacttttccaaaatcaagaccaacctagagggtcttcagcctgttagtcaaccagtcaaccagccaaccaggctacacttcacgcataaacctgacaacacatcatgagatttccggaagaggatcactcagccctaacatttcctgggtgtcacatctcgctcactgtgacgtgctgcacaatggcgtagcatcgaccggtggtgtggggttagccatcttcatcaaaaagcctaattcgcgaacacacacgcccattgaatgcatgaacacgttctggacgcataacaacaatctccaggttagtgttagggtattgggggtgggttggggagggtgtggtgctagggaggggaagtgggggatcaagcttagagggatagtgcaggaggcgatggacaagggcatacaacgagtgtggatagtatgggtactagatacccacaaggcctcttatcagactagtgatagaaggtgaaccagatccatgtaataggagataaagtaaaactcgattgccatgtagccttgtaccctaagataggatatagaatccaggccgaagaatactatgtacagattaggaaactgaaaccgtgtccggctaagttttccccctttgtaaccctgtccaccaaggtatataaaggagctcttttaggatgggccaatcgttcgtacgaactcctccacgaacgttcgcgcaacggccattctggcatgaacctattaaacccttgttttccacatccatctgctttgagatctcgtgcgtagccttcttaaattattgccgatacaaaacatcaacaacaaggcggtggtagtgcctccggagccacgggtcggcaactgactgtgggctggtgttggtgcggaggcaaagcgaggcaaaggggaggggaggaggccagcactgcaggggcgcgcctgcacattgattccctttggtgccgccaaggccaggcgactgcattgtaggtgggtggcagtcgaggaaagggctaacctagtcgccagatcaatctcgtcaagagaaagctcgccatagggagggagctggggctcactagaggaggcctttgccgtcatcatcaccagagggaagctgctcgactacgtcttgtcttctcaatcggaggaagctcaccggatggatgtggagcaagctcgctggaggaaggctgctcgtccgcgacttctcttctcactatgttgcatgcgcggatgggtggcttcctatccgtatgtaccagacaaagaaagagagtttgggagggggggagctaattaatatgttgtgggctgccgttttgtggtaattccatgcatgtcatagttcatcactaattaacaaacaaagaaatcaatccaaaactgggtgaatccattctctatggccgagcagtagtgctaagaagggaaattaccttctctatggaagacggtgtggtctcgcgttagctgctttgcggtggatggcacacgatcagctaaaaccctacagcaaaagcatcaatcatcagtcaaacagctcggcgagctcaaatcctgtcatcctgatcagataaatacatcaaaatttaaatggaagaaactaattcgttaatcttggatatgatcttttggagaatcaatttacttaccaaaataaatacttgatatattctgtctatcctaaactcgatttcttccatgaagaagcactaatctaattttccatgatatcacctcaaaacatcacgcaaatggaaaggtcttactttgcaacgcaatccaaatttgagagaacaaataaattcagcgagaggtacagttagattttcctgtagaatggggggggggggggtacttaccgtgcacgatcactccacctcacgagctgatccgctgcaaatttccagtcatccacactgtaaaacaacttagaaaatttaagaatggcaaccaatgccagaaaatcgcactgagctaacacagtgacgaccaacacacaacggcttacacggatctacctcccaacgaggccattgaccatgacgatgaggtgctccaggaagcccccctccctacactacctcggcctcggccatccgcgtgctccactcgtcctcccctccactacactctgtctccccctccacgggtccacctccggccgcttccctttcacctccttcacggccactgccagccagaaacagctcatccatcccgagctactagctgctcaccatagccacagccgcggccgcggggacaggaacatcaggcggagtggtccgacagcgcgtggtaactatgaccgggtcccaatgttagagtaggtggggctgtggtatatatataaaggtggcaccggcaacgatcatctagctaggaggggaggatgtggccgccttggctaccgtggctgctagatccactctgcatcgatgagccagtccatatctggatgggcagatccaagcaccaattcaaaggccgccaccgttgagcatatgcacaaggggatggggtgcatgatatgttgggaaggggggggagcggtgacaaggaggggatgggaggagccgaggaggcagcgtgctgggtaaggaggggatgagatgagatggcggcgtaagggagggtgggggaggagttagaggaggggaggataagagagggtagcgggcggcatggaataggaataccagatgcacacatgtgggggcggcacgccggtgaggattggggcaagcggattgcggcgtagggaaaccctactcttgatgagagggagaggggtgggggagggggggatgattagtagagagttttggttggtggaaatgcaggtgtcaaccatccgattaaatactatggaccaccaaatcaatcataagtgtattcgagggaggatgtgggtagtggactgcatgttaaaattgacggacgattaaaaaaagatgacgaaacagaagcactttgatttgttcaggtaggtaagttgattttttaggtaggtaaggtaagatatggaagtgaactaacttgtaatatttttatttgttattatcgagaagtgatagctcatattatttttcattgttctttactacaatattacgaaatgacagcttgtaattgattcccttgttatttagtatagggaaaaactcctaatatgccatttgataaatgacaataaacagatacactgtctacagtatctcacaaacatgtaaattgtaggattaatttgactagcaattttctatcacatacattcccacagttttcatctaatctattattgttataaggaaatatcttatattatcaaaattgataacagtaaaactaagttacttccaaacaatactagcaatttgctattatattttgcacatctgtcatcacatttcttatataaagattatcttatgtcttctatggctgcgttcgtttgtgagacatagggtgagaaagcatctcgttttcctcgcgcacttttcccaaactattaaatggtgcgtttttgtaaaaaaattttataggaaagttgctttaaaaaatcatattaatccatttttgaaatttaaaatagttaatactcaattaattatgcgctaatggcttacctcgttttgcgtatcttcccaatctccccaatttccttctcctcaaaggctcaaacacaccctatgttgccatatattggtaacacaactatacaacagcctatcaaaactaatatatttcattgactttttcttacatgtttgactattcgtcttattcaaaaaatttacgtaattataatttattttgttatgagttgttttatcactcatagtactttaagcgtgatttatatcttatacatttgcataaaatttttgaataagacgaatggtcaaacatgtgaagcataaaatttttgaataagacgaatggtcaaacatgtgagaaaaagtcaacggcgtcatctattaaaaaacagaggtagtatttaacaagatataccagaaatatgagataaatagttttttttattttctagaaatgtgcatagtacttgcatgtaaactagtagttatattttttataaaaatgttaattcttgaacatttaagaaaatgaactaggcgtgtgttcaaacaatataactttcagcgtgccatataaataatatattcttttatagcaatgtggaactatattagttgagattttttttcaccaaaaagaactgtattacattagaaaaaaatgagaaaggacaaccaattaacatacttaacaattatagcaacaggtagaaagatagtttgtcaaaatagttggttatacaatatcatattcacaaaataatatctcaaccattcatttgttttatgaatgcttgtgagcaaggagggccatgaatccaggaattcacacatacttcttttgaatagggtgatacatatgcacgtacataaagtcagtaaacatgtgccaacagacaacacaattcaggtgaaaaccggtagagtatgatcttggtcctccattttcgggcataaacacataaaatttgacaagaattttacagtcgtatggtagaaatttcacaaatctgttgattaataagatattacttacaaatgaatcaaatatcgacccaaaattattaaatatttgttaataagatctcttggaaacgttaatttttcaacattctattcttaccttttgaaattgtcagcagcctaaagatttaggggaaaaactgaatgaagatctattcacattcctctattctttgtctcatatatatctccttaatgagcgggtgctgcattgaatcacattaatctgtgtggttcccgattaaaaaacagcaacgctatgaacacagaagaaaaggtctggcagtttcggtactccatcccagatgaaaaccccatatatggcctttattggttagatcgagcgatgacgttgagagtgatatgtccttcttgaaggtgttccttgtagaaccagtacctataatccaaggtgaatacctttgacctgaccttcactcgtcgaatctagtatcgatgatgcaagtcgtgtcgatacgaaggtgagggttcccaaccctcatctaagaacaaagcctaaagccacatcattttttttgtcacacaattgtcatgctcttgtggatggcatattgtttagtttcgatgccagatgatttttttcccttttggctaattggtgtcttgaaatttactccctccgtttcaaaatttactccctccgtttcaaaatgtttgacacagttgactttttagtacgtgtttgaccattcatcttattcaaaaaatttaagtaattatttattcttttcatatcatttgattcattgttaaatatactttcatgtacacatatagttttacatatttcacaattttttttgaataagacgaacggacaaacatgtgctaaaaagtcaacggtattaaacattttgaaatggagtagtttgtaatgttttttttggcttttctggctaaacttgtactaagattttagcatggtggtagaatggttgtgtgtatctctagttgctgcaacagccagaagttgtacttctgttttctaaaattttttcctgccaagggcaaattgatttttttttcattacacatagttctgtacactcaatacccatccttaaaattctggctctgcaaatgcttcaactacacctcacatcataggcacgatcagttatatcaaataagtaaatatcacttccctgatgataatgttacatgagtgacagcatagtgaggatcatatattctgaattgccagtcttgcagcgatcataccaatattatgttctacatactcaatcccactgtttagtctttcaagagtgtttgttgaatccattgcttgtatcttatatttttgcagggaaagaagttctgcttctgacatacctgtagtgcatgattttgatgttagatactatctccgtttcaggttataagactttctagcattacccacattcatatagacgttaatgaatttaggcacacatatatgtctagattcattaacatatatatgaatgtagacaatgctaaaaagtcttataatatgaaacggaggaagtatgatcataggactacatgaagctgctgcacacactgtgcgcaacatctgtttttgttggtcattccatgaaagattggcatacctcattgaaattgaaatttcaaataaaaagcaaaattcaacattgcaagctatatatttaggcgataatgatctgttgtcacctgaaacagtctggtacgcagcaaaggagagacgttcgggtagcgcagggataaaaccttcattatactcctcaaaaatttctttttcagaccacaacagggaggccttgatgttagtttgcaatggttcatcctcaggtacctatgtggcaaaaatgaagtctcacgacttacgacaaaaccattgttcagcattcgcaaattgctgaaattacagtggtagtggccaaaccttcagtttcatctgtagactgtgtaaattacacatagactctcttagcttggaaattcttaatcccaattcaatactctcggaagatatgtccataatgggagaaacatcaccacgcaagtagggttccatctagatcaatgaagtaaaacaggagaaggactgtgaatcacaactgctcaaataaacgtacagttttaaagagcatgtgcctgaaaagtcatttgtttgtaccacttcttattagtataaatacgtacttcaagaccaatgcaaaaaaaaaaaacattatataatgttccatcaaaatataccaaaccagagcttttttttagacagtagaagtagtactttcgacttgcaccaactagggatgtatacaatcacatgtatggacaccaggatttaaaccttgatggatggagacgcccatgactccatcaccacactataaacaatgcttccccaaatcaatcttgagaaaatatggtcatcacaattacaaaggaacttttttaaacatgtttgaccgttcgtcttattcaaaaaatttaagtaattattaattcttttcctatcatttgattcattgttaaatatatttttatgtagacatatagttttacatatttcataaaagtttttgaataagacgaacggtcaaacatggctaaaaagtcaacggtgtcaaatatttagaaacggagggagtatgaagcattgaatggcacatgagttcctatcggtgacacaatgcccttacaggatcaatgcggcaatgtctggtggattatacagacaactcatggaatttatattgattaggtatgacatgttataagtataaacattgaaaaaatatttcaatctacaaaattgcaatgaggttacctgcaaaaggttgataatgtttacacggcaaactcctctaattgatactagtgctccaatatcaagcctttcaacctatactaaagaaagatcattgagtagaaaatgtaaataatcctatgcagaatcctgtcataaaaaaattgtaaaaaaaaagggtatgaaccacaagaactttacactttctatctggaccaaacaaccatgtcttacagcaaaggaagctttaggtgaacctgatacaactgggtcgagcaccaaatgcacaaaagaattgtttgtcctatacaaggcctgttgagcaaaaaggtagaaacagatgagaaataattatattttcgcataactacaacaacactggtgcggtgtgtgtgtgtgttttttctataacaagcaaattacccggctttgggagaaagccaaaaacagagacagtcttacataacggaaattggtgtggtgtgtcactcagctgaactactgaaggtctcgttataactattaatctagtgatagagatatacagtttttgtaattctgttacgtcatattatgtcataatcccatttccaccgagaaattcttcccttgcctattaagggtaactagagcaccttagaagagcttagagctgaaatcaaaatatagcgcaatagcaatataattcaaacttaagggattcagcaaatggtaattacctcttctagcaacgccagatacctagcctcatacaagtgtaaagtcttgcactccgatggaatcaacacctacaatatttttactgtcttagcagcaccctagtgatttagttgacagtaaaacgtgcagatagtaagcatttgtggcaaccctgaaaaccaaacacctctgttagaatgcagatatttgacccaatcggcctttgccgagtaatgagccagatacctacatgctaccaaattaagatactggctagcttgcttagtcgctgcagcatatgacgagtaactgatcaaattacttcttattcattataaccagtaacaattcagagaactgttactatcacagatactgcagattcagatatgtttcttcacatgtaattcccaagtggggtgaaagaaaaattatacagacgttacacaaaggcagctgaaggtaaacaattggcatcgtgatcaagttagtgctaatcatggcatacagtgcacagacactggttgctagaaacaatcgtagatacatgccagccactgccactatgtcagggacggcctaagctgcgaaatttttttggtggctcctcatcttagcctcttgcaagaaagcaataactttctttcacttgaattagctacagataattaatccagctcgattcgaacactgctattgacctattgttgtgtcaaactgacggtatgcatgtgcgtccaatttcaaatcaccatagccataggtaggggcggcagctttcttgttgttcagaggtcatgaggtcgtacctctgcgggctggaacgggaggagggggaggtcgagggacgccggcgacggcgacgagcagcgtactacggcgcggggatggcggcggcgcgtcgcgcgcgcgtggagggatgctggggacgagggagagaggaggcggagcagagccgaggcggccatggatgggtgggagtgggagccgtgggagagagataatgcgcacctgtttcctctcctcttcttttcttttattttcttttgttttattttcttgttttctttttaagcctcaacccttcaagtacaagtagtagtgtctgaactcacgcacaaactcacaccaccacaccgcacactacacactcacacaacaagatctacgcaaatacccaaaggctgcacgtggctgagagatatgcgaagtgaactggcttcgcacgtgacaagcatgtcaccttgaccattgtggcacattcacgtgtgaggctgcaacagaaggaaaaggggaataaaaccccaatgcgaaacccgcgtcgagcggcgctcgaacgcgggtggtgggcgctccaccgagcagcccaaccaccgagccaacggctcgttcgctcttttcttgttttgtcttggagaaatcgtgcaaatcctctcttactatatatataaaaagttataacatttaaggatcacgtaagtatgctatattatctatagttttataatttttttttaaaaaaagttagagattcaaaatgcaagcatgtttcatcatcccacataattcatataatattttgatatatctctccatcatttttttataatatcctataagttcatcatcacttagttaatgttattttattttctctcattaagccatataatatcaattgcttttagtccttatatgattattctatggttaaaattatctttctccttttcttctcattaaaccatattatctcaattttttaagccttcagatgtatagtctaaattatcttccttcttttgttctcacaccatcttacttttacatttgaatcatcattctatataccatttcaatttaaatcacatcaacttatgtagtcctcgtcaccggcctccttcttgcactgcgccgcatctttcggtccttccactccttcgcccacatcgcgcgcccaccgccgccgcgggagacgacgggagccatggatggatggaggtcaaagggcaacactgcaacacaactctttggctgcagggatgattagcatataagctcgacgtagaccttatgatccagtggttcatatgcaatctcatccatcgatcgaacggctgagaattagtgataacgtggaatgctgaggtttcagctttagatcttaactttatagaaagaagggatttacgtgagggaggtggagagccggagatgatttttgggagatgggattttggttttatatttaaaatagatctaatggtgtaatataatgggcccactgtattaagggaaaataagagtaagatgttttgttctcttttttttagaatttcttgggtttctctaatttattagagcgccaagtgacgtcctagagtgtttatagaaagtttaatggatttttaatatataatagataataaaaaagtaatcacatgctctacccattttcttttgttccaaacacgtagagaccagatgcgtggagattttgagctcggtttgacaataaataccagtgcataaacctcatgcacataatctttcaatcgcaacataaaattttcggtgtataaactttatacgcataaagtttcaatgtgtaaactttataaagagaaagtttcaaatatactcaaacgaattcaaaaattgaaaagtttttcactcaaaatcataatcattcaatcaaagatctaaaaatttcttttttatatataaaaaaaactttgttcaactgaaatctctaaatgtcccgctccaaatcatgaactttcaactgagatatagcaaaagatataggagtaggaagaacctgttgaaataataagcacataatgatttaatttattccataaataaattatgacattacagatgtaaactagaataatcgcatcattggatctacacatgtaaactaagcagtaaaacatgaacagatcgaatatgcgcaacatgttgaacgcgtatcgaggttgccgaaagatcggttgctcagcaggaattactcgcggttgtggacattgacgaagcgtgagcaaacaggaagacgagccgtcatggacaaacaaggagcggtcgtgtgaagcgcgcgtagtgtaactgaactggataagtcgcgcgtaacttatccggactctatgccattgtcacacatgagtaaccaattttgcagaccattcgacgcgtaacatcgtgcacgcgccaagcgaggcgagcgagcgcatgtgttccccctcttctctccacctcacatgctttaagtggctaggagggcatcctcccatttaaggaagtccctctctcctagaataagcaaggtggtactaaactccctatgcatgctatcccatgaggtgaacttttgtgatttttcaaagaattaatctttaagtggggtaaggcctatctattaatttcaacagaacccgcacccatctaggatggggtttcacgtgctatggtctatggctcaatcacatttttttctgccctcatatgtataggagaaagcagagattaggggagaagagtggctgcggcttcactgttccgttgttgtgtttccatccgtgttccgtaccatgtggagggcatcggtttgtcgattctttttggtggtggggtcggcttctatctaccgtgcagaatatgacgccgtcactactccgtcaaaacaaaccgggtactagtacttttcactccgcgctgcacaacttggaaaaccactgcatccttatctcttgtccccaaatcagagagttcatctgaagttctgctcatctgctgctctcctcatcttcctcttggccgcacgcaaccatggttgctctcgcgttgtcggcggccaggctcgccggcttggcgtggtctgcactccgcatactcgtcggcttggtgtagttcaatggtcagtaccaaatgtggaactcccttgttgctggcaactactatttgctatggtgaagaagtgaagaattgaagatcgaaacttttttcaccatacagctgcattaaggtagttttatttgataagttcatttttgcaaacacctcttgtgttttgatgcttctaaattattatgatttttttcacatgagccaaacaacatgtttggtgggaaccatatatttgatgctaatacaagagaaagtactagtatgatttgacagcttgaatcgacatgggaattcagattaagatccaatcttacaagttgtaatgtgattggaaattggtaaaggtgctaattaatatgaaaaaaaggtggggattttaatttaaatgggcaaacatgctatagggatatgtatcaaatgtctgtgcagtctcttcatgctgcatcccttgactttgtttagaagttcgaaataaccagatgactgaagtaatgaagcaccttcaacatgatagtagtctggcatttgcatgtgattgtagttagtgggaatctctgaacgaccctgaatctgtataaggcaaataataatcagtagcactgataagagagtctctgccaagtgtgtgtgtgtgtgtatatatatatcttgaatctactaacctgcatcatggtgtatggcagtgatggtgttaccacctctgcttgtactggacactttgatgtgcttgaatcactctttttctttttactccattgtgttgccttgtcaaaaccaccaattggtctcctcgacccacgaatggctttctccttaacctttatgcctcttgctttactcgggccaacattttcctctgtgcctatgataaaatatttttgagatagctgatttagattataacatagtagtcactagcataagtactattcaactcagagtaggatacaaacctgatttatccaaatctggatcaggccttatactcaagtatttctccacatcttctgctaacttttgtgcattgttggcagccattaagtatgtttcatcagattctgcagctcgagatgctattttaacaaacattctgcacaagtctctcctgcgcgttgataactttattttaggatcttcatgagtactgcagttgctctttatatgtagagattttgcatcaatggtccatctttgtagtatgtattgcttaggaatttcttttatattgttaacatcaagtatcttcaatgcatggcaacataggattccgagaaattcaaacttcttgcagctgcacctgactttaccttctgttggagaaaattttataacatgctcatggtgcttaccgtgaacttttaatttgtacatttcagcatcaatatcaccacagtagtataggtcacagttcaatgtttgcaacacttgttcctgaaacactttaaatattgctggagtataaattcttgttgcttgccttaatattgtcaaatctacttttggccatggtgtactttgtgttgtcttaaagtcatttttgacttcctcatatcttttgtctgacaacaacctgtcaaagtgttccaagaaggtaagtatgtcatatttcacactgatatagcccttcaattcattgttcatgctctcacttctctgtgttccactcatatcagcagaaaatgtgtttctcccatacactaatgcccattgctcttttttctgaaatagcctctcaagccatttgttctcctgcagatcatactttttaagcattctattccatgcatttataaattcatcttcctcctctttgtcataaatacaattctgaaaatctgcattgaatttcttgtactccttcacaactccagcaaggtgtttgcaggcattttggttcatatgccaaacacaaattctatgatgactttctggcatgactaacttgattgctttggccattgctgcgtcttcatcagtcaatatagtctgtggcttctttccagacatggcttttaaaaatgtcttgaaaagccaaacaaaactatcagcagtttcatcatacaaaagtgcagcaccaaaaacaacgcttttcttatgattatccacaccaacaagcaaaccaaatggacgaccatcatttagttttctctatgttgtgtcaaaacaaagaacatcaccaaaaacttcataatcagcaatcattttagaatcagtccagaaaatatttgttatcaagtcatcctcatcaacctgaatggaatagaaaaaattaacatcttccgatgattttttctccatatattccaagactccccctgtgtcaccttcgtttaccttcaatgacctctttgaatataatatattcttcatgtcttcacgagtaaatccaagattctcatatccacccgcttcttttgccattaaatcaatagtagccttattagaaatgcctactgattttgcattttcagcacttgccatctgtgcttcagttatttttctttgagatcttaagtagagggcctgacttccagtagcaagaatgtggttatgctcgtgcaagaattcatatatgcaatacaatccatcatccctaagacttatcttcatgcatgctcggcacatacatcgtgtttctggcctactaaaacactgaccgtaatttgaaatttggtcttctcttttatcatgaccacgagtacctattgttaaataaaactaacttagtatatgaattctatatgaacactgaactttgtaaatataagttggaactagtacctgcacgagaacaacaaaatgtccgattctttattatggtggaatctttcacataatggtaactgcttcttcgaatgctaaaacccatgtctcgagcataggcattatagaaatcatatgcctcttgttcactgttgaatttcataccaatgattggtgccttccctttggagggatctgcttgtggagtagcttcaattttactaggatcctgattaatatacccgttttttatttgagacaaattagaaaagaagaaaaactttcatgaaacttacagaaaaaaagggctaatagaaaagaagcaaaacttctatgagatttactgaacggagatatgatgtgcttgtagtgatcaagtctcaatgattactaataaaagaaagtgaaaacattatgaagtcttactgtctctaattccccttccaggttaccatgaaagcttgtccctggatgatgcagtacaaacgttccagcagaggcagctggttccgtcggcatggttgtcacttgttcatgcagtgaatcggtgaccttgattgaccttggaagattagatagagaggccattgttgttgcgaagaagatgattgtgatccgataataatgtgccatatgtaaagcttaatctattttctgaaaaactgtctaatggtttggcgccttaatttttatttggcgcctttgtttccctggagggccacgctaattaggattaatcgctaactgcgtaatctggtaattgacggagagaataatcatgtaatctccgtttatggtggggccacacaaaaagaatcgacaaacggatgccctccacatggtacggaacacggatagaaacacaacaacggaacagtgaagccgcagccgagaagagtggaggaagatgagatgttggatgacatatgggcctggctttttcttattttatggatgacgggactgctagataagcagatgaatagcctgacattttcttatttcagccctgtctagttcaccccaactatcccaaacttctaactttccatcacatcacatcatatctaaaatttttttacacatataaactttcaacttttttttcaaacttccaactttccctaaacttctaattttttttaggaactaaacatagccttcgtagatgattggactggtatttaggcgaagagccaaagaggccttcatcaactacccagcaaagacattaatcaactggtactggctagaagagttgaaggggtcttaagttgtgttcggcacagaaagttttctgctaaatggtgagtttttttttcaaaagaaaaatcgataggaaagttgctttgctaatccattttcaatcttttagctaatacttaattagtcatcattaattagtcatcagctaatgagtcacttcattttgtgtgcacgggctaattagtcaacagcacgtacgcattctaaaatagtcgtgagaaatgagtgacttcatattctaattaaaatacttatttaagcctatcttagccgttgggaccagattatggccctctttgtttaggcttaaatttattggcttagacttttaagtcagcttattggcttataagatgtatttaatgtcctaaatttaatggtggagtcatgcatctacctcacataaaccaaaaaatcttatccaacctaacttttggcttaatagtgttagagtggcttatggcttcaaaaaagccaaacgagaaagctgtttgtttatttaggcttagacttttcatcttataaattgacttataagcctaaacaaagagagcctatatacagtatatttaagcatcactttccttttctttcgtatgcctctccgccccacctcagcctatgttaggccattcccaacccaatgactaggatggagtcatggagtctatagcattaaataagctgccacctaaaatgaaaaatgatgtggcaagtgaataaatgaggaaagagaatgaaaccatgtcttgcatgagacttggtttctacacgatatccaaaacatcatgtgagataagtagcattaaatttaagtatagaatagtggtgtttgcattggaagagtagtgtctagtactagtttcttgatgatgtggagtttatggaaactatgtctagtatcttgggttgggaatggccttagcatgtgcagatgtgcttcattgtagagctctgcatgcaattagaaagtatgcatgcatgctaaacatggttggtttaatttttttggcaacttcatactattttttctcctaaattacttctccaaactatgatccaattacactattaaatttgttgctattaattttttacaacaagaccacatgtttcgatgaaaaaaaggtatttagctttgttaattcttttaaatgttgcacgtggattaatttaaatgtttcaataagtattttagaatgtttgactagttaatttacaaatgttgtacggtgctctttgaatatttcggcaaatattgtgtaatgtctctatagttacaacttaatgttcctacatgataaaacatgttcaatataaagtttttcaaatatatcatatgtcccccatgattctttttatgttttactcgttgggactcaatgcttcatatattggttgactatttttaaatgttgcatatctctgaaagtgaattaaaaacaatattttacaagtggtgaaacaatgttcgatttttttttatcaaaatataatcatgtgatatcatgttataaagattgaattataagtaatataacactgtaatcggataatagaccaaataaatattttaagaaaaaaatcaaaagaaaggaaaatgtgtaaatgtacctgcaaagaccttgctgcagacatgcatgggcacattgacatgcacttagggatgaaactggttcggatagtttccgtccgtctggaccaattttcggattcggaaaaattcggtcggaactatccggaatttctcggattcggaaacgtattcggatttttttctcgcatacgaaaacgaatacagtaaggtgatatccaacggaatcggaaaacggtcggaaactatccgggatttttcatcggatatccggagatatttttcagcaaaaaaaataaaaagaaacccagaaaccctagccggctagccggccgggccagctgcccgctgccgccgcccggcgccgcccgccgtgtgagcccaccagcaggctctgccgcccaccgccgcgcggtgcgccgctcgagcccgcctgccgcgcggcgcaccgctctcggccgatcgccgcctgccccgccccgcgttggctcatccggccgccgcccgccttgtgccctgtggtgtgtggatgagaggaagtgagagagagagagagagtagaaagtgtgtgtgagagagaggagaggaagagtcaagaggataaggttggggtgaaaaaaaattggtggattttttttcaatgtaaaaatcaatttttattttatatgtggctctttaaaatgaatttaaaggcactaaatcaactcatttgaaaaaagttgttaaaaacaaagttgtataacttattgagatctatcatttttattttggtcatttctccgtccgagtttgattaaattatataaaaatttgaatttaaaaatataagaaattcaaataatttttcgggtagtaaatgatttcaaatgaaaaaattgtcaacaacaaagttctataacgcatcaacatgtacaacttttgttttggtcatttttctatatgactttgtttgaaccgtttgaatttgaatttcaaatctatatgactttgtttgaaccgtttgaatttgaatttcaaaatatgacaacttcaaataatattttgaaatactaaatgatttcaactgaaaaagtcatcgacaacaaagttgtataactcatcaagatctataacttttattttggtcatttcttcatccaacaaagtgatagtaatattgttaacaaaatctacatctatcttatttggttctataaactataagagagatatgtaaactttgtgaacaatattactatcactttattagataaagaaatgaccaaaataaaagttgtatgtgttgatgagctctacaacttttatgttcatgactttttcagctgaaaataattacagcttcaaaatattatttgaagttttgaaattcaaatttttaattgataaaacaaagtcacaagaaaaaaatggccaaaataatagcggtaagaacacaataacatgataaagcatgattttagaaacatttaggaaaaagaatcatctaatttagagttcatatgagtgagataaattagtttcaaatttccaaattttatttttgcatacggcttcttaagtcccttaaatggtccacatacaaacaaatgaaaaaaattcaattctgaaaaataaccactcaaatttttaaaaactttcaattgaaatgttcaacccaaaatttaaaatattcaaccaattttcaaaaatttcaatgtgcctacgaaaatttcggtgatacacattaatttatttgtttcatgataacataaatttatatggaaagtaaacataacattttctatctcccccttgcccttataaatagagataaaatttgaaaataatgatgttttgatggctacatctctttctcgttttaagaagcttattttgaggggtcttcatattttgataattattcgttatcgtattcgtttcgattcgtattcgctccgtatctgtattcgataatattcgattccgttttcgtatccgggtttccgattctgatttcgattccgagaaaaaatatgaaaacgaatatgatagagctagtttccgaccgtattcgattcgttttcatccctacatgcactggatatagtttgatcaatagcctaacatgcattcagccacatcatttagaaataagagctagccattggatcatttccatgttttaatcacaaccattcattttgtacctattattcctcattaattagtatataagtcagaataaaatgttattgccataaataagttacactatcaccatctttggcaccattgcataacactttttcatctcagcctatatatactcataactatattttgaaaatttataactgtattgcagctgcacctcgcggggtgtcatctactatcagaaaataagaaaagaagagagaggaggagttaggcgtgagttgggcatccgatttaagaaaaagtgcattttgactcccttaacgtaggacaaatctaattcgtactctttgaccagaaaattggataggacgactccttcaattattaaaactggtgtaatttgactctcttagtggttacggaaaacagttttgctgacgtggccctgtgacccggtccaatcggcggactcaacatgtgggacccatatgtcagtgtcatattttcttctcccctctttcttttctcattttctcccctttttcttcagggcggtggtcggtggtctgcgaggagaggagcgaagtggcgagagggtctcgacatgatgtgctcgagcagcacgtcggcatcggcgggcagtgggtgtagtacacagcgaccgacggcggcgacccgctcggcgtggccggcgtgcatagcatgtacatgtcggaaggaggtggggacgggattcgcgacgggttcctcgggcggttcctacttggggagggtggccaaatttacatattaagaaaaatatcattacaatttgtctatttgtagccatgtcactaaaattttacaaaattagaaccgtgccactgccgttacttttcccatccttctccatctttctccgtcttcttccttctcgcttccgtcttctctctccatctctctgctgtcatgcctctgtcgcgcctcatcgtggaggacgagaaccgcacagccatcggcgtgctcggcgccatcccgccacgctgacggagtagcggacgtgtggagcggtggcagtagcaagagagacggcgctgacggcgcgtgaagcgagccatctcccgcagtgaggcgagatcggaggagagagagcttgccggcgacccaaccatggcaggcggcggcggcgcatggcagctccgctttctcctctccctcctcttccggatttggcggcaaaacccaagcgggtgaaatccccaaatcccctgtctcctccttctccgccaccacatggatccagctgttggcttgccgatctggtggtgggggcaacctcctccacagcaacgaccatcctcctccgccacctcgacaccgccaccgtgctctggcctgcctcccgcacccccggcttcctcgacggtgatggcttcgtcctcttctccatgggcggcaccatagccgccgctgtcctccaccgcatcgacgctgccaccgcactctgcgctctggcctgcctcccgcgctcccggccttctcggaggtgatggcttcgtcctcttctccatgggcggcgccatcgctgccgccgtcttccgccacctcgactccgccaccacgctcttgcctgcctcctacgccggtgaggattgaaggcgacggcaccacgtgcggcggtgaggacggaacgaaggaagaagacaaaaaaaaatgtaggggatggataaaaaacatcacggcagtggcacggttttaattttataaaatttcaatatcacgattatgaatagacaaattataatgatatttttctaaatatataggaaaaaattacaattgcaggaatccaattaacgaattaaatttgaaaatatactgttgattagttttttttctcagaaatatttgggatgtaaatttttttttggcagaaatatactatcagtctcgcacaaccgttacgcgaaaatgacgtgagcatgatgatacagacgttctcacacgaggaaaacgcgagactttgcagtatcgcgtaacgacgtcacgagaccgtgcggtgtcgcgcaacggaaaacgaaaccacgcgtcctcgggcgcacggagaagccacatcacaagcgcgtgagcgaacggcttgcttagaaagtagccgcattattagtgattaattaataataattagtaattaatgaggttgattagcgattaattaatcgataattaagccattcggtctcgctccttctcgctatttcctcgcggtctcgcgttttcttcgtgcgagatcgtccatatcatcatgcccacgtcattctcacgtgactgttgtgcgagaccgatagtatatttctaccaaaaatttacggcccgaatatttacgagaaaaaaacaaattaaaagtatatttgcaaatttaattctccaattaataacccagataataatacagttccattcctattgggctcatgaggcctgttatgtcggtggcccacgtgaggaacgccggcctgcacgccgcacctctccctcttcaggcgtttccatccatacaccatacccacccacactactgcccctcattccctctatagatggccatatggcccgaggcccacggcccggcacgaagcccgcaattttggcccggcccaagcacagcccggcccgactagggtcgtgcccgtgccggcccggcccgacagccgggccgtgcctgggctgcaccctcggcacggtgggccggcccggtacggcccaatcaaataaaaaaatacagggatgaaaaatagacttatataatcgtataaggcatggcccaagacaataggtatacaaaatagacttattatccagccatttaaacacagcccacagagttgagggaccaaaaatagacttatttccagccatttaaacacagccactgagttgacggaccaaatatagactttttctgtgaggcagcacaatagcccatcataccttcgggccggcccggcaaaccccgagtagtattgggccgtgcctgggccgtgtatgccacccgtgggctggcacggcacggcccggtgcgtcggtcgagccgtgccggcccgacaagcctcggcccaggcacggccgggcttgggccgtgccgtgccaggcggcccagatggccatctataattccctccctctcttgtcctcatgcacgaccacgaggaggcgaccgccgccgcacctctcctcctcttccacgacgaggcgccggtctcgccggcggagcccagcatcgccggcagatccacgtcgagcatcgcggcaggagcaggacagggagaggccgaggacacagcgaaaggggatcgatcgatcgatcgatctagggttttttgagctccgccacccgccccctccttcccgatggagaccccctccgctcccgctcccggggatggaaactcggctcccgcatcatctcgggtgacgtttgaggatatgcttcgcagctgcgatcagagttattatcaaatgctcgggttccctgacgctgcttcctacttcgaggcaaaggagcgggtaggtacccagattatcccttctccgtatggatcgatcgatcgatcgaccgaattgcaatatcttcccttcagacattcatttggctcactggttatgcaatcattttgcgactaactataaatatggcgacatgttttttggggaaaaaatactagtctgttgctgataacaggtcggcaacacagcaaagagacatatttggttggcaaaacagttagattaaatttcctgcaacatataatatttagcaagaatataacctagactagatcggtggtaagaattcatatgaacaagctccaatcaaatttcaaatttttattatctatctatataaaagttacatcagagttacagtgcaattacaatgtaactttgttgtaattatatataattatggtgtcattgtgctgtaattttaaccaaacaaaaagcaagctagtgctagctgtctgttcccggtgtaaaatgttgatttagctacctgtttcacactgctacatgcagggcccttatggagtgtagaaaactagtgttgtcttctttagttggatagaagcatgaatcataacacagatcaaacggtcaaacaacttactgtgattaagcaaaaaatctgttgacacaactatagcaactccaatgatttttggcttcctttgtagaatttgttgggtcagtatattgattacgcaatgtttctttttgggcttcctttgtagaatttttgggtctgtactgattatgcactgttttcttggcttcctttgtagaatttgttggctcagtactcgcgtcaggtattccctctgctatggcctatactggagaaggatagcctcacgcgcttcaatcgactttgccaagggtggtcgcgcttgatgggccttcgtggtttcatttacccggagattctcagctccattgtcgccaacaacgctttgcgctgtgccagagtggccctgcaaggcagctctccgttgcgcggacgtcgtgccgatcccaacggcctccatccttatggctacacggctctccacctggccgctgagacgttcagcgtcgaaatggtcaagctcctcctccgccacggtgcgtcagcaaaccaccgcactgagggcgactacgtcattgagggcctcctgcctcttcacgtcgctgttgagaatgccagcatgcacaaatacctggaggacaattgggctgatggccactctcctaacaacctcatatctctcctctgtctgccagagatggttagtgtgcatctactataataatttatcgcgaacatccatcaagctaccactattttgtttcttttagtctgcttacatttacttcatatgccattactctcgccgttttgttcagttaactatgtccatgaatgcttacatgtaaggcaaaaattatttactagtggtagggtagctaccgccatgcctcatttgttaagtgaactttatctgatttcaagatttttttaaaatcttgtgcataactaagcccaatcatttctccttatttgttgcatgcatccatcgaaacttgtttacagatttttcatgttgcctcccatttgcagaagatgtatttggacacaactagattaattgcccaacatacgcataacattgtcgatgagttgtgggattacatcgataagaagaagtttgtccagttagcaattttgctgctggcttctcagaagcagctccatggccccataaataggagccgtggcaaggctaatctgaatgggtttgaatctattagacggcgcacttatgaagctatcagtggcctacatctccagatgatagctatggtgaatgaggggaaaaatggcagtgcgcttaagaagctgaaagagaagaaggaagcccttcttacagcagacgcactagttggtattatagacaaagctggtcaagatcttgaggattatattcagactaactcagaggtagttcctaaatgatacccccctttgtgatactaatgagttttcattttctatttttatgtatgcttcaaatttctgtgatgttgtgcatgcatgacttcgttctgctagggatgctccaattagtaaaatgctttcttttgtgacttgtcaacagtaggagagattcctatgcagtttaccatctagtcatcatcccataaaaaagaactaaacatatctttacataaacccaagagattgtcagtgctgctttaaaagtttatgtattcctgtttgacagtagaatatttttttttaaaaaaaatgtgttcaatttgtaacttagtaactatttttattgatataggataattctttttgtcacaatgtagttcttttgtcagtcatctaaaaattaactaatacaatttaggggtaatttcgttcatacccttgttttgatgttcaatatcgattttatcctcattttttagggttttcatttttacccctgtttttttgaaacgaagttttattttacccctactctggatggtcaagttaacaaaatgacatttataccctcagttgtggttgcacatttgccccaatatttattcattaattctgtttttaccctggtttggaacatgattttggttcggaacataatttcgaaactcaaatgattttgacaaacttttactaatacatatgaatgaatgaacaatttgtagcccaccgtatgcaccaatatgtacaggcagaaatcacaatggatcctagacagaagtgattctgttctgcaaaataggggcaagaacgaaattatccctacaatttaagatcactttcatgggctgtgtttgaaatgtgtactgcaggaaatgtaaaaaggggtaaatgcctaggaataggcctaacatttgaagatctatttggatcacatgttttattttgggcgagtgaaacacctgatagttgttcatatggccaatagctaaacaaaaagaagtttcattaaaaaaatggagaattttgggatccatttggaagggaagatacataaagagtggtagataggaatctcatactatctttcctgtaaaattcctttggaatgcaagaacaacaaagaaaaccaagatagtaagagcgccaagaacatgcgatgattctagagcttcctcacacataggatcactactgcctatcacatcatgaagtgcctgtgaccacttaatcattaatcattctatcactgtcatggttggcactgctgttgccattcatggtggtggttgtgatggaagtaatgggatgacggagagtagtagcctggttggtttaggcagccccaactttccatcaccttttttttataaaaaaatgttttctaatttattgtctctcagtctcagttgtgtacaatgtggcctttgtagtggtaactaggtatgaatatcttctttgccgtcttgttgtgtaaaatcggttgtgattcgtgttttgtgatgtttttgttttttgttttttggtgtttccaagggtcctcctgtgttttcgaaaaaaaagatatatcttctttggctatttccacgaatatttacagcaaatacagccagtaggctactagcagtggtgcagccaggaaccagtcctagaactgcccttgcctactagcgcgaagtagtagtgtataccatgttgagaaatctaaagtagtgaaaatactaaagtttttcaccaccacaaagcgccaggtcatcggatatttaggaccgtcggatgcagccacgaattcaaccgctgccatcagatctgaagtgaagaggagtgcaaaatcctggtgaatggtagaatactccagagtctggccaaccaataatagaagccacaccaccatgtatatataagaatcactgagtgctccaccaaaaaagaacgcaaaacccagtgaacaaaagaaaaaaaaacaacacatccattggagtaggtgaaaaaggtacaaaaagaaaaaaagaacgcaaaacccatctccctaaacgcatccattccaccactgcctgcccacctcctcgcctcctcctcacctcttcccccattgctgttgcctcctccgccgtgcgcactcgccctctccatatccccgtcgccgcagcaagcccaccacctcagatcctccccatcccctccggtaaagttcctcatcctcctagtgcccgtgacagcctcctagtccccagccccatgccgtcgccttctcctctctacccccggcgtcttttcccctctctgcacccggcatctcttcctcgcacagtccaccgcctcctcccccattgacgctaaagccttgagctacgcgctttctcatccccatcccaatcacagctccagaaaatatcgaggttcacaacggtagatcaaggcgggcaacgataaatcggatcgcagcttccagtcacccctcgtcaacgggatcaacacgtcaataacccttggtatttggtgagtcacaaacttagtaaatcccatcgcctcctatctttgccttcccaagctgtagccaggaaccagttggggtcaataaagaacagtgatgggatggattgatgaagagcaatgttataataatatattagaaagcacatgtccaactgtgtttcgtaaaaaaaaaaggattgttcctgtgttttgttcagcaagggaatattaatgtgataagctgatagccaactcaaatgatttttttttcatggacaatagggtctttttaattttttttgccttctgagttctgaagctgaaagccaagcgcaacagttcatggtcaccatgtgacaataggccctctggtgtgtccttgaagcctgagggcacgttaaccttaacctgtttaagtacaaaaaaatttaggttctacttgatatatctttaaagccaacatcgatagcacctgtttaattgtacaccaatcacctgaatactggagtttctgactctgcatttagcctatgtaaatgtcaatcatatattgcaaactgtttatgcacatgtcaatataggattttagcgtgaatttgagaaacaaaatgtaaatgactgcatctgtaattactacatactaggtacttctgcatttttggcttgcaatatgctgaccacaaatggttgtcaagcctgaaatttatgatgactttcttcactcattctgatagagcttctttgatagaagaagttatatcttcttactctttaagattctagatattcctaccctcaacagcatatttcttcttactctttacgattatagatatccgtaccctgtttaacctttacgatattatatacactttgcaccagcgtatacatatatcttaaatagaccatcacatactaattttacaggtcatcatggtcgtgccacgcgcgacctacgtggctagtgttatttgaagttatgaactcagtaccatggcaaacaatgttcttaaggtggcggcgcctaggcaacaatgcactcccagcgcgatgtagagctgcaggagattcagaaaggtcaatcttgtgttatcaatctatataaaactgatggtcaaatgttaaaagagttggacttaggacaaacctagatggacttatatttgtggtaagaatttagtacttagaagacgatctttgtgtttttactgtgctgtactgtttgtcttgagagatgttctgttcaagggttattatgtgccatgcagccaccaccacccttgaaatgtatctgtataattgttggaataatgtcttgaacatttttttagtgacttacaaatattttgatgaaacgtaggtaaaccatgaggaggtccttgaacacgtttcatcaattctaaacagcaagggcattgttccttctgggaaagggatagacactgcagaccttaaatggtatgtcatctattagcttcaccttcacttatattcattccgtatcttctaaagcacatccgacatatagttgatgaggcgttcttttcctaaaatattccttcttgttttgaagctaccgatatcctgggcaaacatcaattaatatgtcacattcacgaggtttgttacttcttggttgattttatttcttaatactagaaaagagaaaaatttatacttccacctgttgtttgtggtgatgcactactttccaatattgcagtataaaaaacctgatcttatccagtaaaaaaagggggtgcaacgtaatgtaaagtgaatcaaaactgactggaccaccactctgctgctgaccgacaagtatcagctgtggtgctcgtaatattgtctgcagattcttttttttattcatgtatgtattgctgctgccaagatgcaaggacaacgattttcctccatatcgctaacacccataacaatcttagccattgcctattgattagatttctggctatgattaactttctgttcctttacactgtgcctttattgaatatagttgacccctaaccaattcctttattgaatataatggacactgggggaactaatgaagctgacaagtcatatacccttaatgctgaaggttgtaaaagggtaaggtgatactttactaaattggaattgtggattatctttcttttcccatgtcaaaaatatgtttacttcaacaaacatataattgctatgccgtttttttgcaagtacttgacagcaaaagcctttcagttttgttgaaaaaaaaagttttagtctgatcactgtaacttcttgtgatcctccaaatggcaccgtcaattcttatcttagttgttcaagtacagtagtgttgtagtctactcccttcgtttcacaatgcaagtcattctagcatttcccacattcatattgatgttaatgaatttattaacatcaatatgacttgcatttgtaatctgttgagtctaatttgtacttatagatatttatagtggcattattcttctgaagtaacatatcctatcaacttggtcgattaaatatttaaggtggtatttgatataaattaaataaacataacacgtaacctctagttgccgccatgctgtttaacaagttaccatgtatactcattgcttcccaggtgtttgttgtttatacattcagatgctacgtctcatgtaaacagatcccttcaaagcgaccatctaaactactggtcctaaaagaagcgagagataagttctttccatactggaaatcggtgctgtctgcccgtttgccgtgaagatagttccaccctgtgaaccaagcagcaatgacatacaaaggactgaaccaaggaaggacatcctaagtactgaagcaagcaggaaggacttgcaacccccaaacaaatcaatcgcgaatcttgtttcgacgtcaaagccccgattggcaagcaattatgaatgcaggaggcagctttgtgctcttgctgcgatgtctcttaaggtgttgaggcgcacgtgagtgaatctatatggtaatatacctgttaaaatactccttttttaggctactgcatgatcgtttcttttgttatagaatcttttatgctcaatgttgctataatctttgtgcaggcttggtaaagacgaaagtatcggcggcatgagagtagctgtgctagaatctgtgttcgtgttcttttgaccttcgtggccgtgttatattaacatgtatgtacttgtcatgaaaataagatatatatataccagatgtaatgtatttcaggcttgatgcaacctggtaacttggtaagatttctagctgaacacattgtgctatctttgggagtgccttaattttatgattaaatgctgtggtgccttgtgcaatgtgaagatcgatttaggttttactgaagtatttatatagtggcgctgcgaattgttgtatttagtgtagtcgctagtctcctgtaacatagctatagaatgggtatggctgcttggctatttggcctttgggaagaaagcacatactctcgtactggggacgtggagtatatgctatgtgacgtcagaaaatgtattattacagcatacgctactaagtacggtatttcgcagtctacttggcaggcagtattagcaggtctcgtggacgatccgcactagctcccatgtattgaaatgtggcacattagctttgatcccatctactaattggctctattgatttgcgtgcacacatgacgcacgtacacgtacccatgcatgcatgcatgcatcctaattaattagttagttaatgcatgcatcatcctagctaattagtaattagttatatgtatgcatgcatatagccgaacttaattagttactactaggatgttaatgattcagctatatgtgatgtatgtgtatgcccgccgatgcgatgcatggtcgcgcatccgacgatccgctccggccgcctcctaactccaccgatttcctttcctccaacccaccggccgtcttcttttgtttgtttggttagcttaattagtccctcaacctcaagagacgcggaattaatccctctcaagttacttcttgacaggtaaatatgtattaatgttctctaatcatccttaatctctatctagctattattataggaaaagaagctggatccctaccacctcaaccgcaaccgcaccggtgtggtcgtcacgtctgtcggagtcggagcccaagttgcattggtgcgaccgcgagtccgaccgacgcactaatcttgcggcgaatgaccggggaaaaaaaataaaatcaaaaagaaaaaagaagcgcaaaaacctactactactactacttccctcactccagagtccagaggcaaaaaccctctccgccgtctcgagagcaccgctgcggaggaggaaagccggggagccggggaggtggggggacgcggcggcggcgctctctcccggcccccgctgcgcatcttcgcgcgcggcgtctctagctctccccccggcccgcccggcgcccatcttcgcctccgccggtacgcatcttctcgaccttgaggcctctccccctctcctctcccattctcgagggttttattttgccatgttgccttgcctgcgcggttactggccgagagtttcttggtgacgaaatcttttggctttttgatgggtacggttctgtctgtgcgcggggaacttcacaatttctgggccggtggggaataatatatgactagttataacacaggtcttatgtctcttttcttatgacacattgtggatctatgtatgacaccattatggatgcactaagtagtttattaaatgcattgcttatttgtcagtcttgctaatttatttctttattattattttttttttgaaaagagggctttgcctcgtatatatagatagagaatcgggctaatttaattgtaaatgctgttaatttgcagccatgttacttcgacaagtgaatcaaaaatcatggaatcttctgaagcaacatagccgtccagtgtgccttcacttctcttctgatagttcggccaattcaacggctaatattgatcttgatgctgaagctatctgtatgaatcctttgaagccttactctaagtgttggttttatgtgcccccgtggatcaacttgccgcccataaataaggataatgatattaagaagttgattagttctaatccttcaacagtaatgaaagcttatgagactagcaagttagaaatgttgtttgagaagaaagttcgctcctttcttgtttcaaggtgtattctggcttgcgaatctataaatggtcctgacatcaagaaactgcattttatgaacaagagtatcattggccactttcctgtctatgtgacctctctctctttgatgaagtgtttgatcaaacatcgtgaagaatactggattgcaatccttcaatcacttgcagcagagaaggtgatggtattacctgactggaaacaagaattaactcctatcgaggtttcgttcttcgatcatggactacagttgccatccaagtctgaaacatcccttgacttaattacttgcgaactagaatctgatgcgtcatactacaaggtcccagacagtgaagcaacaaatccagacgtagcaggaggacaagaagcagccataacaactactgaaggatcagcatcagcagaagtgggaatggcaacaattgcctcgattatttggaacaatagagcgattttagaaggccgaattacatgtgggcttcgttgtgaggattctgagcacgcagaagcaattgggattttaagcggacttcaactagcaagaaaattgaagataaaaaagatagatgttgtaactgataatatggaaatctatgaggttctgattggcagaaaggatgtgtttcagcacaagcatcgtgatgttttgttgatggctattgaagtagctaaagaattcgatgtttgtaggtttaggtgggaacctcgagaattgctgtgccttgtgaatgaaatggcaaatgcaacaagagaagattaccgggcaaaaacattgagcttgagaagaatttgggagggcaaagtagcatattgtctgtggagtttaccggtcattcgtataaaccaatcaacaaagaagattgcactaaaactaggtatgtcaatgtactatatgcaatttatgttgtttgttgcagtttgcaatttatgtactgcaccatatgtactgtattttttcctgttgcactttgcaccagtggtggacccaggatttttatcctgggtgtgcccatgtcacgagcaaaatcaaagccttcacacataaataaggttttagtttatcaaaaagtttagcacaaatagttgttattttggtgttgaaccaacagtgcatccttagatggaactaaacaaaactggaacaacacaaattacaatttattcctattttcttccgatattattcttccctgttctgaatttcctcatcaccttcacagaagggaaaccctggacatagcattggtgatgtagaacgagtacagtatagaaagagttaatgcctatgctcctcttcatagttgactgattcaatttgacctaatcctacaaatcacggaacatgccttcactgatttggcatttcagttttcaattgaaaatatagccgtctagagaagcaggacgagaaattttgaaacttcagatatatatttttttcagtttttcaattaatctcttccactgccaaaggagaaagagcatacatgcacggctggaccttggtcgccacgggcagcctcctagtcctcgttgccttgctgattaccgtgcgatccaccagcgggaacgcatgcacacgccaccatacaatcttttggtgagctatgcgagaatcatggcattgggccttgatctgtctacttctcgatgaaacaagttacacatccattttttaggccaactaaagcatagttagatcctaaaattttttcgtaacttttgggtacccggcaccacctaggtctgcccctactttgcactaacactttgttttttttatatatgtagaaaaaggctgggctggggaggttaatatgaagttggttcaatcaaaagggtatcatgtgaacgttcgagaacaaatgcttaaaattgatgcattggagggattacttgacagtctggaccctccactgttaattgtattagtaggatcagaagaggctgcaagtaaagtctcacttgagctgaactggaggtttcgttccgttctgttgaggggatctggtcaagttagtggttccataagcaatgcaaatggtgactgcagtcctattccagagggtacagctcttgttctgaatagtgaaactaatatcccaccattttctgcacaaaaggtccttctagtagtttatgacacgccatcaagtgaactacagttcagtaaagatcaagataccacaggagttatcacagtcagaatcgtcgctcctcacgaggaagattctcttccagatacctcgactgaggtcaatcctttcgttttggggttctttaactcaggtacatattttcttcgcttgaatctgcattttggttctttactaaatgttatatttgtgtatcccacttgcaagttattcacttgaatctgcatttcggttgtctttactaaatgttatatttgtgtattccacttgcaagaaattaatacatgtaaaaccatgcagctaaaacaaaagcacacaggaaggaaaagacatcaaataaatcctttggagaaatttggtcaacgtgggaagatagaaaaggctgatgactctgttgtcttcaattcgatgccctttacatgctcttcaatatgcttgcttctttttggggggaattttaactatttgccacttttctgtttgctaattattcaaataccccttttaggtttgtactttaatctgtcattggagagagaagaattcttaattttatgctacttttgcttatgtggcgggacaaattagattggcagcttggatgtatggtgtgaaatgtctagacctcacccgtcatttatctatctctcttctctccggtccggtgtacggaccacgagcccacgaccgatccatggtggggcggtaggtcgttgtggcacatcctgacgcgatggccgctccatacttgtagcccaggattcaaacatacttgcagccaagaaatagtccgaatgaaatcaatcgcaaagagacaacaatagtacgtaatatcgaagggaacagccgatgaaaccatgatacaaacgagcatatcgttcagaaaagaagcgatatatgcaagaacatctcaaatcagagagcacgcacgcaatggatttgtacatggatagaagaagatcgatggatggatgtgttttaccggaggaaaggatattacggagcgatctgccagggatggagcggccgtccgtcgtgccgcatcggcgcatgcgctgctgcgccaggctgtgccatagcgccgcctgccccagcaggagtgcaggacgccaccgctcccccgcgcttggtccgccgcccgtacgctggagaaaataaggttggagggatggtgctgacactcacaggtgaggtctacgctggcaatctgatttgtctcgccacatatgcaaaagtggcatcgaattaataatccttctctctcctgtaacatattagtaagtgcaaacttaatatgggtatttggataattggcaaacgtaaaattgacaaatagttaaattctccacaaattttaggctgaaattctatttattatcctccatttattttcctcccaccttctcaaaaatatatttgttagaggcatatcacgagggccttcaatcggacctgacgaaaccaccgacaccataagacgtcggctgagtccaaggggtgcacctggggcgaagaccgaaggattcgccaccaaggtcaccatccggccaagtcgctacctcgactcagcaagcagcggcttcgaccacgctcaactctactcaagaaggcgttgacctcgaagcacaagccgaagcagaggtgggtgcgatgcgccaaaacatgaataagctgcaagacatgcttcgccaaatgcaagagcagcatcaagcgcacgaggcagctaggcaagtcaagtaagtttcggcagcccccccatccatcttcgatagcgatgatcgtcgcccaagctccagctacccaccaagctttcggccaagctgtccctcctcatgtggcgcaggcattgagcatgattaggcaggccaaccaagctccgacgtacgttgccaagaccgctccgaccgtcactgcacggccaacccctcacaccaccatggcgccagtacggccagcggcgatgcaagtacagccagcgaaactagtccaaatgccgcataccacgatggaaacaacttcggccctacaagcgcaacttcaagcttttcttcaacaactcaaccaaccccacaccattccaagaccagcccctttggcgcacgccatcgggagctcaagtctggcaaccatcaagtcagttcggcgccgtgcaccaggcgaaccaacaaggacaaggggcattgacctggcagcaggcgccgcacttcgaacagaatgccgcggtccaagcaccttcgactgaccttcaagggatgatcgccggtatcaacaccacgcaacaagcgaaccagccaaatcagggcgccatgacttgggcccacgtaccacagttcgacccaagcatggcggtccaagcggtttcatcagatctgcgtggaacgctgtccagaaccgggccccagccgaactcaatggcacatcatcacatgcaacagcgatggcttcgccattcgtggctccgtatcaaagcttgaactcacctttccagcaaggcatgatgacaagggctggggacgaaaagaagctgccactaagctgggggctcaagaatcatcccattcccccagttcaagtacccacccgttgcaagatactcaggcgaaacagatccaagcgagttcttgttgatctacaagtctgcaatcgaagcagctcatggcgacgaaaacaccaaggcgaaggtaatacatcttgcgcttgatggaatcgtccgctcttggtatttcaatttgacctctaatatcatttactcatggaagcaacttcgtgatattttcattcttaacttccgaggtatctatgaggagccgaagacccaacaagacctctttggcattcgccaaaagccaggcgaatcaacaagggagtacgtgcgacgtttttcgcaagcacgatgccaggtgcaagacatctcggaggcatccgtcatcaatgctgcttcggcaggcctcctcccaagcgaattgacaagaaaaatagcaagaaaggagccacaaactgtcgagcacctgtttcgcatcgttgatggctatgcgtggggcgaataagacacaaagcaaaggcttgaaattcaagctgactatgacaaggccgccactgccacggctgcgcaagcgacggcgcaagcagccagagccgtgcctatagcaaatcgctagttgcagctggtgaatcaagcgccgctcccaagacccagccaagatcccatgacttggaaaaagttcagaaccgaacgcggaaaggcagtgatggcggtcgaagaggttcaaactctccgaaaggagttcgacatagatacatgctgtcactatcaatggcccacctctactgtcccgtagcatatatgcccagataatgatacttaataatctagacaccacgtctacattattaaatattactctatatcctctggaatgacatggagcaaccgaataatcggacattaaacccataccattgcacctctctggtaagctagctacacaactaatacgacacaaatataacataaagccgatacttagataaagtaaagtaccgagagtatataaagaagaatattctattaattccgaaaatcttacaaaagaggaaagtagaactactaaagccatacctgaactcctccgaagacttcgaggattccgagagctattctattctactccacttagcactagagcactaaactaaagtatggagagatcttgagcttgcttgagtgtgtgagggagtgaatgaggcctcctccttttataggcaggtaattacggttacttctatacaaattgtccaaactacctcgcaactgtcattgggaagcaatcaggatcgtccacgtgggacgccaagataagaggagctagtcagggttcgccgaacctaggctggcccaacaggcctccagcttcggtagggtcactgacaggtgggtccttatgacggttatggtagtttttgtggtttccaggacggttacacctgacatgtggacccatattatcctttagcttgattaggagtgagttttcctcattttttcgtttattttatttgctcaattctagcaacaaataatactacaagtacaagtggaaatatactattctaaaacaaatatgcattataagcataactagttcttctttattttagttatattgacgatcgaaattggtctataacgaccgtcaacaacctcctagcctctccttcggttgggaggctgcaccaacatcttgtacctttgttgggctcaatcctatgattttgattaacatctgggcccttcaatccatgtaaatgcgtcccaattttttgtaggtgtattttcgttgcatgacggatgcattgtctccttaattgacatgcatacatagatttactaaaactagtgaaaatggttagttgtaaatcccagtcactaagatttgatactatattttatatttcttatgtaggagttgatggttaaagtttgtacttaacgaccgtcaacaacacctccacacttatcttttactcgtccctgagtaaagctcatggatctactacagttatggctttctgtccaatgatatgatacacaaaatattccaagacatacctgtgtatttgaaccttgatgtgtctaccatgtcatcttgattgaagaatgaaacggtcatcgactcaagtcagctttactccttctgatgaattaccctggggttttctttggtgcttgtttaggatgaaaaataacgtccgagatctctctctatttagagagatatgtgtgtgtgggtgtgccaatgtacctaaatacaccataaacaacacatagggaacatgcactttattaatctcgaggatcataaatacaaaatctcatgtaatgatacacgctacatagtccgtcattggacatatccgaattgtgcgatgtggtcttcctggttcctagggcctcgataagctcccatttaattacctccgcaggcgaaggcctacagcaggacctcggattaagctgcttgtggtcatcttgtcgtcttcgtttcacaatctccatgcatgattttggtggtgtagatgtgggcgccggcaacgatccacaacctcgtcggtccgtgcaccggtgttggtgacatagccttcgcatcggcttcactcgccctcgtctagtctcgccggtcttgagcgatgtgttggtgtagattgcttgaataagacatacatggattcgcgtagcttggatggcttgacgtcatagaagttcactactacaaaacatcaaataggtgttggcactataggtgccggagtgctaaaaccggcaccaataggccttttcccacctctgtgggttgaaatcgcaaaaaagggcacctttaaccaattataggtgtcggttctaaataaaaacctacacctattctatatgagtcggttttttaaaaaaatcggaacctttactataaaaactggcaccaataataaattataggtgctgtttttttttctaaaaaaggcacctacgaattgagccgagccgattggccccaccacgacgcgtcgaggagataaggtctgctcgctcgttcgaactctctcttctcctcttgatctctcttgttctctccgctctctctcgcccctctatctcgctcgctggtctaggcggcggcctggtggagcggcggtggcggcggcccggcggcgacgccctccccaccattctctctctcttagtggcctggcggaggtggtggcggcccggtggtggcggcggcggccgttgacgtgccctcccctcctccagatccagtgggagggaaggcggcgacagctcagcgactcggcggctgcgcccttcctcggctagatctagagggaggcaacggccgtgaggcggcaacacatcctcgggcgacggcggcggtggtggttaaggcagcggggaagtgttctatgttgttaatgtgttcttagatgtcttctgttttctgtgctgtgttcttgacatgttcttgaagttcttgatgtgctcggtttgattcgtgcttgggtcggcttgattcgagccgagccggcatttttttggggctcgttcatccttatagttgccggttttaaaccgctggcacctattttgtttgacatcagtgtcgcctccgtggtgccggttgggaaatccgacacctatgccaggttcccaaccggcaccaatatcctcttctgtagtagtggttgttggagatggtcagtgtagagatatcggacttcactcgcagttgaggacttagtacacatcctcatagccaagtgagtataggctgtatagcttaattagtactccctccgtcccataataaggaattttgagtttttgctttcactttttgactattcgtcttattcaaaaaattttggaattattatttaatttttttgtaacttctttattattcaaagtaatttaagcacaaccttttgttttttatatttgcacaaattttttaaataagatgagtggtcaaacagtacaagaaaaactcaaaattgacagagggagtaattaataagccatttggttggttttcttttcactgtagtactgtacagtagcatgcatgcacacgtaaaacactagcatatcaggtgacacacaatggcgtggcagcgacgacaatgatgaacacgtgaggaagggggcagcgctggcgaagagaccgcgacgagcgtgaaggcatcgcatgcattgcccggtggagtcttggtgagagcatcctcgcttagcaaggctgcacaacgacggcgccggcaacaggatccgaagatgtgtcatcatggcttgtgaacggtgcaacagcgatcatcatggcaacatccccgaagtttgcggtcagtgaagcgacggcttaattggaatggaagccatcttggatgggcacactactagaaaaatcctcacaaatcctacagggaccagctcataggtgccggttcatttaaaaccagcacctataaagctttccccacctccctatgatgaaaaattgtagaaccggcacctttaaacacgctagaaccggcacctataatatattataggtaccggttaattaaagaaccggcacctataatatattatatgtaccggttgtttttaaaaaccggcccctatagctttgagccgagccgtccagtcgagcctacccgcacacgcatctctccctcggtccttgtctacttcctcggtcccctcaatctctcgcatctctctccctcccctctctttctcacgtctctctccctccccagctcccctctctctctcggtggctgcccggcggaggcggcgggctcccgcagccggtggctgcctggcggaggcagcgagctcccctctctttctctgtctcagatctggccgggcgacagcggcagcggcggtggccgcgcccttccctccaccagatccggcaggaggggaggcggcgcacctcagtggagtggcggtggccatgccctcccctccgccagatctggcgggaggggaggcggcgcacctcggtgacggtagcggcggcggccgtcgacggcaggggtggagaaggacgccggtggtgcgggcgaggtggtgacccgcggcttgagttcttgagtgtatgagtttttctctttttgagttcttgagttctttctgtcttttctcctccttgatccatgccccaaatataatgtgaacttgttgattgatctattgaattcttttcggccggccataggtttgttgttgatttggccgagcagccgtggtgttctaggggatgatgtgatccaggaggcggtgatgaagggggagtagggctgggctcgaaggagacgacgggtgtgtggttggtgagttcggctcgatttgagtcggttctctttttttttttatgctcgagcaaagttaacggtgccggttgttagtattggtgtcgaccaataggtgccatttgggaaactggcacctatagccggttcccaaccgacacctatgataatttctgttctagtggcagcaccatgcatggtgacttaattggcagcgtccgcgtgtcattctccgacttctagatcagcatggcttggcggcgtccgcggtggctctggcgatcttcggcgcactccggcggagtggtgtcacgagggccttctccggtgggcagcagatggtgatttagtcaacgactcatcggagacaatgttagaaataatcttgtcattagtactatgcatgtttattttgttcattttcacgtatagaaagtggttttgcattgtagcagtgtttggcacactaaaaaagcattttcgtcgatgttgggtctttttttcacaggcgggtatgaccctcggaacccaatatccgcctacgaaaatatataccgaggtggattttcatcatccacctgcgaaaatcaatttttgcaggtggaccacttaagaggtccgcatgcgaaaataaattattttcacaggcggaccacttaagatccgcctgcaaaaatatgatttttacaggcagaaccttatgtggtacacctgcaaaaatcatgcctatataaaaaaaaaactagtcccctcttatcatcttctcttccatcttatcctctcccccaccactcattccttcctctctctgctccctcccctccccttccttccttcctaccagcggagggagtcggtgccgtcgcgggcggagggggctggcggaggcgccggcggagggcgtaggcagcggcgcgtgcggagggggccggcgaaggcgcgagcgcggagggtgtcggcgacggcgcctacgagcgacaacgacgactaccgcacaacgacgacgactaccgagcgacaacgacaactaccgccggccgcgtcgctacccctcccctcccagatccggcataggggatgggtgtcgagttgcatgcccaatagatggatactacatacccaatagtaatcgactaaattcggcgggacccaccacataccatgtcttatacggaaacaaacctcgtatataggagttccggataaggaaggatgagtagagttctatatgaaaacgacaaggactaatcggattgtatctatattggtctccctagttctacttggacaagggggcatctgtgggtataaatgcaagcccccctaggagagagggcacacgccacaaagtcacgagccaacacaaaccaatacaccgccagatatcaacatcagagattagcctagacaaacccaatccggtgcctatggtagccggtaagagggatctagcgctatctctgatctcgacgggttcatattcaaggaggaaaactaccccgtcatcgactacgagctggttatctagccgccaagtcaacgacagctagataggttatcccaaatattgtatgtgtgatctagataaataaagagaaacaccggtttaggccaacaagatgtagggttattatctgtcagataagaggcccgaacctgcataaaaatccttgtctccatctcttttacctcaatctcgcatataccctggtaccaatgatccccataccatccaaataccgtagtcgcgatctcaaacgtcgacagcagctgcacaaggtggatgggtcggtggcggcgcgggcggagggcgtcggccgtcggccgcgacgacgaagactaccgcaggacgacgacggccctaccgcgcgacgatgacgatgactagcgccagccacgtcgccagccctcctctcccagatccggccggaggggggagggaggcggcgacggccaccccatgcaacggaggagttcgctggcgacgacgacccggagacgacgacgtgtttttttaagtttacatgtacattgatgttaacttgatctgaatttgaatccaatgcttttgtgttgcaagtttacaatgtttgtgattggatttattttcttggatgagatttgtgaatatttatgatttgtgatttgaaaccctagggaggggtggggctggcgggaaattttcttggcgtcgagggtatttttccaagcgaggctactgtagcacttaaggcgcatgggaagattcgacatcgctcgggtgctttggtctgcctgtaaaaattgggaaattttaccgtcgtttggatacaggcggatggctttgccgcgtgcgaaaatgtgttctgacaacctggaaaaactttttttctagtagtggcaccagaagaagaagtacatagtggcaccagaagaagaagtacacagcaatatgtgtgatacgtacaagtacataggcttggccggagtgcagccggattgtacgaagcggccggagagtagcgacattatcttagacgtggaagttgcatgtaacaactagtgattagtgtggttgctttgagtagtggttagtcgtgtgtgatgcatggctagtagtagacctagtattaaggtgtgctcccgtgtatgcagagctagtggcattagagtaggaagagtttgttagcttgcttgcatgaaagtttatttagcattttacatggtcagctttgctagctcgtaggatcgtgtgcatgcatgatcagcttgggatcgtgtgagtgcgttgccgttgtatagtacgtacctacatcttggcttaagttaataagaaaagaggagaaaaaggacgtgagctagctgtgatagctgcgtagctaaaatctaaattcgtgtgttcttgctcattgtgtttgtgtgtgtgtgtccacaagagaaaaatcttgagtatttgtgataaacacctagagagtgagaggagagattcccaacagacaagcactggttggcagcgctttggcgactcaacgaaatggttgctggcacgtacggatggagtcgatgacgccgtacgtgcgggcgtgagtggtggtgctccgcccgatgttctcctcgagtggttcgacgatgagcgtgaagaaaatagcaaagccgatgagggcgagcggacgtcgatcggcggtgtcacgtagaggagggtactgcgaccggcaagagcgacatcacatcgccatgtagacgtcgtgaggtagaggttgcggccggcgaggcgagaacgtccagcacccgagccacgtcgcagcatacggcagatgccgtcaccaacgaccagcgtccccaaggacaattaaagcagtatcttgtgtcaactcggacgggcggcagatggttcggccgacgcaactgctacgtcgctactcgatcgctacgatatgatgacaacagcgcgcgcgtgcagacgttgcatgtatgtgctgcaaattaaatactctctccgttctagtttgactaagttaaattgttttaagtttaactaattttataaacaaatatagtaatattgtaatgttccagcaaatcaataattgaatatatttttataataaatttgtcttggattaaaaatgttactaattgtttctacaagtatggtcaaatttataaagtagtttgactttaaccagtattgtatcttacggagggagtagaagaagaaacgatctaattaattaccttgagcagccatcgtcctcctttctgtggtggctgatgatgatggtcgatcaggtgcgcgtcgtcctgccggacaccgcgacgccaatgcaaggcccggtgggcgtacgcgtgtgcactgtttcggcaaagtcgatggcgtcgtcggcgtgcgcagctcatgctccgacgctgctccgacgaagtcacgccggtggtgtgcgcatccggcgaggccgagtcagcgaggctcgtgtaaatgaattagaggtcgatgtgtgtaaagatgggataactgctggtggttttcgatctaatctgtatatatatgtgtgttaggaacgtgtgtgaagagaggagcagtgtatatatatgttgagatcagtgggatggcctcctttttataggtacaggagaagccctaacctacacagcgcattccccggcgccgcctgcacgcgtcacgcattggatcgctccgaagcctctgcgcgccatgttcagttttatctgaatcctccggatagactgaggctgtgtttagatcaagggtacgtgtttgtgtttagatcaagggtgttacatcgaatatacggatacacatttaatacggatacacatttaaagtattaaacatatagtaatctaataataagaacaaattatagaatccgcttgtaaaccgcaagacgaatttattaagcctaattaatccgtcatcagcaaacgtttactgcagcaccacattgtcaaatgagtaaagtccatcaccgggccctgaactagtaccgctgtgtcattcccgtccctaaactcgcaaatcaatcgt

SEQ ID NO: 58058 - DNA, 16198 bp, Oryza sativa
tgtatatacatgatagttattaattattttataatttcagattttagttatttataaattgtattccaatctagacctagactcatctttcaatatttcttattattttaattttgaattttcattattcataaattctattcctataaggaccttggactcctcttccaatattcattttacttatttgtaaattgtatttctatatatactctaaactcttcttttaatattctttttttaattttgtatttcctttattggtaaattgtattcctgtatggactctagacctttttatcaatatttattttttttaattttatttatttataaaatgtatttgtatatggactctatacctttttttaatattccttatttgttaattctaaatttcagttatttataaattttattcatatatagacgctagactcctctcccaatgttgcttattttttaaatttttaattttttttctaaattgtatttctatatagactctaaactctacttttaattattttttaatttcaactttcacttagttctatattcctatatggactatggactcttcttccaatatttttatttgtctaattcccaatcttttatttataattgtatttctatatagactctatttttttccaatatctgtattttttaattccgaatttcaattatttataaattgtattcctatatagactttagagttttttctaatattacttatttttaatttcgaatttcagttacttatgaattgtattcctatatatactatagactcttctccaaattctgcttatttttctaatttctaatcttagttatttctaatttgtatttctaaaagatatttaagttgattgtgtataccagtaaaacaaagtacactcgcttgagtcaactgtcacaaatctgaatactctatcaaaagggggataaatagaatttgtaaatcacccatcagaaaacaaacattctgagtagcaattctaaggcttacggacctacaaaatatgtgtaatacagcttagaaaccataagtttgtcttgcttgcgattttatctaactgtaaaaaggattccaatttgcgggcgatgcacaaccaaacatagttctcaacactcaacagaacttgagaacaacatggcatgaaaagatttcactagtcatcgtccttaattcttttcagcagcctagcagcccaccggcgtagtcttctcttcaatgtgaagcccaccacaacaccgactgcaaagctgacggcgctgatcttcgtacaagttgatagagagacaacacgactgcaatacagaatataacacaagtataactattgtcaggttctaaggtgttggacagttgagcacagggttcatgaataaaatggtatcagtgcctggaaatgatagcaaatgttgaaaagttgtgccaaataaattttcctgaggcagtgcaacttacttaataagctcttaaagctgcatgcagaatatatatatagggtatgcaaccatgtctagctcttgttgttaagctttcagatttagtaacagcagcaccaatgcacacaaactctaggctattttgcaactcaaacacagttatacaatcaatatattcactgttcatccaactgaaattctgaacacagctcaatcacaatcaagtactctcacggtcttaaacctcgtagcttttgatctagaaagacactaaaattttatctactctgaactcaatgagctgctaggatcacaatggaatctgctcatattcttctgaactcaccattgcctcttctggttgcatcttgtatgacacgagagctatacaaatacagaccccttgcaacatatcaatacactcaactttgagacgagcccttgcaatactcctgaattcaggaactcaatatgccagtgatgccaaaagttacttgaacactgcaccacctaattgcgaagagcacttctcaacttcgagctattgacctattttacaatccctcagtcggtatggcttttcataggacataccaaatcaccctatcaaactctgatcagtttttgtaaacacgcctaattgcagtttgcttatttcagatagtagctacatggcacaaatcgggagcaattggagtcattcgatactgcaaatccagcaccaaaccaattcaaggcaagcaagaaattgagctgaacctggagctccaatgtgcgaaaacattcaagctagagtaggtggagggcaagtgaggaggagaggagagtataccctgcggccctgggcacgaggacctggtgcgcctgctcggagaaggcggccgccgagcgcgacgaggagttcgccgcgtcctgcgccgccgcctgcagcttctccaccgccgacgcaaccgacgacgccggtggcatctccgggcttcctgccccctcccgccgccgccgccgccggggaaggagctagggtttaacggcgggcgtaacttggaagcgagagaaaaaaaaagaaagaaagaaaagcaagcagacaccttcaggacgatgcgtcgaccatattaaagccaatgacaggtgggaccagccagttcgagtccttgggttgagacttgagagagccttcccaaaggggagagattattcaggtggtaggcattatcatcaaccgatgtgatattaacgtatgattaattgagtttaattattacaaacgtgaaaaatagattaatttgataatttagagcaactttcatatagaaagttttcgtatgaaatttaccgttttgcaatttgaaaagtgtgccaagagtatccaaaattttatatccctttttagcatattcaaacgggacctttgtggatatctcgtgctttctcacgcagttcaattgcttccaattccaagtgtgaaatatacgcaagcaaatccactgtaaatcatacgagatcaaatgaaaccgtgggtgcaaaggaaggcaaggcaatcatatctcaatcaaatacacttccaacatatatccaggatgcagcattaaccactgtcaaaactgtaatttctcattgctgctgcagaaccttgttacagcaaagtaatgcagtaaacaacatatcaagaacaggggaacagttgaaaccaagattaggcaaggacaaacattttactgtaaataaactactggttaccagctttctagatataactcgcgaaacaggagaaaatgctaatcagatacagagtacaaatggggtacaagagcaaagttttggctacgctaactccggacttcattttgatttccgtggtctaagaagattccagtcaagcttttcacgcttgtttgacttgtgagacccacggccattgctttgggaagatgaatcaccatcgatactcttacctgtggtcttgggctgcctatgtgatggtggtgtttccatttcaagctcaggctgtttcctctttagttcattcagagatatgctttctgaactatcaatgttgaagtcactaaatcttgttcttgatacttcatccgttctgcatttccattgtaaaagggatcacgtgaaaattcattacatccacaagctattcaaagtgctcaaaattatatgtgccacataagaacttgtacaatgattttgagcggctcaaaattacatccacaagctattcaattgcctcacaatgattttgagcggctgtagttagcattttcataaaaagtacagatgaaagtgttctcctggtgaattgtgtccataaggctacacctttttgtgttgcatagtagtgatttgttaatttcttatctgaccgaactgaatcagaattctactaaagaatttcattaatttttttttgggtgccaaaaatgtatgcattctagatttttcatgccatttgtgcaaaaagcttcctcatttgtgaatatgcagtaactcataagcttcagaatagcattagttgtataagctttacttttagcaaataatgttaactatagcaatacatcaataatgtctgaactactcagagcaagctaccagtaatgacggatatagtgatatacagttatacactaacaatgaatggtaactctgcatccaacattagcgccacaacgagtgtattttttaacaaatcaatcacttcaagcttagatttctaccttacatgatgtcaaagctgcagtgaagttattaacaggtgattcatctttcacaaggctgaagtgcactaaatgaatgttaataatgtcaagtctggtaactatgtaagagcttcaggctcttctgctttggttatgtttccagttcaatgatcaaaagtccaaactaaataactcttagcacatactcacgacattaatccacatattgtgacaggtaatctatattttgtaacagataaattagctataggttaacaacagttacagcacagaaaagagctggtaaatagctaacctgctggaattcgaaccatcctgatgattattactaggtgatgctaactgtgattggcggccacccgttgcctcttgagttaatttctacagttctaggtttgggtgagggaacacgacaatattgcaaataacaagatataaaaaaataatcttgaaatctcacatcaatggatgggttgaaattcaggaatgacattcgaccctttgcagctccagggtgtggattaccctccatgataactacgctgaagaaagagttagtattggtttagtctgcattgacagatcaaagaaaggtattggtaatgaagtactgcgtgtccaaaactaaacccaaaaaatgaatttgcatgacaacatcaaatgcatgtttagctgattagtgtgaagcatatctgggaagaaaacgttaaaaaaaagtatccaattatggacatacacatgaatgttatagtttctgaagcacaaagtatcatttctactacctccgtcccacaaagacttcatttctagctatgaacttagacgagtacttgtccaggtgcatagccagaaatcccaaattctctgtaattaggtaagaagtaaattagatgggaggttttgccagatatctcatctaacaaacccaaaaaggcacaatcttcatctaacagattcagcttaactcaaacataatctccaattcttcatcgcaccttgttatatagcatacaaaacatcccatgctaccctagagtcaaaatctctaataccatgctaaaaacaccaactcagcataaacgattaaaaaaacgagcctttcaatccccataccacttccgagcgactttaaccgacgagccaacacctccgctaggcaccgtcaccacctcctcctccgccgccgccgccgccgcctcaaccttgggcttctcctcaaccttctgcgcaacagccgcccgctgcataaactgcatcccccccgcacacaaatacaaaaataaaaacatcagacgagatagcaacgcgtgcggatgtaataagaggcaacatttccaagggatttcctcctcgccttgaggttcctgagggtgctcgagagctcccgcttcgccgccatcgccaccttcctcctccgccgccgcctctgccgctgccgctgcttcgcttaccgatttagggttagggtttacgcggctcgcggaagccgtcgccgcggggaggaggcgcacgacgagaagagagagaggagaggagatcgggttcgagtcggactcgggcccatcaccacggcccggtgcgcgagtggcgtgcgggcccacatgtcagccagggaaggagaaccgcttgcctggctggtcctacctgcggtctgaccgacatgtgggcccggtatttgatgtggtggactcctacgcggtttattactgattcgtgtatacgagggcgattcgtataggcggtttatattggccctggatatctggaagcctcacctgaatacctgattttgatcttgttctattgatttgtcgtgtgttcttcgaattccatcggaagaagaagaggggatttgactaactcgatcggcagccaattaatttagtcgctgacttcatcagttcatcttaataatggtatgtcagtcaattgctctgaaatctttttaatccaagttgttgttttatccccttctcttccatcttttcgattctttggagcgcaaccaatctgtcattgttcttgcatatattaccatgctaattatgttcttgattcatgcatatactggagttgtttaggataccggttctgaacttctaatctaattgctggttcgttgaatgcgttgtgcaggatttcgaggagtatctcaacttgcaatcggcgacgttcgcgcagctgtaccgctgcttgccgatctcgcttctcaagaaggagaacgccgacgatggcaacaggggtaagttgctaattaacctgttattaatagtcagtagtcaatctatttttttttctaactgaatattacgaagttttgcttatgtttaatttgtttgcagtcttcatgcctgtatctgctcttgatcggctcggtaagttcctaacatcttcagtaaaaaaacgatctttccgtacatacttgatcatctggtaataaattagttggttaaattactgatgttattgcttgtggttaatttactttcaagggtatctgcacatcgagtacccgatgcagtttcagattcagaacgccaccacgctgcagacctcgtactgcggcgtgctcgagttcaccgccgacgagggcttcatccacatcccgaccatggttagtatactcttcatagaagaacatcaaattaactttgcccaaatacaaatttaatttaaacaactcttcagagcattaacataaactgatgctgatttatattttgttcctgaatattttcagatgatggagcacttgggcctgcgagagaacgatctcgtgctgctgcgaagcacgtcgatccccaaggccaccttcatcaagctgcagcctcacacctctgacttccacaagctttctgaaccaagatacctgtaagtaattctatcgaaagaagttttttttttctttagaaattaatctaaattgttcaccttttctaattcagattttttttactggaactaaaactcatagaacaacagttaggatcatcttctactgatggtaatattgacaaaataactttcaatactgactgaatacgatcattatgactaaattattgaaatttccgttcgaattttttgaaatttcaggccctctcggcaccgaactatttcgtccgaaattttcaattttttaatcaaaatttgatcaaattccataaaagttctgatcgaaatttcgatgccccgtcgtagatatgaacaacgaaattactaagcctggttattctttcctactataaagttaacttactaaattctaaagcttaacgtacagatatatcacattatcatccactaacaattattacatttaattatcataataaacattgctatattatctattattttattcgacattggttgacatatgttgtgttgatgtgcgtgtaggctggagtacaacttccgcaactacttctgccttacgaccggcgagacgatcgccgtggcggcgggggacaggttctactacctcgacgtcgtggagacgaggccggccgacgctgtctgcgtcatcgagaccgactgcgaggtcgagttcgaccaggccctcgaccaagcggagcccgccgccgccgccgccatgcaggtcgacggcgtcggcgccggcgagccggagccggcccggttcaccggcttcaggatgcggatggacggcaagccggtggaggaggagaagaagacgatgccgccgccggcgacggcggcggcgccgcccaaaagggggcttcggtttggctcgtcggctcctgccgccggtggtggcgtcaaggaggccaagtccggcgagaaagacgatgggaatcggttcaccggcaagaagtattctctgcagttttaaaagaacaaaaaatgggatttcttggtgcatcgatatttgaaaacgagagaatttgcatcgatgttgacgaattcgctgatattcgcgttcgcgaaaaaaaattcgctgatattcatacgatctcttttttttttttccttgtaagttttcgtaacgaggatcaaatatatgtgcatgtgtttgtgatgaaataggtacctgctcagtgacgtggctttcagattttgtttgctaatggtagagcagagtattgtgtccaactttccatggctatgttgttacttactatttctcttatcttatagcatcaatatgaatatgagaaatgctagaataaattgtatagtaaaattgagggagtatttgctactacacctaggaggaactccaggattttatattccactggcaaaagtgcccgtgcgttgcaacgggaagtgtatagaccagaaaataaaggaaaagttaagaaaaatttacattatgtagaaaggttatattccctcccttgtgtaaaaaattaatttacaagtaaagcaagtataataaataaaatgacaggttaaatttaattttattaaattctccatatttaattaagctctttagaattttattggaattttcagagcttaattgctaattttaataatacaaacctcatttaacaattatttaattggaaaaaggaatcaaaatcctccctttcaggtttgggccgaatatagaaagtttatattctctcccttacgtctattctatgtatctggcttgtttcctttctctgttaagtccattgcatcctcttgatatcgaccacacggtccattcggtggcccaataggccggcggcccgacgcgggagcagctggagctgtccgatcgaatggacggcccagattaatcctaacctaaataactacacccaaaacctaaccctaggattcattctcaccccctccccctcctttaccactctccctcccccgagcggcggcggctgcggcagcgcctctcgcccctcccttaagcggcggcgacggcgcctctccccgagcagcccccctccccgagcgacggcggcgccgcccgagcagcggcggcagtggcggcgcctctccccccgagcgacggcggcggcggtgccctccccctagcgacagcgccgctgcccgagcagtggcggcggtggcggtgcctctccccccgagtggtggcggtgtcagcgtcctcccccgcgagcggcgacggtggctctcccaccactggcagcgcggctgcgtcctccctcaccaccggcagcgcggctgcgtccttccccaccaccggcagcgcggcggcgtcctcccctaccaccggtggcagtggcggcgcccttccccatcaccagcaggcggcaacggtggcggcgcccaacccaatcccaagcaacggcgacggactcgatgtatttggagtttttggtcgatatatttggtgtttttgggtgttgaagtttgggtttctattttttttttcaattttttcgatcattcacaaaatcgaaatcagattaggatttgatggagggacgaaaaatacgaatcttttaattagttaagatagagaagagatatttacggactattaaaacgaatagaaatcgaattttttgccgcgcttttttccgccctttttattttttttttgttcgttttttactttttactaaccttttttttttgccacggaatcgaacagacctctgtagatgtgaattttttaagtagggacaggagtagagatacatatgtatacaaagtttatatacaaaacgtataaaaatataaacgtatacaaagtttgtatacgtgtatataaaatttgtatatatacatagtattaagaaataaaaaaaccaaaaaaacaaaaaaaggaaagaaaaaaactgaaaagaaacgaaaaaaggaagaaaaacagaacaaccgtgcgtgggccggaataggatttttttcccctttttaagggatcggatctatttttttcgccactttttgtgtttttcgaatttgactttttttttcccgtttctaggggaatcggattacagtttttttccctattttttcctccgattttttttgtttttcttttttaagggaatcagacttcttttttttgttttttttcgctattttttatttgtgacggacgaaggaaacgtctcttattttttaagtagtagtagaagaagtagaggtagatagatagataccggtcaaaaacgaacgaatttaaaaaccgatccatacacggatgacgtaccaaagtaccgacaaaaatatcctcaatttttcgagaagtctttttcgagggagtcggactttttttaaggagtcggacgttttttttcttttttaggtagaagtttttttcctttttttgtcgcctttattttctccacagggagtcggatttttaagagtcgaacgcctttttttttgcgacagattttttttctcttctttttttgtttttttctctcctttttattttccaccgggggagtcagacttttaggagtcggacttctttttttttcgtttttttatttaaacggtgttttttctcggacttttttttttccttttaacggatccgatctttttttttcaggggaatcggactctttttgttttgtttttttttcgctttttttatttattaaacggacgaaggaaacgtttcttttttttaagtagtagtagattataaaaagaacagctaggaagaactctgttgtcaaaatttgcttagcatatgtagtactccctccgatcattgacgcacaatgtttttacactaaaattagtattaaaaatctcatatattaatgacgagacagagtgacaccttactactctgcatagtaaaaaaaaaaccatccacaatgcaaatagcaaaaatttgaaatccgtgcaatttcatgccattgaaatcttgaatgaaatgatatgatagcacccttagggtccctttaaatcgcatgattgaaaaaacataataatagaaaaaacatagaattttgataggaatgtatatataaaacagatattgcaaaaacgcagggaaaacataagaagggtagtttgattgaactgaaaaaaaaaacgcaggaattgaataagagagatagacccaaagaaaagttaccaagatgttgaagctctttctaaatttcctccaaattctctataggattgtccatttcataggaatttcaaaggattagataggattcaatcatttgtttcaaagggcttcatagaaaattttttcataggatttaaatcctccaaaattcctatgttttccctctaaatcaaaggggctcttaatatcaaaataagttcattttttattcatccacccatactaattagaaaagactttctcaaatcccaaagcaattatttttctctttatttatttattctcaatacatttattttataattttacaaatttcgatgcaacgatcactttaaaaataaatttatttttgataaacaagaagaaccaaaaataaacatttattctggatagagagagtatgtgcctcatgttgaattacgagtagaatgcagggggttttgcgttaatatccctctcctcttctcccctccccctctcaaagcaccgcgagctcgcgacgaggacgacgcagcgagacgagacgacaaaatttaccaaagtgcccctcaaacccctcaccccctccgcctccgcctccggcgagcccgtcgccgccggccggcatgccgtcggggtaccgcccggaccgggagaccgacttcgccggcttcccgagcaccacccccatcgtcatcgacaacggcgcctccaccttccgcatcgggtacgacctcccacccgccgccgcccggaaactccccccccccccaaaccctaaccctagcagggcttccgttccgtacgtggattctgtgaagtgacgtggtggtttggtgccgtgcaggtgggccggcgaggcggagccccgcgtcgccttccgcaacatcgtgcagcggccgcgccaccgcagctctggtacgccgcattgcgcgctttggaaagcttggctgtgatatctgtttggtgattggggtttttctttggatatactgcgagaagtttgatttctgcttcttccgttaatccttagcgtgcgttttcagaatgttcagtgaataggtatggcgtttcgttggtaattgggtgctgtttgtgtaatttgttttgttttgatgcacagaaattgggtgctgcattttaattatgtctatcagcagccacttattaggcccattttgaaactctactcaattcaagtgggagttgaactgttacttgtcagattccaatgggctttatttatttttatcgtttgcgatgttttgatacaacttgattcattttcttcgtaagtgatactagtaattctgaaaacagatcaagttcagatgttttagtgctctctttgtgtttgttcaattacactgtatggttcatgcttgtctgaatataccattactgaactgaacctcttatgggtatggcttgagtcaggctaataataacagagtttgacaaaatatgataattcaactgattggaattcgttttctgtgatgcaggtgaaactgtcacagttgttggggacactgatccagctttgatgaagtatttcgattgcacacgatcagcaattcgctcaccatttgatgatgatgttgtctaccagttcgagtacatggaatatgttagtttgcttagttattcctatgaaaccatcttaactttttttttgtttgagttggtagcaagatctatagatggtttgctatatgtttagcttgaactgatcagtctggtctgtcatctttgattctgaatgcaatcttaatgtgtgtgttaatttttaggctcaccagaataatgcatatgaaacattttaagaataagatacgtgtcttaactgtggttgagatgtatattaactgatattaagaaaagctttatctgaagttagaaattcatattctaacttgcttctatgagtatgctctattctatagctattaatgataatatctttcatagttcacatatcctttatgacattagataccaatacatattgttatgtttcacaaatttagagtgcagcacatgattgcttacttcagagtgttgatatttgcactccaacctttattgcttgtgtaacaaacattttttaagtatttctttgatctggtattattactgtctgggttgcagattcttgactttggttttgatcgactaggtgccacttcagaggtaaattgcactctgccatcatctgtactatgaatatattctgaatgtagttgacttatgtactgtttccttggtttgacagctttgctttaccttgcactagtaaatgtggggtagtccctctcaaataaaaatgatgaaatttgggggttcttttgtatgccagttctatgtataagtgaagtgtgtgcaatgattgggactatgtagtgtttattaaaacttgaatttagcatgtgagttctaaaatggtcagttggtttcgggttcagaattaagtttcttatgaatatattgcatagtgacacagttgacgttcacaagttgaacgtaatgcttcaaagtctttgggaaactttagtatcaggctctcagcctctaaaacaggcaagttaaatgacaagtgaatgtcatattcagcatatccatcctagacatatgacagacatggacaattatcttcatcagtgagctttctcctctcaagtgtatggtgggtgacagtgaaaaaataacccaggcatagcaggcatttctgaacagatttttctcattagtatcatatagttctaatagaaagtgttatgtgcctttggttatatagtaatatatttgtatgcatccttttaccttagaattttctggttcccacatgagctatttgtttggtttcatgctgctggaagtaacagtaatgctgggcaggtgggccatcccattcttatgacagagtgtgaatgcaatccatccttttctcgagccagaatgtcagaactactttttgagacatatggcgtgccatccattggtaatgatacttatctttttgtgccattgttatcaattgtgcatggtagttttgaagtaagaattgtcgatgctaaagatgtttcttcctatgtgagtttcagcttttggcattgacgatgtgtttagttacaagtacaatcagaaacttgggaattgtggagaagatggactggccatttcgtgtgaacatggaacatgccatgttgttccagtaagtttggtccttccacatgccttcctcttaactttgtgcaacatacaaatcctttgccattgcatttccattaccttgtcagatgttcggaaaattaatgcattgcatgcttgaagaacacagtattgttgaatgcattgtagattctaaaactctgattggataatctgtagtgggtaatgctatataacatgctcatggaaagagagagagagagaaagagtgcccctattcttagctaaatcattttgctcatggaagtcgggatgtattttcttgatctccagacacagcatgttgttttctttccatctaatctatgatgcttccggacaactacattggtaaaagttgctttgtattttgagccctgtgtgtttgaatttctgcttacttttccatggtaggctgcatactaactcatccaatccaagttagactattcttctctgtagtgtatttttcacaatttgtttattgttgtcatgatcctgaaacaatcaataaacaaaaatattatgttgtactcatcaaagtggttctgtgaaataaaatcttctttctttgtccacatatgcattctgattaatgctttgctgtgtatatgcattcagtttttaaagggagaacctgtgttgggggcatgctgcagaaccaacgttggtggctttcacatcacagattttctgaggcagctcctctctctaaagtatccctatcacaggtaggtgcccgcagcatatttctgaagtgctccatgcatttttttttcctaccatgtctaatcgttgccactttacattgagtagtgcaagcattacatgggaaaaggctgaagagctgaagaaggaacattgttacgtagctcttgattatatgtcagagttgcagatatttaaggtgagaaacttttatttaccgtttgttttcttaccaatgtaaattccaaatccagttcatctatagaatgcacagggcttttctaccgtgttacatttctagctctttctttcaacactatgaatttattgatccacttggcagaacaataaggaagaagctgaagaaaaaactaggtattggcagctaccatgggtcccgcctcctgtagaagaaccaccatctgaggaagaacttgcaagaaaagcagctttgaaggaaaaggctggtcaacgtttgcgagatatggctgctgcaaaaaggtcgcagaagatagcagaacttgaaaaacagctttcttatttggaggaactaatggagcaacttgatggagctgaggaagaagaagcaacagccattttaggtagatctgggtatctttcccagcaggaaatcaaatctgctattttgaaagcaacacaatccttaaggaaggcaaagggggagtccaatggtaacgaagagaaagcagatgcttctggggttgataagtatccacttgtgtctgtccctgatgaaacattgacaccagaacaggtgtgtgtctgtccatttatcatctgtagcaaaggggtttgtttttgcttgtgttttggggagaccttttgcgactgtgtgacatgagcacatatctattataccaagtttagatattttccatgtttcaaatatttactattcttatttcactttcgtatactttcagttaaaagagaagaagaacagatactacttaaaaccacaacagaaggtggaatgcgtgccaagcagagacgtgctgaggaggaagcattgagggagaagcaagaagaagagaggcgtttg

SEQ ID NO: 58059 - DNA, 15076 bp, Oryza sativa
cccaagctcatagtcgcccccatcgagctgctcaaaagccgatgtgttcacgtgtccccgagcttcgcctctcctccgcagaggcaaacacgcggctccgccgcatcgtcttcgatgtcaactccatctactcacgttgcggtagcatcgtcctcgatgcatgcgcccttttccccaacgctcgccatcgccaagctttttgttcgttgctagccttctccccacccatcgccaagcgccgtcgtcgggcttctatctaccgccgccgcccaacaaccaccaccattctccctgctggtcaccggccaccacacacctctcccgcgattcagcgtctggcgtcctcttcgcttgcatgcacgggcactcatgcagtcagtggtgctcgcgagtatgctcaggcgtcgcaacgtactccatctcccaactcttggagatcctcccgccaatcccgacggtgtggctgatatgcaaccatgatgcggacgcggcgcagatgcgcggcgagctgccacgcaacgatgtggtggtgtaacccgaggggacgacgtgtcgggagcccttcctacttcgcttcttcgcgctctttgccgtgtaggtccatgacgcagccgtcagtcgccactcttctccccacctgttgctgactgccctggaggtttgggttgagacgggaagaaaggggagataggtgggagaagattatcggctggcatgtgggacccacatgggtcccacgctgactcagccaccacgtcaccaaaaccgaggagcaatactgccttgggacctaacgtgacccggtattgtaagattagggatttgttatatctggtattttagttcagggacaattaagaaactcgatgacaagataagggacctcaagtgaaccttttcctttcatctctctcatttctctttttttaaaaaaaaatagcaaagatgctcgtgcattgtgataggaaatccaaattacatatgttattttttttcgtggacgttggcggagagttagatgatggatatttggggggctttcttatgaacctgggtgggtctcaggcatgtcgtggatggaacatatgatagagatgtgggtttcacgtagagataatcaatagttgaaggtgtaattatttattagtgtggtataaagattttattttttgctgcaagggcacttatcactataaaaaatgattttcgcctttggctaaaacctgttcttgcaggctgctaggtctaaatattttttttttgctataacgacgcttatcactataaaaaatattttttagtatctttccatatgggcagcacaaaccacatgcgaaaaccctactccctccgtattttaatgtatgacacatatggatgatatggtagcaattttttaagaaaatgaactactccctccgtattttaatgtatgacgccgttgactttttaaccaacgtttgaccattcattttattcaaaaattttgtgcaaatatgaaaatatttatgttatgcttaaagaacatttgatgatgaatcaagtcacaataaaataaatgataattacataatttttttgaataagacgaatggtcaaacgatggataaaaagtcaacggcgtcatacattaaaatatggaggtagtattatatatgcaactggtgaatccgtgaaacaaaaataattaggtaaaatttgccacaggacatacaaaaaagcatgtaatcggctgagagacaccgttaaaatgtggcacggctgatagacactaaaaaaaacgtgtaattggctatagaacactggttgcattattttcttatttctggttcaaaagaggtgagatatttttctaaatgcccagattgccccttctctttccttctttaaacaccagtgggtcccaaatgtcatagacagtgtatgtttaatctaatttttaataggtatttaaccacctggccccacgcgtcatggactaatttgtacctaattagtagggtgattactatttgctaatcataagtgggcccctgttaacagtgaaatttggtaagcctaaagtcatcatcggcttagagtcattatcggctacatcatttcggaatcggtcgatggaagttatcaagtcaccaatagttggattcctactatattcggttaaggaaatcaatctactaaaggaagcttatccataaacgaccgagttcaaagaggatgcggcatggcaatttatctattaattaggaatagtttgttagtttccttttatctttaggaaagtgtgtttagtgtccgataaggactttatgttttccttttatcttttagaaagtttgtttcttgttcgacaaggactctatagacccaagggtataaattgtgtaccaggggtccctgtaatttttatctatcgatcaatacaactactctcggcgcatcgccaccctctttaccgaggtttttacttatctttcagcggaatttgggcacctgacgcggggctgcatcggttcagttcgatctccggcgaaggagtaagtcctacgttccgtcgggccctggtgaatctgtcatctacgtcggtgtcgttcaaggctgcatcagtacattcgacctcttggattgctctggtttggatgatatatttgcctacctatttatcatatgtctctattaatctaatcttagcatattaatttagctctatcggctgcttctcgctttagggtttctgccgatatcggctaaatcgtgttgctagattagattagcttaggcatctaccatcctcaaaatcagtcaagggcttgattgtctagatattgtgtttcttttcatacttagtgctgcatcagttaagtttgatctactaagtcgtgcttagaaccataatccctagcctgcttgttgactgccaataagggtttcatcggggtttcagccaatgaattatctggacgttgcatcggcttataagaattgtatatataagttagatttagccgatgacaacgaaggtttcactgtttaatctaatcttgtggattttatgacatcggacctccagccgatgtatgttttaaccttcggatcagtgctaattctaccatgttattattagccgattggtttctattggattatattattgttagtttattacatcatcatcagctgattgcctttatatcatcatctacattggacatatagccgattgcttaaaccctatcgctatcggctggtatcggaatcggctgggattgctccattggctgtttagccgatcggctatttgatctactgtttacaaatcttgtcggttgcaggatcaaactgactgacacgcccgcatctcaccaacctttggacctgcacaggagctaagcagatctcccaggccggtgtgttcgattttttttgtcaacaggcccacattgctctcatatccttcttcttcctcacacacgcggcggagcggaggaacgacgcgcgggcagcgcgacggcccgagtgggacggtcggtgtcgacgggttcctcagcggcggcggcttcagcctgatgctgcggaagcatggcctcacctccgacctcgtcgtcgtgccaccatggtgaacgccgagggggaggctcctcgatagggccgccatgggggaggacctcttctgggccatccgaggcggcggcggcaggaacttctccgcgtcgtagtgcagaaccagaacgcgtagttcgagtccctgtacctcggtagtcggcacacgccatggcctcgtcgccgcgatggccgacaccttcctggagctcggtgtgacggcgagcgactgcatcgagatgatgtggatctagtccgtgctctacttcacgttctacggcacggggaagccattggagatgctcctggacatggacaccagcaagccggacaagtacttgaaggccaagtccgactccgtacgtccaagaacatgcccagccaagtctgggagaccacctggagctggctcctcaaggacggtgctgggctgctcatcctcgacccctacggtggcgagatggtccgcgtcgtgccggcggtgacgccgttcccgcaccggcaggcgctctacaacatccagtactatgggttctggtcgaagagcgggcggcagcggcggagaagtacatgggctggatcagagggctctacggtaagatggagccgtacgtgtccaaaaccccaggggcggggcagcagccatcgccgccatcacaggatctctcgccgtctgccgctcctggcgcgggggaatatggctccaggggcaatcttgtcattttgaaaattttctcacctcttttgacccggaaataataaaataatgcgaccggtgtcctacggccaattacacatttttttgtagtgtccatcagccgtgtcacgttttcacggtgtctctcagctaattacacgttttttgcgtgtcctgtagcaaattttgccaaataattaatagctaaaactggttgagtgaaaaaaataatatgaaacgaagggagtaaagtatattctatgaactgttggcggtcacaagatttctatacacttgaagacagattcgtgagacccaccagcaaaaaatctctatcagctcaaaagacaactgaccgccatgagtctcgtttttgtgataggggaggcacatgtcactgcttgaggctacatgcagcgggtgcgtgatgttgtcgtgctcggattggaaactgaatttttatatgtgattgtttccgtttcacgtgggcgaaagagtcggacgtttgcgggggacatggaaacggaccaacaattcacatgtcggatgaaaaattgtgtgagacacactattctacgatgcacggcaaaaacactatgaatgttttaagtagataaagatatacaactatatacgtcgtattttgcaagcaaatttggtaggattgatatatagatacattataacctacctctcaacatttttcatattttttttaccaccgtatacatatatttcaaagcagtaagcatgatttaaacatcgtggttttaaatttcaaacaatagtcatgaaaatttttaaaaatattttagagctttgataatggtgttatgtctggccctacaaaatatcagctttagaatatgactcgtataaaaagagacgaagaagataaatgctcgagcaaaccaattttagtagttcaaggggtacaatgaggcaaaacatatgttagtgggttaagggtgtgctttttactccatcttccttacttatactcacttctttttatacgcacgcttttccgatctgtgtattttatgtaaaaaaatataaagaaaagttgctttaaaaaatcatattaatttgttatatgacctagtctcaacgatttattatggcgtgcccccacctaaatctctgaacaaatcaatttgctgctaggaaactcagaacgtttatttgttcagagatcatagtagcaccttgcaagtttcagacattaaacacattttttgtttcagttttgagtttagataaatatctgttaaacttatatagatggtgtttagctgaaatcatttgtgatccaaggtgagagttatatttgccagcaataccaaaatatacatgatcctaactaatatatatgtactgcatatacaaaattttaggtgcaatagatgctacttacaaattaggatcttgtattgatcagttcaacaatcaaacttctatttatcactaatcaaaagtaggattgtaccacactgatctgaaaaaatatccgtcgcatgaacataaggaggtcaatagtgcagatgatgcgtcaatagtgtagatgatgccatctaagattagtgagtcctttttgttcagaaatgaggaaggaatcaataagggagtactgcactgaacagaaacaagatgaatttcatgaacataaacgggaatataatattgaccaaatgtaaacctcactctaataacacaaacggttccattcatacaaaagtttttatactcactgtttgtattccgatttaatattgcaagctatcattatgtcagtcaataacaagcatccaaactcatgtgctagaaggctggcaatacataagcatttttttggaaaatctgagtatataataagcaatgtcagaattttttccagacggtaaatttcagaaacatgcccccctaaggccctaaaaaaaccagaaacacggttatccaagtagatgaaattcatatacaatatatgccaaaatcgaaaaacataatccaattgtagaagttatatcatgcagatagtgcaattcagtttatatttcatttataatggctatgatcaaaggataattcatcagctgaatgaaatacataactgaataaaattgtcacaagagaaaggttttcaatactcatctaaatgaatgaaaccaaatcagcgagagagatttaaaaagaaaatacctatgacatcctaaatgcagcaaccaaattcagtttgaatgttttcatcagtaacttcacaactcgggtactaccataatgagatggttttgatttttcacaaaaaaaaggattctgaaaaaaaaggcgggttcatgagatatttgaccatatttattcaatagttgccatcaattcacatatatacagtctaaatgtctgatcttaagaaaataatattggttttgaattagttcgtgaattagtttcgatatctttagacaaccttgatgacctggaccactttcagaaatatataaatatatgaatgatccaaatatatgttgtagctaaagggcagtggcggccaccagatcatgtaatggcatgtttacatgtaacacataaaaatttaagatgttcaatcccaattcagtaattgctgtatgtgcagcacaatagtgcaattaattttagaaaaaaaaatgttaccctaaaagccatgaacacatctattacccatgaacatatgctccatgtactacatgatttcttgcagtgtatgtgtacgagcatttcatcgaacaacatgagggtatccggagatagagctcaaatacaatcagaaattatgaaggccgtgatgcacgatcaaacataagccaaaacaacgacatgacctgtaatcaggagaaaaggaacacatgaacatgaagatttcctttcccatctgagggtagaggccggtgatgatgaagatggctgcagcggcgccgttagtcagcacgggctgcgcctcgatcgagccgaggatccctcacaccaaccccgcgttattcctgctctcgggcggcacgaagccgacggctagatctcgatgaaacgaatcagcgatggcgctagggcgaggcagggtggcgcggcacgacagtcggcgggggctcggtcaccgcgacgacgaacccaaggtgggggatcggtggcaatcgcgacgatgacggctgtgagggaattcggcggtggtggttgaaagagaggggtggaatcagcgggcgtggaggaagatcgcgagcaatgtggaacgtggagcggactgtgggcgtttgacgcgtaagcagatacaggggtgggaggtggagacgaccttgcgttggatttcgcatatgcaatctagaccgttgcgtgaggaacgagagaatgagtgatgagtaaaatcatttgttgaactatagggtatagggtagatgtggctgataggatgaagacgaatcgagatgataacaataaaaggccatgcattatgtagataaaacttagatatgaaatgaagggatgtgttgaagagagtttaaaaggataaagtcataggtctataaacaacaatggcatgtaataaactaattaatatatcaagattatgatggactagtggtggattactggtgaataatttatggaggtatagagcttgtcgtagtggttgtcgtagattagcctgtcattggcttcggactattaattactagttagtcattaactaattgttaagagaggatagcgctcatccctaattagtgtcttgaaatatttatcatattatagggtttgcaggagcactgtataaacctaattagtatccgattggaattgagtttgattgacgttgttttcgctgaatctggttggatggaaggcaaatatttatttttacactgaaaaaaggcatattaaatactctatccaataattatgtgaatttggtcatttcagtagtactccctccatcccaaaataagctagcattgtactaaaacgtgacacatcctagtacaacgaatctggatatactgtccaaatttactgtattagaatatatcacatcctaatatgaggttggtttattttagaacggagggagtactcctaggcaaaaagaccatcaggaagggacaatctccgatttctgcagctagcagcccaaaacccggctggtagcccgtcaagaatcgtattgcgcgaacattcgcaccaaatgcccgtgcgaatctggcattcacattctaacacaacaacaaacattctcattcacctccacctccaccttcacctctatattcacatccatggatggatcccacgtactctctctgtcccatattcctggctagatttattgtactatcacattttattctataggttgtttttttatgtgatggggggagtaggtcctgagtactcccaagaatacccatttttcatgaaaaaataaattatatatagatatattgttatttatgtatgctttttttgtctcctgttcttgagtttgttctcaagattgggccattttgttattttatagtgtgctcaaattctcgagatttttataatatattattcctatatgatttatgtcactattgtaatttaatatgtattatcctcctcaacatttgtgttttgtataaaacatttttttaaagtgtgaatatccggccatgaattcctacgtccgtcactgttcacatctatatcaaattaactcgaccaaatattcccattcacactattgcggcgctcattatgaatggttgacgaacttggccaattaatatattgtggcaaaataatgataaagagatattcgattcacttaagtgtacaacatactcagtacacatctttattcattccaaacaaactgcagctagtgcatattcgtgaaattaaagtgctacgcgatgtatgtacgcatgcttaccgtactatatgcgtagcatatgtatgctagatttattcagtgcatggtaactttagtgtacttgttcatatcaatagtggcacggccgttggcttcgagtgggaaatagaaggggtagatttcgtagcgtgcccaacagctgctatagtcgatttggcacccctgcgcagcgccacaagccttgtcaaacttggacactgtcgaagataggcactgagcacacgcaggcggtgcaaggtctcgtgtgcactgggccagcgcgtagacgctcacgaacggcgtgtactgctccttcgccctgcccagaccgttgccacccaccgagacagcctgtgttgttgcttttaccatcgccttccccaccaccttctggaacgcctttgggttgtccatgtccggccatctcctcaaggtcacgcttgcgtcctccctcgtgtccacatccccgatgaagttgtagctgctgtagtaccgcatgaagcagtactcgtacctacatgccacaagcacacataaacgaaagaaatatattaaacaaccggcctgaaatctactagaatgatacagtgtcactcatgtgtgtagatgacatgtagaattagaatccatagataccaaattctggagtctgatgtgtagttgcagttggagaccatctgcttggcggcttgggcgaggcaggcgtcgcagtcgccgccggagacgtcgccgcggcactgcgcgaggccgtagaagacctcggagcccctgccggccttggaggtggcgaatccgccgccggtgcgcgccttggcgacgaggtcggagacgacgaagttgacggcgcgccgcctggtgacggcctcgctgctgttgagatcgccgtagttcatccacgtctccgagcagaagctgccgatgggatcatacgtcgtcgccgccatgcccagtgggagcaaggcaaccaatgagacgacggcgaccagtaccagctggcttaatgccgccatggatggcgccaattatgtactctcacactctcacttcacctagattcaattcttgctagctactggagtagtagagatcgatcgatgtcgatcagcagatgtaggtggctatagctgggttgtgtgttcgatcgggagcaatggctggagcttataaaggcgaggattggaagggaaggagagagagatcgatgtgcttgcagtatattgcaggggaacatagtagacagacatagtatcacaacccttgttcttgcttgcagatttgttttgactgttctaatggtttgcatgcagtgatgatcagatcgagtcagactgtgggcaaagctattgcatttgcacctatgaatgaatgatactcttgcggatatcacggactagctagctggctagtggctaactacctgctttctaccatttcttgtgggcttccggggggctatgactagttttgagggatgaggtgatcgataggtgatggacagggtttacgatttcggttcgaaatttccgcaatttcaccccctccaacaagcaaatgtatcgaccgaaaattcagtttttccaaaattttggttaatttggtaaaaaattatttaaattcagtttattttctaaataatttcatgcaaaaagtatgaaaattcctgaaattttcggaaattacagtgacaccaaaatcccgaaactttcggtctaaaccagagttttaaatctcccgctctagttgtttgagaagggttctagctatttgttcacatgtacaatttagtcgctatagctctatttagcccgctatagctgccgctatagctgtttgagaagctaaccgctaaatgccttggcccgctatttaaaatattggtccaaacgaaattgaaaaccctggtgatggacggaaaccaagcaagccatcatggattaagtggtcaattcattattacgacattgctcaatccaaacaaaacagcacattagtgatgagtgaagatgaaaagctattcggttgcaggagcactgcatatatagtttgattgagtttgcgttcgctgaatctggttggatatgaagggcaaataaactatccaataattttgccaattagcaaatactaattgattcattcctaggcaaaaaccagcaggaatgtagtcgatctcctgtttctgcagccaaacagcccagaaactagtagccggccgagaatcatatctatatatacttcgtataaagttcatccactaataatagttagtacatatttaacctcatacaagcatgcaatatcatgcaaaaaaaatatggctccaattttattagccttatcttaggctgcgttcttttcagattctccccactctcaacagtgttcacggaaaacggagcggtccattagcacataattaattaagtatctgttaatttttttttttcaaaaatggatcaatatgattttttaagcaactttcgtatagaaacttttcgtaaaaaaatataccgtttagtagtttgaaaaacgtgctaacggaaaacgaggagaatctaatcctactagcctggaaagaacgagcaagaaatttgaagtactcaactggacgtacggccccctttttctacactgcatggaatagtttgcccatagtctgatcactgcatgcaaaccactagaatagtcaaaatagtctgcaagcaagaacaaggattttgatactctgttcccctgaaatgcatgcaagcacatcgatcgatctcactctccttcccatcaaattctcgtctttataagctccaaccattcttcccgattaaacacacatctcctatagctcatcacatctctacatacaagtgaccagtgagagtaatttggcgccatccatggcggcattaagccagctggtactagttacagcctttttggccgctgcattgctcccactgggcatggcggcgacgacgtatcccatcggcagcttctgctcggagtccgggatgaactacggcgatctcaacagcagcgaggccgtcgtcaggcggcgcagcgtcaacttcgtcgtctccgacctcgtcgccaaggcgcgcaccggcggcggattcgccacctccagagccggcagggggtacgacgccttctacggcctcgcgcagtgccgcggcgacgtctccggcggcgactgcgacgcctgcctcgctcaagccgccaagcagattgtctccaactgcaactacacatcagactccagaatatggtatgctattattatggatcctaattctacatgctagtatattgtatctcgatctagttccaacggtttgacaagctaataattgaaactttaactatctatgatttttataatatttagtttgaaagcaaatattagaacatgatatatacattattctttaaaattacttttaaaaaaattaaaattttacttttttttatattataatatgtaaaaatcattgtagaagtcgtattaaggaccatattattgtcccaaacattaagaatgatggaacataagagagtacacatgatttcacgtcgattgtttaattttctccttatttatgtgcttgtgcgcgcgggtgatgtgcatatgtacttacaggtacgaatactgcttcatgcggtactacaactacgacttcatcggggaagtggatacgagggaggatgcaagcgtgaccatgataaattggcagaacatggacaaccccaaggcattccagaaggcagcggggaaagctatgggaaaggcgacagcacaagctgttgcagtgggtaggagtgggctaggcagggcgaaggagcagtacacgccgtttgtgagtgtttacgcgttagcacagtgcacgcgagacctagcgccgccagcgtgcgcacggtgcctatcggagatagtgtccaagtttgacaaaacttgcaacagcgctcaaggatgccagattgattacagcagctgttgggcgcgctacgagatctaccccttctacttcccactcgaggcaggcagtcgtgccactatcgacatgtccaagtacaccaaggtcaccatgcactaaataaatctagcatatacataggctatgcgtacaatgcgataatgcatacatacatatatacgtcgtaccgtgtagcagtatatgcaatgtgagatcaatcccaataatagtatttatgtttatgtttaatttcaggaatatgtatgcaacgaataaatcatatgtaaaaggttatatatgtataaagttgtatcacccttatttatcatgctagctgcagtttgtttggaataaattaataaagatgtgtattgggcatgttgtacaatatcagaaacttatgttctcatattttctcgcaataaattaattgggcaagtttagcggccattcttaatgagcgccacagtaatgtgaatgtgtatgtttgagtttgacatagatgtggatgtgaatatggaggtggaggtggaggtgtggatgaaaataattctatttggggagcttaaaattttaagaaacaactgattggtagccaacttctgggttctagtttatcttctagattctacaactacatcttcttctcagaatctggatcaaaagttgattgtttgagggagcttctgattttgggagaagctgcagcagctagaagctcccccaaacaagcccaatgcttgcacggggcattgggtacttggttgcacgtttgcacaatacgattctcatgggctaccgggttttgggcacttggttgcggaaacatgagattaattgtaccttccttctatgttttgccttaggagtaccactaaaatgactaactggcaaaattttggatagtgcatttgcctttcatccaaccaaattcaccgaaaacaacttcaataaaactcaattccaatcggatctcgaaggcaagaaggttatacggtactcctgtgcaaaccgaatagatttttagcttttcaactttattcactaataggttgttttgtttggatagattgagtactgtaataggcaattgagcacttaattctagatggttagtctgatttaataaggataggcttcatccacccatcacctcatctatatggtggataacaagtcagcttggctcgctaagacttggttcatttgatcttcttatctcgacgagccatcttgactcggctcattgagcataatgagctgaaatcgtagcttagctttgctcgtgagttgactcgttaactttgttaagtctagcttagctttgtaattttaaatttactattttattatattatatgttaacataataattaaaactaacttatgaataacttactatacatacaaatgtacaaatagtttggatataactagaagtttaaacactcgtaaagatgcactaagtatataaaaatatgacgatctcttctactaacgagttaaacaagacgatcgtgaactgactgattaactcatgagcctaaaaatatagcatggtttgaatcataaatcattagagtttgagttcaagccgatcggaactaagctcgttccactaactttgagctttcttactacccctaattaacctcatccctcaatagtatgtacccggggctagggtgagccgagggcaagggggacagcataagtgaggtgatatgcataagcttagtcaaaatattcctattctagatggagcaggcatcaactggtgttggtcctatggaccgtgaatggatttgtctctggcctccgggtacatctgaacatggatgaaaatttcggttcaaaattttagaaattttcgccccccacccccccccc

SEQ ID NO: 58060 - DNA, 21918 bp, Oryza sativa
acccttcgacacccccctcctcctcttcagatctctctctccttgctagcaagctcgatttcttagaccatggaagattaagatcgaattctcaataagctaatcattcatggcggcagaagccagaaccctggtgggtgctgatcgcccggaacccgaaggccgccggggcccccccccctttggtgccggccggattaccaccggcttcgtaaccaacaattttggccgaatggtccaacccgcggccggtgggcttctcgccgacaccttctaccggctcgcgctctccgggaccttccttggcgggatgaccctggtcggcgcttcggtctgggtggccgacaacccggctgcccgccgtgccgccggcaagaagctgttatacaccgccatcccgccgctcctcgccgccatgggtttatcggtggtggcgctgctctggtaagtatggttctcgaacaggctccggtccggccgcaccgctgtccgcatatccatgatcggagcaaacaataataattgccggcgtctctctctagcttgctggtcgatcgtgtttgtgtgattgaaaatgaatatcatattcttcttccatttggtttgctcgtttgctgcgtcgtggttgtgtcttgtcgtcgtagcatgttctgttgttgcaagtagttagagagtccactgttctgttcttatttactctgtctcgtgtgcttcgattgatgaccggcttaatcgaccagtgttctatggagtgttcatcatatctctcgatttcaatttcaagtatatatggtgcttcattttttttaatgagatgataaagttatggtgattgtactcctaattttcatcttacttgcattctgcgaatattggatttggaatactccatggatccatgcatatcggcaccgccgccggcgagcatggcgccgtttctcctcaccaattaattcatcatcaattcaatcgcgccaccgctgccgcccgctggtagtaccactgtttcggtggcggtaggggactcgttcgttgccatggaggcggcgtcgtcgccggcgtggcgtctctctgcgccgctcgccgtcgacgccgacgccgaattgttctatttggaagcttctggcgcttctccttctagaagccatcctttcctctcttttttttcggtttttttgggtgatacaagtggggaagggtgggccatacaagtggggcccacatgccccctgaccttgttgtgttgcgggcggcggaagaaaattacacaggacctcagtccttcgctcatctggaaagacttcattttgtgaatgacacgtgttcgcacgaatcttgaggcagacaacagtcgtcttctacctcagactaaagtaccaaaataattcccccatctctctctcctctccctttccacttcccagtccggcagtccctacctcccctggctcccttctctatggccggaggcccaatctccagcacggaaacatggttcgtcgcctcttcctcctcctcattgtcacgtcgcgggatgcaacatgatgctgtacacaatgcgacgaaaaagttcagcgagctcgccgcctcctgcaagtggaaccttccctggctaagaaggaggaaggaaggtgggaagtggagaggagagagaaagggaaagtttggcactctgcacttgagctcaggtagaagatgactacgttaaaattcgtgtggagacgtgtcactcaagatgacaagtctttctggatgagcgaaggaccgaggtcttgtataattttcttccgcgggcggcggctacggccatggagatctcgcgactcgcgggtcgcggccatgtgccggtgaggtcggctgcttcgccggcgtctccgcctccgcatctacgcctgattgatcccccccaacctatctccactgtgctatcgcgtttcttgcggacttgcggaggttgtggttgaggcagtagcctgtggggcggtgatgcggcgccgagatcccgctcgtccacggatttccggtcgccatcgccgggattcgtcttctccggccaacccctcgccgcgccgcccgtcctcggccaggatctggtcgggatcgcttgtggtaggtgttgggcacttggggtttgaaagacagcatcgttgatgtgctttgagttcctgcctaattgacttacgctgactctgtcaatatcaacatcttcagttactattcccataatccctaaaatcccagcagttgcgtggtaggttatgtaaagcgcattcctgtgatgaaaaatagaccctaggagacatataatcaattgtatcaagtgatccaacacactaggtccccaaatattgtcgtagataccattttctcttcagtattctgtttaaagactgatattggtctttggatgatgtgcttgttcatcgcaccagttgatctttactattggtgcatatttagttccaaggcgtcgttttagttaagctgctgaagcgttgagcatcttgtcatgctgatattcttatgagtggttcaagatggtttgttctgttttagtggaagtgaaagaaggggctgtcccctgcttatgggaagagaaaaagagatgtattttagcaaccatgtgtttacagtacaatccaattagttcactaagctattatttatggctgttatatcctgttctgagtatttatttgttatactgtaatggtattaaatttctggcattgttatacatgattatattcgatcatatacagctattagtaattcatgtagttagagctgaatgggagttttgctagaaagacattgcttctttcaacgacccttattcaaacaaaattaaagtacctttttctctgttgtgctgattcccattgttacatagctgaaacttaagtaattgcaaaatttgatggaactcatatattcttctactcttataataagggaggtttgtatgtagctacactcatgctatatgcatgcgctctgtctatctgacttttgtatttacatttgtattcaagacattgaggtcaactaaattctatgcccaatggtgcagccatatttcatacatgaatatggctatctctttgcctggtaggttatgaaatatgaactctatgtgtttattttgatgtgaaatggcctcagggcaactcattttgatgtatgagtatacatgtcaatccacacagtaggtcctgagatattttattaatgaccttttcacttttcaccatccttcacttgagaatatgctctggttgatagtagttagtttccgtgctttgacttattgccgaacccttgagagcatcttgtaatgttcaactcttatgaattgttgatgatgaccttatctcttttgatgaataggatgaatagcggcatggcaacccaagggccaaggccagagcactagggcctagagccgcaggagtggagctagagcgaaacagagggtggtgccacttgcttaatttactctactttagatcaagtttaagctgatacgggtgcttaagtttgtattgaggagggtgcatacatggtgaaaataggtaaggtatagctaaaaaaatttcttgatcgggttcctgggcacccccctaatatatactagctccgcccctgcctagaggcattcctagaaacttaggagcaaacgaagaaaggtagcagaaccagtgtagaggaggcattaggagaaatcttaaggacatttggtaactttgaaataccataatgcgtctcataaaaaatattctaattttaaaatttgtactatgtaataggtggttaaatgctgttcttctgagtgatggagttgcagattgtaaatcaatctttacttatacaaacgatgggccaatcattggcttgttctcgtctcttttttttttgggtcaaaatgaattggaatagcaggtgcctttgaagtgtaaatataacagaacaagtgggtaaattttaatataattccgaaagaatcatcatccatgtgtcattttctttttcatgcaatgaacaacagatttgtatatatgtatttttaccatcagtaacagtcctttattaatgcatagtatgtggttctgcttttctgtagggggacgttgagttgtaagaactaagaagaccagatgcatctgctcagattttacaggcctgtataaccagttaacgagtggcaaaaaaaatgtctcgcggccgtgtctgatacataactttgccaggagatctatctgttgatgcacacaggctgccatggcattgttacccagttgctcttacatgcatttctgctggcataagatggtggaggttctgttgttgaacctggaacacaaccggtgctcagaagaattttgtatcactacaacctatcaggatttgatcgaacaatttggtatgttcatacacatttgagcaattgtacagtactccgaagttggtgttttctatcatctggtaattgtggatcactggcatatcgaggaattgtggatcactgacatatggaggaattgtggatcactggcatattgaggaatcaacctgacatataatattcagggtgtcttttgtatacgtggagactgttgtgtatgccatttttctggaatgtcatgtaatatcaacgtatccgtatcgccgtaccagtatcacgtatccgtgcatcacaaatagccatattattttctatatcgatatttatgattaaattgagttaagaatttcttttgttgtgcggataactgcactgattgcaaatctgccaatgagtactacctccgtcccaaaataattgtatttctatgattcaaactttgtcccaaattaattataattctagagcactaattgccccatcaatcatctctcattcaaatttcttcctattataccctcaaccatctttccactctcacataaacaccatttaatgaggggcaccatagtcttttttctcaaaccttaatatatgctaaacaacatagaattacaattattttgggacggaggtagtaccaaaatattcgtgatttagtgcattgtgttcctgtgactgaatctgaaagtttggcagctagaatgaataccaagtattgttgtgcatatccccgtggaataagtctatttacctccatcattgaatggtttcccttaaccacaaggctgggtattacgtcatcttcacaaaccagtgcaaattaccttcttcagtggtttgacaatcggtttttgttgacgtggctgcttgattgcagttgactcgccgagttggcaggtgggatccacatgtcagcgacatccacctcatatcatgcttttctccccttctctttcctttctttaatctcccttctctctcttaccttccagcagcaacagaggccatgagggctacggtggtagtgagccggattcgggggtggcgacgacgaaggaggagggaaaggaggatgtggagacgaagtagcaatagcagcaggaagcgactgcagcagcgagagagagaggaggttgtggtggcggcgtcgaagcggaagcagcaggtggctgctgtggtggtgagggagaggaggctgcgagacgacggcgtggaagcaacaacagcagcaggcggtggcgttgaagtggaaataataggtgattgcagtggcggtgatggagatgaggttgctacgacggcaagggagaggaagtggcggcatcgaagcaacagtagtaggcaacgacgaggaagaggaagtggcgacatcgaatcagcagtagcaggcgatggtagtgacaacatcgacgcagaggaatccgcggatactcttgatggcttcctcatctccctcctctcttcctcgccggccatcgaccgtgctactgccttgcttgacgatcactagctgttgtcgtcggcttcgtctccggctaccaccactgcagcaacctaggaccaacctgtgactagtgtaaatggagtggtatatgtaagtgggcccatctatcggatgggctaggctacgcggttgtagaggtagggctgttacacgaccggccgtcttcctcgttgggagaacaagattgggaaaaaaaaaaggaaagaaaggatagagaaggaggatcaaatgtttcactgataggtgggtcccacctatcatgttgataaaacccgttttccaaaccaccgaagtagtcgatttgcactggtttttaaagatgagggagatgctatatctagttttgtggttgaggaagatgattcaatcgggagtaagagatgagagaggaaaagtagacttgcttatctccgtagcccggacatgatccaactactaagctcggacaaattacgtggtccgactaaggtgggtctagttctcgaacgttcgcatctcgcaaaacagttcaataggttttatcgttatcagttctaacgacgtgtttaagctcgtactatatagtattttgttatttcagttagaagaccaaccaatcactttttcctattatcaagttgttcagattggattttatttcttgaaaaaaaaatccagtgatgcttaaattttttttatttatactgaaatttatacactaataattaaacttctaattgcaaattataattcatactataaagtttataaataaaaagtccataatataaagtgtatatacttaaaggctctatgcatagaaagtttatatacataaaatctatatatggaaagtttatacacataaattccatatatatagaaagcgtacatgtaaaaaagtaatacatgtaaaaaagtttgtactaaaaaaagctataaaaatgactataaagagaaaaaagtaatttaacaaaaagaaggggaaaaaatgatatgtaccgttaggagaattaacgtaaaaaaaaggaccacggtaaattgaaaagaatcacgtagaaaagaaaaaaggaaaattaggaatgtaaagacgacgccgtaacgacgcaacacacctgtcacgcatcgccacgtttccttttgtctccccaccctgacctgtccgcgcgatggacaagtagcgcacgtcgcccaatagtcaatccgcctactacggttggaataagtcaatttgctgtccctcgaatttacgttgagtccgatagattaccagatttgccctttgtactgcttagacctccccagaaaacgtgtcacccccggttcgcggcggctcggccgagtccagtcccgcaggggcaaaaccgtccttcagactctcctcccgataaccggcgccgcccagcccatcagtccgtccgccccagaggccccaactccccaggtccgtaattttgataatttgaccctttgaaaaaacttattttgatattgatccatgtcaaaacctattttcaaaaatagaccttttttcgtgccattcgctgagctacaacatcatagcgccacttactttggcgctgagataccgtccgacatgtcactggtgtcacacatcatacgatgtcagcgccaaattctttggcgctaacctccgtggcttgctatgtataaatactatgcatgtactaccgtgatacatggaagatttggcctagtggtgaaagcccgcctctcttaactagaggtcaggcgtaccacgaagatgttagcatgaagagctctccaccaagctatctcgttttttttttcagttgtggtagcttgtagcttgataatatttgtagactggagagaggtgacctcggataacgtgtaaaatccgtgacacctcggatggcatctcagcgtcaatgatagttgcgccaagacgttatagctcagcgccaaccacaatggcgctgagaaaacggcctatttttcaaattagtttttggtacagttcaattttgaaataagttttctgaaagggtcaaattgtcaaaattacgggaggtcttccccttcgcatccataaaagcagcccgagccgcgcgtgatcccgacgtttctgtagcttgatctttctagcatctctgctactgctagtactccaaccttctcaattccctagctttgattctgaataataggaagacccacacatcggagatgatggttgacaatattgctcgccgggaagcggaggccgacggcggtgcttccaagatcgcggcggcgctggggctgttcggcgtcgccacggcctctctgatcatcaacctggtcgccgcgttcgacccaccgcagggcttcgctgaaagcgcctgctacgacctcgctcttgtggggtccttcctcgccggaatgggccaggttggcgcggccatctgggtcgccgacgacccacgcggccaccgtgccgccgtcggcaagaagatcatgatcgcctccatcgcgccgctcgtcgtcgccatcggcctcaccggagaggcactgctctggtaattccactacacgtaccaacaccatggatcggagcgagtgtatcttgtactactatcttacttagtggagtcgcgtgatagtgtgatgatgctttttacttgatgtttttgtctactggctactgctgtttgtgttagttgatcaatgcttggattgatgaatatttcatgtaaattttaagtccatactattgtgtactacaatcaatgaaaaatttctcaaaaaaaaaaaactgctaatgaggggaacagagtatatggaattttggagtactccaattttcactgacgccggcgagcatgcgcttcctgatcaccaattcaaggtgcacttcccgccgccgccggcgggggtatttaccgctccggcgacggtggtgcggccggcatgccgccgccttgtcctccctggggaagcagccgctgtgagcctgtgactcatgcaacggccaaaagggcactctgttttttttttttaaagattctgatggaattgttggaagggggagtaggccatatttaagtgggccccacatgctaaaaattttccccaaaaagggaagggaggagtaggagatatcataggagcggcggccatggcgccttcgcctgtcccgcccactccatgtctctgtctcgctgctgcggcgccttttctacaccagcttgcccccacctctccgtctcaattcgcgcgtgcggcggtgacacggcgcgcgagatttcgctccggctcggccacgatctgacctcgtcggcgccggcggaatcctccgtcttccgcggccaccccctcgccgcgaacctgcgccgggaggacctggttggcatcgccgttggccgtcgcgtctgtgctattgcaacagatctgtggatagtactccctccgtttcaaaatatttgaaaccgttgactttttagcatatatttgaccgttcgtcttattcaaatacttttatgaaatatgtaaaattatatgcctacataaaaatatatttaacaatgaatcaaatgataggaaaagaattaataattacttaaattttttgaataagacgaacggtcaaacatgtgctaaaaagtcaacggcgtcaaatatttcgaaacggagggagtatgtgattttttgtttttttttccattggaggcgttgacttggaagaacatcagagtaccagagccatatctgttccgattttggaggttcatacattacaggtatctgcttgcccttacatagttacgtacatgcatttttcattggcaaataataatccttgggtgatgatgatcctgttgttgaacccttgaactgaaagacaacaggttcttaggggaatttcgtagggtgtgatagcctatcttacaatttgatagggcaatttggtatgttcggtgaaaattctgtagacatttgaacaattgtttggtgctgcgttttctgtcctctggtaattgtgaatcactggcatattcaggaaccaagcttttgtatatttgtcatgctcttgtatttgtgcacatgtggatgtggaggctggtgtgtgtatgacaatttcctggcatgtcatgtaatcggaagcattgtttcggagagggaagggcaatctcctttctaataggcatttacaggtttgcttgtgttcagacttcagactagttactagaaaatggtgcgccagttggcgcacctagtacttttatagcctgtatataacacttgtatgtaacagttacgacttagttacgacttatttagaacatatatttattagttttcaaggtatcctataatttttaattctgtcaattttatccgtttttaagaactcatgaaaaatagactatatattttctatggtttgtttagaacacaataatttggcacagtcaactgctagttcaattatcgtaaaatttatttgggatagagagtttagttttgtactaacttctcgaaggtcaaaatatttctaaatatcttaaggaaatttgatgtattttggtaaaaaaaaaacccacaaatctgatttttattttctttacctctgcataatgtttagtgtctctctgggaggggtatgtgtaaaaacatcttaatttacccaaccgagtttcatatgcacaccacatagcaaattttagtttgatatatgcacatgaattacatagcaaaattacttgtccaacttataaacaaaagcctacttattaataagttttatcttagggccatttataaatactacaaaccgagggcctatttgtacatttaaattttgagaggaaaaaaagaccagagtcacaccctttataaatgaccctcggtaggcctatttgtacatttaaaattttgagaggaaaaaaggatcagtcacgccctttataaatagctctcggccaaaacgaagtattatcaaatcggagggagtagtgttgaacaaatcattcttcctaataaagcttattgtttttctccaccattctctgtctcttatttttgtttcctccccgctgcccaagctactatattgttcggaaggctgatatgcggctgcggctgtacaaccaaccttgtctttgcttcttcgaacatgcatgttgacagccatagcacatgctgcattgctgccaaacaggtctattgtactaaaccaagcctatatgacacatgccggcgaactccccctctaaaaagttaccgaggcaaaaagaaacgaaaaaagaaaactaaatagagagacatattgtttcgcttgcaccaccggtacaccgctactttgatctaaacaactgaacacactctaacacccaataggggaaacctgtccaattttaatgagggtgaaatgttaaccaatcagcttgtgcggagtgcgatcagctttagattaactgataatagcttatattgaaaaatatagtttgtttttacttcaacattttttaagtgtaaatatgatactatctaccaattggcaacgtctagagtcgtatttttaaacatttaacaccgttttcatattaaattattattttcctattcttttttaatttttatcatgagattttgtattttattaagtttattatagcgtgaaatctgttaataactaacaatttattttatttcttctctcaccaactactgatattccctactgccctggcagggagcaccactgggaatagagcagcagccagctcctttttatttttttttatcagcccagatgaataaaaacggcacaggcctaggcatggcccaaatcgcatgcgtggctgccctggaataccgctcgaaggggcgagaagatgtgcgctagcgcgttagaaagcgattttttaccatcgtaatttgcatatttatcttaaccttttttaatcaagtagaaccgtagaaggattaggaggccacatggcacgattttagaggaggtaatcctggaaccaggtagtgccacgtggccctataagaggcccgagatcgcaccctgaaatcgtatataaagataaccatatgctattttctatatcgatgtttatggttaaattgatctaagaatttgtcttgttgtgcggataactgcactgattgctaatctgccaatgagtgccaaaaatattcttgattcagtgcattgtgctgctgtgactgaatctgaaagtttggcagctagaatgaatatcgatcaatgttatgcatatcccgcggcccggacatggtccaactaccgcagtcaggtcaggcccaactaaacttggatggcaactaactgtagcgatccagattcacggtcaccaatggaaaaagtccaatttgtctcccttaattgttcaccgaatctaattcgtgactcttaactggaaaaccgggtaagatgacttcccgaattattgaaactaatgtaatttgactcctccagcggttttggagggcggtttttgctaacgtggcagcgctgacgtggttttcattccacatggcgtttatgtggcattagaattaaaaaaatatctatgggactcacacataaatatattgtgggacccaccgacatgtggggcccacatgtcatcctttctccttcccctcttcctcttccctctcttcctctctcttttctttcccccttttctcttcccccttcgaacgcatcaccgtcacatcggccacctcctctcctctcccattgttgccgtcgcgccggctgcctctctccccctctcctgccgccaccgccagccgccgcttccctatctgccgccgcacctgcttgactgctcgagagaatcaaggagagaagaggaaaaaaaaagaaaggagagatgtgggatccacaccattttctctcacttacatgtgggctcgacatatttattttaatttttttgttgactaggctgccacgtcagcgaaactaggcatctatactgtctcgggacttttttttggatggttttacatagtttaggggtatacatttctggtattgcggttaggggacctcaaacagactcggcgtaaagctgagagatggctgatgaacttatttctctcccgggtgcctggcccaagcgggcgctgaatcatgtgtagcttgtgcagttctttttcttccggttatttgtttgcctcttgatgcgatatactgcactactcggtatacactagtttgctctatattttgaattttccatgtttctgcatttcaaatgtgcaatggaataattaaaaatgattcatcgaatggaaactattgactgtgagattttgctacatgattatgggttttctgctgcttctttttttttttccgctgatgccttatagttttttcatgggagagaattagggaaggcaatttcccccgcggggacccgaccctatgggggcggggggcggggacgggttaagtttttgacccgcgggggaggcgggggcgggccccgcatttttacgaggaggggacgggggagacagttcacccgcggggcccgcgggtgtatattaacccttaaaatgtagcacatagaagacccaaaagagcccaacccaataaaataaagataaaatgaaaaggaaccctagccttatcctcaccagtgtcttcccaactcccctcctggctcccgtacgcatcatccaccggtggaggcggtgctaggggccagggcgcacgagcacacgacgcacttctttggatctcgccggcgccggtcgccctctcccctcccctccggccttccgagtcccatcctctccaatatccctctccggctctccctcaggtctgccaatgaggcgacgacgcacaggcgcacgggcgcggcgaggacgccgtcgagaggcgagggtgtggcgcacaggcgtggcagccggcaaggggaccgacgtggcgtccggcgagcagcgaggggataggtgcgcatgaatcgaatgatggatcaatgtgttcttggcttcttgctgaattttttgatgctatttatttttatggtgttaattatgtacaatatttgttcttgccgaattgatgattgtcttgtaatttttgtgctgattggatggagatgctacctaatgcagggccccggtcgggttgcggggccccggaggggtccgggatgggggatgatgtcgggggtcgggtgcggggccgtttcagcccaacccggccccgccctgccccgttgccatccctagagagaatatgataggtgagcccactaatttttaaaatataatcgttgaatgttgcgcgtacgtcatgtagaacaaaaaccacttcagattgagaggggtgaggggtaatttggtttgagtagttgggtgtatcaaaatgtctggtattcgagatcatgggttagttaggtcgactgcaataattcaagggttaattcgaacttcttcctcttataatattattttgggagttcaacaatcaatttaccatgttttcacggttcgcttaatcccataagggattagggggattaattccatgttgcaatagcagttgggtgaaggattaaacaaacaagacctaagtggctaggtgggtactacattttgcagttatggctagttctatgtgtcggttgattttatcagcccaattattgggaggagataatactacctagcggtttttaccaatcaagaaaggaagatataattattggtataaaaactaatttgaatcctactccctccgtttcaaaatatttgacaccgttgactttttagtacgtgtttgaccattcgttttatttaaaaaatttaagtaattatttattcttttcatatcatttgattcattgttaaatatactttcatgtgcacatatagttttacatatttcacaattttttttaataagacgaatagtcaaatatgtgctaaaaagtcaatggtgtcaaacattttgaaacggagggagtatttgaggatacgccctcgtgaaaatgaaagaaaaaggagagatagagaggaagttctaagtctcgacaaatcctaaaaccctaatatactcatccgatcaggagatgtttggaagatgttcgtgtgtggtggtctccagatagtgccattggcgccccgagggacttcgcttcaccaactaaaaacattcggcgcgacggcgacctcaagcatgttaaatcggcgtctatgcatgcttcccttgtagcagaaccgaagaaagaagaaaacaaggaagaacaacaaacggaataaatcaaagttgttggaatataaactgaattacccacattttctcattagtttaagcttttggattaaattggtcggcgtatacaacttaatgtataagtgattgcgattgactataatggctttactaaatacaagtgattgcgattgacttatcggttagataaattttcgcattgaacaaaagatgatcgtatatagactaaggctgtgttcattgtgggaggttgggaacaaatctcctatacatgaaaaacggagcgttctattaacgcgtgattaattaagttttttttttcaaaaatgaatcaatattaattttaagcaactttcatatataaacttttttaaaaaaacgtattgtttagaagtttaaaaaacatgcgcgcggaaaacgagaaagagaggttgggaactagtagaaggaacgcagtctaagacttaagtgaataagtaaactaaggctgtgtttagttggatccaaagtttggattttggttgaaattgaagatgatgtgattgaaaggttgtgtgtgtatgacatgtgatgaaaaaggactgaagtttggatccaaactttgggtctaaacacagcctaataaactacaaaagtatatgcagttgttgctgtggtgcagtggacctgctaattttgcccgttaaaatttcttcccgtcttcatgtatgatctctcagctgattggtcgagatgaaaaagtgatgacgtcaccaacgtgtcatgctaccagtggtggacgaaacgagttgagagaaccgaagtaaaataaatatagaaaaaaatacccgtgcattgcaacggaaaaaaacatgagaaatttacgtaaaggttaagaaatatttatattatgtaattaatttaaatataaaatcgcaactatacgtgtatatgatgttgaagaaaaaaagctcttaaaaataagttaaatgtggaaaataaaattttccaaataaactatagctggatttaatttttattaaactctccatgattaataacactatgtgaaatttcttcggtattttcagagcagtagagcaccattgctaatctatctatctatctatctatctatctattatattattaaaacagccttgaaaggaggcaccacgttcgctgtggaggctataaattctcacattaatcggagaaaaagaaaagaagagtccaagtagaaatacaatctaaaaataacagaaattcggaattaaaaatatgcaatatggaaagaggagtccatataggaacccaatacgagattaatcaaaagttggaataatgataaaataaaatccaaaattagaaaaggaaaggagagtccaagtagaaatacaatttaaaaatagctgaaattcggaattaaaaataagcaatattgaaagaagtttccatataagaacccaatacgagattaaaccaaattcgaaataaaaaaataaaatccaaaaatagaaaaggaaatgagagtcaagtaggaatacaattttaaaatagctgaaatttgaaattaaaaataaggaatattaaaagaagagtccatatatgaacccaatacgagattaattaaaattcggaataaaaataaataaatccgaaattagcaaaagaaaataaaagaagagttcaagtaggaatacaaattaaaattagctgaaattcggaattaaaaataagcaatattgaaagaagactccatataaaaacccaatacgagattaattaaaatttggaatacaaaataaaacaatatccaaaattagaaaaactaaaagaaagttcaagtagaaatataattttgaaacaattgaaattgaaaataaaaaaaaatattaaaagaacccaatacggtattaactattttttttaaaaaaaattctgaaattagaaaaaggaaaataagatttcaattaggaatacaatttataaataaccaaattttttgataaaaataaagatttttgaaagaaaagaccatctaaaataaaacacatgacgagataaattaagtaacatgcatataaaggaatagagtggtggcggttgatacgacatataaaaattattaataaagcaccaaatagaatcctaatgacaattaaaaggagggatgttaggcaggccgtgaagcaaacgagtaaggcggttgccggagcttctagaaagtaaaaaaaaaaacccattgataatcatattcgatttttaaaatctcaatgacaattatattattaaaaatagttttgaaaggaggcactacgttcgctatgtgagctagaaattcccacattaatcggataaaaagaaaaaaagaaaatgagagtccatgtagaagtacaatttaaaaatagctgaaattcggaattaaaaataagcaatattgaaagaagtttccatataagaacccaatatgaggttaatcaaaattaaaaataaaaataaaataaaatccaaaattagaataggaaaggagagtcaagtagaaatacaatttaaaaatagctaaactttggaattaaatataagcaatattgacgggacttctagaaaataaaaaactacaatttcaatttttaaaggttcggaacttctaaaaagtaaaaaaaaaataatgataatcatattcgattttaaaatctcaatgacaacaaagaagggaagcagcgggtgagccataaaggagtacaatggcaaagccactcacggtttggcggtacttctagaaagtaaaaatgaacctaaacgataattatgttcgatttttaaaatctcaataacaataaagagaagagacagtggacgggctgtagaggtgtataatggcaacgtttgacgggacatttagaaattataaaaatgaaacccaacgtgacaataaactctaaaaactataaaatccaatttttaaaggttccacgaagaatgaatagaaatagtggtagatcgagcaagcaaataaagaaggagatgacatgagggatagcaactggtgtgatttttaaaaactatatgattaaaaacacgatgatgataaggtttggtctttcaaagtcttaagacaatgagatagctagtaaaatcatactaaaaaatatattattttgtttgggtgctagccgtgcaattgcgcgggcaacccaactagttttgataatacaaacatcattttatcatttatttaaatgagaaccctcctttctccctgggccattttgagcccattctttctttagcccgtagcaaagccagcccattaacctgacttctcctcccttccacctcgacctgcaagcgcgcatccagcccatcaagcaaccacaaagtctaattagtgtcccttctcctcctctagctgtcgcgtgggtcccagtgctacatggtcgtcccctacctccgtccaactccgcagcttcccaacactgtcggaaaccatccccttcgtgaaatccctccacatccacggagataaaacaaaattgattgagggattttaatccttatctccttctctttccgttttttcaataattagagcaaaatcgcatcgtatcgaccttagaattaagccatatagcaaaccatagagttgtctgttttgcgtacgggagggaatcgaaccgcgcgcccaggtacaacgtacgaaaaaaagttggaaaaaacatcttaaacttttataataggtaaagataaagatatatatatttatggaaaatttgtgggctgaaaatcagattgctaaggggcgatcgatcgccctgagcgatcaccccctcctccacgtggtttgcttttttggcaccacattactttcttattttagtaaatttatacacctcaagtttacacatgtaaagtttagagacccaaagtttataagtcaaaaatttatatttccgattcaaatttgaatttgaattcaaatattttttatatatagtatttctatacatctaaggtttatacacctaaagtttattaacccaaagtttataagtcaaaagtttacatacccgtttcaaatttgaatttgaattcaaatattagtttatagatccaaagtttataagtcaaaagtttacatacccgttttaaatttaaatttgaattcaaatattttttatatataatatttctatacataaactttttcaactttattttttatttttttagtggtgtaataggaagagaagaagggggagaggagggagcatacaggggggaggggggtgcccctaatgcgcgatcagtcgcgcggtcacgcgggcgcgcgaccaccaggtccaccactactactcatacgctactgctactactactacaaatctacaactcatacactactactgctactactacatgtatatatgaatatgtatatattgtatattaaactttgtattattgtatatatacatataaattttgtattaaataatataaagtttatgcatatatatataaagtatatacatacgtgtatatataatttttatgtgtaccaaaaaatcgatgtataaaaaatatgcacatatacaaactttatatacgcgtgtataaactttgcatacgcgtatacaaactttgcatatgcgtatataaactttgcatacgtgtatataaactttgtatatctacatattaaaaaccgagagaaaaaaatacgaatacaaagattgtatacgtatgaatacaaacttggtatacacacaaatacaaactttgtaatacgtacattaaaaaaagaaaaaaccaaaaacagaagagaaacgaaaaaacaaaaaagaaaaacagaagagaaacgaaaatggaaaaaggaaaaacaggagaaacgaaaaaaacccggaaaaatcgctcagtcgcgccggggcggggggcggcggaccccgtcccgaacgtgtgccccgaacaaaataaaaagagcacgggacgggtcgacgtgtacccgaaggccgaacgtaaactgcagggttatctatgtgcgttcgcccttcgcagaagcttctctaatctctctccaccgtagcgcagaacgtaaactgaagggttattagtaccttggaatgactggatgacaagtgggcccagtacagaaggtcccattatgtcagtggcactagatcgagcactcgcgccgcgagcccgcgattggaatgccatgtgggtctttctcttgactactccatccgttgaatgtcgttttcagttttatgtcaggtttggtaggtcgtgatctttttactattttgcccattgtgcaaaattttctactacatgcaaaatccgtcgaatgtcgtcgtttcgtttgcgtccgcggggttatcactatatattcctctctctctccaggaaaccaagccttccccacaggatcgagtcgggcagccacgaatcgatcgagagatctaatggcggcggcaaagctactgctgggtgatgctcgccgcgaaccggaggcctcagctttgggcgcgctcggcgtcgccgccatctccacggccaccactttggccaccgcggcgttcgagccgccgccgggcggcttcggcaccaccacctacaaccatctcgccgtcgccgggctcgcagggaccttccttggcggggtggccctggtcggcacttcagtgtgggtctctgacaacccagctgcccgccgtggcaccggcaagaagctcctctacgccgccgtcccgccgctcctcgccgccgtcgttctatcggtggcggcgctgctctggtaagcatgtacaagcccctgtccgaccgcattactatccgccatgatcggagccaagccggccgtccctagcgtgctccttgtgtcaatcaaatgcaatcttaattattccatttgtattgttcatttgtttgttttgttggtcgatcgctccgtcatgtgttatgtctcgtggagttgtagtatcatcatgtaatagtgcttgcttcttcttcttctagtccattgtgtgtatcacatatgtatgatcacgtctcctgttcttggtctgtcaaagtgttattcgattgatggccggcttaatcgacgagtgttttgttaattatgagttcatatctcccaatttgaagtatggtgattcaaaggggagctatgcagtactagtttttggcttaattacatttagggaagagtggatttggagtactccatgcatatcggcgccgctcgccgtcgccgccgacgctgaatagttctggaagtttgccttgtcggccgtcgtgtccttctggtgctaaaagcccatctttttctcctttttttttcttttctttttttttggaggcaactgttagaagagagggaatggtgggccatattaagtggggcccacatgccgtatcatatccatgacctttgtccttgcgttgccggcggcggcggcggctacggccatggagatctcacgcgaccatttgccggtgaggtcggctgctccgcctccgcctccgcatctacgcctgattgatccccacccctctctccactgactgtgctatcgcgtttccggcggtggttgatcgaggcggtagcccgtgcggcgcgcgagattccgcccgtccacggatttccggtcgccatcgccggggttcgtcttctccggccagcccctcgcgcgcgaactgcgccgcccgtcctcggccaggatctggtcggggatcgcttgtggtaggtgttagggggcacttgggtttggaggacagcatcgt

SEQ ID NO: 58061 - DNA, 11176 bp, Oryza sativa
tactacagctctcccaacgtcgactcgcgccccacggacatagtggagtacgacgagtttagctctcgctacaacgaaccggatctcgacgacttcgacgaaagcctagatgacaactacacccctctctacttcggcgtcttcatggccgataacgagacggaggagcaacgccaagcccgggagaccgaagcacgtcgcgaggctgagcgtctccgactggaggaggagcgtcaagcacaagaacaagaacggttacggcgtgagcagcaggagcgtgagcggaccgcgaaggaggctgaagatcgacgacagcgagctttggaagcagggcgccgagcgcgtgatctcatcggccaacaagatgttgaagggacaccggttttccgcacccctcagcagaatgcggttgccgcgatcaccctcctcgacaccctcctcaaggaaaacgagctcaatcaatctgatcacgtcgtcaacatcttgaaccagacgaagaccatgattgcggcttcggtcccagttaactccgaaagcgtccacacgccgactggcagccgagttccccacttccgatctcatgactaccgtcatccaagcctcagcatcaccggcgcaggatccaatcgcaggagcaggggtcacgacgggcggttcactcacctcccgaccatcatggggagcgccgagtggaacggcctcgctcaccacctcgtcgccgccccgtcgatcttcgcgacacgatcatacagcgccgagcagctcgaggccatcatcattcgccggaccgccatgacgatgaccttgacggagtagcagccttcaccgacgatctgcgtcgagtggattggccagccggcttcaagccgactggaatagagaagtacgacggtaccactaacccagaatcgtggcttaccgtctacggtctcgcaatccgcgcagcaggaggagacagcaaggccatggcgaactatctaccagtggctttagcggattccgcccgatcttggctccatggattgccccgtggtacaatcggatcttgggccgaattacgcgaccacttcatcgccaacttccaaggcaccttcgagcgtcccggcacacaatacgacctctacaacgttattcagaagtccggagaatcccttagagattacatccggcgattttctgaacaacgtaataagatctccgacatcaccgacgacgttatcatcgccgctttcaccaaagggattcgccacgaagaattggtcggcaagttcgggcgtaaacctcccaggacagtcaagcttatgtttgaaaaagccaacgagtacgccaaagctgaagacgccgtcaccgcatcaaagcagtcgggtcctagttggaagccaaataagggtacgccagctacgggaggaggtggaagtaacaatcataaggaccgcaagcgtaagcctgcggaacttgttgcaaccgccagtcactcttctcgacagcgttcgcgcgtcaacacgttcgacaagatcatgaactcccaatgcccgcaccatcctaactccaaccacgtggccaaagattgtttcgtctacaagcaattcgcggatcaatacaccaagactacacggaagaactccgacgaagaacaaagcacgtcgaggaagaaggacgacggcgacgccccggcaggatttcaagaccaccgcaaggagctcaaccatatcttcggcggccccttggcttatgagtctaaacggaagcaaaagttgactgaacgggagatcaatgctgttcaacccgacacgccccagtatcttcgatggtcagaaatcgcaatcaagtttgaccgctcggatcatcctgaccgagtggtccacccggggcggtaccccctggtactagacccagtggtccgtaatgtcaagcttcgcagaaccctcatcgacggtggcagtgcgctcaatatcctcttcgccaagaccttggatgacatgcagatccctcgctccgagctaaaaccaagcaatgcgccttttcacggagtaattctaggattatccgcaactccactcggccagatcaccctcccggtcacctttggcactcgggaaaacttccgcacagagaatatcagctttgaagtcgccgattttgagacagcatatcatgccatactcggacgcccggcgttagccaagttcatggccgtcccgcactacacttacatgatgatgaagatgcccggtccccgaggagtcctatccctacggagcgacatcaagcaagccgtcacatgcgacaaggagagttgcgacatggcccaaacccgcgagatgacgtctgtccgagaggatatccgactggctgcagccacggcgagcgaaggagaagtgcccgccaccaagacttcaaaaagtggagaaagcgaagccaagactaagaagattcccctagatccttctgattctactaaaactgctgtaataggcgccgagttagattgtaaataggaaagcgcgctcatcacctttcttcagaacaataaagatatctttgcatggaaaccatctgatatgcccggtattcctagagaggtgattgagcactccttacatgtcaaagaagatgccaagcctatcaaacaacgactccgccgattcgcacaagacaggaaagacgcgatcaaggaggaattaaccaagctgttagcagcaggcttcatcaaagaagtccttcatcccgactggctggcaaacccggttctagttcggaagaaaacagggcaatggcgcatgtgtgttgattatactgacctcaacaaatcctgccctaaagatccttttgggttgcctcgcattgaccaggtagtcgactcgaccgccggctgtgagcttctcagttttttggattgctactcggggtatcatcagatccgactaaaggaatccgactgcttgaagacttcatttatcacgccctttggagcatactgctatgtcaccatgccgtttggactaaaaaacgcaggagcaacttatcaacgtatgattcagagatgcttctcaacacagatcggtcgcaacgttgaggcctatgtggatgatgtagtcgttaagaccaagcaaaaggatgatttgattttggatctagaagaaaccttcgcgagcatccgcgctttcaggatgaaattaaaccctgaaaagtgcaccttcggagtaccgtcagggaagctgcttggttttatggtgtctcataggggcatccaagccaacccggagaaagttattgctatcctcaacatgaaaccgccaagtacccagaaagatgttcagaagctgactggatgcatggcggcgctcagccgatttatttcaaggctcggcgagcgggggatgcccttctttaagctactaaagaaaacagacgacttccagtggggacccgaagcacagaaggccttcgaagatttcaagaagctcctcaccgagccaccagtcttagcctcaccacacccgcaggagccgttgttgctgtatgtatcagccacctcccaggttgtgagcacagtcttggtcgtcgagcgcgaggaagaaggccatctccagaaagtccagcgaccgatttactttgtcagcgaggtcctagccgactccaaaacgaggtaccctcaggttcagaagctgttatatggtattctaattactaccaggacgctatctcactactttcaaggtcactcggtaacggtggtcacatcatttccactcggtgatatactgcacaaccgtgaagcaaacggacggattgctaagtgggctttggagttgatgtctttggacatatcattcaagccccgaatttcgatcaagtcccaagcgttagctgattttgtcgccgaatggaccgagtgccaggaggatacccccgcggagaagatggagcactggaccatgcattttgacgggtcaaaacgactttcgggcactggagcaggagtagttctaatttccccaactggagaaagattaagctatgtgctttggatacatttttcgacgtcccacaacgtcgccgagtatgaggcgctccttcatggactacggattgcaatctccctagggataaagcgtctaatagttcgaggcgattcacagctggtcgtcaaccaggttatgaaagagtggtcctgccttgacgacaacatgatggcatatcgacaagaagtacgcaaattggaagataagttcgatggactcgagctcagtcacgttcttcgacacaacaatgaagctgccgatagactcgccaactttggatccaagcgtgaggcggcaccctccgatgttttcgtcgaacacctttatacgccgacagtacctcacaaagatgctactcaagttgcgggcactcatgacgtagctatggttgaagccgactggcgagagcccctcatacgatttttgacttctcaagaactcccccaagacaaagatgaggccgagcggatttcaaggcggagcaaactttatgttatgcatgaagctgagttgtacaagaaaagcccttcagggattctgcaacgctgcgtatctttagaggaagggagacaattgctgaaagacatacattctgggatatgcggaaaccatgctgctgcacgcaccattgtcggcaaggcttaccggcagggtttcttttggcctactgcagtatccgatgccgacaaaattatacgcacgtgcgaaggttgccagtttttcgccagacaaattcatctaccagctcaagagttgcagaccatcccactgtcttggccgtttgcggtttgggggcttgacatggttggcccgtttaaaaaggcagtcggcggttacacgcatctctttgtggccattgacaaattctccaagtggattgaagctaaaccggttatcacaatcacagcagataacgctcgagacttcttcatcaacattgtgcatagatttggagtgcccaatcggatcatcactgataatggcagacaattcactggcagagtttttaaagacttttgtgaagactttggaattaagatttgctatgcctcagtagcgcatcccatgagcaatggacaggtggagcgagccaatggcatgatacttcaagggattaaggcgcgtgtttttgaccggctaaaaccctatgccggcaaatgggtgaaacagctgccatcagtactttggtctttgcgaactacacccagtcgggccacaggccagtcaccttttttccttgtctatggggcagaagcaatgttgccgagtgaagttgaatttgagtctttgcgctttcgaaatttccgtgaagaacgctacgaagaggaccgagtggatgacttgcaccgattggaagaagtccgcgaagcggctttgattcagtcggctcgatacttacaagggttgcggcgttatcataaccgcaatgttcgatcccgtgccttcctagtcggcgacctggttttgaggaaaattcaaactacacgagatcggcacaagttatctcctctatgggaagggccatttatcatctctgaagtcacccgaccaggttcctatcgactcaagcgcgaagacggtactctcgtcgataactcttggaacattgaacatcttcgtcgtttctatgcttaggcttatcattgtacttccctatcttgactgtcaacattaagttttcttcttgaagttgtcagtcgggggctatcattataataatggagtttgattacttatcaattcaatttgcttacttggtctatcattgccttgtttgttttttctacttagtctgcgaggactgaaagtttttaatagcttctttgggttttaggctcaacaaagcttgataaaagcttttaagaaatcaaagacttggctagaattatcaaacacagcataaatacaccagtattgtacaagttgagcctccatttgttacattcatactcagtcagaatcagttctttcatcatcagagttattgttgctcggctgaaggtcgttgttgcggaattgctctacaacgtcacttgcaatcttgtcagccgcattttgagcattggtgatgagatcaagagcagcttcttcgcttgtcccgtctgcaaagccatcaatggcgtcaatttcaattctcgggtacaatgatttggtcatcgccaatgccatgctagctcccatacttccagctttcttgatgttcttgaaatatacatccggagcaactctcagcttgtcgaaaatttcggttgcgtcgagtgcactcggaccactgttattgaggaacatagcttggacgagtggtgtagcgacattggcgacttcatctcttgctccttcaagcctcttgatcttaccaaccaggacatcaaattgagcttgagatttgattttgcagtctgcaaaacacatttatgataagaatctgctgtatttaaaagagagaagtccagattgttagctggtagtaccttcaacctccttcaaggctgagtccctttgcgcagccagttctactttgtcttttttcaaggcttcaatttgtttctccatttgagccatcctggtggcttgcgctgtttgaaatccaaatgtttgaggatacagttatgacagtacaaattaatgggacagatctagaagattaccttttgatgaaccactcagctcgaagtttgaatcctggagctgggcaattcggtcccttaattccttctctgtctttttggcgtgctccttggcctcgtgtagctggtccctaactgcttccagagttcccaaatgaggaaccagcttttctaaagttgcagtcttggcctcattgcgaagatggattctctgcatgatggttcatggtttagttctgctaaaaagaaaacaaagtcatcaaaggcagtcgcctgaaagatttacattcacaatacgagtggcttccccaagcgccttcttcagctggcacacttcctcatcttctttttgacggtttatgacgatgccggcaacctgtgagttctcgtcccaccatttgagcaagataggaggacgagaatcatcagccgcctttatgcggggaatttcttcttcgccatcgcccggtggtcctgatgtatttccaagacattaggcaaacaaactggagttatttaaatcggtatcacttgagaagatgagttacctgaggatgttcctagctgagcgtgaggtgacccttgttctttatttggagacccaatcattgagtctttactagtctctggtccttgggaagttgtcgtctgcgctccaacttcagggatttcttgatcgggacctgcatccgactggtttccagtcgggggctcttgggttgttgcagtttcagctgctgtcgactggtttccagtcggcggctggtcactcggatcggccttatcacccgaagcatgggcaccagtcggctggctttcggcagttggctcaggatccttggataaatttggctctgtcacggcttgatcaggatcttttccagttggatctatgtcggatggtttcctgcaaagtgttctttcaatatttagtataatttctatgagagaagcatgtcaaagggaaatggtaccgagaggtttatacctggaagatgttctaatctttggcatttgacggccagccagttttttcctgggcatggtacgcttcgagagtttattaggcgagcccttgtccccagatttgttgtcgtcgtcgccttcatcgttgtcaagcaccagttttctcttgcgagaacctgtctgtccagttggattggaggtttgaggttgcgaatctggtctgattattggccctccacctccctgaacggtgtgctggcgaggagaccggcgctgagtgattgggggatcagattttatcaatacatattcctgaataagatgcctccatggttagttaactcaacatgaagacaagatactattttggtcataggttgaagatttcagatacatacctgcggaggtggattgaatgcattatatggcacaactggcagctgatgtgagtagctgacgacaatagcatttgagaagattttatacattctctccttcatgattttaaaatccagagagtctggttcttcgcgattaggatcatgcttgccgtcaaactcaaaagctgtacgggatctttctttaactggcgccagtcggcatttgatgaagtgccgagtgatctgctctccttgtaagccttgttctttgagttttagcatgcggtccatcaactctaaggcttgggctgcttcgtccccaatcggaagagagttccaagtatcttggtacactggaggaagacaagagtactcgggaagagcaggctcaggattctgaacataaaaccagttcgcatgccaccctttgtttgaagtcttgaagggcattgagaagtacttctggctcaaagttcccctcagctgaaatccggctcctccgactacacatggcttgctcttgtttggttggggtttgagaaagaagattcggcgaaacagagcgaagtggggtttaattcccaagaaggcttcacaaacatggatgaaattggcgatgtggactatggaatttgggtttaggtgatgcaagctgattccatagaagcttaatatcccgtggaaaaatttcgaggtcggaagagcgaagccgccataaaagaaatgagagaagaccacaacctcgtgtgtatcgggggacggaaaagcctcaccgcacgctggccgccacccgatgatctccttggcagggagaacgccgtgcgccactatctccttcaggttctcctccgtcacgtcggatggcgcccattggccctcaaagctttctttctcttccgccattgattttacccgaatgcgctgatttgattcgggggatggctagggagaggtgagggattgaggcggtgaattacgggaaggattttgatgaacttttcgaaggtggatttgagtggattggtgaaccctagtttgcctgcgcagctccgtactgtagcagggagtggggaaaatggcgagagttccggcggggaagactaagtggcgcttggatcacgggattttttgttaagggtatcggaggtgcgaatgggcttaggcctgaacagtacctcagcccaatacttttaacagcgtggcccattgtgctccttagggacttaggcattttttgctttggcaacttatgcgcacaatagtgttgtccaatgctgataaaattcttttttacgcggtcatataattcttcggaattattgcaatgcgaattttcaggtgtggcctgtcacgttcttttagggactcaggcacttttcgcttaggccaaagtgcgcgtgatcaagtgcccaataccttaaaatccttttataccgcagttactcaactttttaggagttggtacaatgcatcttaaaaggtgtcaaacagtaaagctttatatagctgccccgctgactttttaatatagtcatggtgctgtttgggtttttaagcaattgattggatacaatatcgttgctctttgccacgtaagtgtgcgtttttattgaccaatattatggcttaggctgattatatattgtagtcattttttttaggcggttggtaaatcctttatgagtttatttactcggattttacaccacatatgcctgttttcattatggtggatagtcatagcttaggctattagacttattcattaccataatttttataatatttggtgggtaatctttagagttttttattcggatgcctgtcaagtgtgttcattcgtgaaccttttagagtgttaaccattcggattctttttattatggctaaaaagcagtcggctagaatgcctctttatgcgccgcatatgcttttgtcatatgatgcatgattgtgctattattttgttctcaactatatgtttagtttgttaactaatcacatagttgggggctacacctaattaggtgcatctattcgatgcaccatattccttattttttcgccctttacagtcttcgtcttcgctactcggcaggccttggcatgaaaagtttgaagcactcggattattatctttgagaaggctatgatggttgactgcaaaggtctcgggggctactgtggagattatggatatcccatatctacacggcgatgatatttggactggatataggataccgaatatatatagaatatcttatttgtatctcgggttcgtttcttaacttgtacatcaaggaaacaccttgagacttagtcggttacgactgtattttacctgtatctgcatattccgttagggatatagattatcttttgtaacacggactccttcccatatataaggggggtccgggtgcctctaggggcagagatgttgattttctccaaatcatacaatcaataatacactcggcggattcatccccggacaggagtagggtattacttcttgaataagaaggcctgaacctgtataaatcctttgtttccaaacccatacacttttccagcttgatagccacccacttttattattgccgaaatctagtttcgacagttggcgcgccaggtagggggagcgtcaagcttttcgccgatcagtgcaatgggttccgtctccggcatcgacgacctcgtcttcccacccgggcagacgtttcggttcggcagcctcgacttcgtcaccaacaacttcggcaagatctctctccttgactcggtgtcggcccagtcgggagagaaccggctttcagtcccgtttggactcccaaacgcggctgaaagttacttcaagaccatctcaatcgagttggcttcaaaccactcgggcgagatcgcatcttctccaacgacaccagatcaagatgatggggcttacccaccgatcctaatgaagctccccgacgattcggcggccgcctccatcacgacagcgtcttcatcccgtaggcctaggcggaagtcggcttcaacaccgatttcgcctagcttcagggaagtcggcgtcatcctccaaccactcggcacggtttcgacggatcagttggacggctactacagctctcccaccgtcgactcgcgccccaccgacatcgtggagtacgacgag

SEQ ID NO: 58062 - DNA, 520 bp, Oryza sativa
ctgctctaccacagacctccatcacctggccttccttgctgctccatcgggctagccaccgtcctccctcgctgggtcgtcgatccaccctgagccccaacctcctgagccgctctctttatgagcaacatcgtgagagaccgtgagaccctcgtcaatcaggggattttggatctgagcgattccctttttggacacagatctgatttggtgaagaaggaaaaaagaggaggaagaagaagccctccattgccatgcactccactgccttgcagcgccagcagcggaggcccctggcgtcaagacggtggcggtgacttggaagccctcactgatttcgctttgttgcggtatggatatggatggcacctgcaggccaacgacggagggagggaacgatggccactgccggtggggatgatatgcgtggcgaggatgatgatgaccaatgcagcaataatgatgggcggagcatgcatgcgctgcagtagggggcgtcatccggggaggagggcgcacg

SEQ ID NO: 58063 - DNA, 7115 bp, Oryza sativa
aattagggtttttaagagataattttcccgctaggcgccacgacggaatgggcactacagaccaacccccctaacaagaatctcgaccctgagattcagcacctaagggagcagctccgggaactcggagcggagaagatcttctcgctcccaggttgcctcgtcttcaaaatgattgctccattggactttgtagaacttgatggtcttccttcgagtctgacgttctgcctcttcaagaaccttgatcgggctttccttgtaggtcagattcttttccagttcgatattacccagggggacttgctcttctggaactcgaagacatttctttagctgggatacgtggaacacgttatgcacatctgcgagaccttcaggtaactcaagctgataagccacttcgccacgtctggcggttatgaggtaggggccgatgtagcggggtgctaactagccggacatcccaaaccttctcacaccacggaggggtgatactcgcaggtacacatgatctcctttttcgaactcaaggtcacgccttcgattttcagcgtaacttttctgacggttctgcgctgtctttaaacgttttcggattagcttaacttattcttctgctgacttgagtatgtcaggaccgaataccagtgcttcgcccacctcattccagcacaagggagtgcggcactttcttccgaacattgcctcattcggcgacatctgaatactagcctggtaactgttgttgtatgagaactccgcgtacggcaaacaacgatcccaagtgccttcgaaatccaaggcacacgctcgtagcatgtcttctaggatttggtttaccctttcggtctgaccatcggtctgcggatggtaggctgtactaaattttagatcagttccgagggcttcatgcaactgcttccagaaccttgaggtgaactgagtgcctcggtccgacacaattttcttgggacagccaaatctacacacgacatgggtcatgtagagttctgctagtttctttccatcaaaggtggttttcactggcacgaaatgagctgatttcgtgagtcgatccacgattacccagatggagtcgtacccgttaggggttcttggcaaaccggtgatgaaatccattccgatctcttcccatttccactcgggaatcggtaggggttgcagcagaccagctggcctctgatgctctgccttgactctttggcaaatgtcacacaaggctacgtattctgcgacatctcgcttcattccagcccaccagaagtatgccttgatatcttggtacatcttcgtacttcctggatgaatggagtaggcggactcatgagcttcctttaggatgagatctcttaactccttcttggccggtacacagatgcgtggaccgcaccaaactgtgccttgatcgtctatggagaaattggtgtctttcttctcctgtattcctttttattaattcttttatcccttcgttgtctttctgagcctcccggatttgcgactctagggtaggctgtactgtcaagctggcagggacacctgactgtaccacggtcagccttaacttctccaattctctgcacaggtgatcatggtcaggccgtatttgagctacattgcaataggccttgcgacttagcgcatcagcgaccacgttggctttaccaggatgataatggattccaagatcgtaatccttgattagttccaaccatcttctctgtctcatgtttaactcggtctgtgtgaagatatacttaagacttttgtgatcggtgtatacttcacatctgttcccgattaaatagtgcctccagatcttaagggcatgcaccacggctgccaactcgagatcatgggtgggataattgacttcatgaggcctgagctgcctggatgcataggccacaacctttcgttcttgcattaggacacatcctaagccttgtcttgatgcatcacagaagatctcgaaatcttttcggatatctggcaaggtgagaactggggcagtggtcaaccttttcttcatttcttgaaagctgtcttcacaggatgcagaccagtgaaatttattttccttctttaacagctcggtcataggtctggctagcttagagaatacttcaatgaatcttcgataatatccagctaagcctaggaagctgcgaatctctgacacattcttgggcgggttccaagcaagtacagcttcaaccttgctgggatctacttcgacaccgtgggaggagatcacgtgtccaagaaatgctactcgatctaaccagaatttgcatttcgagaatttagcgaatagttgatgatctctgagcttttccattatcagccttaggtgttcagcgtgttcttcctcattcttggagtatatcaggatgtcatcgatgaacaccacgacaaactggtccaggtattccataaagattttgttcattaagttcatgaagaatgctggagcattggtgagtccgaaggacattactgtgaactcatatagaccataacgcgttgagaaagcggtcttcgggatatcttcagatctgattttcagttggtggtaacctgacctcaagtcaatttttgagaaaactcttgctcctttaagttgatcgaataaatcgtcaatccgtggcaacgggtacttgttctttatagttacttcattcagggctctatagtcaattaccattctctcagagccatcctttttcttaaccagaagcactggggctccccaaggggatgagctaggtcgcacataacctttactctccaactcttcgatttgtcttttaacttctgctaactcattagctgccattcggtagggcctttttgcaattggagccgtgcctggtgccagttctatagcgaactcaatctctcggtctggtggcatactcgttaattcttctgggaatacgtcgggatattcacagactatgggcaccgactcaaggaggtgacttgtaaacaggttaggatagaccgacttgcggtaggggtgttaggggtaaagcggacttgctttcctccaggtccttgcaaggtgatggactttcggcacaatctatctgtcctttgtgcttagccaaccaatccatacctaggatgatgtccaagctttgcgagtctaggactatcggtttggctaggaagtcaacttcctcaattttaaggttaacttccgggcatatttgagttgcccttatattccttccaggggaatgtactatcattggtacacgtaaattttgggttttccaaccatttcttttcacaaaagcttgtgatatgaaagaatgggaagctcctgaatcaaacagaactattgcgggtacggagttgacagagaacatacccatcacaacgtctggagcatcctgagcggtttcagcttgaatatggttcacacgtcctcgaccaaagtggttggaagcacgtgaaccttgtccacttgcctgagagctgggacgagactgagctgtcgctggagtaggagttctggcagtgctgccattagcatgtactgagttggtgttggtaggattctgaggacactgtctggcatagtgacccatctggttgcaccggaagcactgaactgctgacggtccctgtggtgacttaaaagaggtaacactgtttggcgcagtattgccactaggggcacgctgctgtggctgaggtgccggatggttcatctgaggacgaggggcgtagcctggctggcggttagcctgagttaccgactggtgatattgcatgggctgaccgtagcgagggcgaggtgcgcctcgggaagaatttccctgatggttagacttgcgtttcttgtattcttcgatagcctcttttctggcatcctcaagtagaagtgccttgttgatcatatgttgaaaggtgggaaagtcatgagcaagcaactggagtctcattccaactgcgatccccttcaaaaatttcctgatcttcttcttgtctgtgtccacttcctcaggggcgtaccgagccaacttgttgaacatacttaggtactcattgacactgctgttgccttgcttaagtctgttgaattcttctttcttcatgtcaatagtgctttcaggcatatgagctgcacggaaagccgtagcaaactcatcccaagcaatgttagtgggttcagggtgtgcattgcagtaattctcccaccaatctgcagcgggtcctcttagctggtgagaggcgtagagcgtcttctcaacaggagtacactgcactaagttgagttttctatccacatctttcagccaatcgtcagcctcgacgggctcgacggtctgagagaactctggcggacgagacctcagaaagtctgtcagcttggatctattgttgctcatgtgagggtggccatttccatgcgtattatgctgaaaaccggctatggctgcggctaatccttgcaagatttgtgtctgaactgccattaagtgttgcatgttgttttccacatgaggtggggaagggaggcgttcttctccagaattgtgactggcagtgtggtgagagcggtgagactattccatcttcgtatcacgggaagctgtacgatgcgagcggttgctgtggcggggttgctcaacttctgcgttgcgggaaacagtacggtgtgaacggttgctgtggtgagactgctcattagctgactcatgatttgcttctggctcggctctaccatcttcaaaaccaaagcgggctggtgcacgagctgcacggcgggggcggctagccatctaaactcccagaagagggcggggtaagagttagataagcacttaggagggcaagtagcaaagtaaatagcaactcagatagcacacactaggcataaactggatttttcaaatcataaaaacacctgatacaacgggtgtggacaagtcacagagctacgccgagcttgactgtgcgcacaccacctaggagaaccagactaccaaacaacacccacaacaaacacacgcacgcactacctcgccacgactccaaaagagttggcggcggaacaaaagggcctgacacccggacggctgctgaagactgcctcctctactcctcgtcggcctggctgcctcctgtagtcggctcctcagtcgaagaaacgtcgatcggctggcgcgaagggaccggcggaacctgtcgagggccggcagcagcacgggccgctggcggtgggggagctgggtagtggaaacggaacacggtggaagaaccaacaacacgcttccgcgcggtgcggataaagcgtgggccacggcgggaggaagcaactggggtgtgtccgggggtgtaggaagggctaactgggtgtgggtagggggagtacactggtgagtacggcgcacgcgagctgggggagcgcggaccactgggagtgcgggcagagccacgggagctgtgggaggacaggtggctggcgtgacagagccggcctgagtcccaggagatagtgtcaactgaggtgacaccctcctcggccagacgggcctccaaagcggcgtagcggcgggcaagggagcggtaagcctcaaggagtaggtcgtgctgagtggcctgagcctccgaaagctcaaccatgcgagtcagcactggctgagactcgctgtacggacaagggtacctggcgtctgagtggccagaaggaaggcgtggaagctgccggaaggcggagcctccgagacggtggctgtagtcgtgggccaggcgacgaagcgcagtccaggagaggtcctggtacgcgatctggagagtgggcctggccacggtgaagtggtgtgggcgaaggccggctccgtgtatacctccacgggggtaaaggtacacagagagctcacagtgagggggaacacggtccacggagtaccccgtgtactcgggacacgagaaaccgaggaaacgggcgaggtcacgaagctgagcgacgtggtgaccctcaccaaaaccgtgggaactgaagctggagttcactgccatctacaattttgaaagagggagaaggatcagtaaccattttagaaacaaactattgaaaataaggaaaccaaaagaagccttagcttttcgcaagcagttttgaacttagtatccttagggtcgtcctaaacgtcgggtttcgccctagggccaagcctgtgctctgataccatctcttgtcacgccccgaactagtcccgaccggaactagcccgtgacgctccaatttaacctgttaatcgataccagtcccaggaaatagtgctggtatgacagggagacagaatatcacagcaacagaggtctctttattatagagtagaggtacagtcatgttgggctgcggacagatcccgagctcacaactgcattacagaagggaaacggaagccaggacttggaccaaacaacacaggcgcgacttgggaactaggccgaaaccctaaaactcatcatagccggcttgctcctggaagaactcctcatcagcaggatccgcttcatcttcttcagcaactgggggggggggatatttatatagagcaagggtgagtacgggagtactcagcaagccagggaaataagtgtttaatgtaggcttcaaggaaaggctgttgttttcgtaattgattttttttgaactcttttctaaaaacaactaagtgagtgcttctcaaacgacacggatgagacagtgcgtctcgtccggtcggagtatgtgcaatgtatcagtctttagaattaaaacaagattggcacccggccacagcttttcaaacggccacccgggccaacaactttacaatcggccacccgggcctagctgatcccgtcagctgctgatttttcaaacatcgaaccccttttcacaacagcaatttcacaagcagtagtcaaacaaaactacgctaggaatcacctcacatccgcccatgaccgtgggcacggctgctcgaacagtttgttaacctctgcagagggggtacactttacccacacaacattactaacccggatcacccagcccgtggggatcagccacgtcgggagacctc

SEQ ID NO: 58064 - DNA, 21005 bp, Oryza sativa
ctttttggtggtggtgttttttttttggggttcgtttcgacgtcatggtatctatctgttgcagtcttgagctttcatcgtgtgatgaattaaaggatagcgatgttgcttatgtttatcgttgttatgtctatccgctgcagtctttgcctgagtaacgtgtggcttatttggatttagcagacgatccttgataatgtttgcttttgtctatcttatgatccatacatgctacgtatacgtaacgcttcctgcatggtttacttaatttgttagcatattttggtatctctttagttcacatttttccgttacacttccgcaatgagtaatctgcatgtaagttggttttacgagcaatcattaattgatagtcatgcacgtctcatacatcacgctagttggcgactctgcggctatgctttgcattcttgtaatagttagcacctttagtttttttgtactcttatagctttcagttatcgactatggtagcgtgaaccaataaacaattaataggaagtgcaagggcatttttgccaaaaacaatcaacgtggcatctgcaattaccccgccaacctatggctcctactggaaaggtaaatatgtcagtgtggtttaatcatttcctattctaacaagaataataaaaatctgcaatcaataagggttttatttggtttgtcacatggatcatacaaattgtttctattataaaatgtttctatttggtttgtcaccgaaaccaaaaacatgttatattgctctctcattgggttatcatatgttttatatatatatagttaagaggcataaaatgatcggtttcaaaattatgaattgatttatataaaaaagatagatatttatcaatccacaatgtgtgagctccttggatcatttaaccggattttaaagcttttctttcaatgtgtagaatgttttgatggtgggagacatgtgcacatatccctcgcttttagcgcaactcatgagaagcatataatccctttttttcatatagttttttttaaaatcgtatctaagcatttaatttcttttggtgtgtatgagttaatctgcgtatcatttttataatagctgggagattttatttaatgagaagatatggttatacgaatgactgtgctagtattaattgatagcgatatatatggacatggccctcgtaataatgtttggagatacagtactataattatgctttattacgtgattaatattcagatgttgtactggaagcaccctggcctactgattttctactggccctttatgattaagtcctggtacttgtaatgcaacatacatgcatgtgttttccatggcaatatgagcaaaacactcctatatatcatattgtggggacagattaagatagagacatggtaaccaacgagattatgtgcaggtgcaattttattcagaagtccaaacagtcatgtggattattacctgattaacagttacatattaaaatgttctattatgtagttatgttgtaggcaatacaacattgctcagaagagaacattgtgccctttaatttttattagaatccttggtctctagctaacaggcctgagcaactctctagttatattagtcaactattttgtgtctagcatgagaatggtgtatttccacccatatttcatattttccatatatcaatgtttaagtcaactagctatattattgggtgaacttagctcactggtgagaatgttttgttgacctctgtacatccgaagtttgcagacctttacacatccgtagtttgaaaacaactccatccatttgagtggcagtttttttttgtcacaaaatttagtggaaattaataaagggactgcctatacttcttgtaaaaaaatcataaatttaatgataaaacaatcagatttcacacagtagaattaaaaagagatcactaaggttacaaccacattgtacgaatatgacgatgtatttgtaacaattccgactaataaaatagggtccacgagtgtctaccaagataggtggcattggaccaaaacgaactatgtaattaagaagccaacgagcaaattaagccatgatcacgacacttaaagatatggatacatgcaaaatcatagtacttataaattaccttgaaaagagatatcataatatcttgcttttattatgtgctataaatctgaaattatactgatatagaaaaaaataaagaaagaaatctttcacattaaaacttaacatttgagtacatacacacatttttgccctctctctcactccccaccatcacattcattcaccaaccaccagggtcagtgatttttttttcggttagtgacttagagcctcatcggttatctatatttcttaataaaccaaaaagactaattaaagaataaaagttaatttataaataaaacttttatatatctttaaaaaaattatgttgaaaatatcttaaaattaacttcaaaatcaagtttaaaaattcaaaatttaattttttttatttattagaccaatcgatggggctcttaatttgaaacaattttacaagtgaaaaggaaaatgcaaaaaaaaaaaaacctaacccaaacggtagaactcgagataaaacggtgacgaaaccgaattgtgcggtgcagtcacctcccccaccatcacaaaacggggagcggagaaaggtcacaggaatcccgggggacgcatctgggccgtacacgtggcacgcgggcccccgtgtgaacgcctggaaatttatccacgggccttatcccctcccacgccactgacgtgtcggcccgcctcctcccggccccactaaagtaacttatccctaccggtcgaacgtttgaaccgggcaggtaaggttttttttttcttttcttttaaccctttttggggtgtttttactgcgcggtaaaagtaggaagtggaaagcgaggagacgcgcccaacggctagaagtggtcgctggcgtgtactttgactgcgtggtggggccctgcggattcagtcagtcagtcagtgacagtgagtcagctgaatcagtcaatttctatagtactatatgtgtagaatctctctttggacccctggaactttttacaaattgcttcctcctgggtgtggactgtgagtttggaactgtacatcatatgaacaactctgtccagattaaaatcccttatattttagaacagatagatagagtatgagtcaactataaactcatgtggaagagagatgaaaaaccgaggagtattggctctcatgcaatagttatacacatgctccaatatatttacattataaattcatgatgagagaaagagagaggagagaaaaaaataaaaccaattttatagttaacttattatacatgttaactttaatatatgagctaataaccaattgtttgctatactattaaatctgctcttacggtggttctatgtcgtactaaaccatattttgggaattgaaaatggtcccccaaaatcactatttgctagtatcatttgtaaaatcctacaaaggagaaaaaaacatttagtgtgtgattaatatttggaaaaaagatgtctacggttttaatgtttgacttgtatattagttaaaacagctcaacatgttgtttgtccgaattttgaattttagaaactatataatggttttttatatttcagtctagattattgaacatctaaaaaatcaagggtataaaagtataaaaatcttgtctgaacatttccggtcatagaatatgtagccctagccaccccaatctctatatcttctctattattataaaaatcaaagatatttccgctgaaattttggtacgtcatccgtgtttgagttggtttttagtttcgtacgtcatttgtgtttgcgttgatttttagttggttcactacaagaaataaatatgaccttctgtgacgaattcctcgtgacgtcggagctattcgtcactagcacattccattttatgacgattaattagtatgagatgtggtcgcttagtgacgaaaaaaggatgttcgtcgttaatactacctagaaatcgtcataaagtatttcactgggacatcgtgacgaatattaatttgtcataaggggcacaaagcaaacgtcataaatttatataatgcatttatggaaaaatatattaaaagctaaagcaatttaatcaagtgaattaatgaggaaactaaatttttccttcaaaaatcatggccggaaatatttttttaatattctacgtggtctaaataattctctgaaattttctgtgaatttcggtgcttaataactatttttaattccacaaagtttatttaaccaattaaaataaatggaaaacaaattaaaattcttctctctgtccttgggcttttttcggcccaagtattactctctccctcccttagcccgcagcctctctctctcgtcctccctcttcgggctgccggcccagcccttttgttcctccttcaccaggaagtctaattttcctccctcttcttaattcaaataatttttcggatagtaaatgatttcaaatgaaaaaaaaataccaataacaaagttgtatattttaccaacaacaaagttacgtcgctcgtatccaattcgacatgagtttaaaataactattatacgccttcctcctagcgcaacctaacccaatcggccacaccatcctgtgcgcttccactcgaagctgcacgtacccctccccacgttttttttgctcttttttcccttttctcctttccttttgtcctggtctttctgaccctctcctctccttccaatttcctttatttttgcatccttttctgtttcgctattggtatctctactattataaaaattgaagatgtttcccctgatattttggtacgttgtccgtatttgaggtagttttaaagttcattcgctttttggaaatacaaaaggagtcgtataagaaatccttttaaaaatcctgcgtgctaagttaggacgagagtcggactcctaattgcttcagaattctcgccaggccataataaagcaatgtatatgatgtgaccgtcatctcaataaagattccgaattagatatcaatactatcaaaataaaaatcccatatactttttactttttagaaaaaaaatctaacaataatacggttaaaatagtcttcacccgttacaacgcacgggtatttttttagtataaataaatagataaaacaccctaattggaggcccaaacattttaatttaaagcccacgtcgatgtaaagatagacccaggtaagctcacagtgggccataaaggcccaaaatggccagcctacgaggacgccacaataaggaaaaagtacaccgaagatccctcaacttgtcatcgagttacaaaatcgtcccctaaccacaaagccgaatacaacgtatcccccaatttacaaaaccagtgtagattaggtccctcggtggttttgcactaggttttgtccaatgtggcggctgagtcagcgtgggacccacatgtcaggatgccacttcagcaggctggcctctccctccctctcctttcctctcttctctctctttctctctctcactcctctctggacttggcaggacggtcgacggtggggaggagccgaggaggtcgccggcgatgcggcggcggagacacgggagaatgggaggacggcggcaagccgaggcggcgtcggcgggcgagcgcggtggcggagagtaggcggtggcggctcccacgcgggaagccgaaggcgacggcgtgggcgagcatggaggcaaagtgaagaaagctcacctcctcttggatctaggcacgccgcctggcacctgcctcgcgaccgccagcttcgccttcgcaggagaggccgtcgtcggggctagcagattctcctacaccaccaccaccaccggtttctgctgctctggctgcggctgcgtcggcggcggcgtaggcgtcggtagagacgacgacgacgaagaagaaggaaaggcagcgcagaacgccttgagaagctcgtcggcgtaggagaatctgccagccccgcgtctctggactgggcagggctctacgagttcaggtccagcagctcgatgtatagctacaatgagaattgtactggagtatgagatagtcaatccgtgatgagataaatgatagctcactagtagctgcattcaatcacctccatcaacacctccacctcatagcattcgttcattagcagcattaacctgagaaatatgaataactgtcatcttcttcatcgtcatatccagatagttaagagttagagattattgctttaacaattttgcaaatatttctagaaagattgccaaatccacacgagcagcatcagattcgaaacgcaccatagccacgaacacaagcatcggcaaggatcgaggaagggaacgaattaacaaggaaggaaggacgtacgatggcgacagtggcgccgtcgacggaccagagggtgatgtcgcccttgtgcagcttgagtgcgcccgcgcccgcatccgccgacagccggaacgcctcgccgctgctgagcccaggtgccaccgccatggcgaacgatgccctcgtcgcgccgctgctcggtggccgccgccgccgctgcttggggaggagtgggagccgcgacggcgtcgttgccgccaccgcctctccgccaccgcgctcgcctgccgacgccgcctcgccctgctgctgccctcccattctcccgtgtctccgccgccgcatcgccggccgaccgtcggacctcctcacccggcgacctcctccccactgtcggcctccctgcccagtccagagaggagtgagagagagagaggaggaaaggataggaagggtgaggctagcctactgacgtggcatcctgacatgtggggttcatgtgggtctcacgctgaatcagccaccacgttggacaaaaccgagtgcaaaaccacgagggatctaatctacgctggttttgtaagttaggggatgcgttgtatccggttttacgtttaggggacgattctgtaactcgaaaacaagttgagggaccttaggtgtactttttccccacaataagtctcaatcccgttcttgggcctcacataagcgaaattccgttccggccgaaaattgttcaggccgcacgtaacttacaaggaataagttcatccgaggtcccttaacttgtcaacgaatccaatttttattcaaccggaaaaccagatacaacgggtcccttaactatcaaaaccagtgcagatgaggtcacttggcagttttgatggcggttttgactgacgtggcacctacgtggctaatgaggcagagcaggaggttgtcggcgagcgcgacagctccactccgtcggccgctccgccccgcccctccgccgcgatgctctctctcgagcgacgcgagcacaacagcgacggccgacggaggatggcggcggagggagatcatctatcaactccggcggagggagctcctcgcctggccgccgcgccgcaaccgaagcgccaccactctactgaggaggcagcagccatggcgcattggcgccagtgccacgaagcagacgctgcacgccgcgttgtcgtggtcgacttcgtcgtagtggcggaatatttgtgtcttggcgctgcgttcgggcgtcacgccggcaatggttgtgctgctgctgctggctcgcttgagggacgagacgagctacctcaacaagccgccaggatggagcctgaggaggaggttccccggtgcgttcacgggttcgggggcgactgcatccaacgcaccaacaaaacaccacacgaatgaacaaacccagtcaccaccaagcaacctaacacataaatacataatcaagagagtagagagagcacgtatggtgaattggtgactccggatctctcttccatcgccggcaggcacgcctgcgtgtatgcaccaacaaaaactaatccatagaacggattatgcaccattcctcaatagcgcaacaaaaactaatccgtcttccgccttgcgctcccccacgccacggccaccgtcgtgtcgtcgtcacgcggcggtggcggaggcgcgagcaggaggagggagtacgcgtgctcacccaccacgcacccgggcttcttccggtgcgcgctgcaatggagcggcgcgtcgccgtcgcgtccctcctcggccggcggagaggacagatgagaggggagagagatgaacacacggagttggggggagagaggaggaagatgatgagggtgagaatgacatgtggggcctacgtgggtctcaacatttttaatttatttttttgtgcaaactagcatgtggcccacaatttttaatatttttcaaatcaaattgccacgtaagcgccacgtcattgccatgtcatgtgaagaccgagtcaaatagccacgtaggcgccacgtcagtgaaaaccgccatccaaaccgctatgggacctatattgtatctgtttttggacccgttatatctgattttctggttgaaggatgaaaatcggattcgttgacaagttaagggacctcaaatgaacttattccaacttacaatatcatgggcctcacctaacaaagatgggccatgatccggcccaagtaaaatgggccgcacgcaagtcgaatcgctttccggcccatgaaacgggagagccgagagcccgagatgtatagctggtcacctctgcttcggtgcttcgtgcatgtttggtgagatcttttttctggatttctgtgtctttttgaaccagtggcgtgcagttccatgaacacctagtggaatttgatctctgaatcgatgtcttacatgcagagatggaaaggaagcttgttgtgagtgagcaagatcagaatcagaagcagaccccacgaaatctgcacttccatcaacaactgcctgatagctgaaaaggaagtgttctctctgtacttttttttttaaaaaaaaaatcttacctgcattttgggcaatgtcaactttacactggagtttatatgatactgttattatctgaaaagaaacatagtgaggtataattgactgtttacattctatttttttaccgaacaacacatcagagtatcagaccacacattgcttaagcatcagttctttgctcgctacctgcctccagcttcctctcaccactgcatctttgactccatccacaagtaaagcaaagaatctgagtttatatgtacatcctcagttacaaattgtttgtttctttgtgaccaaaattgaagctgcagcctgcatggtctcagtctaagagagcaaaataagggtgttaggaaagtctactggtgacaacctactcatggatcgatacaggtaatttaacaaggtcaagctgttagattttgagtaattattttcttcattctttttgtatcaacactggaagtttggaaccaacatatgcgaatgtgctactactttatatgtacaatttctgttttgtaccattatacgcaacatacactgagtatacttaactagttatccagccacatctcaagaaagaaaaaaaaagaatcattagtattttctgaagtctatagctgtagtgtttatcagtttgacagctatggaatgaatgggagatacaagtgttggtgctggtgagcttttccctgcaagtgttcctcctcttgctctcgggcatcaggaagcgtacaacctccaatgtcttgagcatattcatatggctcgcatatgtgtcggctgactccctcgccatcttcgtccttggccatcttgcgctccacatcaatggccggcgccatggtctggtgctcttctgggcgccgtttatgcttcttcaccttggtggccaggagacaatcacagccttctccatggaggacaacatgctgtggaagcgtcaccttctgaccctcgccacccaggtgggtttggccgcctatgtggttggcaagcagtggcagggagacaagcagctgctggctcccatggtgctcatattcatctcaggtaccatcaagtatgcttgcagaacatcggcactcatgtttactgctgaacaaacaacacctgggagtaatcttggcatgcaggcaaagggttggtcagctaattggaaacattattcgactaataattggatgatgaatgaggtgcacacttacaacgaacttttgtgggaagccaacgcaggctggaccttatacatggccttcctgatggatatgacaccgctgatatctaggcctgaaacctattcactgaaagggctcctgtcgaaggaacaccgagtctatgtctcttataagctagctgagctccagctctcgattgtgtatgactacttctacaccaagcttggagtgtattttgagcccgaggaacgactaaatggtcgcttcgcccagcttgctacattgggctccacctttgcagccttgtttctatttgccaggggtaatttcagctacgatagagccgatattgttgtgtcttacatattgctaagtggagctttcattctagagatactctctgtttttattgttgtctcatcattctgggcatacttcatggcaactgtatctgatttcctttgtactagatgtcatgatgtgatcttcagcatcgtcaagcttgtccatccagagagcaaaccacaatggtcccaaaagttggcacagtacaacctcatcatcggatgtataaagcagaagagagcagcagctggcagttgtttactgaaatgcatgaagcgtgtgatcggcatccagcccagcactatgactcatgtcgacatctctcatgagctgaagaagctcgtccttgataagctactacaggttggaagcagattgcatccagatgatgtgtggggacatcagcaaattcaccggccaatgggcaaagttggagctcatgaggagcaaactgcacattgaaagttcatcaagagctcggctgcaggtgctgatcagcgatagcattcagcgtgccggtttcatgtctgctgtccttgcttggcatattgcgacggacatatccttcttccatgaagatgagctaggctgcagctctccatccagaggtccaagcagagaactatctaaatatgtcatgtacctttctgcaaagcatggcatcctatctggcaatgatgggcacatgcggcttagaaatgctcaggaattcatcgttgaatgtctggaagaccgccaggaagctctagatcaagatgctgttgtcagaagtgtagctgcaaagatagataatctaactgaggatttcgagcacccaagaatactgacggcagttgagcctgtgttaatccaaagtggccaacttgccaaggagctgcttaagatgaaagaagcaaatgatcgatgggatatcatcatgaatgtttggatggagatgctttgctacatggcatttcactgcggacctggtttccacattaagcaggtaagcaagggtggagagttcatcagccatgcatgtgaaggttgtgatatataatctaggctttccatattcaacatattcacctgaaaccgaagaacccgctgcaggccattcttgacaagcttctcaatcgatgtttggctggggcatatattcctttcagaagccaatatcagtgctaccgttctactattatgtttgatctctctctctcaatgtatatatgctgaacaatataattcagagtgggatgtgaaactctgaagatatctgcagcaggacggagagcaagggtagaatggagtgaactgaaacaggagtttggtggggttcagacttcagaggggcacaacaagatctgtttgactgttttttgcaaagagaacacttcaaaaccatcaaagatcagtactagccagcagtatcctacactacatatactacctctgctccataggaccataataataagttcatttttggctcaaaaaaaatcatttttaaagtaacctttgtattgtagtttgtgaaagtagagaataattgtattggaagtagataaagtaagaaataattacatggggatttgataaagtagagatattttaatcttttaggttttgtatcagtatgtgtgggatgggtgaaagatgaacttattttggaatggaggtagtaatatacatgagctcatatttgaagatttgacattcgttaatttcaaccaacatgtaagctaagtagtaagtacgtctagattgctgtgatcagtgtagattctcggttcatctcacgtcttgtttgtgaggagtaacatattcctttttccccgaaaaataaaatgtagattctcggttgggtttgtccatcgttgcccatgagcacgattgtcgaaaccattaaacggtgttgatttttcatgaaaaaaatttatatatagaagttctcctacaaaaccaaataagtccaaacggaactggaagtaacacaaaagtaataccactgtattcatatttcaatggaaaaaaaacatattttacaaggcaaaaatattcccaaagttcaacatatacatatatagaagacctaataattgaaatacagtcacgcttcattagaagaaaactaattaaacagagaggatgtagatggagtgtattgtatccttgagcgaacttggatgagtgtatgcatcttggtcgtccttgtagacgaaatccagcacgcgtgtggcgttgacgacggcctccagcagcggcggcggttgagccgccgccggccggagacactccccggcgatgtccatccatgactcctccacgagctccctcagcttcgcgtaggcttcctccttcgtgatgccgccgtgctccctcatgcaggcttccaccgtcgacgacgacgacgacgaagacccttgctctctcttcaataataaggaaattaattggccgatccaagttagcgaacagattaattaagagaaatatttagcaactagttaactactccattcgtcctaaaatataacaacttagaatcggatgtgacattttctatttttcagattcatattactagaaaatgtcacatccgaacataagttcttatattttggggacaaaataagtaattaattagcagatgctatatagagcttgtttttttttattgattcaatcatgtctcttcggcttataagatgtaaaaaagtttcaaaaaagagaaatttacgatctttaagaaagtacctcgaggtacctaaatttacatcaaaatttccgataccttaaatattactcctttcgtcctaaaaaataacaacttttagctctcaagatttgtcccaaaatataacaacttctccatcaacattctcttcccaaccaatcacaactctccaccattcacttttcccacctaccttcactatttaatcaattacaaccctccaccattcacttctacttgctttcttaataaccgtgtctaactctaaaaatgcttatattttggaacggagggagtaagtatctagaggtaccaatacataaaaaatatgatacctcctggtaagatggtaaaattacccaaaaaaaacactcaaacatacctcatgtgaagctatgtcattgagtaatcggccaacgatgcaggaagatgtgatgatcttggggtaggccatgccccagttgatagcatcatcggttgtgacatcgtttcccatggcgacgaaggcgtagacagggacgtgcatgcagcagctgcttggcactgaaatcttgaggtgctcctccaccgtagcagctacctgatctgcaccttcagagcgccatttcacctcgttgtaaaagcatctcgtagcgtcgattaactgcaagattaaccaagcagttaaagttgtgatcaatgagatcagctgcctgcctgcctgcaggtagttgatgagactagctacttactaggtttttgacatagtcgacatgcttgttcccttggagtttaagatcagtttctatggatttcatggtggtcagtactttcttgtagaagaacttcatgtagcctggaagttcttcagcggcttcctcatcccatctattatatttttatggttcaatcattgataaaaattaaattcaagttaaagacaagaattttggctccatgcagcttctttgaaacaaattaagttcggaatgaatttcattattaaaagaagaaacttaatcaattgacctttcaattgcttctgtgaacagcttgctttcttccaaggtgctgtagttgtcgtagatgtcatcgaaaatcgagacaaagatgaacaatttagtgagcatggttctcccatatgagtactgaggctcgaagagaactccaagcatccaaaagtgcatctccaccatcctatctcgcgcaaagcttagatgatcctggagttggagctctttccaccaccttcaccacaccgaaataataaataaaaattcacattctaggtccagttcttgtatgtacatgcattaaattggacatctatatagatatataggtgaattttggtaactcccaataccttggcaaggacagtaaaattgagcctatgcatgttttgaattttagggttggttcaggtattatagctagcacgaaaagataataaggtattctcttgtggtgtagatgaagatgaagattaagtgttttacgtaaaataagatggtattaatgtataattaattgagttttaattattataaattttaaaaatagatttatctgatattttagaacaacttccatatagaaagttttcgcacgaaacatattgtttagtagtttgaaaagcatgtcaccaagatgataattttcatccaattcctatagcagaaacgataattggacctaatctagtgatttttagaacatacatggtgaggatattgagctcctcgcaatacagagattgcaaaatcccaaagtcgagcttggcgaactccaaaatggtctcatttcgtgtgggcaacttgtcgtaaactgagatgtagtgccttgcttcaactcttcttggcctcctgaaaagaggggtcctaagtgcactgcacacctcgtccgccattggcgactgcagatgttttaccacagactgcaaatagttcctagtgaagacgatagcatcgtcgagtatctcctccccatgaatcctgagatgggcagcattgtacaagctcagcatgcttcttgtgccgttattgttatcatcgcgtgtgaaatttccttcctcgtccctgaacctctggaacacatctacaacgaacatatttcattgcatatattcaattacctccgtttcaaattataagttattgtgtactttggtcaaaatcaaactgttccaaatgtaattgagtttgtaggaaaaagtagtaacatttttaacccaagacagatataatatgaaaatgtattcaattttagatctaatgaaactaatttggtattataaatagatattactatatttgactacaaacttggtcaaataaagagcaatttaagtttgaccaaactcaaaacgacttataatcttagttaactaagggagagtattagttcatgctaaaaatatggtatatcatcgtcaattacacacacacacccacctggagaggcatagtatccatgcttcctgagcagatagaaccggagagctgtagtgtggaggtcatagtgattgtcggtatcgtcttcttcctcatgaacccggcgcaacacattttcaatctccttctcgtagtggtagtcaatgcaaagacgttctaaggtgtcgacgagctcaagttttacgtgcaaattggggccagaagaacactcaagtatcatccttctcacttgttcctcggaaacatgagcttttctcttcatattcagaagctacatatacatatacatgcgaggacgattatgctacgaagtaattaattatttgttaggcatatttatatgtactatacgtactatatatctctaaatgaagaataatagatagataggaaaattgcatatgggtagtagtaaattatatataatttactgatttaattgtgctgttttaccattgatggagtgcagggtgagaaggtaagaaagtaatcgccccagacattaggatggtgatcaaagtggggtttacagtgcagcagatctcctccttctactggtgagactagcatatcggtgcaagtaggcacaggtagtagtagtacactcggaacagaggttgccatacttcaactccctcttgctctgcaagctctaggatgagttgttgctgagctacaaactaacttggtctttccctaacttacttggctgctatatatagagataggaatcttataaaccgacgtggcaccacaaataaagctccgttcggctagagaagcgtgccacatattcgtacaaaattacatatctaccatggattcgctaaaatgccattactcaatctacgctagaatgttatcctcgaccaatttacctctgaccttcttctttctccctcccacccctcattttccatcatcgtttagttcccacacaaaaattttacaccatattacattgaacgtttgaatacctgtatgaagtattgaatataagcttaaaaaataattaattgcacaaattgcgactaatttatgagataatttgacaatatagtgctacggtaaatatttgctaatgacggattaattaggcttaataaattcatctcactgtttattgagggattatgtaattagataccgacgtgacacgctaaaactttacatccctatacctaaccacccccttaatcccttaatcttcatgtttagaagattcgaacgggggatccagtcttcaacttggcacgcacacgtctcaatctgcctctccattaatagccaaacaagctgtgtggcttttctcttgcaacttgcagctgtgctgatgttgctgcattctggtgaactaggctaaaaggcattttgtggtcaggccctgtttagttttacggtgaaaagttttggcgtgtcacatcggatatacggacacacatttaaatattaaatatagtctaataacaaaataaattacatattccgtctgtaaattgcgagacgaatttattaagcctaattaatacttttatcaaatcatggcgcaattaggcttaaaagattcgtcttacaatttacacgcaatctgtgtaattagtttttttatttatatttaatactaaatacatgtgtccaaatattcgatgtgacatgatgaaaagtttttgcgtgaaaactaaacaggacctcatccacattgccatggatacatatcattcatgccatggctagctacctcttgataatagtagaattgtcacgccccgaactagtcccgaccggaactagcccgtgacgctccaatttaacctgttaatcgataccagtcccaggaaatagtgctggtatgacagggagacagaatatcacagcaacagaggtctctttattatagagtagaggtacagtcatgttgggctgcggacagatcccgagctcacaactgcattacagaagggaaacggaagccaggacttggaccaaacaacacaggcgcgacttgggaactaggccgaaaccctaaaactcatcatagccggcttgctcctggaagaactcctcatcagcaggatccgcttcatcttcttcagcaactgggggggggggatatttatatagagcaagggtgagtacgggagtactcagcaagccagggaaataagtgtttaatgtaggcttcaaggaaaggctgttgttttcgtaattgattttatttgaactcttttctaaaaacaactaagtgagtgcttctcaaacgacacggatgagacagtgcgtctcgtccggtcggagtatgtgcaatgtatcagtctttagaattgaaacaagattggcacccggccaacagcttttcaaacggccacccgggccaacaactttacaatcggccacccgggcctagctgatcccgtcagctgctgatttttcaaacatcgaaccccttttcacaacagcaatttcacaagcagtagtcaaacaaaactacgctaggaatcacctcacatccgcccatgaccgtgggcacggctgctcgaacagtttgttaacctctgcagagggggtacactttacccacacaacattactaacccggatcacccagcccgtggggatcagccacgtcgggagacctccaagctttcatgacaaggcatttccaaagccaacacaggtttaccatatgccgacgagaggggtcccagaccaacaacaggttaggtcccagaccatactgtgccaggaagcccaggggtcctccccgacaccaccccggcgaatccacatgtctctcggcatcaaggcccccctgataagctagttactcagccaggggtgtcccattccacccatgtggtcatacttgtcttatgttcggatgaaattccaaggaaacggtccttaagtgcgagagcgggaaaaccgtacacccggtacgttccccggtccgcggttttggaaattcatttagttcgcaagcactgacccaggtgtcgggttttccaagtcttttgtaaaacccaagttttacccaagttgttactcagattttaagtttgaaggcgaccgtcggtactcgcacagagtgcacgattcccgaggcgcaactgggtggttacaagggaacatggtataacaattaacaaaggaaggatcatatgcaacaaactaggtaggtccgccaatttgccttgcagacgggacaaacagattaagtgcgatcctatcaatgcataatatttttcaagcaacttaattaaatttcaaatataggctcaagatgttcaaaggtggcttgccttgctcgagatctggagcttgatcctcgaaatcctcgcgctgcgggtcttcgggctccgaaactacacgcgaaacgggacaactcaacaaacggcgaaaaaataaagccctattaatgtcctctaagcatgccattagatagatctcgagatttgaggaattttggaagttgaacggagtcaaacggatttacggttgggaagatattgaatttctaagattattggatttttggtctaaaggaaaaggatttaattaaatccttttggaaaagaaaagaattgaaaagaaaagagggagggattatagacttttcctcgggcggctaaggcgcggcccaagggaaatggggtggctcggccgagcttaacgggccggccggcccaagaaggccccatacgcgcgcgcgcgcggagggaggagagagagtccggtggaccgggctcaccacgcgcggtcccgggtgggacccgcttgtcagcggctcggctcaccgtgcggagggagtacgcggcttatgcgcgcgggcgggggagggatgcggtgcacgagcgcggctcgcagtggacgcggatgcggcgggcccacgcgcagcctcacggctcacggtggaacgcgcgcacggggagggactgaccggggtcggctcgaccctggtctaggctgagctggcgccgacgtggcgcctacgtggcggccacgtgggctggcgggagttagacgacaacccggccgcgaatggacggcgggcggcggcggcgagcggcggagcgaaccacggcgatacgggcaaaagcgagcacaccgggcggttgttcgtgatgaggggagacgagccaacggctcggattcgccggagggagcttgacggcggcgaatcgcggcggcgacaaccggcggggagggaagagggaaacggcgacgaggccacgaggggtcgattcccggcggttagagcatctacgcggcttcgggaactcgacgctagcgtcggattggacggagctacgccgagcgaggctggcgacgtgcgggtgctacggagctcgagcggcgacggcagcgagcacacagcgagcgacggcaacggtcggggcggcgccggctaactacggggaggctactcgagctactaccgaaatctaaggggggaagatgaagcgaggaggaagaacggagggaggcactaccgtgatgaggaggggcgttgtgacaagaggccgacggcgcgggagtaatctctccggcctcgggccggggaagaggaagaagagggcgcggccgaagtccccttccgcgtcctcgaacgcaccggctctcccggcgctcggcgaaggacggcggaggcgagactgagcacgggggcggcggcaatggcgcggagacgaatgggagaggaagggaaaggggaggctggggtttaaatgggcggcaatgtcggtttgggaaccgacttgcgcggtcaaggtcgcgagctggcgctcggcggtcgcggccaaagcggcgacagggaggatgacgccggcgaggaggaaaaggggaaaaggagggggagaaaggggggcttgcccctttgccgattcgggataaaggaggaggggagcgggggcgatgcggcatagagaggaggggcgctgcctccgtcccttggcggcttgcgcgcggagtggcgggggctgggcggtgacgaccgcgatgacggcgggcggtttggagcggcgcgacgacacgggcgacagacgctgacgacggcggcgaccaggcggtcggccaccacggcacgtgcgcgcggcttgcaacgggaggcgcggcggatggagcggcgcggctcggcacgcgcgctggctgcggggccgagcggctgcaggcgcggcagggcagcggggccgggcggcgcaaacgcgacgcgggcgaggaccacgcggacgcgcgcgcgatcaacgcgcggggagcggcagtgagggagcggaaaggagggcttggct

SEQ ID NO: 58065 - DNA, 39056 bp, Oryza sativa
aatgtgatttctttctcacttttttttttgttctgttcgaggagatccagtaccatgccgtatttttttgttacaacacgtcccgcgaccaggtagatgagttaggaccacttttgttgttattacagtatgtgctatgaccattttagatgagttaggaccactttatgttctaggaggtccggggtccagtaccatgccgtccatatatagcgcatttgagttgcacatctccagcaaccaactccctcccaaccgatcgatctctctcttctacttcatccaggtccaaggagcggctcaatcagtcgagagattaaatggcggcacagtatgaggtgagtgacgcattaggcgcgctcggcgtcgccgccatctccacggccaccactttggccaccgcagcgttccagccgccgccggcgccgggcggcctccgcaccaccaccacctacaaccacctcgccgtcgccgggctcgcagggaccttccttggcggggtggtcctggtcggcgcttcagtctgggtgtccgacaacccagctgcccgccgtggcaccggcaagaagctcctctacgccgccgtcccgatgctcctcgccgcggtcgttctatcggtggcggcgctgctctggtaagcctctcaaattaacgctcatgtacaagcccctgtccgaccgcattactatccgccatgatcggagccaagccggccgtccctagcgttctccttatgtcaatcaaatgtaaccttaattcttcatattgtttgttttattggtcgatcgctgcgtcgtggttgtgtctcgtggagctgtagtatcatcatgtaatagtgtttgcttcttattctagtccattgtgtgtatcacctatgtatgatcacgtctccttctgttcttggtctgtcaaagtgttattcgattgatggccggcttaatcgacgagtgttttgttaattatgagttcatataatctcggcgtggaaatctcggcgtgggctgagagacttaagttagatgacagacatgtaatctcggcgtggaaatctctcttctccttttctatccgctccctcgatatataattggactctctgtactttctttgctattaatggattcaggtggggaagctctcccccccgggtgaattttcaaaaaaattatgagttcatatctcccaatttgaagtatggtgattcaaaggggagctatgcagtactagtttttggcttaattacatttagggaagagtggatttggagtactccatgcatatcggcgccgctcgccgtcgccgccgacgctgaatagttctggaagtttgccttgtcggccgtcgtgtccttctggtgctaaaagcccatctttttctccttttttttttcttttcctttttttttggggggcaactgttagaagagagggaagggtgggccatattaagtggggcccacatgccgtatcatatccatgacctttgtccttgcgttgccggcggcggcggcggcggcctacggccatggagatctcacgcgaccatttgccggtgaggtcggctgctccgcctccgcctccgcatctacgcctgattgatccccacccctctctccactgactgtgctatcgcgtttccggcggtggttgatcgaggcggtagcccgtgcggcgcgcgagattccgcccgtccacggatttccggtcgccatcgccggggttcgtcttctccggccagcccctcgccgcgcgaacctgcgccgcccgtcctcggccaggatctggtcggggatcgcttgtggtaggtgttagggggcacttgggtttggaggacagcatcgttgatgtgctttgactttgagttccttgctaatttagttatgctgattgttcccataatccctaaaatctcagcagttgcgttgcgtggtaggttatgtaaagcgcattcctgtgatgaaaaatagaccctgggagacatattatcaattgtatcaagcgatccaacacactaggtccccaaatattgtcgtagataccattttctcttcagtatgctgcttaaaatgcaaattgtaagcttttctctgtgctgtccagttacgtctagtaattccttatgtttaaagactgatattggtctttggttgtgtgtgatgtgcttcttgttaatcgcaatacttgatctttactatcggtgcatatttagtcccaatatgcccttttagttaagttgctgaaacattgagcatcttgtcatgttgatcttcttgtgagtggttcaagatgatttgttctgttttaatggaagtaaaaaacgagggctgtcccctcctaatgggaagagaaaaagagatgtattccagcaaccatgtgttatagtacaatccaattagttcgctaagctattatggcctttatatcctgctctgagtatttatttgatttgctgtaaagttattaaatttatggcattgttatacgtgatttgtacttgattatatgctgctattggtgattcatgtaattagagctgaatgggatttttgctagatacacattgcttctttcaacaacccttatgcgaacaaaattaatgggctggtttctcttctgtgctgatttccattgttccatagctgaagcttaagtaattgcaaaatttgtaggaactcatctgttcttttgctgaaccaatagacttttgtaaatacatttgcacaagacattgaggtcaactaaaattcttctatgcccaatggtgcagccatatttcatacatgaatatggctatcgctttgcctgataggttatggactgtgaactctgtgtttattttgatgtgaaaatggcctcaggggaacgcaggataactcatacatgtcaatccatacactaggtcctgagatattttcttaatgcccttttctcttttcactatactctacttgttaaacttctaagaaaagtcttatccctctactgttctattatatctataattcctttgttttgatgtcaaaagcagtgtattcagctgtatattttgttgtgatatgctctggttgatagtagttagtgtccgtgttttgacttgttgctgaacccttgagagcatctcgtaatgtttaactcttatgaattgctcgagatgaccttttttgtcttgatgaatagtggcatggcaacccaaggcaagagcactagggcctagaggtattcctagaaacttaggagcaaacggagaaagacgtagcaggaccagagcagaggacatttggcacctttgaaacaccataaatcatctcgtaaaatatattcaactttaaaatttgtactatgtaataggtggttaaattctgttcttctgagtgatggaattgcatattgtaaatcaatctctacttgtacaaaagatgagtaaatcttttgcttattcttatctacttttttttgtcaaaatgaataggaatatcaggtgcctttaaagtgcaagtataatggaaagagttggtaaattttaatatacttctgaaagaatcatcatccttgtgccattatctttttcatgtattgaacaacagatttgcacatgtatttttgccatctctaacagctctttattaacggatagtatatggctcttcttttatgtagggggatgttgagttgtaagaagaccagatgcatcagctctgatttagtgattttagaggcatgtataacctgtcaaagagcagcaaaagaaatgcgtcatagctgtgtgatacataactttgccaggagatctctctatttaagcacacagactgctatggcattgttaaacatttgctcagtttctcttaaatgcatttctgctggcataagatggtagcatggtggaggttctgttgttaaaccctggtatcaggacttgatcaagcagtttggtacgttcggtgaaaattcatgcacatttgagcgatcgtacagtagtctgaagttggtgttttctatcctccggtaattatggatcactggtataacgaggaatcaacctaacgtataattgccatggtctgtatttttgtatatgtggagactggtgtgtgtactaattttctggaatgtcatgtaatcagaagagttgtttagaagaggcataggcaaattctcttgtaaggcttttgtagttccttgatagtttaacatggttataacagtagtgttttctatgacgacatttatgattaaactgtgtctacaattcctgtcttttgtgcagaaaaaaaaaaagcactgataaaacaccctagagttgaatgcattgcgctgttgcgactgattctgaaagcttggcagcaagggcaatgttcagcatttttttcctgcagctgtgaattttgctactcttgttaaacccagggttcgaaactccccgcccccccccccccccaaccgaaatgctcacatatcgcccaaaattttggttttttgcttttttttttccgaatttggtcaaatttattcaaaatcagtcaaaaattcaaaaaaaattgtacgaaaaaaataaaaaaaaactcagaaatttcggttctatcacccacctgcggcagaaattttagtttcaaaattaaaaaccttggaacttaaacctgtgcccgggtgtgcaaacctgacagccattatggttgtgataactgataggtgctatgcctatagtttttcaggtgagctggtgatggtatgtttggtttagagctgattctgtggtggagacgcaaattaaaccgagatactaagggaatcgagacacaggagtctcaaatggcccaattttttcaatactcttctcactaaacaaatacgagtacctctcaaaaagagaagaacaaatacgagtactttatacaaaaatgaaatagggactaaatgatgattctttgtcaacccatttgtgctgatgacctgcatctttgatgtgatgtttctaatgtttctttaccaattaattttacacaaaacacattgtttaggagcttggaacttggaaaccatgcccgcgacaatccagaatcctgaattagaaaagaaattaattacaggcccttcgttgtggcaatcacaggaaccaggagtactactgcatactttaacgacccgcctaatttattaaacatcacagggacatgaatacatgaaaaaacagtagattacacgaaaccaccatggatcatacacaaagaacattagattagatattatagtattaaacatcaccatcataatcacagcagtaacgacacataccacgaatagagggagggacataaatggagggtgacgtcaccgacgctttggcagtgtttggcaaatgtctaagggaaataatttcccacccatttttaaatcctaaccattcattatccatcatccatttaatcttaacccttcgtcaaagttcagaacggagaacttccatgaaattatttgcgcgcatcccgcgtacacacaggaagctggaagccgcagggggcgcgcatcgcacaatatatatacttccacgttcatagttgggaactcggaagctagcccaccccgtcccgtccctgattcaccgcagatccctctaattcatagctagatccattaaggagaggatcgaatcattgatcagctaggaaccggtcgggagattgtccattttggggagggattagcgaaagagatggcgccacagcttccggcgggtgctgatcgccgggaaccggaggccacgttgggggcagtcggcatcgccaccgtctccgcggccaccgccgctctggccgcagcgctcgagccgccgccgggtagcctcgtcgccgacaccttctaccgcctcacgctcaccggggccttccttggcggggtcgccctggtcggcgcttcaatctgggtggccgacaacccggccgcccgccgtgccgccggcaagaagctgctatacaccgccgtcccgccgctcctcgccgccgtcgggatatcggtggcggcgctgctgtggtaagtccgtcaaatgttcatgcacaagcccctgtccgaccgcatcaccgtccgctggcgtcgatctctagcttgttgctcgtgtttgtgtccctggaaattgtgtgcactactacttcttgtagagtttgtgtgtatcacccaggctttgaaggtatcaccttacgtatgatcatatcagtgtctgagtgtctcgttctgtatgttttgtttggctgtcgtgtttgttcgattaatggccggttggtttaatataaaagagatccacaaaagtttttccacttcaaatattcccagttaaaagccttgtgcgctgtaatggcgggcggtcgccaaggaaaaaaccagcaggttaatttgttgtaattttcagagtgaggacgtcgtaggaaccctgggtatgtccctggtgccttgccacatcagcgccacataggatcatagagggaatgtgtcaatttgggacctagatgatacattttgacaagttctggaacctggatatgcattttgagagtttatgaatttatatgacacaacctacaagtttaagtaccgccaatgcactttactttttttttttgtttttttggggggtgattttctctctcaatgctgaactgctacatgggccatagaagtggggcccaaatgccgcatgatatcctttgaccttgcgttgccggcggcggttattacggccatggagatctcgcgcggccatttgccggtgaggtcggctgcttcgccggcgcctccgcctccgcatctacgcctggttgatcccccaacgctatctccactgtgctatcgcgtttccggcggtggttgatcgaggcggtagcccgtgcggcgcgcgagattccgctcgtccatggatttccggtcgccgtcgccgggattcgtcttctccggccagcccctcgccgcgcgaacctgcgccgcccgtcctcggcaaggatctgatcgggatcgcttgtggtaggttttgggggcacttgggtttggaggacagaatcgttgatgtgtttttgagttactgctaattgagttatgctgattccgtcagtatccacatcttcagttgctattcccataaaatcctacattgcctgccgatgcttttcgagcccgcagattatactagacttgtttggtagcacgctatgtacttcacaagtgcgcattccggtcatgaaaactgcactcagggagacatataatcatttgtatcgcacattaggtcccttgatattgtctttgataccttgtcaaaatgctgagagtaagtttttctctgtgctgtcagttacatataatcccttatgtttagactaaaaaagaaaaggtatagactgatattggtatttggcagtatgtgatgtgcttcttgttcatcgcaccagttgatctttacgatcggtgcatatttagttccaagatgtctttttagttaaattgccgaaccattgagcatcttgttatgttgagtggttcaagatgatttgttctcttttaatgtataagtgaaaaaaaaggggtttaatgtaaagaaaaaagagatgcatttcagcaagcttgtgccacagtacaatccaattagttcgctaaggtaagctattgtttatggctgttatatcctgttatgagtatttgtttgatttgctataacgttattaaatttctggcattgtcatacatgatttgtgttctgttacatgctgctattggcaattcatgtaactagagctgaatgggagttgtgctagaaacacattgcttctttcaacaacccttatgcaaacaaaattgaaatgatggtttctctgctgtgctaatttccattgttccataactgaaacttaagtaattgcaaaaaaaattttggaactcatctattctcttactcttataataagtctgggttttgtaggtagctacgctcatgctatgtgcttgcgctctgtctatctgaaccaatagacttttgaaaatccatttttacaagacattgagatcaactaaaattctatacccaatgatgcagcactgcagccatatttcgtacatgaatatggttatctgtttgcctgataggtttatgaaatgtgaactgtatgtgtttattttgatgtgaaatggcctcggggcaacacgtgataactcatacatgtcaatccacacactatactctaattgttaaacttctaagaataggcttatctccctactgttgtattacatctataattgtttttgttttgatgtaaaaaagctgtgtattcagctgtatattttgttgtgatatgctgtggttgatagtagttagtgtccacgttttgacttattgctgaacgcttgagaacatctcgtaatgttgaattgttcaagatgacctttttttgtctcgatgaatagcggcatggcaacccaaggccaggaactagggcctagaggcattcctacaaacttaggactttaggagcaaacaaagaaatagcagaaccagagcagaggaggtgttaggagaaatataaagggcatttggtaccttcgaaataccataatgcgtctcggaaaaaacattcaacttttaaaatttgtactgtgtaataggtggtaatgctgttcttctgagtgatggaagtgcagattataaatcattctctacttgtacaaaagacaagcaaatcttttgcttgttctcgtctctttttttttggtcaaaatgaataggaatagcaggtgcctttaaagtgtaagtataacagaaagagttggtaaattttaacatacttcttaaagaatcatcatccttgtgcctatctgtttcatgtactgaacaacagatttttaattgtgtatttttaccatcaggaacagttctttattaacggatagtatgtggttctgcttttccatagggggaacgttgacttgtaagaagaccagagccatctgttctgatttgagaggcctgtatattaacctgtcaaagactcaaagagcagcgaaggaaatgtttcatagccttgttagacataactttgccaggagatctgtctgttttgatgcccacaggctgttatgggggttgctagtcacttgctcttacatgcccttctgctggcataagatgatagtctggtgtaggttctgttgttgaaccctggaagtctggaacacaaccggtgctcagaagactttcatatcactgcagcctaccaggatttgatagagcaatttgatatgtttggtgaaaattcatacacatttgagttattgtacaatactcagaaattggtgttttctatcctctggtaattgtggatcactggcatattgaagaatcaaacctgacatataattgccagggtctgtaatttttatacatgtggagattggtgtgcataccaaatgttctgcatcatgtaatcagaagagttgtttaggagaggcataggcaaattcccttgtaaggcttttgtagttccttgagtgaacgtagttataacagttctgttttctacgacaaaatttgtgattaaggttcacaatttgtgttggttgggcagaaaacaatgagctgatagaacatcctagaattaggccttgtttagatactaattttttttttgccataaacgtcacattaaatatttggacacatgcatggggcattaaatgttggaaaaaaccaattgcacagtttgcatgtaaattgcgagacgaatcttttgagcttaattacgccatgatttgacaatgtgatgctacaataaacatttgttaatgatgaattaattaggcttaataaattcgtctcacagtttacatgcagaatctgtaatttttttttgttattagtctacgtttaatacttcaaatttgtgtccgtatataaaaaactttacacccaacgtactaaacacacccttagtgcattttgtgctggtgtgaccgattctgaaagcttggcagcaaagagttgtgaaatttgttaatcatgtcaacttgtgctcggggtgtgcaaacctgacaagcattatgcttgtgataaccgataagtaatgtaggagtagttttttgtggtgagttgttggtggtggtattaaaagtcattgaaccgacataacaaggggcattgggacacatgagtatcaaatggtccaatttggccttattctatactcttctcactaaacaaacgcgagtactgtatacaaaatgaactaggaataaaaattgatgttttacttattttgtcaacccatatttgtgctctgctagctgacctgggtgtgaaattgaagcttgtttgacaacgaccattattctgatcgatctctttgtgatggggtaacattgatgtgatgctttctaatgtccctttaccaatcgtgatagcgctctcaacagtatgcaacagtattcctgaagtttttcgccaatcaggtggtgatgaccttgatctggtgtcccttgcaggcttgcattgtgttggtctaacaatccatttggaccatttgtcgtatccaaaggctcgtaagtttgtcaactcggctttgtatatctttatgcatgagatgtgtttccaggcgtgcatttgcattgtacttgatgtaatagatctcccggcctgatttatatttgtttacgtactactgatgcactctcgcacaggtagttgcgatgtcgtatgatgagagaagcagatctacgtgatgtttgccatttagtccttttaaagaacatattttataaacagattgcgagaaaacttgttgcgtatatgcaccctatatcggcgccaaatacaatcgcgctgaacctaaccatcaatcattttagtgtcgacctctctgacataagaaaatctcattttccattcaaatactattaatttgctatcaaatttggaaactaacaaatcgtcctaattggtttctgatagttcattttttatcgagtggttggttaaatgtgtgtgattgctgggaggcttagcatttatcttgtgacatagagatattatgggtcagctaagtttttttcaagaattagacagtataacgcagacacttataacgcacgcgcactcactcctatgaatacacgcacgcaaaccctacccctatgagtatcttcgaagactgggccgctgtcgacgggtacgtcgcttaccactgaaagcacaacgctgttaaatcctgaaaaattcgctctcatgggtagtcgaatctaagaccttaagtgctactgaggctcttgtaaccattaggctacagactcttttgctatgggtcagctaagtttaaccacatttaaggaaggtttttgcgttggtactatttgcatgtagattgagaggtgaagacctgtgcagttggttgccggcaaaaatttgctgccgttggggagcttttggggctgatgatcatatacgtgcgtgctgctgcttgacttttcccttattcgcttgcgtgcgccatattagcatggcatttttttccctaatctacttgacttctcccttaatcgcttgcgtgcgcgagagccgtattagcatggcattggtgtgcggctgcgtgaaggatatgcagttgtggcgtcggtttgtaaacgatgcgatatgattagcgtgtgcagctgctaggaagatatgcggcctcatctcttgtttacgtatgcttatacttatcagccaaaatttaaatttttaaccttcaatttgaagctgattttaatgtttttttatcaaaatttatttatcaacatttgcttttagatcactaagaacacgtatataaaagttttattcacaaaattatttttcatttgtgaatatgccgaataagccaaacactagagccgatagattttccatcttaacagtttgtttcctttttgtttgaaccttgctatttttgtgttggaccgatgaccatgctacctgcgtatatatgcgggtgtacggttaattgaaaagcctcgaacaatttatggatatactatttctctcgttctttactttttcgttattttctattttactttcatggatgagttctagtaaccctagaatttggttaatatttgccgttttgtgctgaaaaatggtcgtgcttttccataaaagagacgaggttatcctttgctagtttgctcggaaattagtagttcgtcgtcacataagtacgatatttaccttctttgctaatttgctcttaaattagccgtgtgattatacgaaagtgaattaatctcaaaatcggtttagtcggctagttttgatctatcgattttgacgactccgtcgattaaatcacaaatcgttaggtgatcttgtgttggccataaaaaaagtgtcaacaatttctatctctactacttaaaaagtaggttcaaaacataaatctctatctctactacttaaaaagtagatctataatttctaaatcttaaaaagtaaatctctatctctactacttagaaagtggcgaaaaaaacgtagatccaattcccccttaaaatggggaaaaaatctgagaaaaaatagcgaagaaaacaacaaaaataaaagaggtctgtgtcgacgtttgatgtcgcgattccggtatttacatggtatggggatcgttggtattaggatatatgcgagattgaggtaaaagagatggagacgatgatttttatacaggttcggacccctgaattgtcaggtaataaccctactcctattggttgaagtcggtcgttactcttattcaccataatcacaccagtaccatatttggggtagcctatctaactgttgtcaacttggcggtttgaagttctgactcgtagtcgacaatagggtagccttcctcctcgaatctgcatccggcgagatcaaagacagtgctgtctctcctgacaatatccgtagataccgtgggggactagtcatgcttatctctgaagtcgatatccggcgtcttatcttggcacatgttggcttgtatgttgatcttgtgtcttgatctattgttctgtgtcccctctcctcctagagggccttgtatttatacccataggtgtcctattgtccaagtagaactagggaaaccaatatgaatataatccaagtagtccttgtcgtttccatgtataactctattcatcattccttatgcggaactcctcctatattcgaaggttgtttccgtataagacatggtatgtggtgggtcctgccgagatttagtcaactactattaggtatgtggtatccataaccctgacagtctgtttcacctaagtggcgaaaaatatccgtagatccgaactggaaaaaatccgattcctaaagaaggcgaaaaacaaaaaaaagtggcaagaaaaaggctagatcggattcctttaaaaagagggaaaatattcctataaaggcaaaaaaaacccaaaaaaaaataaaaaaagtccgtccgattccctaagaaagtagagaaaaaagttcgtataaaataaaaaaaacgcgtgagaaaaaaaaataaaaagacgggaaaaaagtccaatttgtattcatttccgtatgtatctcttctctatctttaatctaacctaactatttaaaaggagaagtttttatcgtacaactaaaaacaaaaagtgcacgagagaataaaaacgcgtgagaaaaaagttagaaaaaaggaaaaaaaacacgctataaaaggtttcccatctttcgtaaaaaataaaaaaacatgcgagaaaaaatatttccatcgtccgtaaatttttttaaaaaaaacatgcgaggaaaaaattatcagaaaaaaatgcgccatttctaaaaaatggtttgaaaaaactgcgcaagaaaaaacaccgtctatatataaaaaaacaagctgctttggaaaaactgtcagaaaaatgctaaattcatgtacgcttgagttggataggatccattgattttttttccatctactacaccattcataaaaaacaacccgctctggaaaaactatcagaaaaaacaccgtttataaaaaacgagtaaaaaaaacaattggattcaacacgagaaaaaaatcgctatttctaaaaacagttcgagaaaaccgtctaacttaacatgagaaaaaaaactatcatttctaaaaaaaaattagagaaaatcatccaactcaacacgagaaaaaaaactagcgattatagtaggcaccgccccgaaaacccgcatgactcacgggagataagactgatggacgcatgggttggataggatccatcaattttttttccatttcctacacaacttttgttttctcatctattctcatgtattggagaccctgcacgtctctgtatgcaattgttagactatttttgttaagtataactactattcttaataacatatgatatagaaataatattaaaaaataaacatattttaattgctatttagagaagagtgcacagtaactctattttgtgttgacttgaccatgcaaggcagtgtatgatttgattgattctattattggttgcaagaatgagattgaaagagtatttttagattatagatgtatgttctcgcatgattaatctaattattttaagtaaagcacgcatcagtcaggttgccaccgtcgatgttttttttagagaagggtattttttacccggcctctaccaagcagatcgaaaatgttttaccaattaattaatgtccaccgtcgatgttggaccattacattgaagatgtttcaattttttgattgtattaattacaaacgatccatacaaacattgtcattgatatggttatgcatgaaaaatatatattttgattagaattttttcacccgtcacaacacatggttattttttatagtgtaagttataagtataagacttccggtgaaaatttggttccatcacgagtccatcaggagaattaattgtcgattttgctatatatttgtcgataaattttttctcaaaaatttgacacatgtaattacagtacaatcgtagtgtaattacactgtaacttgcatgtaattacactataactatagtgtaacttgtatgtaactttcaaaaatctctccgtaacatgttatttcggtaaaatttaggtcatgggaacaaattctttcacatatgtgtgtgctatgatttgtttttttcctcaccaaaacaaatcttgtaatagatctaacgattcaaaattatgtgaaacttacatataagttacagtgtagttacatgcaagttacagtgtaattacatataagttacagtgtaattacattacgattgtactataattacatctgtcaaatttttgaggaaaaatttgttgacaaatgtataggtagtcccttaattgttcggccttgacccaaactctctctgaatcaatctatcggcatttatgaattgggatgttctcattatgggctggctaggcctgttttgtaccgtgctattacactatatttcctatttctgagccccaatatgtgattataatacttaatcttccaggcctaaggttgattgggtaattattatttcataacctaattttggttcgatgtatccatataggggcatattcaaggccctggtatagcagagactattagtatcttataaacagttaagacgataaaagacttaaatatataattaacatgaaggttaaatggcagtcgaacgatttttgatatctaaattatttgtgtttcaatatattcagaattattgttttatacgttgtagcaaaatatttcatgaggtgatttaattgtgtttcagttatttagaagattgaaactttttcgatctacttggtgaaatattttcgatccacttagcgaaacagcgcttgattggcatcaaaatgtgcatgatggaagcttaaaaaatcatgcgaatcacatatagactttttctcgatgtacttggatttgtttcatgtttcaatattttcggaaccgttatttcatacattgttacaaaatgtttcatggggtgacttgattgtgttctagctttttttaaaatattggaacattttcgatctacttggtaaaacatttccgatctacttggtgaaacactgcatgatggaagcataaaaaatcatgtgaatcccattttgatagccccattaattaatacagtaaaacaatatttttgttatttttctttccttttcttcattcttatacaacgaaaattccttttataaccgctaagagtcaatgttaagatgttgtcatgcgtaacaacatgttgtttctctgtttaccctctttcgtagtaaatgttagcaaagttaccttgttaacaactctaacaatatgttattaattgatattatacatgtcctaactcctaagtctatgtattgatcgggttaattaacctgctgttatggtaatcaagcatcccatacatacttaggtggtgtttgaatcttctgaagatgaagatgaagattaagtgtttcacgtaaaacgaagtggtaataatatataattaattaagttttaattattacaaacttgaaaaatagattaatctgatattttagaacaactttcatatagaaagttttcgcacgaaacacaccgtttaacagtttgaaaaacgtgccattttaatccaaaattttatccacccttttaagtagattcaaacagggccttaaaagaaataacaggaaattattcatatcacgtttcttcttttcttttccaccaagtatgatggatcccccacgagtcatggatttcacctgttgcaatgcacgggcatatttttctagtgatatataaaaatgcttgttaaattaaattgataaaaggctgtaagcattcttttaaaacggaacccaaacatttatagagtaataggcacggccaggctcgcaagaggtcaaattgtaggcgtcctttagaaatagttgaaattcggaattagaaaataaagaatattagaagaggagactagagtccatataaaaatacaattaggaaataattgaaattcggaattaaaaataaggaatattagaagtagagtatagagtccatatagaaatactattaggaaataatagaaattcggaattaaaaataaggaatattagaaatagagtatagagtccgtatagaaatacaattaagaaaaaaaaaagaaattcagaattaaaaaaataaggaatattagatgtagagtatagagtccatactaaaattcggaataaacataataaaattaaaagtagtgtttagagtccgtataaaaatacaatttacaaataactaatattcaaaattaagaaaaacatgggaagaagagtttaaagtcaatataggaatacaatttagaagtaactgaaatttgaaattaaaaattaaagaatattgaaagatgagtttagagtccacatagaaatacaattagaaataataaaaattcagaattaaaaaaagaaatattaaaagatgagtcgaatatatataatttataaataactaaaatttgataataaaaataattaataactaacacgtatataaaatacaatatgaatattgcacattagtagtttcgtaaagttattgcaaaatttaaaattatgttatcattttaatatatttgaataatataatgagaaaacatatatgctattatatgagagaaaatataatgttgctagctgcgcaatttgcgcgggccaccatgctagttttaaaggatggaatttctaaggattatatttttaatatgattagctattaacttattaaagtaacagaaaaatgatcatccatgttcgttctcagagcctagaaattctcgtattaatcggagaaaaagaaaaaagaaagtttatatatatggtaataaaatttaaaaataactaaaattcataattaaaaataaggattattaggagaagagagtctagaggccatataacaatacaatttagaaataactgaaattcagaattaaaaaaatacagaaaaattaaaaatagtttagagtccatataacaagtaaattcaaaattttaaaaaataaataatattggaagagaagtatagagttcatatagcaacataatttatgaataattaaaaaatcagaattaaaaaaataaagaacatttgaagagaagtatatatagagttcatatagaaatacaatttaaaaataagtgaaattcgaaattgaaaaataaaaatattgaaagaaggatttagagtctatatatgaacaaaatttataaataacggaaatttggaactaaaggtaaggaaatttggaatcaagatcgcatgcaccatccgaatgacggatgacaaggtcagcgagatcgaatggagcccgtattgtcagccagtcaaaccccacactttgttcattgacagttcgacactcgaccttgttgcttgtgcaacttcggagtgttctacccgagattttcttcttcttctttttgcgatagttctacccgagattttcgtgaaaattaaacgaccctcacccacgggctatagtcgctttcaagttcgtaaggtgcgggtgcgggccgcattcccgtcgaatttgtgttttttgggtggagaacggatccatacaggccaagttccggatgaatataggggctgtttggtaaacgtcctgaggcttgtatgccgcgtggacagctcagccagtagtctaccgcatttttcaagtcgctttcacgccggtgggccacaacacccaacaccgtttgcctatatatactctcatttttatctctctaccatctctgtccaaccttctaattccctagtcggttttgatcgatctattatattattaaaggaatagaaaaaagagcctccacgttcgctctcatgggctagaattctcacattaatcggagaaaaagaaaaggcagagtccatatagaaatacaatttagaaatagttgaaattcggaattaaaaaataaggaatattagaagaggaaactagagtccatatagaaatacaattaggaaataactgaaattcgtaattaaaaataagaaatattggaagtagagtatagagtccatatagaaatacaattagaaaataactgaaattcggaattaaaaataaagaatattagaagtagagtataaagtccatatagaaatacaattaggaaataactagaaattttatcaatacgaaacaaagtctactcaatacatgatagttacccctaatctttcacgtacataatgagcatacatttatgttggatttctaatagtactctttgatcaaggatgttttccgattgggtgtggaataaaagggaaaaaaaacagatgcacagtccatggaagagtccatctggactcaagttcacttagcccaaataatcttgccgtcccgctaaagccacgtgcattaattcatcttgatatcaacacctacacgacatattactgggaaaaaaaagaaataatcggagaaaaagaaaaggacagtccatgtagaaatacaatttaaaaataactgaaatttgaaatttaaaaaaagcactattgaaaaaagagtccttataagaacctaatacgagattaattaatattcagaataaaaaaataaaataaaataaaatccgaaattagcaaaaaaaaaggaaaaagaagagttcgagtagaaatacaatttaaaaataactaaaattcggaattaaaattaagcaatattgaaagaagagtccatataaaacccaatacaagattattaaatttcggaataaaaaataaaacaaatcaaaattaggaaaaaaacagaaaagaagagttcaagtaataatacaatttaaaattaactaaaattcggaattaagtacaagcaatattgaaataaaagtacatataagaacccaatacgagattaattaaaattcagaataaaataaaatccaaaattagacaaattaaaaagagagttcaagtaggaatacaattttgaaaaactgaaattgaaaacaaaaataaaaaattaaaagaacccaaacgatagtagttaaaattcgaaaaataagtaaataaaatctgaaattagaaaaaggaaaataagatttcaactaggaatacaatttatatataactaaaattggtgtaaaaaataaagactattaaaagaaaagaccatctaaaacacatgacgagattaattaagtaacagacttataaaggagtagagtggtggcggttgatgggacatctaaaaactattaataaaacaccaaatagaatactaaagatgattaaaaggaaggacgataggcaggtcatgaaacaatcggtcaaggcggttgccgggacttttagaaagtaaaagaaaaaccaatgataatcatatttgatttttaaaatctcaatgacaataaaaattagaggcaatgggcagatcgtataggagtacaatggcagtgccgtcgatggttggtgggacttctagaaagtaaaaaatgaattccaacgatagttatgttcaactttgacaatcctaatgataataaagagtaggcggcggatgggtcatagaggagtatagtggcagcgtttgacgggatttctcaaattatataaaatgaaacccaacgagacaataaactctaaaaactataatgtccaatttttaaaggttcgagcttctaaaaagtgaaaagataaacaccaacgataatcatttttattttaaaatctcaatgataataacaaagggaggcagcaggcgagtcgcagaggagtacagtgacaaagtcgctgacgttttagcggaacttctaaaaagtaaaaaaaataaacctaaacgataattatgtttgatttttaaaatatcaatgaaaagagaagaggcagtggacgaccatagaggagtataatggtagtatttgacgggacttctagaaattataaaaacgaaaccaaataggacaataaactctaaaaactataagatcaaaattttaaaggttccaagaagaatgaatagaaacagtagtagaccgagcaagcaaataaataaggatatgacagaagtaaggggtagtagttggtgtaactttttaaaactataaaattagaattacaaggatggtaaggtttggtatttcaaaatcttaagacaacgagataactaattaataaattttaagtaaagtcatattaaaaatatatataattttgtatgggtgctagccacgcaattgtatttttatatggactctatactctacttctaatattccttatttttaattctgaatttctattgtttcctaattgtatttctatatggactctatactctacttctaatattccttatttttaattttgaatttcagttatttcctaattgtatttctatatggactctagtctcttcttctaatatttcttatatttttaattccgaatttcaattatttctaaattgtatttctatatgaactctagtggcaagctgcgatactacgccggaaggaaggatgccgaggcgaggaggaaacggaagatttcgccatgttttgcccgcctccgcccacgcgtcccttgttgccacgcactacccgagtactccgcctatttaggccccaccaccaccaccaccccccaactctccccctccgacggcgtccaccacccgaccacctcccgcaccgtataatcgctgatcatggtgaacgttgctcgcttggatcaggccgacggcgcagtcggcgctgcgtccaagatcgccgcggcgcgcgcgctgggggcgttcggcctcgccacagcctctctggccatcaatctggccgcgacacgggggccaccgtcgtgctttggtgacagcgccttactaccacctcgctctcgtgggatccttcctctccggagtggcacaggtggcggccgccgtctgggtcgccgacgaccctcgcggccgccatgccgtcggcaagaaaatcatgtacgcctctattgcacccctcctcgtcgccgccggcctcaccggagcggctctgctctggtaatcccattccaccttggttcatctacacgtaccaacaccgacatcgccgccgccgcctcctaccgcgccagcttctccctggataggcgcgaatgtatcttctcttatatgtatcttacttgtttcagttgtgtgatgctgctttcttgctgtttgctgtttgggtcattattctaccatcaatcgatcacgctgtttccctccatttcctgatgctgttgtgttattgatcagtgctcgtattgatgaatatgagatgaaagtttgagtccccaaatcaaccccaaaaaaatcagctcatttacagaagagtgtatttggaattttggagtaccccgcgaattgcgaagccggcggaggcgcgccgaccggcgattatggtgttcgtgatcaccaattcgacatccacttcgtcgctgccgctggcggggctccggcgacggtgcgcaccgtacggccggcccgccgccgccttgttctcccttgggaagaagtagccgctgtcatgtgatggccaaaaggattctttttgtgatttttctatccagtttttaatcaaagattatgattgaattgtttggattttggaggaaaggtggggcatattaagtggaccccacatgccacataggagggtatgaggattagtggaggaggagacatcacagggtcgcggtctcgcggacttgcgactgcggcggcccgagagggccacggccatggcgacttcgcctttgccctcgccctcgccctgcacactccaaaaaagtctccgtctcgctgctccgtcttcctaactacatccgcttgcctcctctctgcctcaattcgctaaatcttgtcgccggaattttgctcggccacgatccgatcactgtcgccggaagccgtcctccggccaccccctcgccgtgaaactgcgccggcggatcttggccaggatctggtcggcatcgcggatgcggtattaattgcaacagatttgtggatgctatgatggccgtgcgccgttcagctgttgacttgtaagaacaccgcagccacctcttctgatttgagtggttcatacaggtatcgtgacttcctcaaaaattttatgcaaatatgaaaatatttatgtcatgcttaaagaatatttgatgatgaatcaagtcacgataaaataaataataattacataaattttttgaataagacgaatggtcaaacgttggataaaaagttaacggcgtcatacattaaaatatggagggagtatattgaggagcccaacttttgtatatttgccattgtctgtatttttcacatgtgggagactggtgagtatgacagttttcctggcatgtcatgtaataatcggaattcggaagatttgttattaggagagggatgctcaatctcctttctaatattaggcttttaccgttgtttgtgtgcaatcttcagcctttttcagactagttataaccataccattttgtatatcaaaatttatgactaaattgcactaaatattcgtgatttagtgcattgtgatgctgtgactgaatctgaaaatttggcagcgagaatgaatatcaagtaatgttgtgcatatccccgcagcctggacatgatccaactatcacagtgagctcggcccaactaaacttgggctgacttgggcagctatccatattttcatgggttgacttgggcttacaaatttctcccaaaacgatgcccaaagctttaatgggccataaagtggcgatccagttgagcacgaataaatcgcgtggttgaggttcggagtttaattcgccaacccctgtctatgcaaaacttttccattgtttgtttcaaaaaaaaaaaaaacatttccattgtttggaggcaataagaagagctccatgatacaaatgatttcatctgagcacgtaaggttgcttctacataaggttttgttcccatcacactatctcacgaaagcaaattcaagctgatataaaacttcatttgctgaaaacatctgaaaaatgtaagcgtggtactgcaggtctgcacctgccatcggccatattcgaatgaacgcattgcagttgtaatcctcggcgatgttgttgtatgcatgatctgccgtggtgatattaatggtttcttctaccttatctatgatgttcagcacagcagcagtcaacagttgatgacggagatgatgaagcctcccctagccgtcgccacccactagagctcagctatctcggggccttacaggagagagagaaaactgtggtggcggccgtgttttttttttaccttttccacatgactaatatgagggccctatggtttttctgatttcttcctagaatatataattatcacgtaaacgtcacgtcagtatgtgtgtggaccgagtcaaaatgataagttaaacaaaaccgctcaaaaagaccaccgagagagagttgatttgtactgattttgataattagggaatgcttttatactcagttttgtaattgagggatactaatcgatcacagcatataagtcgagggatgcaaacacacttatgcccatcgttgtggtcatatatattgcgctctcttgatacttaataaacacgttagtttcttaattatttcgttggcaactttttgtgacaagtcgacaaacatgattgtaacatctaaacgtcttgcggtgatatagagtcaccaatcacctcgatttagccaaactttagcagttttcccctatttcatccctaggtgctaaatttaggtgtaaatacatttgtcatgaattataaaacccactaagaacataaatgctcttggaacttgaaagaaagaataccacttggctctttttttcgcccccatgtagttaagctggcaattaatcgtcttttttgttcgtacttcatttgaaataatgtgtaggatcaacaaaacacacatacataagataaattcatttatccagacagtaattgacaacatgacgctgatacacacaccgagactgaatcgacaaacgcaacctgcaggtgctaggcatgcaccgtgaattattgtctgcataatatttggctctggtcgatcgatcgatggccgggcgatgagatatgctatatttatatggggcaactgaatgaacaatctagccagctctgtcgtcaataagccacgcttacctatcaaagcacggcgagcgcgctgacggcgacgacgagcgaggcgacagaggcgtagacgaagaaccagttgccggcggcgccggcacggcgggggtcgtcggagacccagacgaaagcgataacctgggccacgccggcgaggaaggtcaccactgcaagtgcaagtgcaaggtaggagtaataggcagcgccgttattacccaagtcagcttgcagcggcgtggtggtggtagccaaggtgattgccgcggaaatggtggctaagccgagcacccacagcgccgcgtccacgttggcctccgcttcgtcccgccgagtaacagccaccaccatatcttgattaatttcgaagactaatttgagatcgaagctagaattaaggcccaaagaaataaatactagagtttgcttctatcaaatttgctagagtttcccccttcttcaagtattgcatcgatcttcctcgaagagatatgtatatatataatcacgtattactactagctgccatgagttttctgtgggtcgtcgttgcacaaaatcacggtgcgtttgactgactcggtatcggggtgtacccgggctctactcgactcatctgaccgacacggcggggcccaccagacgtgggcccgcttgtcattcggatggtgcataacatacaccgcagcgacaccggcggttgggacatgaagacagctgcgtataggcgtcgtgagtggtgtttctgtggacggggaggggtggaggtttactgtacagctagcatccgctaagggcaggtacgcggcgaaacgcagcctgcagatattttatgtacttcgttgggcagacaggatcgagtaggaccgtatgcagtgacgcagccaaaaagaaccgccttcggccgcgttcagactgctcatctcatatgtatagttggaccggaacggaggctatgtttagattccaatttttttctttaaacttttaacttttctgtcatatcgaacttttctacatacataaattttcaacttttccgttacatcgttccaattttagcgtggaactaaacacagccggagtgtcggagtcaccaattaaccacgtgaagcccataataatttggccacgttagggatcgcaatatacatgttagggtgaatcagggctgcggtccaatatcgcgtgaacagtcgagggttccattttccccaaattctagtggcacgcaggctatatcgtaaattgtaatggtatttatctaaaatgattaacccagacaaaaacatttagttgggctagaatggatctagttgcaaactacgtggaccccataaggaataagttcacttgaggtccattaactttacactgaatttaatttttatccttgaaccgaaaaaccagatataacaggtccctaacttacaaaaccagtgcaaacgagtttcctcggcagtattgtcctcgattttagctgacgcggcgcctacgtggctcttttgactaggtcttcgttccacatgacgctaatgtggcagtatgacctaaataaaaaaataaaaagtgggcccacatgttagttacatcataagattaaaaaatggtgggacccacatgtcaataatacaacgttatcttccacctcccccacactctcccctctgttccccgagagggagaagaagaggagtgcctcgatcgcatccccaccctattagctaggtttctgttccgcctctgcctttgcctctacttctcctcctcctcaccgtcgccgccgcagaatcgatggagtggcaggcgcagctgacaaggagaaggacaacagccggcaatcgacagggagcagcgcgactggcggtaggcaggagctatgtgacggctgtgacgtccgagctcaaccgccgctgggaggtctaggagcctctgctcccacatcgccgctgcgggcctcctccgtttttggacttggacttggaagagctcgtcggcctctcagccctcctcgctgcctcctcgtcccccttgccggcctcccaacctcctccctctctgtgcgtgcttgccggcttccctgccgcctcctctcagcgcgctctcactggcatcctcatcccccagccagtctgcgccattgctccctctctgcgagtgctgagaagatagagagggtgagctggagaaagtgggatccactgacatgtgggtcccactatttattttatccttttgtttgactgacatgtgggtcccatatattttggtttaatttttaaaattttactcctagtgccacgtgggtgccacgtcagccaaaaccgatgacaatataatactgttaagggaccttgttcgcactggttttgtacgttaggggggccattgtatctggtttttgggctcaaggatgaaaatcgaattcggtataaagttaaggggcctcaattgaacttattgcaccccataataattgccgttagggatcgcaacacaggttcgggccagcagagggtgaaccatcgcgtgggccgcagcccaatatatatacaggtcgtgtactcactgggggtggttttcatgggtttgtatttctgtacattagaagagttgttacgagtggcatgggcaaattccattgtaaggtgtttatagttccttgcacgtgcacgatatctagtagttataaattactaatttctatgccaacatttatattaaaccgagttcacaaatttctgttggttgcgctgaaaaatgtactggttgcattgcaaaactgccgatgtgtagcaaaacatccaggagttgatgctttatgctgccgtgatcgattctgaaagcttggcagcaagagatagggtaaatgttgtgcgtattttttcctgcagctgtgtactagtaggctcttaagagttaagttcggggctaatctctaatatcgaattctatgcggattcccgtgcaaatagcacctccacgtggcgcggccagattcacggattcgctcccacgcacagccgtccgattgcatttcaacggtgagagatcgttgtggtggagcctgttgtaatatacgagaatcgaggggttttcttacaaaagcactcaatccccccatcatccgtctcctctccagcgtcaccgccgcctgattcagcacatccgccgcgtcaccgccgctgaccttcgccctgacctcctccccgctgcaccgaagcctctctatcccctgcgcctccacatgtcgcggctacgcgggcatctcgttggatctatcatcggcggcgaggaggcgtggcgatggtgccgaggttcatcggccggtggaggaacatcgtcgacttgaggaccgtgcccaggttccgcatggtccccaactactgccaccccgtgggagccgccgaggggggcaacaactatggctttcagatgatagtttgatcatgcacacaatgcgttcgacgaaatgtccatgggcattcatgggtgtggctggcgccctgatgatgctcaatcctaccttcctcgttggattactttggtgttggtcgaagcattggccgaccaaggaatgtgctgccaggagttacaatggtggactcacgtcttagagggcagttcccttctgactcatatggtgacataccgtggcgtgccgtgaaaacctgagattggcaaatggcttactaagtgtgatgccggcgtgtctttgtcactgaccaattcggattgcttgagctttccctggattaatttggttgttcttctgaaacggtttataggtgcaaaggggtgcgagcaagactacaatggacaaggtgtgtgcaactatgagctgggataatggagatgctttcatggatatgttggtaagtactactttgtcagctcaattaatgtgttaatcttgttcacacttgattaatgaaattgcgatttcacatggaatttaacaaggttgggttttaatcacactccattttttagcaccatccaaaaaatctttaagattgttttagtaatttatctactccgtacataatatcaagataaataggcatagtttatgaacctttgaattctgcacctgttccatactaagaagcaaataagaaagaaacaaataaatactccagttggttagtgtgtttgctcatatatgccattcttaagaaaaacatcagtttatatatttatttatgtcctatttagtttgctgtctatcaactcttcaaaaattatggataaactgtgctacttcaattctttgcttttgatcaaatgacagcccttgctctttccaacaactctattgacaaagatgttaaacatattttgcccaacactacaacttttgctccttagttctggaaatgatattgtatactctataaaccaagctaattcttcatttgacttatggatataccatcatagaaatagtataaggagacagttgcatattattactacacttattttttgaatatatatttcatcattgtacatatatatatttagacagctcaattatatatctttctgacaattgctaacacaatatttattataacaaagtttgcttggaaataacataataaaggatataatgaggcaataagaactgtgcgtggagggccggaagatgatgtctgtcatggccggcaagatggacgagctctggatagggcgtatggagtggtgcgtgctggaatgtaacaagaacgccatcaacttctacgagggaatgggcgagccacgcaggtgtgctcccgtaatggcacatatacagactcactggcgctgcacactggaaagtacaatgggactaagagaagggcaatggggcgaaatagatcggtggttgattcttagttgtccagtctcaagtaataaagaaaccggagatgtgtgatttagggtattggataagttcgtgatgtcttagcttgatgttctttcaaatgtagtacacaatctttgcagaaggttaagggaaaataaacaaattcttaaattataggaaaaggcaaaaaaagataattcaggagagtcacaagccccattgcataacaagcccaaaactgaatgttggagacactctagatcaaaacgttagcaagcggaaatggtatactgttatacctaattttataaaattattttatctctaacctttttacatttcctttttaccttgttgcaattactgacaatcacccaattactggactttgcagatgacatcgaaaaaatcctaggaaacactaacaagcatccattcaggacaatacattttttttcatgctagcaatggtgttgtttttttcttgcacaattttcatctcaagtcccaacgactatttatttaattcgttattaaggaaaaaattgatggatgctttatctagacctctatgtacactaatatcaaacaaatctaagctatagataaattagaattagattggcctaatatcaattgggcgtggcaaagacgcgccattatttctagtactcatgttaacctgtgcaaagctgacaaccattatggttgggaataagttcactttaggtccctaaatttgtacctagtctgattttcatcctcagtatagaaaatcggatacaacgcatccctcaacttacaaaaccgtgcagaaaaggtccctcagcagtattatgcccggttttaaacgatgtggcgcctacgtggctccctttgactaggtcctcgtcccacgtggcattgacgtggcgctcatgtggcaattggatcccgggaaaataataaaaaaccgtgggacccacatgtcagccacataaaaacaataagaaaaggtggggcccatgtggtcccacatgtcagccccctctcctctctatccccccccactctctcggtctcgtacagaacggcgagcggtggtgcagaggggagcggtgggcggacgacggcaggcgacggacgaggaaggaggcggcgggtggccaggcgaggagggaggcggcgcggcggccggaagaggaaggaggcgacacgcggcggccgggcaaggaggggcggtgcgcggcggctgggcatcgcgggcggagcggccgacggcgtggagctgccgcgctcgctagaaaagggatggcaggctccggttcctggtgcggagcccgcaatcgtgctcatcttcaacgcctccgctcgtctgccgtcagcgtcctctccgtcttcgccttcgatgtcgagggcgtagatgtccgccttcgacggttgtcatcgttgccgtcaggaggaggaagaggcagaggaaaaggtcgccgtcagcggttgtcgtcgttgccgcgatgtccagccaccgcgtgccgtccctcctcgcccggccgccgcgcgccgcctccctcctcgcccggctgccacgagctgcccctcctcggggcggagctagcacaaaatgaaggggggttccacttgtttgctttactctagtttgaatcaaatttagcttaatacgagtgcctaactttgaactgacagagtatatatatggtgaaaatagacaaactatagctaaaattttgtttgaaccgggttcctgggcacccccctagctatacatagctccgccccctgcctcctcgctcggccttcgcccactgctcccctctacgccgccgctcgccgctctgtacgagactgggagagagagagaggggggggatagagaggagagggggctgacatgtgggaccacatgggccccaccttttcttattgtttttgtgtggctgacatgtgggtcccatggtttactattatttttctgggattcaattgccacataagcaccacgtcaatgccacgtgggacgaggacatagtcaaagggagccacgtaggcgccacgtcatccaaaaccgggcatagtactgccgagggaccttttctgtacggttttgtaagttgaggaatgcgttgtattcggttttttagactgagtatgaaaattagactgggggacaaattgagggacccaaagtgattccttatggttgtgataggctgacagaaatgacgctgtggggaaggccggagaaacccacaacttgaagcccagcattgggccctggacacggccatacagtccacgcaggcccatcgaaaattctagtttcaagtcagtcgcaaccattggttgcgatccaattttatgtgggctgcgacgtctcccggatgcctggcccaagcgagcgcggaatcatttgggtagctttgtgcagttctttttcttccggtgatctgtttgcgtcttgatgcgatattctccacaatctccactactcagtataagctagtttgctctatattttgaattttccatgtttcagcatttcaaatgtgcaatagaataattaaaaatgtttcatcgaatggaagctgttgcctgtgaaattgtcatattgtgcttcatgattatggtttttctgcaatattttttttccggatatgccttatacgtttgcatgggaggagaaaatatgataggtaggcctaccaatttttaaaatataattgttgaatgttgtgcgcaagttatgtaggaccaaaaccactttggattgagagggggtggaggcttatttggtttgagcagttgggtgtgtcaatgtgtcttgtattcaagttcatggcttaattaggtcgatcgcagtagtttaggggttaattcaggcttttctcttataataaaataatatgttgggtgttcagtagttaattgttatgtttttgtggttcgcttaatctccataagaaagtattagagggattaattccacatcataatagcagttgggtgaaggattgaacaaacaagaccaattcttggaaggaaacaataccacaggcaatcttattggtcaagaaagaaagagataattatcggtataaaaactaatttgaatcctatttaaagatacgccctcgagctctaccaaagtcaaaaataaaaggaggagagaaagagagagcgtgtgttaatttattcccgtcttcacgtacaatctctcagctgatcggtcgatcagaagaaaaaggaggccggcagaaaagcccccggccggggatgacgtcaccaacgtgtcatcctaccggtggtggactgtggagtgtggacgaaacgatttgagagaaccgaagtggagtaaaatactatgtgggccatgtatttatgggaaattcgcggtcagaaaagccggggaaatggcgaccccaacgtgtgccccgaacgaaaaaggaaaaacacgggacgggtcgacgtgtgcccgaaggccgaacgtataaaaaaagccggtgttgaatcaaacggcagaattatgcgagttcgcagaagcttccttgtttaaagacatgatcgtcatttgggcttttcggttaaggccatgtttacttccaaaaactttttcccaaaaacatcattttaaatctttagacacatatatggagtattaaatatagataaattaaaaaactaattacacagttaagagaaaaatcataagatgaatcttttgagcctaattagtccatgattagccataagtgctacagtaatccacatgtgctagtgacggattaattaaactcaaaagatgcgttttgcggtttacttatgaaattagttttttcattcgtgtcaaaaccccttccgacatccggtcaaacgtccgacttgacacccaaaaattttcttttcgcgaactaaacagaccctaagagcaagtttagggggtgtttgggagagaagggctaaaccccttaatagtatactccaaatcttatataaccaatctatcgcgttcaaacttgcagtcgaatggctgacctgtacatgaagcacagtccagtgacagacagactaccgaaacagcccataattagttatcctacgtgcggcagagtactaagagtatctggaatgaccgaatgacaagtgggcccagaacagaaaggtcccgccgtgtcagtgggagactgggaggcccatgcccatgtgcgactttcgtctgactttcttctgaccttttttttaagtgtgtgcacgctcgcgtcctcaagcaaaattttctactgacatttcttgtttgtgtttgcgttgtcatctatatatatttcttcctccgcctatcttctgagcatatgttttgcacctccagctccagcaaccaagccaccccaactccgacggtccctcccacaggtctctctctctccccctcttctgtagttcacgaggagaagatcgggcagccacgaatcggtcgagagatttaatggcggcggcaaagctactgttgggtgatgctcgccgcgaaccggaggctaagatcgcctccgctctgggcgcgctcggcgtcgccgccatctccatggccaccactttggccgcagagttcgagccgtcgccgggcggcctccgcacaaccacctacaaccacctcgctgtcgcggggctcgcagggaccttccttggcggggtggccctggtcggtgcttcagtctgggtgtccgacaacccagctgcccgccgtgcagccggaaagaagttgctctacttcgccgccccgccgctcctcgccgcggtcgttctatcggtggcggcgctgctctggtaagtgccgcaaaggctcatgtactacaagccccccctgtccggccgcatcactatcttgttggagctgtattgtcatcgtgtaatagtgcgtgtttcttctagttctagtccattgtgtgtatcaccaatgtatgatcacgtctccttctgttcttggtctgtcaaagtgttgttcgtatgatggccggcttaatcgacgagtgttttgttaattatgagttcatatctcgcaatttcaagcaaatggggagctatttagtactagttttcagcttaattacatttagggaagagtggattcggagtactccatgcatatcggcgccgccgccggcgacagcatggcgggcgtttctcatcaattgcgccaccgctgccgcccccatagcagtactactactgtctcggtggcgctgggggactgcgttgccctggaggcggcagagtggtggcgtctctccacgccgctcgccgtcgccgccgacgccgacgctgaatagttctggaagtttgccttgtcggccgtcgtgtccttctgccgctaaaagcccatctttttctcctttttcttttcttttctttttttttttggggcaactgttagaagagagggaagggtgggccatatttaagtggggcccacatgccgtatcatatccatgacctttgtccttgcgttgccgccggcggcggcggctacggccatggagatctcacgcgaccatttgccggtgaggtcggctgctccgcctccgcctcggcatctacgcctgattggatccccacccctatctccactgactgtgctatcgcgtttccggcggtggttgatcgaggcggtagcccgtgcggcgcgcgagattccgcccgtccacggatttccggtcgccatcgcggggattcgtcttctccggccaacccctcgctgcgcgatcctgcgccgcccgtcctcgggcaggatctggtcggggtcgcttgtggtaggtgttgggggggcacttgggtttggaggacagcatcgttgatgtgctttgactttgagttccttgctaatttagttatgctgactgttcccataatccctaaaatcccagcagttgcgttgtgtggtaggttatgtaaagcgcattcctgtgatgaaaaatagaccctgggagacatataatcacttgtatcaagcgatccacacactaggcccccaaatattgtcgtagataccattttctcttcagtatgctgcttaaaatgcaaattgtaagcttttcgctgtgctgtccagctacatctagttccttatgtttaaagactgatattggtctttgcctctttggttgtgtgtgatgtgcttctttttaatcgcaacacttgatctttactatcggtgcatatttagttccagtatgtccttttagttaagttgctgaagcattgagcatcttgtcatgttgatcttcttatgagtggttcaagatggtttgttctgttttaatggaagtaaaaaatggggcctgtcccctcctaatgggaagagaaaaggagatgtatttcagcaaccatgtgttatagtataatccaaatagttcgctaagctacgttatatcctgttctgagtatttatttgatttgctgcaaagttattaaatttatggcattgttatacatgatttgtacttgattatatgttgctattggtgattcatgtaattagagctgaatgggatttttgctacatacacattgcttctttcaacaacccttatgcaaacaaaattaaaggactggtttctctgctgtgctgatttccattgttccctagctgaagcttaagtaattgcaaaatttgtaggaactcatctgttcttttgctcttacaataaatgtgaggtttgtattcgagctacactcatgctatgtgcatgcgctctgtctatctgaaccaatagacttttgtaaatacatttgcacaaggcattgaggtcaactaaaattctactatgcccaatggtgcagccatatttcatacatgaatatggctatcgctttgtctgataggttatggactgtgaactctatgtgtttattttgatgtggaatggcctcagggcaacgcaggataactcatacatgcaatccatacactaggtcctgaaatattttcttaatgcccttttctcttttcactatactctacttgttaaacttctaagaaaaggcttatccctctaccgttctattacatctataattcatttgttttgatgtcaaaagcagtgtattgagctgtatatcttgttggagcaattttacattccttgaggaggtaccatggggtaccaaaaaatttaatgtaaaatttggtacctgatagtacctaggtatcaagagatactaaatttacaatagaaaaaatagtacctcatggtacctcctcaaggactgtaaaattactcattttgttgtgatatactctagctcattgtagttagtgttttgacttattgctaaacccttgggagcatctcataatgtttaactctgatgaattgtttgagatgacttttttttttgtctagatgaatagtggcatcgcaaccccaggcaagagcactagggcctagaggtattcctagaaacttaggagcaaatggacaaagatgtagcaggaccagagcagaggacatttggcagctttgaaataccataatgcatctcgtaaaaaatattcaacttttaaaatttgtactatgtaatagactaataggtggttaaattctgttcttctgagtgatagaattgcagattgtaaatcaatatctacttgtacaaaagatgagtaaatcttttgctcattcttatctactccttttttatttgtcaaaatgaataggaatagcagggtgcctttaaagtataatcgaaagagttggtaaattttaatatacttctgaaagaatcatcatccttttgtcattatctttttcatgtattgaacaacagatttgcacatatgtatttttaccatcagtaacagctctttattaacggatagtatattgttctgcttttatgtagggggatgttgagttgtaagaagaccagatgcatctgctctgattttagtggcatgtataactataacctgtcaaagagcagcaaaagaaatgcctcgtagctgtgtgatacataactttgccaggatatctctctgtttatgcacacagactgctatggcatttttaaccgtttgctcagttgctcttacgtgcatttctgctggcataagatggtggcatggtggaggttctgttgttaaaccctggtatcaggacttgatcgagcaatttggtatgttcggtgaaaattcatgctcatttgagtgattgtacagtactccgaagttggtgttttctatgctccggtaattgtggatcactggtataatgaggaaatcaacctaacgtataattgccatggtctgtatttgtgtgtatgtggagactggtgtgtgtactaattttctggaatgtcatttaatcagaagagttgtttagaagaggcataggcaaattctcttgtaaggcttatgtagttcgagtgtttaacatggttataacagtagtgttttctatgacgacatttatgattaaactgtgtctacaattcctgccttttgtgcagaaaaagaaaagcactgataaaacatcctagagttgagtgcattgcgctgctgcgactgattctaaaagcttgacagcaagagttagaatagagcaatattctgcataattttcctgcatctgtgaattttgctactcttgtactccctccgtcccaaaatataacaatttttacttagatgggatgtatcatattactacgaatctagatatgagacatgtccaaattcatagtagtaggatatgtcccatcttaaaaaaatatatattatattttgggagggagagagtaaaacatgtgctcgggtgtgcaaacctgacagccattatggctctgataactcatgctccctccgtctcacgatataagggattttcagtttttgcttgtaacgtttgaccactcgtct

SEQ ID NO: 58066 - DNA, 1434 bp, Oryza sativa
  unsure (1)..(1434): unsure at all n locations
accaacactggggtgtcaattaaaaaatcaaaaacacttctgttttttcaaccctattttatttactggaaaatggaaaagtttgcactagtagccctataaatgttgcgcatttgagcaatcaaacttatcacttttggttgggtgaatctgcttgaacagtgcaacttgtacaagtagaggtataaaacctaagcattaaataaaggcacggacaagtgatgaaacaagtcgaaggaacagaggcatcagattaactatggaaagtaaaatagatgaccttacaaagctaagattgaggcctaaatgactattcgatcatgagctttttgctaagtttcgataaatctgctaaaacaccaaaatagaaaagaacagattcataagttcgcttggctagaagtgtcattaatttcaaaggaaaacatgatagcagaccttaatatttttttaagcagtaatcagcagctaccagaaaaggagagatgatacctgcaatagtttaccaccagcgacgaaggaacgtaatcccatggtatcctgaaaggcaaattgggtcagtagaagtgccagtgccagatatgcgtcacattaaagtaaaatttgaatgggtaactgaagcaagcacaaaaagggaaaggctaaaactatattaccttgtttttgaaagtgactaggaactgagcagcagggtccctgtttgtagcatttgacacgatatcaaggatccaaccaccaccaccagcaagtctctgtcttgcaacatggaaccctgaattatcttttgttctcaaggctacaacaaaaccatctttgagtgtatcaggatatttccttctgagaactgtaggcaacttcgtctcagaagttatttccattggggattcagcaggagatttctgcttgtattttgagtcctcaggagacgcaaatcgtgaactggaactcaatacctggtcccttccactcattgcagtatcatcatctctgcgtgaggaataattactgccactctctacagcagataattcatctgttttctgttgagatctgcggcgagcaggtctctttttccctttctttccagaacggctgcgccttccttctgatcgggggacaatatgttgagatctaacagatgcttgaagctctttatgcctggatatggctcttctcttttcgtacttcatttttaactgactttcatctgtctgctgctcagaataaaaaacttgtgaactgctaaccttttcttctagctgatcatcttcatttgcagcttcgctaatttcctcatcttcatcagatattgcactacttggaacagcaccatcaaagaaaaaggactgcaatatcgngattgctttctctcttatttccatccacacttcttcactgtagtctgcacttcgaggaagaattaaaacatttggc

SEQ ID NO: 58067 - DNA, 1204 bp, Oryza sativa
cacactatttctcagctggcagtaaaatgtactcttccaagaaaaaaaacatgtcgttttgtagccagctgcataatgtctagctagtttttaacctttttcacacacatatgtttttacatttaaagaaatagttaattgtatttttttggggggcggatccaagacctggtgaccccggacgaccgcccgagctcgtgcacttcaagctagcagtaaaatgtactcttccagctaaaaaaacatgtcgttttgtgaccaactgcataatgcctagctagttttgtttccacatttaattaattaaagaaataattaattgtatatttttgggagcggatccaagacctggctagtggttaccttcgggcaaccgtccgaactcattgacaagtcacatcaatgtaatagcttccatcgctgatgttcaatggcatccatataatcctttggacatatatgtttgttcatgttctaaaagatctctagattcgccaatgtacattcacacacttaattagtcattcgtacatgcagcgtgcttaagtttctaggcgcataaggcagggtcgactagtatcccttaataaagcttatggtgatatgatggtggcattgtgtgaactgtgaaggtgtccaattatcaagtgtacatggtagccggctcgcactgtctatatcatagctcctcttcttcccttctaaaattttggaaggatgccataatatggttttgaagtttcttggccgccaagctgaagccaccaccacactgagctgtcgatccgcgtgtatttccagtcggtggtagtaacacgcacggtgcatcctgagccagtgagccgctttagcgacacatcacgtgcatcggattatcggaagcacacggtcaaggcaagacaggtattttgttagtcgcgattaatctacaacagttagggcatccacaatgtgctacaaaagtagtccatagggaataaactattccatttagccatttagtaacactgggcaactagtccatataaagaaaatagcaaaagatatccatatgcatatacactacctatatgacataaataatattatatatctctacttctctctcttctcctaatgttacattgtatccatatacattgtgagattgctatagttaaagtttatttatatgggtcccatctatataaaccacttttaacat

SEQ ID NO: 58068 - DNA, 11177 bp, Oryza sativa
tattttccgctctgcccgcgcgccgcgcgcgcgtgcgcatgagccgcgccgagccgagccctccctctccgctccctcgatgatgcttcccgcgcgccgttgttcgcatgcacgcgcccgtgcggtcgccgcccgtgccgcgcctgcgccgtctgcgccgcgagtcagcacgcgtgcccgagccgcgccgctcaaatcgccgcgccgcccgttgcttcccgcgcgcgcgtgccgtggtggccgaccgcctggtcgccgctgccgtcagcctctgccgcgcctgtccgcgcctgccgtccgtgtcgccgctccgctccaaaccgccccgccgtcatcgccgtcgtcatcaacccgaccccgccactccgcgcgctagcttccaagggacggaggcagagcccctcctccctctgccgcgtcgcccccgctccctcctccttttcccaaagaggcaaggggcaagccccctttctctccctccttttcccttttttcctcccgccggcgtcatcctccctccgccctgtcgccgatttggccgctagccggagcgccagctcgctggcttgaccgtccaaagtcggttcccctctcccaaaccgtcattgccatcctataaagcccaggcgccctccctctcttctcctctcgttgtcccatcgcctccactccattgtcgccgcctcccgtgctctgttcgccgtcgccgtttgtcgtcgcgcgtgtcggaggagccggcacgagcgaggacgcggaaggggactccgggcgcgccctcttcttcctcttccccggcccgaggccggagagatcactcccgtgccgtcggcccatcgtcactgcgccccgtcccgcacggtagcgcatctccctattctccctcctcgttccatccccttcccttagactcgggtagtagcacgagtagcctccccgtagctagctggcgccgccccgactgctgccgtcgctcgccgtgtgctcgccgccgtcgccgcccgagctcggaagcgcctctcgtcgccggcctccctcgatgcgttcctcctaatccggcgcaagggacggattcccgtagccgcgtagatgctctcgccgccgggaatcggcccctcgtgacctcgtcgccgtttccctcttccctccccgccggttgccgccgccgcaatccgccgccgacgcactccctccggcgaatccaagccgttggctcgtctcccctcgtctcgtgcaaccacccggtgtgctcgctttcgcctgtatcgccgtggttcgctccgccgcccgccgctgtcgtccgccgtccgttccggccggcgtcgtcgtctacctcccgccggcccgcgtggctgccacttaggcgccatgtcggcgccacctcggccgcgaccggatcggctgacccggccagccgctccctccgttccccccccgtgcgcatggtccgcggtgagccgtgaggctgcgcgtgggcccgccgcaccgcatcttccgcgaaccgcgcgcgtgcaccgcgtccctcccccaaaccctagcgcgcgccgcgtgcgcgttccgcacggtgaaccgtgtcaccgacaagcgggtcccacccgggaccacgcgggatggacccggcccaccggctctctctcccctccccgcccgcgcgcgcgctttgggccgccttcttgggccggccggcccatttagctcggccgagccgccccttttctctcgggccgcgccctagccgcccgagggaagtctacttcccctccctcttccttttctttttcaaaaaggatttaaataaatcctttttcctttagaccaaaaatccaataatcttagaaattcaatatcttcccaaccgtaaatccgtttgactccgttcaacttccaaaattcctcaaatctcgagatctatctaatggcacgcttagaggtcattaatagggctttattttcgccgtttgttgagttgtcccgttttgcgtgtagtttcggagcccgaagacccgcagtgcgaggatttcgaggatcaagctcaagatctcgagcaaggcaagccacctttgaacatcttgagcctatatctgaacttaattatgttgcttgaaaaaaatattatgcattgataggatcgcacttaatttgcttgtcccgtctgcaaggcagattggcgaacctacctaatttgttgcatctgatccttcctttgttaattgttataccatgttcccttgtaaccatctagttgcgcctcgatattcgtgcactctatgcgagtatcgacggtcgccttcaaacttaaaatctgagtaacttcttgggtaaaacttgggttttacaaaagacttggaaaacccgacacctgggtcggtgcttgcgaactaaatgaatttccaaaaccacggaccggggaacgtaccgggtgtacggtttcccgctcttgcacttaaggaccgtttccttggaatttcatccgaacataagacaagtacgaccacatgggtggaatgggacacccctggctgagtaactagtttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggagatctcccgacgtggctgatccccacgggttgggtgatccgggttagtaatgtcgtgtgggtaaagtgtaccccctctgcagaggttaacaaactgttcgaacagccgtgcccatggtcatgggcggatgtgaggtgattcctagcgtagttttgtttgactactgccttgtgaaattgctgttgtgaaaaggggaatcgatgtttggaaaatctgcagctgatgggatcagctaggcccgggtggccgtttgaaagttgttggcccgggtggccgtttgaaagttgatggccaggtgccaatcttgaacaattctaaagactgatacattgcacatactccgaccggacgagacgcactgtctcatccgtgtcgtttgagaagcactcacttagttgttttcagaaaagagttcaaataaaatcaattgcaaaaacaacagcctttccttgaagcctgcattaaacacttatttcccatggcttgctgagtactcccgtactcacccttgctctatataaataatcccccccagttgctgaagaagatgaagcggatcccgctgacgaggagttcttccaggagcaaaccggctacgatgagttttagggtttcggcctaattcccaagtcgcgcctgtgttgtttggtccaagtcttggcttccgtttccctttttgcaatgcagttgtgagcttgggatctgtccgcagcccaacatgactgtacctctactctataataaagagacctttgttgctgtgatattctgtcttcctgtgataccagcactgtttcctgggactggtatcgattaacaggttaatttggagcgtcacgggctagttccggtcgggactagttcggggcgtgacagtagtataataattgtttctactcataatagaactcataaatcaatggttaaaatcaattctaaggctgtgttctataatacaccttttcaacttccattccctcatttttcatgtgcaagctttctaaactgctaaaccatacgtttttttaaaaaaatctaatatagaaaagttcttttaaaaatcatattaatccacttatcaagtttttagctaatgctttattaattatgtgctaatccgttcctccattttacgtgccaggagaaaggttcccaacccccaaacaaacacagcctatggtgataatgccaatattagaatactaattagtaaggatcaccgtcatggtacttatttttaatagtttttatgaaaataaaattagaaaaggtagtgataaaatatgtacattaaagattatcgatgtctaacaataagtaaaagaaaacggagacaatattttgttcattctactgcaagctaatgagtaatgaaacatgataaacgtggagccgtggtttgttggagtattggataggagtacttcctccatcaaaaaaaactaaacattgaagaggagggtacaatgaatctgtgataactctttgttatctttcatgaaagcaaaaggtctgtttgtcccggaatttgtttagaatggagccctgtctctctggcacatggtagccacagcccacagctagagtcgttcaggttcagagtggttttttttccccaagaactgttcagagtggttagcctggcattttcaaaccacctcgaaacacatcgttcagtatcacgcaaggagcgaaaaagattggtcaagtactatagttcttttctgtccgtggggtatggaccaaacttgaaaatggcaacgttttactttggtttccaaggattaaacattttattttaagaaactccgtttccctaaggaaaaaaaaagcaacgctgaaacatgtggggacttggaattaacatctgtgtgcatgagttgtgagttgtgaatgggaaaggtaaccacttgtaattgtgggcgtgtttagatctctaatttttcttttgccaaaaatatcacatcaaatgtctggacacatgtatagagcattaaatgtggacgaaaaaaacaattgcacagtttgcatgtaaattacgagatgaatcttttgagcctaattgcgttatgatttgacgatgtgatgctacattaaatatttattaatgacagattaattaggcttaataaatttatctaacagtttacaggcggaatttgtaatttgttttgtatacttaaaaaaaattgtgtaaagaactagacacggcctgcatggagtaatttcaccagccgtccaagctagctattcgtctgtcctgttgtttctttcaataccaaagcgaagatggagcagtgatgactgacttgcagagtcttttgagatgagcaagaaatggtctttggagtacttggaataggagtagtagagaaggcaggaaaagtggagtaacctgaaggaaggggggttggatggccaatcagggaggtagcggtgaagcgggtagcagtggaggcggaggtagtcgcgccagttgtgcacggtctccttgcggacgttgaagctggtggagaggcggatcttcttggccgggtcgtcggagtagagcttggccttctcctccgccggcagccggaagaagtcgtgcgccaccgccagcaccgacagtgtcagctccactggcaccccatggttgagcacctgatcaactccatcgatcgattgcatgcaacagcaacatccaacatgtgtgagacctgcttatacgagatggacgatgtagtaacgtaggtagtagtgctagtgatttattatacctggaagaagccgtgggagcggcaggcggcgccgacctgggagacgagcttggcgcggtcggggttggcgaggtcgacgacggggatggaggcgtcggagagcacgtcggcgaggcgcgggcgctgcgcctcggggcgcacgtagttgcccggcagcgtgtcgtggtctgccgtggagatgagctggtccgccatgccgcggtacacacacacaacttggcacgcaccacaccacggggggattactactataaataggcgcgacgcggcgccagcggagaagcgtagtcaggcggggagaggaagtcgagtcaggtggcggggggagaggggccggatgggtcgtcagcgatggggctgggcgtaacgtcatcgcggtggtgtagtataaggccctgtttagatgagactaaaacttttaagtccctatcacatcggatgtttgaaaattaattataaatattaaacgtagactattaataaaacccatccataatcttggactaatttgcgagatgaatctaatgagcctaattaatccatgattagcctatgtgatgctacagtaagcattctctaattatagattaattaggcttaaaaaatttgtctcgtgaattagcttttatttatgtaattagttttgtaagtagtctatatttaatactctaaattagtgtctaaagacagttaagtccctgatctaaacaccaccttactccaacgctacggcgacagccaatgctagcacgagttgtgtactcgtgttgcggtgtttgttttttattttctttttgccgcgtgcgagagtgggagcgacgcagtgtgtggttcggaatccgtgtggttcgatctctgtcacccactcacatcagtctccctccacatcgagcctgcaaaagataaaaaataaaagtataacctgagctttggtaggcaccgtcagcctcttattgtctccttgttgttctattaaccacgattgaaatttaaaatttagatccagtttgaatggagaaatattgttaattctatcagcaacgtaaaatcggattagacacatcttattaacgattacgaatttgaataaccaatctattcctagattattatataggggttgtttagatcaaatggtgtaaagttttggcgtgtcacatcagatattatatactatataggatgtcgcatagagtgttcgggtactaattaaaaaactaattacagaatccgtcggtaaaccgcgagacgaatttattaagtctaattaatatgtcattagcaaatgtttactggagcaccacattgtcaaattatagagcaattaggcttaaaagattcgtctcgcaaattagtcacaatctgttagttggagtatttttttagcctatatttaatactttatgtaggagttcaaacgttcgatgtgacatagtgtaaaattttagggtggaaactaaacatgcctataatagactccataagaaagcatttcacttctctctctcttcttttgttctagaggagccagctagtctctcgaggcggcgtcaatgcatccagttgaggccctgtttagttcccacgtaaaaactttttacactgtcacattaaatgtttggacacatacatgtagtgttaaatgtagaaaaaaacaattacacaaattgtgtgcgagacgaatcttttaagcctaattgcgtcatgatttgacaatgtaatgctacagtaaacatttgctagtgacaaattaattaggtttaataaattcgtctcgcagttttcaaacgaaatttataatttgttttgttattaaataatgtttaatattttaagtgtgtgtccgtatattcgacgtgacacgtaagactaattttttttccaactaaacagggcctgagctcgcttggggcattgtacgttgtctactgatattaatggctgagcaatgaaccaagtcaaacatataagtagagtagcactgatactgattactgaaacaagtcaaatacgagtactatacagtacgtattgaacgactaatcttatcttcgctggatattgggcgtactgggcggcgcattagaagtgagttataagcctactttaagattatatggaggagagaggtaaacaaaagagaagggtattggctctcatgcaagagctagtttaacacaagctccaagacaaatacattaaatgcataagtgagagatagagatagaagaagaaaattatagctaatctattatagcacccgcaatggtaaagtaaggtgctatctataaaacatgtacatctcagcaatagactcgattaatagtaaaccaccttaatagtatgtctacattggtatctatagctctctcatgcattgtctcgtttttctctatagactatctctaagttagtagatagctttgctctctctcttcatttaatacattccaagtaggaaaatatgctgacatggatctcttgtagagagcctatagataatcattgtgggtgcccttatatgtattgattttaggatgggctaataggaggaagtgggctatattattatctttgctcttatttgtttgttttgtttggccccttcttttttctgtgggcgcagcattcaagcgtttctcgcgcagaaaacagagcgcggttcatggttcggttgcatttcccggtgagattgtgactgaatacaagccgtaggttcagcttaaagtcaggcggcagtgccgtgactgccgtcacgtagcggcgtgtgcagatgaaattaatccctgctcagcgtgtaccagttcctcctcttgacgccgtcgggagcgtttttttcttctgtacgtcaaagcggcggcgttcaaatttatagtcgactcaccttcgtcatctattttttgaacagtcgtcgatcggactaaaacgaattaattatagtggctgtgcttagaacttggatcaaaggccacatatatcttatccgcatagtcatttttgtgaatttagttgcactttaacactactaattaattatagcgtttaccagaatagtctggttcaattcaacttaagaaggttgttttttttgaacacacaacagacccgcgcatcgatatattaaacgaaaacaaacaagttacaactgaccatctactagaagcagggccaaaagttctactccagcttaaaagattacggtaaagcttaaaagacgctactaagcaaacgggctccagctcaaagggtcgggaagagaggctgaatcacgaagagacgagggtgaccaacaggaagccgagctgctgctgtccccttgctgcacccctacatctatctagaggcggccttctttgcaagacagactgcagtaatgtcagcacggaggtcaagacttcgtcgaacactctagtgttccagcacccgtaatagtaaagtaatgtgctttttataaaacatgtacatctcagcaatagattagattaatagtaaaccacctcaatagtatgtctatatgagtatctatagctctctaatgcattgcctcgtttttctctatagattatctccaggttagtaaatagctttgctctctctcttcatttaatcttttctaagtagaaaaatatgctgacatggatctcttgtatagaggctatagataaccattgtgggtgcccttatagagatgccacgccaccaggatgatgagcaagtcaaagacacgtctccgcaccttgggtagaatgttcttagaccatccgcaatgggtgtccctggggcgtagccctgggaacgaccgttcccctcccgttagctttttcagccggaccgtcttctctgccagacgcgcgcctcctcgctggggtcgcgttcctcacaagctttttttctgagacaccgagccggaagacgcattgcagagggcgtggctaggtgagtgtcccatgaacaccgctcccgccccacattttgtcgttccacccctcaccctcgtcattgggagtaggcaacgaccggcgacgaccccgcgacagcgacggcagaggaagaggggtggaggcgtggcacgcgacctccggcggcgacgatgggtccgcgacggcgactactagatctgcgcgccgtgcccaccaccgccggcgcgcagagacgggcggtagccgaagggcagcggagggagcagcgacgagagagatggagggaggcggcccttctcattgcctcgtggccgctggcgatgagagagagaggcgagcggcaacggggagagaggagggaggtggcggcggcaggctgggagtcggcagcgacaagatgggcgatgaggagggcgaaaagaagaagcgagaagagaggcggaagaaaagaggggtatttggggatttttcatctggggctactttaggctaaaacacctattgtgggctgtagtaccctcaccggattgctttagattttgaggaacctatcaaaggtttgatggtatctttcattgcgaactgagtttctctactagtgttctcagttaataagaacactttagtagtggctcacatcatagatgcccttatatttggccactactctacgagacttactggctagttgggactgcaacctgaagactggtggcaagcagcaatttccgccgctagagatgccacaaatatgcacaggaaagcaagatgtggtttgtcatctccgactcccgagtcacacaacggacacgttgagtggcatccatgtctctgtcagtaagctggtccgctgtccagcatcggccgcgcgtggaaggcaaatcagatgaaaaacttgcattttcaccgacgttcaaggtcaccaaagctgctttcaacatgagaaggtttgactgcaagaaagttgatttaattgcttgcttatgactcaaatctattggctgtgcttatgtcggctccatctagataaatggacagttttattcacttacatattaacacagggattttcttgtagtgtgtcgtgtacattctagtacatatttacaaatactacctccgttatataatataattttttttatataattatgtgacagatgtagtaaatagataggtatggatcaaggttgatcgtgatgtctttttcatgcatggctggcaagccaatttgactccgagatatataaccttatcccggaacaagtgatgtgcatctactcgtttgggatttcgtgaagacaacgcatcacagctagccgtgacaacttgataaactccctccatccatattccttttacgtaaaattatttttgagcttttgtagattcgacctacgtatttgactcccaagcaaagcctctctattcgattcttatgttttatatacgtgttcaatgagagaattggatgatcatttgcatgaacatgcacgcaaacccgatcgaggtcctgcactgcatgcgaaagtttgcaagttctcatgcccgataggacggtggcggatggtggtgggaacggctgagatttttgccggccggatgcggggacaacgacagcaactcctcctcatccacctgcgatgggatagcagcaaacgctgctgtgtgctgtgtggggacgagaaggaaatggctgcagcgcggtgaccaggtgcggtggtgttcgtagctgcccctttctcgatctcctcatgcttagccagggggggggggggggggggggg

SEQ ID NO: 58069 - DNA, 1319 bp, Oryza sativa
acatggcactgatgtgggcgcttatatggcaatttgatccggaaaaataataaaccccgtgggacccatatgtcattttcacacaaattaataaaagaatggcgggcccacgtgggccccacatgtcagtctaactcacccccctcctcttctgcttcctctctccccatctcccctctttttctctctcttgcgacgacggcggcggcggaaatggagaagagtggccgccggccatctcgctcttgcacacgctcgccggtagagtagggagctcgcctagctccttcccaccggtcgtcgcccttgtccccgatggccgccgtctgccgcccttctccccgatgaccgccggcgggagaggagggagcggcgccaccaatttcaccagcgccccacagcgacggcttgccggcgccgctcgccgcggtgacgacgatgaccgtggatgtggcggcgccagcgctggcctcgacgtcctctgctggccggcgtcatcgtcgatgacgacgacgactcgtcggaggacgacgcgccgtcgacatacattccgatggcggccttcctgacctcgagcacgaacagcagcagcgtgaaccagacgatggcctggaagacagagagctggacaactgttagcattatttttgtgtggcagttagcttcgtgcatgcggctagctagtggctgccgaattaattggatcgcgcgcgtgctgcgtgcgcgtacgatgcgggcgaagtttgtttgcttagtggtgtgtctgttgggctataaaagtcatgtattctcatgagttaagtgccaagtgaatgagaaaaaactagataaggtgttcgttgtcgagaaattcttctgtgtttgtccacaaagattttcgctccagctagttgaagtgtgcgtgttgctgtaatccttggccagagctgacaacgacgagctgctgtgcccactcgccgtacatggcgcgcgccatgggcacgccgacgatgagcgagttggtcagcgtggacagcgagaagctggtgatggaccagcgacggcgcagccgcctttgctcattgtagcgcccgttctgtcgtggcgcctagtggaaaaattatctcttaaaaaccctaattgcgaaatttatttccttgcttgtggtctagtgtccgtgccatctcaagatctcaatccccgatctatcgtcgagttcaattccgaatccaaatccatccaaatcaaatttctccgcaaaagtctattttgcctcccccgaggtcgatgggccgaatctcgctcggcccatctcccccgggggtggcccgacgggctcc

SEQ ID NO: 58070 - DNA, 39085 bp, Oryza sativa
  unsure (1)..(39085): unsure at all n locations
cttcccccgatcgatttcttcccccatctcgccgccatttccgatcaggagcggcgcgatcgagatccgcgcgttttcgctgagccgagcaagcacggattcgcccacccgctgccccgtctcccgccgcattcgtacgtttcttggattcgtttttttttcttttctttttcttgtttgaaacaattgccatgactagttctctgttcatgttcggttcttggatttatttttcagtgttattgcatcggttctttttttttcttctgatttttctgttgtgggttcgtgctccttcggtgtaggatcgttgtcagtctgtctgaaggagttctttcttctcgagtttcttgagctcatgtgaggattccagggttgcgtatttccgatttgcgagtgaaagatatggcatctttgcattcgcgttgacgattttagtgtttgtggagacaaccagcgtcaggcctgtagtttgtagttcttccactatgatgatgcggtccatgactccatgaggattctgtgagtagtatgtaatgtgttccggagcctggttttaggttgccattttggagttcgtactatcaataagttccagtttttggtgttattgttctaaaactgcttgaaagacagtaatatggttccttgagagatatctgtgtgtctgattattttttttttcatcgcatcaaaagggaattctgatatgcattcagatatgtttctagtgataataatgccagattagttcaccagtaatatctgacttagttcctgtccaattagtagtgttcttttgtgcaagttggtcctagtttcgtgtattatcagtgttgtcggttgtcaccatactttgtgaatggtctgatcttctgatgtgacatgagttgggatggcaaagtttgaccaaagattgttttgacaaagcactaagcagtaagctgcttccatctactactactagtaattccatatctgtggtttgcatatacatatcaatcttgctgttgacccaaatacccaccacctaacgcatggagacacatgctcacacgttcaaagacttttggcaaattctgaattgtgtacttcttggcaggacaggcatagctgttagagcttccatgaggtggatgcaatatctcaattgctaagatctgcggcgaaatggggaggatgaaaggggtttctgagggcctgatcattggaataacagttggagtggtgataggggtgctgctggcagttgggatacttctgtgcttgaggtatcggcgatctcaggcacagataaggagtagtagctcaaggagggcatcgacgattcccatccgcgccaatggtgttaatgcttgcacgatactctcgaactccactacggggcaggaatcgccaagggaggttgaagatcgcggagcatctatgtggctggaagggcctggtaggaagagtgtgatatcagcttctgggatacccaaatatgcatacaagtatgtttccttgcactctcatggttgtttgtactaatttgtatgttgaacaattgatctagttttaggattagtgatgggcaatttgtttattactgaaacatttggtaatcgattcctgttaactttcaaagtttagtggttgtttatcctcctttgacttcccacatatttctttacctactaattcttttcttttagttttggactttttttttctgaatgtcacagtggaagtgtacattaggaaagtggaacctggagaacttatagagagggggttgtacaatgagattttgcaatatttatttctagcattctagatggggagaaaactggtgtgaggacaggaaaacatgtcaaatatgcatatctggatgtaatgatcgatgatatgtcgaattggacaaccatgttggaccttattgtggtcaatttcaatataattgagttatatattcgatgaaaatgtgcttcacttattaacagttgaccatagcatccagcctcactcaggtgttttggtgaatcaaactgaaggccgatgtctctcttttatttttcaagatcaatagtttttcatccaattaagaccaagttctttttagttgataagcaaatcttttgaaaccatgtattggttcatttttgttgacagaggttatctttctaaatcacatcgagaggaaacatttagttaattgtaggaattgtacttcccacgagatatgcatattttatatttgtaatttcttcttcaatgagtctgataatttataaatgtaaggagggtaaaattaaaccactaaatgtcagtaactattagacatcaaaggagacttttatatcttatgattttaagttcaacaagaacatagaatttgctgatataaacttctctcaaattttaccggtaattggtgcctcacatattgatacttccaacacaattattatcactaattttttgctttctacataattgtgtgccattaattttattttattttttgcaagacattcataaggtatcttgtactatacactttctgaagttcataattttctctttatagagagctgcagaaggccaccagcaatttcacaacactattgggtcaaggagcctttggtcctgtttataaagctgatttgtcatctggtgaaactcttgctgttaaagtgcttgctaacaattcaaagcaaggtgaaaaggagtttcaaactgaggtaagccaatctttatgcgccagaaactctgactgcttggtatttatttgatagactgttaatttcaggttttacttcttggacgattgcaccacaggaacctggtgaatttggttggctattgcgctgaaaaagggcagcatatgctattatatgcattcatgcctaatggaagccttgcatcgcacttatatggtattcattatctccatatgatagcatgctatactttcttgaaagaacctgtgccctcagttttttttttttttggctttcttaatatcctttttatggtttaggtgaaaacattgcacatctccggtgggatttgagggtaaacatagctctggatgttgctcggggcttggagtacctacatgatggggtaggctgttgtatttcataattggaagcatgatacactatgaaatgcaaccagattccttgatctcattcaactctagcgcaggcagttcctccagtagttcaccgtgacatcaaatcaccaaacattttgctggaccagtccatgcatgccagggtatgtgaagcatctctgctacccatcatgatatccatcagatattaagcacctattcatcaagtcagcgtctagtttagtgacatggtcaacgtagtacatattaatgcaattttttgaagaaattcgcaaaagtttagtttattaacctatgtgttggtagttcaaaatacagtacttcttggataacactggatatggtgtcttattgtactaaaatgttttattctcagactaatgagcactttctgttggccaggttgcagactttggattatcaagagaagaaatggttactcgaaatggagccaacatacgtggaacttatggatatcttgatccagagtatgtgtcctcacgatcgttcacaaagaagagtgatgtatacagctacggcgttttgctgtttgaaatgattgctggcagaaaccctcaacaaggtctaatggaatatgtagagcttgtaaggaagccccctacttagttccttactctttttgttcaagaatttgttccttactcttttttgttcaagaattgttttttctcagaacattaaggtttgtaattgctgacttacaatgcaatctatgatcaggctgcaatcaatgctgatggcaaaactggatgggaggagattgcagattctcggttagaaggcgcattcgatgtggaggagctcaacgacatggctgctgtggcctacagatgcgtaagccgagtttcccgcaagcgcccagcaatgagagatgttgtccaggctctgatccgtgtggcgaaacacagccagagcaagaagcatcacaaaaggaggcctccaccaggtagagcagacgatgaatctgtcgacttggaagcatccgaggttcaatcttcgctctccggccatcagagacaagaatcagttgggagtgtctctgatcttgcagatgtctgactgaaattgacaacacaacattttcggctgttcttgttcttggcactttcttcttttttgtctgtgcaattcttttgttttgttgatattaaaaatactaggatcaaggatgacacaattggatagagagaatgcagttttgagcattagtggtgactggtaactggtgtatggagagatgacaatttgtaagtgtgatgtatagacctgctttgtaaccactctgataatagaagctgattgttgccttaattgtcctttgctcatctctggatatgatgaacttctgaaagaaaacagtggtttcccttcacaataatgttgcgttcatgaagaaaattagctcagtaaccatatgggtgggcctaatactgtttggactggctggtgggcccgaggttgctttcttgtacagaatagtacaaagttgtaaagaaaaaggaaaatataatcaacctaaagattgttttgaaatggttaaaaattgaatgaaagtgtttgacaaaataaactgtatttacattcctctcgagctatgttttcttagataatttgataaaagaataacaattcacgctataccaactgttggtactatattctttgcaaacatataatagatggtataatttgtaaacatatagatagatggtaaactcatttctcccctaaatgagcatgtttccgtggcaaataacacaatgtcaagctcctagggcaaagaaaggtaactaaagcacaagtatatcaatttcccttttgacttcaacacaatacagaactcgatcgatgcttccatgatttgcaaaagctgaatcacaaactgaatggaaaaacaacaggttaagaaaaaaaaaagaaggaaagaatggttggtgatcaggtgatgatctcgtgtgtgataaagtatcagcttgctcgtagcatgatctctaaggaagttcgtatgctgcagcgttggcggtgacgtagtaggcgacggtgaccccggcatggacgaagcacaggatccctccgagatccagggtatggccttgcgcaaagctgcaatttctccgggggttggagttgcgcatggcaccggcgagcagcagcgagaatccggcaataagagcaagcctgttacaacatcgaacagtccatggtgatgtcagtctgcaagcacaaaaatttcgttccttctttttcttttttgaaaaggaagtttctttagtcaggatgtatacgttacatctgatactatgaccttaaaggagatgatttaacatccgagctatacaacttacaaaagggagggtttcaataaaagagaggggttggttaccaggagaggactatcagagtcgctgccagcttcctcttgatggaagcccggatgaactccatctgagagcagatgcaggcacagcctccgagaaagttagccactgcgtgggcagctacaaggagcactgcagccgcgaggcccaactggtatactttggaggatgattgctcacattcgatgaacaacatcctcaccgttttaacctgccaataagaaacaccaacgatcattcatttagagtggaaaattgacaaagaaatgcatgtcagctgtctttggctttttcacattaacaaccagtgaaccactattcaattagagtggaagatagagttgcaatagctgaaaacatccattacatgaaaccctttcattatatacattgaatacatctaaaaaagatattgtgtattgcgcaaaacttcgatgtcataaaatccctttgtgaaacctagaaaaatggaaaccaagatttgttttcataatatcttggaatagtaccttgttttgagcaatctgagcctgaagtcctagtatgccagcagtaacatccagcgctaaaatcaccacacagacaagaatagcagccccaattgttgctcttgccatcgcagcgtgttctcaaacgtatatcttctatcagccgagagaagttatggaagcaggataagctgagagcagttatgggaggaacaatcttgtttgcctgcttacaacgaaggaggtgtacccctttttattggtaatcggtgaataaagagctgagagcaaaagtagaacaggagaatttttctccaactatgatgtagttatgaactgagtagaaattagctgtcaatagatgctgaaagtattatactttcctttgatcctttgttacatatgagctttattccttccttaaaggacacaagtaaagattagcatctccagtgtgaaagcccatctgtcacatattcaggccacttttgcagattctgcttttacagaaggtctgtgaagcgtgtgaaaacatggggtaaatatagatctgatcatgctcagaaaaataactttctattgagggcatcacaaaagctagcttttcccccagtgataaaagcatatgatgttcttatcagcaagatatgcacagaaattttgccgacagtaaaatatctcatagaaagataagcatacaagcatatcggtgaaaatcaaacttgaattttactctctcaaagaaactaaaagtttccaaacttaccaattaccaagtagtccgcacaaacaattgagaaatcaacagactgctttgtcctcattaaaccatgctatttccagtccagaattggtttcagaacctctgcaaatgagcagctgccagcaaaatatatgttagcttacatacaatagaatagacaatattgattacgcagcatcaacataagcaacatataccacatctgacaaattatacaatcacatataacaaaaacgtgtaaaagaactgaagtttgctgatgggtcatatgataatggtgaaagaaaattttgcccaagaaatagtgctgcatatttatggcattcagcatagccattaaaaaggaaaacactcaagcctccattatagctctcctacctctagttatagtgccaagtcaagaacacatatgacaaggaaaaaaactgttcgatttaggaatacctcatacaacaatacaaagtctttgattaatacaaggataatacattgtcaggagtgagacccagttggatatacctagttaccagtagtcaccgcaagaacaggtcccgagtttgaagtggtgaaacctactaccatcccttatgacaatttccctcttggtaacttgtgttacaaacttcattaccttgtggcagtcatggcacaaccgatggcactgggtgaccctcaaggtagtagacaaagatgtgctgataaggccaaaagcaacggcaagtctttcgctatggtaaactttcgatgtcttttgttcatcaggaagaatatcagggagcaattcattctcctcagcaacataaccaagttgttttatctccttcaataatgaatctaacttcctatagatttcagaactttgtggatggagactatctttaaagaaaaacctgtgatcttttttcctaacagtaatccagctacaagcagcatgtatacataaacccctcctcttcaaagtattgacaacctttgagacctcagtctgtctcccagagttaatatacaagttaagaagctcaacataattatttattttctgaggttccatcgccaacagttgctcagcagataatctagcaagctgcaaattcctgtggatcctggaagcagtgagcaaggcaccccacatgttcgcggtagggatgaacggtgctttccttatcattgaataggcttcatctaatcgcccttgttgaccaaaaagctcgataatacaagcataatgcatcgcccgtggttttgttctttgattttgagtcatcaactggaaaattctcttcccttcctcaacaaagccagaaaatctgcatgcatttagtacagctagaaatgtaacatggtttggagcaattccctcagctattagctcctcgaacatctcaatagccttttgccccatgccatgatagccgtagcctgctattagagcattccaagagatcaaattcctgataggcatcctctcaaaaacattccttgcatcttccatcagaccccatttgcaatatagatccaccagtgccgtgttcccgacaatgtccagaggtaaccctgtctgaatcaggccagcatgagcttgctttgcatgctccagcaagcccagcctagaaaaaaccctgagcatcgtggagaacgtgaactggtctatgtcaacaccaccctcgcacatgctgtgatacaaatccaatgcctcctcactgcatccatgaagcgaatacgacgcgagcatggagttccacgctacgacactcttctgaggcaccccgtcaaacacccgcctcgcctcatcaagcttcccgcacttgttatacatgtcgatgagcgcacacgacaggtactggtcctcgtacatccctgtcttggcaacgcaacagtgcagctgctgcccggcacgcgccgaccccaatgccgtcacggcacggacggccaccaccaccacccttggcgcagcatccccgcccacctcctcccacagctcccggaacagcgcgagcgcgccgcgcgggcgcccagcgtcgatcagcccgcccatcatggtgccccaggtggcctcgctcctcgcgggcattccgtcgaacacctgccgcgcctcggcgagcatcccgcacgcgagctgcatccggagcacgcggttccacgcgcgctggccgggctcgaacccggagctctcgacgtgccacagcaccgccgcggcgaacccgggctcccgcagcgcggcggcggaggccaccagcgcgtcgtacgtggacgccggcagcggcgtgaacggggcgcccgcgcgcgccccgcggaacgcgtcgcgcgcctcgtcgtgccgcccctcggcggccagcgcctcgatccccgcgcagagggaggcgagcgcggcggcgcccagctccctccgccgccgcgtgtggtggtggtgggagacgccgggctgctgctgctgcggtggcgggagacgcgggcgaggcttgagggcttctccccccgccgccgccgacgacgacgacgaggaggtggaggtggaggtggaggtggccttggggaggaaggcatggggggagtggagaaggcgggggttgcaagagtgcggcgagctgcggctccatggatggggaggtgaggtcgaattcgacgggattatgaggaaatttgttcaaaaatggggggaatttgaggtgaagtttgcgggtttgggaggggttttggggtgggtttggtggattggagtctgaagaggaggaagccggtgaggccgtgaggggtttatctgccatcgcgggaggaagaaggttgggtaccttggccttgggctttgtctcactgacatgtgatgcggtaatgtggggccggacagtataaggatggcccatttccaggtattctttgtttgatcttaggtttattggcttagacttttaaatcagcttattggcttatgtgatttataagctggtggatttaatgttttaagtttaatggtggagtcatgcatctatctcacataagcaaaaaaaaaaaaaaacctagcttttggcttaacagtgttagagtggcttatggcttcaacaaagccaaacgaaaaagttgcttgtttgtttaggtttagactttttgacttataagttggtttataaacctaaacaaagagggcctcagtccatgatgttctctgtactccctccgcctcggaaaaacctaatggaaggggatgttgtccctcctatagacatataagtacaatccaaattcattatattaggagagatatctcctccttggtttgtatttttttaacggagggaatagtagattttgaaaagttgaatagatgttggtagcgagaaaaatctttattttgtttgtgttggctctaccgatagtttgtaatggtagatccaagaagtttcaagggacccttaaatcttcaaatagtttgaaggggaatgtttgtgctaagcttagttgcaactttttatcagctttttcttccttttgcataaaatctgatggattttttttgacatatttaacgggctgtatatcattcatgcatataggtggagaatcagtaccacatataaccacctctctcttttcacaatattgaaaataagagatatgtacatacctataatatagaatcgcaacatgatgactatttcgcttgcgacttgtgacagatttttcgtccatagaattttgcatcaagattatgttcttacagggcacttacactaagttccagtacactacacttagctacaacttttttttctctagatttaccattttgacatatttatcgttttattttgttttatttaaaataggttggatccattgatttaaagttctataagatttaaagttctaatctgatcgaatgatcagtaggtagttccattttaaataacatgttgatggaaacgccaagaccatagccaactcgatgaaattcaatccaactcatacatgctacctcagggcttacgttcatgccaccgggctagagtcatgcttagttgactcagatgcgtatatatgtaggtgataggtgacatgcacccaaagttaattgatgtaatacttaactatataatcatgcatgcatgctaatttaattagtcacctgacctaattaaaaaaccctattatagtcacatcacttaccgcaagatatatgtagggcagtcccatccataatgatcacttgcaattccaaattagccgataaaatctttttttaattagaaacaagtaggttatagttaatattaaataagaaaagatattatgacctttttacatgctcattccgtctgtttttctctgtgcataaacgcacaaagatttaattggcattattgtagagcaccttgaattagagatggcagagatagcaatagggacccgtgacccgacacctctaatcatgctcttgtacccatgggtctactgacgggcgaaaactcttactcatttagtatgtgggtatggatccgttctttacccacccgtatcactagcccgtgggcgaaaaaatccatagattaaacctaaaactatgagtaacataaaactcatttcacctcttaagcatttgttctagtccagtatttgatttcttgattatgttatgtgtataatttttttactcgtatttgaacattaatgttaatagcattgttgctagagaaaataatgatagtttatatgtctaatatggctaattacagtacaaaactataaatgctacaagtcaattatatgggtatccattatgtacccgttacccgcacactgtgggtatggggacgattttgtacccgcgatgggtgtgagtatggggcaaggaaacctggtggatatgtagtgtttccatctctcggatacattggtagaatgtgaaaattttacaggtacgacataccatgggctgctagtttgtacgtcccaatttagaaaacatcctgagtgaaaacgaaggctaatatactggattaattcatgtttgctactagcccccaaagtgcaattggcacataactaaataaataattccatgtcgattatgacacttgagttaaacaaacatatattactccttatcattactggctgtaaacatcaatacatcacactactcatggaggcatcactatatttttttaaagaaaataagtaatatagtctttaatcaacccacctaatatcaaatgtttcctccgatttctatataatttcgattaacgccacgccatgccacattcataataaattcgttttactaatttttgtaatttcgatttcataacatcaataccaattcaaacaccacattttgaaatgggattctctcaaagcaatggacaaacattaccaaacagtcactaattctactacaacatgttcgtatatatttttttgaggtttttttacagcaacatgtagccagcgaaccaggggatgtctgccatccggatctggaccaatcacgtggcgccacgtaagcgcaagccgcgccccacacgcccacctactcctctcccatccactcgcaaaaacaaaagggaggggaggagacgcgaatccacccacgcaagcgcggcggtgggccccacctgtcatccacccacccaccctcctaatctccacccaaaattctccaatcgcgaggcgaggcgaggcgaagctcctcgtcgtcagaatccgcgaaaacatcgccaccaccacgagaggaggaggaggagagcgcggcggcgatgtccggtaccccggcggacggcggcggcggaggcggcggaggcggcggagggagcggggacgactggttcctcgactgcggcattctcgaggacctcccggcggccgcgtgcggggccttcccgtgggacgcatccccgtcctgcttcaacccgaggtaatttagccgtcctctcccgtgggacgcatcccctccccgatgcatgcgtagatttctctagttcgtccagcgaatcgggttgagcgagtggggcgattggatttgtgtggaatcggtttgagcgagtggagcgattggatttgtgtgggattagtgagattattattcctggttttgtggagaggaggggaacataatattattattattattattatagtatgtaaaggcggatgcatcttagaacctatattggtctgtttgtgggatctgttcatctatattggttattatttcttttgtagataaggcaattagtacgcacagtaaaaaaaattatgctgcggctaacctggtcatcgagtttggcggatgctttttgtttttgatgcaagatgtacaacacatgccaggattggtaatctagatgtggttatttctagtgtatatggcatcaatttatcttttcttgtgtcgtgatagcacttcaattctacgattaactggctatcctgaataaattgtaagcggtgcggattttagtcatgtggcctttagtttctgaccagtatctctacgttgaacaacttaaagattcgctaattgattgcgggaaatttaacaggttgtgctcaagcaagtagctacgaggagtttaaatggtttttggtatcttattgtgccattttttgagattttcttaaatttccagcatttgtaggctagatttcctattgcgctatggttctcatgtcctttttattgtttttacagtgtggaagtaagcagctatgtgaacaccacctcttatgtcctcaaggaacctggcagtaataaacggtcaggctgctttttcactttgcgctaaagcatgcttgttcttataatagtttattgtgttcaaaagtcagttctttaaatggtgattctattgcaagttgcagtgtaaggtcagggtcttgtggtaggccaacatcaaaagcttccagggaaaagatcagaagagataagatgaatgataggtacatcatacttcctagtttttctaattctagagttcggaagaaagactgaccctgattttgtaacgttacttatgcttcctaggtttcttgaattggggactactttggagcctgggaagccagtaaaatctgacaaagctgctatcctaagtgatgccactcgcatggtaattcaacttcgtgctgaagcgaagcagctaaaggatactaacgagagtcttgaagataagattaaagaactgaaggtgatgcaacctaacttacatccatattccaaccttctgttatccaaaagcttgtgattggagtgcttcttaacaatttttagcttgcggctgatacatttcattttagctaagatgggaaattgggaacacattttgagtgacctagaatacaacttggttgggatgttgcgagcaatctatcatttggcttaaagctaaaattcttttatttgtcacatttagctgtttaataggacttctcatgcttgcgttgggctattgtttgccaatacggcaacacataaattagctaatcatatgatgatgctgcatagtagtgtggagcacaatgcatgtattgttcacatgatttccagcttttgtaagatgtggaagtggaactgtagggaacataagtgtcctatcctgctatgatctatgctccatgttttggagaacgcccaactagttattactcatgtttgaaatgatgatatctcatggctaatgtcttactttcttccaatttcaggcagagaaggacgagcttcgtgatgagaagcagaagctgaaagtagagaaggagacattagagcagcaggtgaagattctgactgcaactccagcctacatgcctcaccccacattgatgccagcaccgtacccacaagcaccacttgcccccttccaccatgcccaggggcaagccgcggggcagaagctgatgatgccttttgttggatacccggggtacccgatgtggcagttcatgccgccttccgaagtcgacacctccaaggacagcgaagcgtgcccgcctgtcgcgtaatgcttcatcggttgcgttatgtgaattaatcgtaacctgaaaccgcttagttgctcaatccattggttgggcatcgtcgtccctgattcacattcactattgttcttgtgttagtagttcgtttttgtatggaagtaagctgacatttgtggcgctctatagaggctactgcccccttttaatgtacaatacaatttttccggagaaaggaagaatgctcattcttgttctctgcagacacccggtgtcaaattcagtagcatcatatacaccatttcttatcacccaaattctgtttgtcttgtatgctgttttatgtaatttaaccaatcgatacaaatcttgttaaaagaaatgaggacatgtacaacactttgtgctaaagaaaccatgatttattttatcaattaaactatgatgagagatagcagcatcactgtagcagctgccatgatggcaagtgcagtggtggcactgcctgaagatcccggagctgaaccgtaggagacgacgccgggggtggagatgatcgtcggcggcgacgagccgtcgatgcagatgccgcccggcgtgccgttgccgtcgccgtcgctgcccggcggcggcggcgacgggattgagcagagtgtcctgacctccagcttcatgccggcgtcgcagtgccccggcacgccgcagatgaagtagcgcctcccgaggcggccgagctcgacggcgtcctcgccggtgcggtggacggcgatggggctcgacgccgagcatgagaggtagccgtccttggtcacctccaccacgtcgtgcgccgccgctgagtacttgaacactgtaatgtaaaaaaaaaaaaattcaattttgttgttttggatatcgacacggtcttaagaatacgtatttttgtagcaaattctagcagtataacctatatagtttttgtaagttgtaaaatctactaaatataaatagtttaatatcatttaggaggatatatgataaaatgcaaggtgattattaattagttaccaagcttgtcgtcgaggcggaaggtgatggaggaagcccaagaggtgtagttggtctgaagatcccacccgccgttgggcttgccgacgccgtagctggcgccggacgccgtcgagaacgccgccgccgccaccacaacgacggcgagcaatgccattctttccaagctcactatttgcagctaattaaatggatgtcgaatatattcgaactactcaattaatggcactgatcgatcaatgatcaatctaatcgagagctgatgggaattgttaagacgtgtgatgattcatatgtgtctcggtgcatatatagcgttgatttgattgcagattatggtcgctgaacgttgctggattctgtcggtcttaattagtcagcatgcgtgtaccacatggtcattagttagctagcgatctcaattagctttctcatgataaaaataagggagcactagtacttagtcgcatcgagcaggtgaaaattatcattgtcagattattttcagaggacccggtcactcgtgtgttgagtgtctcaaaagattttggaacttgtctcgtatatgaacttaatttaatcttgctttctttgacaagctaattctgctgctagaaacttccaaaattttaatttgcttagttaactttgaaaaaattgtcgctaggcctagctcccgctaatgtcgcggtctttccatacaggacttgcgactgtttcgttaattttaagcaaaacttgccctactaagtaatactgtaattggtaaaatttaacatcgctacattcgatatttaataggggacgttgtttacttttaaaaagtcttttacctttctttttattttttaaaaaatacacaatttttatttattttgttgtgctttagtttatcattaaaaatacttctttaatactttaagcatgacttacgttttcgtatttgtataatttttttaaataaaatgaataattaggtcaaaagttaacaaagtaatctaaaaccgattggagtattcccaagtctttaggttgaagccaacacttaccaaataattaaatccgtaaggttttggttttatgctcaaggtttcaaggtttgttactaccaataaattgaaatataaacagaaaacaaaaggtagagaatcaaacttatcccaaatataaagaagcactagtaatgtgatgataaagtaccagcgatatgatggtggtatcatggattaaattttagttctcacaaatattacgtacacgtggatacgtttatattaggattttagtgagactagtgagttgcttcaggtttagtgaggctatgtttgaacttgtgtaggactgtgtatctttttgagatcacggatttcgtgaggctattttcgagtgtgcgttagtggttttgtgtcagtttagggtgtgtcttttaatgatgaggaggaacaactaatttgcttagggcaagtactataagcatctgagtacaaactcctaagatgccacttaagcttaaataatgaggtggaggagaaaagaaagaagatagagcatgagccacctctcatgcaagggcaacctcttcacaaactttaagaaaaaaaagaaagaatgaggttgattggataagagtggataaaataaatagttatgttgcattgtgtcacaccccaatctggcatcgccgtacaacggcacctgacaggaacgtgtcgtaggaataacggcgcgaaccgcttcctacgaaaccgcgttctcagtaccagtcccaggacatagtgctggtacccacggtgataaatatgaatcattgcaaatccttaaaaaaattagaggacttatttaccttaacttaggttgcagctcaggacagcctgagaatacaaccgacgacgcggacggggaaacaccaacagcagtagcagcagcggaaccaacgaactaacacccaacaccacaggcaacggctgggaaccaggacaaaaccctaatcttcgcttcacttcatcttctcttcgagacagaggaactatatatatatatatatttatatagagcaagggtgagtactttcgtactcagcaagccatgggaattaagtgtttaatgcaggcttcaaaggaaaggctgttatttttgcaattgattttatttaaactcctttttgaaacaactaagtgagtgcttctcaaacgatacggatgagacagtgcgtctcgtccggtcggagtatgtgcaatgtatcggtctttgaattggtcaaggttggcatccggccaatagctttcaaacggccacccgggcctagctgatcccatcagccatagattttccaaacatcgatcccattccacaacagcaatttcacaaagcagtagtcaaacaaaactacgctaggaatcacctcacattcgcccatgactgtgggcacggctgttcgaacagtttaataacctctgcagagggggtacactttacccacatgatattactagccttggtcacctagcccgtgtggatcagacacgtttggtgacttggggctttcacgacaaggcatttcaaaagccgacacaggttcaccatatgccaacgagaggggtcccagaccgacaataggttaggtcccagaccatactgtgccaggaagcccgggggttctccccggcaccaccccgttgaatccacatgtctcttggcatcatggctcccccgattagctaattactcagctaggggtgtcctattccacccatgtggttgtacttatcttatgtttggatgaaattccaaggaaacggtccttaagtgcaagagcgggaaaccgtactcctggaacgtcctccggtccgcggttttggaaattcatttagtttgcaagcaccgacccaggtgtcgggttttccaattcttttgtaaaaccccaagttttacccatcgttggatattttaaatttgaagggaagtgttccgatgctcgagcccgaaggcccatgcatcgaagcacaacagtcgacaaaggaggtctaagtgttcaataattcaaggagggtaattgcagcaattaggattggggccggcaggctatctcgcaagccgcggccgaaatacttgtgttaaacctattcatgcaatatttgcggaaaagaaatacttagatttaaattataggtgcaagatgatcaaaggtgactttcctagctcaaggtcttcacggagcttcacgaatcttcgagaaaacctgcgatcgacgaaaatccggtaaccgcaactatacgcaaacaatcaaaaacctaaacaaaagaccaaaagaaagatcctatttagactaaataatagtgccattaaatagatctcaattttacggaaatactagaagtggaacaaagtcaatcggacgaatggatcgagaaatatgaatttggaagcttaactggaatttctggacaaggaaatgatttattggatttttctagaacacgagaaatggtttatggaataatattctcaagaatattattgatggtcgctgacatgcgggaccaaaggaaatgattcatggaatttttggaataaggaattgatttatgaaaaaggaaaaaggatttattaatccctttggataagaaaaggaaggagggataggaatcagactttcctgagcggcttggcgcggcccgagaggatttgcgtggctcggccgagcttattgggccggcacgggctacagggaggcggcccaagagaggggcgcggggagagagaggggaaggggagccgggtagaccgggctcacctcgcggggtcccgagcgggcccgcttgtcggtgaggcggtgcacgtggaagcggcgcacgcgggggcgggcgctagggtttcgggtgtgcgtggttcgggcgcggcgcgccgggtggacggatggtgacgggcccacgtgcagccgcacggcttgccgtggactgcgcgcacgggggggaagatggagggagggggcggctgataggcttggcccggtcaaagatgaggtggcgccgacgtggcgcctacgtggcagtcacgtgggccggcgggaggaggaaaaaggggaggccgagatggacggcggacggcggccaagttcaccggagctcgtcgcgacgattcgagagagagggagtacaccggaacgatgggacggacgagaggaagtgagccaccggatcggattcgccggagggaggccggcgacaacgaatcgcggcgacgcacgccggcggcgagaaaaggaggaaacttcaccggagcaacgggggttcgattaaaaggagggggagcatatccggggttcaaggaatccgtttccagcgccggatgggacgaaggagtaccaaggagggccggcgacgagcggcggcctccgggagcagacggcaatggcggcgaggccatgccgggcggcggcggggctcggggcggcgtccatgcgcgttcgggagtgccaccgagctatcacgcagactagagggggcgagggagagcgaggaaggggaacgggaggaggcactaccgagccgagacgggcgttgtgacgagcagccgacggcgcgggagcgagctctccggcctcgggccagggaaggggaagatgacggtgcccggagtcctcttctcgcgtccttcgcacgcaccggtctccctggtgcttcagcgacggacggcgtgggcgactgcagggcaggggcaacaaggcgcgattggcgacgagagaaacgagtgagggagatgggaggggctcgggtttttataggtggcgatgtcggtttgggagaaccgaccttaggacggtcaaggagaggagctggcggtcgggcgtggtcaaggtggtggcaggcggtgacgctgatggtggttgggcaaaacgaaaaaggaggaggagaaagggagctctgctccttgctgttttgggaaaagtttaaggagggagagggagtgagagaggggctgcctctctcggctttggaagctagcggcgtggagcggcagagcggcagcgcacgacgcaggcgacgccagggcttgacgcggcggcaaccgggcggtcggccacgcgcgagcgcgcgggaacgagcgaaggcggtggaggttttgggcggcgacggagggaagcggcgtcagcgcgagagagagaaaacgagagagagggagatccttctctcggcgacggctcgtgcagcgcatgtgagggagatggcaaaggggagagatgggctggggagtggatccggcccatccaaaacacggaggaggcaaaatagacttttacagagaagactgatttggagtggattcgaattgaggttttggatttggatttcgaatttgatgcttggtcttagggacacaaggtggagtcaaggaaggaactcaaatgggaatcgagaacaggtatttggcgaggattcaaggaggcgattgaatttcggagacttgaatcggaattggaattttgaggtgggcgattttgatggcaacgagggggaacaaagatggagattgaattgagatcttcacacaaagaacggaatttttgaaattaggattttgctgaattagtttttaacgtctcacgaaaagcggagcgttacacattggagctagcatattagagacaatatggtgtatgagctaccctctaaaaattaattgatgagatagataagtttagatgtgatagtcatatctatcataccacttgcccttaccatgacctagggcgaggatgctaccttcatggccgagcaacttaggaagctagggggtattcgtacaggggcagccggagctaggagaggagagaagatggggaaggagaagcccaagggttatttggtgccaaataatattttagcacatagccacgtatttagaatgaaattttatcgattctcatttggcatttggataaaaccacttttcagttttcacaattagtataatcccaatttcctttcaccactcagggacctaattgaaaatttccaatccagcaatgggcatgaaatccagcaatacgacgtatattgacatctctcatgagctgaagaagctcctccttgacaaattgttactgattggaagcataccaaattcagatggtgattgggtcatgggcaagttcaccggccgatgggcaaagttggagctccagagcaaaatgcaatcggaaagcagttcatctacagtttgtgctcaggaacagcactgagcatatgcagccaattttatgtcctccgtccatactccttatggcgagtatagttctaaacttttttttcaaacttccaactttttcatcacatcaaaacttttctacacacacaaatttttaacttttccgtcacatcgttccaatttcaaccaaacttctaattttagcgtgaactaaacacactggcatatagcaacggagatatgcttcttccgcgaagacgagacaggcagctcatcatcgtcatcatctgcatcatacagaggcccaagcagagaattatccaattatgtgatgcacctttctgcaaagtatatcatgtactccggaaatgggtcgggacgcagccaagagatatcacattattttcaacagaaaaaaattggcggctttgattttctggtatatattcagtcagtcatcctttcaacttgtgatatcccacatgttagggatgatcaattcaagaattctcatgaatatccatggcaatttcataattaccgtgttgctggtgtgattgaaaatataaatactagggaatgaactaatatcaaataaatataagggatgaggcttcaaacccaaaccggctagcccaccactttgtagagttagccggaagaaccctgggtgtttctcgttgctggtgtgattggctctgtatagtgatagttgtaggtgacatctctgaaattactcaagtgattctgaataattaaattaccttgacttccactactatctcataaattaaacaattgatgtggattcaagtgaaaaggatcacataatagaatccaacaatatatatactgaatcaaattacattcaacaaagaattgcataattaagtacaacaattcgagcagaattcatctcaggaaaaaaagaatataaagtatgatgaatctggtatctccaaaaagaacaaaaaaaagagagaacaaatcaagaactcatcatgcattcttgtcactctaataaaagaccatgagaccagcggccatggcgccaacgcccagaccaacaagagactcaacaacaccacccgacttgctcgccgagctcgatggcgtcaccggccggccaccgttcaccggcggcaacgccgccggcgacggcgacggcgacggcgtggtgctactaccgccaggggcggngggggcggncttaccttgacggcgagctttatcccggcggcgcaatgtccagggaagccgcagatgaagtaccgcgtgccaacggcggcgagcgggacggtgtcatcgccggagttgaaggtggtgatggggctcgccgccgagcaggcgtcgtaaccggccttggtcaccttcacgacgtcgtgcgccgccggcgagtacctgaacacgagccggtcaccggcgcggaaggtggcggcggacgcccactgcgcgtagttggtgcgcgtgtcccacgacccggccggtgctcccaccgtgtaggtggtggcgcccatcgccgtcgtcgcgagcaccgccgccgccgccgccacggccacgacgaggagagctctggctgatgctgccatggccgcgacgatcgacgatcgaggagatcgatggagcttggaattgggaggagatgatgcaagaaatgagatggcaaggagacgatgggaagtatgtgtatatataggtgatgggtgattaattagcttaagctaagaacatatataatacagattataaatcagctataatcacatatagaagagatgagagacgaaagaaaagagaagactatacagatttataactagctgtagtacagactttaaaatgttatatgtgtataacaggtggaccaattattaatgatgtattatatatttatagttaattattgtataaattaattattagattgatataatttagagttattaattagctatactattaaacttgctttaatgcattaagctaattaagcgcgtggattggcagggatgagtgaggtgaggtgaggtcaatgcaggggttggttggtcaatatgtgtttgactagactcgtgtgaaagtgtagttaattaattaattaattgatgggtaggtgtgttagaatagtcgtcgagttggctgctcgactttggtctgaatcacctgattgaaatgatcaaagctgcatggatgtagactgactggcttctagatgagaattttctctttctggatggtttttttttgtctttttataagaacaagatggggtcttaatttgattatctaccaatagttaggaggttttttccccctcgagataatgtagctgcataacatcggcgtagttacacacaccacatataaatatccacgaatgtatccactaacacacatctacaagctttgctataggcagaagaaaaaaaattcataatatgtcatatcataatattgtactattctataatatttaaaatattatgggggcaatttgtaaaaaaaataattcaaaagcactaatagggtggtagattcgctgccaccactactaaaggcttttaaaggagtataaatgatactccctccatacttgtaaaggaattcgtttaggataatgtttaagtcaaacattggaaatataaatcataaataatgctcaagttgttgagtttgaaaatgtaaaaattatatgaatagatttgttttgaaaaatactttcataaaaatatacatgtatcacttttgaataaatatttttatagaaataagatgtcaaagttgtgttttgaagaccgtgtcgctgtccaaaacgaatttctttacgagtacggagggagtacacaatatgctacgtggacaagtgtggggtgcccgactgtacgaggccctaattttggattgactccaacgcgttctaatatgttccatgacattctcattctgtttttgtacgttttacatcctctccttcagtgatctagcttgaacaaacttgtttttcttccctttgatgatcgttcgatggtaattatagccacctaaaatatccgttgctcatgacggcgatgcgaacacacgtttgaggtgttgaaattatgtttttatacttcgtaaagaaatcagagtaattcatcaggatgcatgcaatgatttcgtaagtttaaacacacaatatatagttacaatgttagcttcctcgatcatccacatgtttatattgtaccatataactacagctgttattagtcatttaatgttctttttttttaatttagaggagcacattagatctatgggtagttgatagttcttctgatgtggataggggatcatcatccacagcgtgaataaggataattttacaataaattgtaaaatatgttgcattaagtgaaaagtggctatagccttggcctatacacagtataatgtaaaacatactctttgcttaattaatcctattttctaaacagagaatttattattggttagcaccagggcatcggatttataggtacggatatttgaaggtttagctagcatatcccccgtttcggtaaaatatggctataggtatttatatttatgttcatatgagccagaggcttttgaaatggaattctcccccttttgtttaattgcaactgactaattaaggtgtacattttaggtgaaaagacaaaattgaagtcaaacaatagtgatgatggtcaaaaacatatatatatagcaataaagaatcaaaatataagcaagctcaataacatgtaaccaaaaattacataagtaacaatatgagctggactaatcacaaacaaatcaatacatatgaacatgatcaatcgatcgccaatgaagagagaacaaaaaatattcttcctctaatttagaaggacatgaggccagcaactatggcgcccaaactaagcccaaccagagatgcaacaccagtggacttgctcgccgagctcgatggagacacaggccgaccaccagccataggtggcatcgcgttcggtgccattgctgtaggcgtgcgcggacgaggcgccattggcgacagtgcagtgccactaccgccggtggcagtggcggcctcgaccttgactgcgatcttcatcccggcggcgcaatggccagggaagccgcacatgaagtatcgggtgccggtagctgtcaatggcacggtgtcatcgccggagttgaaggtggcgacggggccggagctcgagcaggagtcgtagccagccttggtcacctccacgacgtcgtgcgccgccggcgagtacttgaacacaagctggtcgccgacacggaaggtgacggcggacacccactgcgcgtagttggtgcgcgtgtcccacgacccggccggtgctcctaccgtgtaggtggtggcgcccgtcgccgtcgtcgtgagcaccgccgccgccatggccacgacgaggagagccgatctgttggcagctgccatgatcgccttaggatcaattagcagagcagatgagagatcgatcgagcttgcaactaggtggatcagatcgatcgatggaagggtgatgatttgcaagaatcgatgatggttttgagtatatttataggtgattgtttgcattgcattgcagagacagtggaggtgatgtcagtccaggattataggggttggtgggtcaaatgcgtttgactccatcgctcaaagacgtgtgtgtgtgaacgtgtataataattagtaataacaatctaactaagtctgctcgactaagtctgaaacacctgattgatttttttattgttaaatggaccaagtgctcacgcatacaccacacacaaacacccgtttgacacagctctagctactaactccaacttacctagaaaagacacgaatattagggaatgacttaatatcaataaggggtgaggcttcaaacaagatcatctagcctaccatcttgtggagctagctggaatacccctaagcgtttctcaactccaacttacctagagctggagctgtaccaaatggtatagattctccattttttttagagcggagctagcagagctgctccacaaatttgtactacgggggtggagctgggtttttctgccccacagcttcacttcattccaaaagacccactaccctttaaattttcatgtaattacgtgatatgccattgaactacctattcatatcccctctcttcccgttctctctcctcatcttcctccccatcctcctgacggccatcctcctctcgacgacggcgggctgcgcgtgggcagcggcgtcgacaggcggcggctgaggtggcgagtttgtggcgcagcgcgggcggagaagcgacgtttgcgtcggcgacgacatgtagtggtggtgggctggtcgcgtcggcggcggtggctaggacagcaggatgacggcgtcggtaggcggcgtgtggcgtcggcgagcggtggcgtcgacaggcacgagccaaacggcggcggcaacagcagggaaacgcatgtgcggcgacggcagcaatggcagggaaacacatgtgcggcgacggcgacgccctctatgtgttcaacgaaatggctacaaggcacgtggtgacatggagctggtaaatctagccaaacactttttacccacctcaacttctatatgagctagctcccactagagttgaagtttataattgggagttagagtttgtagctctaccaaatgaggcctaatatatacactaataagcgcataccaacaacaaattaatttctaatcctatgaaaattctattgaaattgtacccgcgaatatatatataaccggatgtatgtactaccaatataaacaccaatataaacgatccaacagatccaacagttgagattgatttatctttctacttaaatacttttcagtacaaggatatgccacatcttgtattttttttaattttattttttatgggacgaaggcaatagataacaatatcaaatttaaaaggataaaattatttttgtattataatgtcttaattttagccgatagtgaaacatcattaattggatctttttctctgcttgaacccttcccccattccccatcgacctcttccctaaaggaattataaggtccggctatcagaacggggacatgatgacttgatatgatgggaggctgggagcctagatcactactacaaaacccctaatagggatcggcttatagttaccggattatttaaaaccgacacctattaactgcccacctccgtaggtcaaaaatatagaaccggtacctttggaactataggtaccagtagtacttttccatgccattataaaaaaagtgtcattgattcattcacactccacatatgtttcacataaatcaaactaactattttgcttgccgaccctcaaaataataatactaataaaaagaaaacaatttcaagcatggttatatatatgtgatacagctctaggatagtacttacgcgaagttgtgaacaaaaaactaccaattcaaatacataagttaaattatcaagatactttattgaaatatatgtatgacgccgttgactttttattcaacgtttgactattcgtcttattcaaaaaatttatgtaattatcatttattttattgtgacttaattcatcatcaaatgttctttaagcatgacataaatattttcatatttgcacaaaaaatttgaataaaacgaatggtcaaacgttggttaaaaagtcaacggcgtcatacattaaaatacgtagggagtacatgttagtattcagttacatgttctagaaggtagagctttatgctaaatttctttggagtgtaatatatgtatcctttggcttgaaaccaccaactagtttctctcatcatataggtggaagctggctgtttggtattggttgaaaaaaaagcgagtatttgctttatgttggactctatgactaagtaaaaatgatatggtttttgacaaaacttcatctaaattttatttacagatactttttaggtaacatataggtttcggtttttgacacgactacaaatgtctgtcatggacaaaaacctatacatctctcttttacatgccagaaactactatgcacattttcatcaactttcgatcgagatttactagtaggattgctacttgagtaagttgttcatatcttttttgagtttggtgtctcatttttattatctgctcatcttttgttgtctatttctattgaagcaaaaggcagatttccaatgtttatccattattttaaaaaagaatattgttgagctttagatatggtctatgctttatatgttgttttgtgttgtttaattgctattgatttgtttctaactaaaatagggatatacatatttatgttcacatgagccacatgcttaggagatggaattctccattttaggtggagatacaaaattgaggtcaaacactagcaatgggtcaaaagaacatttatataatattggaatcaaatcgtaatgagctaaattacatgtagcaaaaaaaatgagtaacaatatgagccgaactcatcacaaacaatcaatacatatgaacacgatcaatagatcaactttgaagagagaaaaaaaatattttttccctctaatttaaaagaccatgagaccagcaacgattgcactcaaactcagaccaaccagagatgcaacaccaacaggcttgcttgctgagcttgacggaggggtgggccggccaccgttcgtagggggcatcgcatttggtgccattactgtaggagtgcgtggaagaggggccaatggtgacggggtagggttgctgccggtggcggcctccaccttgacggcgaccttcatccctgcggtgcaatggccagggaagccgcagatgaaatagcgggtgccgatagcagcgagagggatggtgtcatcgccagagttgaaggtggagatggggctggagctagagcaggagtcgtagtcggccttgttcacctccaccacatcgtgcgccgctggggagtacttgaagacaagctggtcaccgacacggaaggtgatagcagagacccactgcgcgtagttggttcgtgtgtcccatgaaccggccggagctcccaccgtgtaggtggtgacgcccatcgctgtcccgagcaccgcggccgccatggccacaacgaggagagctctggctgccatggttgggaagagaggttgaaattggaagcaagagtataattggagatgcaagaaatgaaatggaacttggttgatttggggaggaggtatgataggaggtgtatatataggtgcttgttagttaattaggtgtaagctaagcgcgttaagtgaggtcagtctaaggctttggttggtcaaatgtgtatgactcgatccgctcacactgacacgcgcgtatatataggaaaatgtataattaattaatgataggtgcacgtgagaaaagtcgtgatcgactgctgctgctcgaccgagtctgaattaatttaatgatcacctgattgaaactatcaaattgacagagtctgaaattagttatctaattgaatttgtgtacgtaatacatataatcatcatctgatgtgtagtgcaagaattcgtgggtggtgggtgggggttgttcgatttggcgactaaattttattccttttgttttttaatatgtaactatttttactttaatttggatacgatatctaaccattcattttatttaaaaatttaatttaaatatataaaatataagttatatatccttgaattgtctttaaggataacacaaaacacaataaactaaacaatactataattaattttattaagaggattgtcaaacgtcatatatataaaagtaaataataacatcatatgtttaaaaagatgcagtaatataagtatatataccatgaaattaatttgcacatcagatgggggccctggtgtttgatgtattttattattatctaaaagccaaatttctagaaattaagcttgaccaagatctaaatcggttagttgggtgaaaaaatcacatatacacacgcgagctggtgtgttgaattcacgcgatgatgacttggctcatgctttcaaatttcaaattaaatcgcaatagactagtagcctgttcaagcgtcggttcaaattaaattagttgttagtggaaaatatcagaactaagggcatgtttagatctatttggaatggcaaatggcaaatggcaaatggcaaaagttttggtggtaaaagttttggcattgcaaaagtactagttggtgtttagatgcgtgttaaagttttgccattctagcactaaagtgagagagagaaagagagagggagtggtcccaaagcactttttggcacaatatgctactatggactagcaaatgataaatgccaaattgacaacttttgctactagtgtttagatctaaaatggcaaaaagtgctacaaaatggcaaaacttttgccattttagaggatctagactaggcctaaagacttttccatgccattggttcccacgtatacgcattctgcacatatatcaaattaaccattcaagcatggatatatgattagttatgcaaatatgagctttattcggaaagcacttccgtcaacaaaaagaaaaatgctacatacgtgttcaaacttcaaatacagaacttgacaaaatatagtaattaaagtgttgtgagaactgactttgtcaaatctcctcatgtctctacttttatctatttcagaaaacatgcatgggcccaacttagaccatgtgggtttctaaaaacaaatttaaaaatacgtttggataaaacaaaaatacaaagggacaataattatgtttaacaatattgatgtgtataaactttatacattatgtgtagaaactttttatatagcatcattctatctatataatatttgaatctgaatccaaattcaaattcgaatcggacatataaattttcaatgtataaactttgggtatacaaactttaggtgtacaaacattgggtgtataaactttaagagtataaagtttagttgtacaaacttacttaaaaaggaaagttatgtggtgaaaaaatgaaaagaaaggcggagggcaccgatatccaattacgattttcgcaccattatactacatgcacaattccatcatgcatgtatactacatacacaattctgacatgtccatgcatccctttgtaacacaaaggatggataaatccatataatatttgatatagagaaagctgattaattaatactttcccacaaagctactactacatccacgtcatcaacaaaacatgggtggtctaatttttttccttaggatattgtaggcggttgaattcctcaattcgcaaaatattttattgatccttcaataaacttcttttgcaaaaaaagggtccttccacacccctacctttagggaaaaacatatttcacttgattatgtatatgtggataatcttgttggtgtggttatgcaactattactcgacaccactatatatacatgtctctttaaaaataaagtagaaaccccaacaaagtggttgatttgtttgaccaatgatggttggattagaactatgaaatgaatgttgcatcgactaggtggctaggttagagatattttgcttagaggttgctaagttgaattaatcgagggtagtggagaggtaggtgttggaagaggcaacactagtgcgggagtttgagggatatcttcatggtttggataccccctctctatatatagctcaaccgatacaggggtatcttggtcccttcacctgcaagagagacaacaaatctgtaaaagggaagaagatgaatctggcatgaatcctctatttgataatagtgttttggtgaaactcaattgaaggatggcattatagtgtaactcacttttgatgatagcataatctgaaatttcttgtttgatgggggcggaaaagatggagcactgggattagggtggacaactggatatatgtacatattgattgtcaagatattattaaaataattcatttatgttagtactatttatttacatgttctagaaggtaaagctttaggtatggtctacggtttctatgttgttgtgttgtttaattcctattgatttgtttctatctagctacaatagggttatagatatttatgccacaggcttttgagatggaattgtccccccccttttgtttaatttcaatggattaaggaaagttttaggtgaaatgacaaaattgaagtcaaacgctagtcatgatgggccaaaacacatatataacaatagaatcaaatcataattaatgagctgatgaattacatataacaaaaaatatattacatataaataacaatatgagccggactctaccagagaaaatactcaaagcaatcaatatatacgaacacaatcaatcgatcgccttcgaagagatacacaaagtatcttcttactctaatttagaaggccatgagaccaacaactatggcacccaaactaagaccaactagagatgcaacaccagcgggctggcttgctgagttagatggaggcacgggccggccaccagccgttggcggcattgcgttcggtgccattgctgtcggtgtgcgtggacgaggggtcatcggtgatggggccgggttgctgccggtggcggcctcaaccttgacagcgaccttcatccctccggtgcaatggccattgaagccacatatgaagtagcgggtgccggtagcggtgagagggatggtgtcatcgccggagttgaaggtggcgatagggctggagctggagcatgagtcgtagtcggccttgttcacctccaccacatcatgcgccgctggagaatacttgaacactgcacattacacatgcatatcattagctcggttagatattatactaaagttgccacatgtatcgatcagttcaactcaaacatttaagctggtgagcaaacacggacaatcacctatctgatctccggcacgaaagttgatgttggaaacccactggtcatagttagtcctcaagtcccatgagccgctcggagctccgacggtgtaggtggcgccgagcgccgttccgagcaccgctgctgccatggcgacgacgagtagagctctggctgccatgatcgccatggaatatggtccaattagctatatatcgacttcgaggatcgatggagatgatggtcgatcaatctccaagcaattggcagtagaagctaagctagaaatcgatggatgattgaatgaaatgagatgtgctgggaaggtgtgtatatataggcgttggttggaggtgtgaaattgtgaactgaagcagtagaagtagaacgcgtagaaggtcaaagactctgaagagtaggtcggtcaaatgtatgtaacgttgactcattctctcatagtaagaaaagtactatgtgttgactcactcgttggatgcattgcagacgtgtatggtgagatctagctgctactgatcttgcctggtcagttcttaaaaaaaaggaaaaaaaatgtttggtcgaccaagtctgttgcgttagattaattaatgaaaaaaacacacctgtgaaatgatccaacatgcaaaggacatctatactaatataaaaaggaggagttgtcttcttgcaatcctacagatgaaatcaacatagttaatcccatccgtccatctgcatatctgatctaatctcatccgtccatcgctatctcatcaatcccacctgattcctctcccatgctacagtcaaatcatcaataccccacaccctaacgtcgctcggcattccctcggtcccactcccacctcccaccaaaatcaatcgcgtgatttcctcccaacccccaccacgcgattttctgatttcctccgccttcatcgccgcctccttcccactccgccactccgggtggtgcctccctcacatcggctcctgtggccgctcccgtcttcgccgccgccgcccgccggtgcctccctccaccaccacctgggccccgcctccttgccattcacgaacaggagtttcggcaggttcgtgcgggcgccgtcacgccgccacatatcgagactcgctgtccgttcgccgggtagcccgcctcctccacggccgtccagtctgccgccctcaacgccgatcgcgccgtccagtccgcccgcaccctctgccgccatcttcaaaaggtatagatcccctcctcctaccccttctctctcttcctccatctctaatatgttctctctatccattagtagccctgccgccgccacgagatccaggcgagcatgatggaagacgtggatgcggctccagtggttgattgggtggcaacgaggatgaaccgcagctgactgcacccatgcacaaccgcaaccaactagctaaaggtacgactacgagtccttcgagcagctaaccaccatgacgcaattccgtttgagcggtgctccatgtggctttccagtagatttgacccccaaatcgatatgatgtagcatcaaatgatgtgaatacacttcatgagttttgcctttgatcaagacgaactcctgattatagcgtcctaagctccatatggtgcgtgtcagcatccctttgtctgttctaggccagaaattggtgaaaggtttgtcaagcggtctacttttgattgaaaacatggctacttaattacttatattaatgttgtttatatgtatgactgatgttctacagctacattttgtgttatctaatataactattttttcttttagtttggatagatttggagatgaagcttattaatttttatattttggttccgaaaaagaaatagaaataatacatgttgtttttcacgatcattttacattgaaacagtaataaattgacgacatcctttgtttacatcagatggcatctttctaaaagattatgtgtttatgctgttattgcacttgtcatacatgttagaataagactaaaatcaggcctcaaattttgacatccaactatttgttttgtctgtatagcaacgaagcctattctcttcaaaaaaaaaaaaaatggcataaatatgctgaaaatgagcttatgctaatcctgagataaaaaggggctgcagggatgttggggctttggtccttgagatcatgcatattgcaagagaaacctaatctgagtttcaaaagtggatggtgcagctgttccgtttgattgcaaaatgcccgaatagctttgactttcaagtaagtttctttccaaattcagaactctaatttgatatatgccttgattaatatttgttcatgatcctctatgtatcatgctctgcatttatgtttgcaactatccagtattcgcttcatgatttaacaaagggtttgattatgattggttactatcaggtgtttggggtcaagtctgtagtttgcaaggagtgaacctcattgtccgttcgttggggagacctcctcctccaccgctgtccagtccgctgcccccagttcgcacgttcgagggggaacattgatttgttctttagaaattcaataaataggcattcgtacatgtggcatccgatggttatatgctatggtcatttttcattaaatgttgactcaactttgtggtatgttttcagtttcatttagccattaaactctggaggaactacagaataaacttgtagatgcagaggccagaatggatttgtaagaggcaatggattttagtattcagtaatctttgatttcaggtaaattaaagatcattgcacaatcaagaaatatattttgtgaatgtttgcaataacttgcatggtggtaaccttctgtttcagcttgtcaatttgatgcgtaaccttctgtttcaatttgtcaattttttgttcatccttgtttttattatgatcccaaagatcaccactttgtctggcatttgagatggaataaagttaacattaggattatcattttgtatgttgtcctaaactgagcacaatggctgatttcagatagaaacaacaccttttgtcagttgccaagctgaagcattagaaggggtttgtcttatttttaatattgaagcccaacgggtagatcctggaagattatttggggctttccaaaaagaactgtttgaaaaatattttgatttttagattagagacatgaagctgtcttgatcagaggcaattctccaagcagtttagattaagatgctttgataacctgcctgcaaatctctaataccgaagccaccttcagaaattggctctagctaccaatgtcattccaatatttaatatgcatacctccatccttttgaatgccagtccagaattttctaacgatagctgtgagctttgaaataagggttttggaatgaagaaatgtcaacatgttataggtaggaatggaggaaaagacatattttctgagagctaaccttccaatacgacgtctagagcatgttgttctataaggacttattggtggattgctataaagttgtacattacaaactaggttactgggcgggtgatgtactccctccgtttcccaatgtaagtcattctagtattttccacatccatattgatgctaatgaatctagacatggaggaagtatatacttatgtcgtgagcattaatatgaagaaaaaatgtgttatttgaaactttccaaactcttaatttggcatattccaaacattttttacttccaccagtgtatatataaaaattttacatgatataaacacaaaatatttgaaaacacttgtgctaaaagtaaaaaaaaatcagaaaaaagagaaaaaaaaagaaaaaaatcacgaaaaaaccaaaaaaccaaaaaaaaggctccccgccagctggcgcgtgcacgccaattagctctcacggtaagatgcagggtcaatccacaatcccattttatccgtccggttactcacttatttaactatttaattaaacatggacttacggatctatccatttatacctagatgattaatacctgaattgcaattcgaataatgaaccatgatatgcatccatatataatttaatcaagtgagatgtgatatatatgtatcgatgcctgaattgcaaatcgaataacaggctgtgatatgcatccatatataattaatcagccgatagatgtgatatatatgtgccatattggtggctgatttccaattaattaaagcactgtcgtctgatatgttgtggtgtcaattctcaattcaagcctatttagtactctctccatttcgaaatatttgacgccgttgactttttagcacatgtttgaccgttcgtcttattcaaaaaatttaagtaattattaattcttttcctatcatttgattcattgttaaatatatttttatgtaggcatataattttacatatttcacacaagattttgaataagacgaacggtcaaacatgtgctaaaaaatcaacggtgtcaaacatttcgaatcggagggagtagcagataacatcaaacagtaatgcttgatactatttcatcaaccgtccgattcacatgcagcactccggccgccacgagtcaaattaacacgcatggattgtgctgcctccggtttttaaatagaagacgctattgattttttttttgagtggagattgctattgattttcgatcataggtttgaacacacgtcttattaagaaattatataattattatttattttgttgtgatttagtttattattaaattaatggtacttgcactacgccagatcctcacacctctgacgggatacctgtgacgggcaaacgaattggtcagtattgaccattacctttgacgggttatacgggatgccgtcaccggtgaggcatctggccgcggcccgtcacaggtatcccctcacctgtgacgggccgaaaggaaaacccgtcagaggtataccagtgacgagtttttcttccaacccgtcactggtatcccctc

SEQ ID NO: 58071 - DNA, 12869 bp, Oryza sativa
aatatgttgcagtttgattctgttgttttacgtcacttgctaatgtaccttttcaaatatgcagacaaatgaactctatcagttggcttctgttgctttctgcttgctgctagcctgggtaaggttattcaactttattgcctaaagctcattctgacatcagaatgactttcatcactcttattttaacaataaattggtaaatatttaaatataaccatacaatttttattcagcaaaatcttataatttagaagttattgatggtcaaaggtggcaagtaaatgggaacagaggaagctacaggacaaatgcagtcagtatcgaatgattgcatgtgcgctagtgcggggatgttcccccaaaatgttaaggatggctagtgttttgtcattatcaataaataatattctaacaataatcccaatgtttgccgaacaagtacttgattattatattcacaaactatttaaaggtgatacatggatagtcaaggagagtttctgcccatgctactgtacaatgtctctaacctgagggataaatggttgcatagtgacttttttttactgtcaaactagttgtattactattaatttcacttcgatcagcaatcttacacatgcaacatcatttctgtagatagagtaatgttatttctttgtatttccagtgtagtgattatcttggattgagtcttgaactaggctcatttcttgctggcgttatgatctcaaccacagattttgctcatcatactttggagcaggtaatatgctacttactgttgacttgattcttttatgcagggatttgacttgggtgtcaatgtttttcttttcctgttctttttattgatttaagaataaacggtttagaccaatttggatggtctgcataacagtttgctaatatttgaacttctggaagtttcttccctagtgtaattttgtttttgtagctaaatcagtacattttgttctgattgaactcactctctaacatgtaatttctttgtttttattcaaggtggagccaattcgtaacttatttgcagcactcttccttgcaagcatcggcatgctcatacatgtcaagttcttgtggaatcatgttgacatattgcttgcagctgttatactggttataatagttaagagcgtagtcgtaacagttgtggtgaaagcatttggatacagcatcagaacagcttttgttgtaagtatctctttcttgatggttttttcataagtattctgcaataagccaataatgatataaattctcactcctggtttttcttctctcacaaggttgggctatcattagcacagataggagagtttgcatttgtgcttcttagccgtgcttcgcatcttcatcttgttggggtgaataattctttatttgttcatcgattttttttgagacatacttcatactaaagattagccattctggcttcaatacatgcatgatgtaaaattcttgttgaaattttgtttttcagggaaaaatgtatctattattactgggaacaactgcacttagcttggtaaattccttttacctgatgatggagcttagttgtttaatacacactagaaatcatttgttttgctttgctttttctggcaggttacaactcctctcattttcaaactaattcctgtggtaatgcaccttggtattcttatgcgctggttcccctcggaaagcagtatgcagaatgaggtatgctttcttagcttctttgctgatggttgcggttataactactagatatattctttcatcaccaattactaaatgaatcaacatcctttttctgcagaaattaaataagccaccttgttctatctttgcttggaagtagatattagaagtgttcttattattcatgaaaaccatgatattgaaatgctttgtatatccatgagaagatttatatttcagtagtaaagccaaatgctcaatgactgtcattagtatctttttaattccatatctgatcatatttcagctacctttacaggataaagcaaccatgcttgaagcctacaacagatcactctaacattacaaagccacagacattcattcatttgactgacaatgatttattcgtgcattaactctttgcacatgccgtggaacattggacagacaattccatcatttctttttgcggcaatacgtctacacaagcgatgactaaagacacagtttgacaggccggggatctgttggtataccatttaagttgaaaaattgagttgtacatactgtacatgttgtcagcgtagcatattctttagactgtaaggccccaagccttggttttgtatcatccctgccaactcaacctaggagttaggtaggatttttggtgtaatgctatcagatataccgagagaaccgatatgtgctgattccccatcagaagaccatgggaaagctctatgttagtatatattgtccatttgtcctatgtatgagctgccaggtgacttgttctgttcttgtcgtatggataaacattttgtcacaacattctcttgtcctagtatgagctaccattggaaagtagcagcattttattctcccgtgaaggttaattctcttctcctgcctttttgtgtggtgaacattatttttctggagaaaacagcttgttagaatcgtcttgtagcgctgggcttttttggtgtatccgcatgattgcgatgataggtccctggacaagtatttttgcagaaactttcggtgcgtctgtccagtgggtaatggttgtgctggctcgtagtcggagcagtagaaaactagaaatcctaaacaagttggtgcaattattaaaggagaagctctgaccaagctagctggagctgaagagctggagaagatctggcccgaggtgctgacatttgacgctttgtggcgaatcttgtttcagtggttgcgggacgcacatgctcacgtggtcggcctttgcaggggtagagttcaattttcactattcaaacttcatcgtagacatagaaagcttttgttccacacagtgcaaaagctggaatagctcagttggccagagcgtatggctgttaaccataaggtcggaggttcgagccctccttctagcgattttttttaatctcatcacaaaaaatgtaactcaattgttttttttactctttcaaaaaatgtaattcaaatgtatcacaaaacaaatttcaatatattttttaatgtcatcacaaaaaatgtaactcaaatgtttttttactctttcagtattttttttaatctcatctttgcaatatctttttcactctcataataaaaaaacttttttactctcattataaaaactgtaattcaaatgttttttactctttcagtaatttttttaaactcatctttgcaatatttttttctctcatcatcaaaaatgtaatttccttttaattttttaatctcatctttgcaatatcatttttactctcatcataaaaaactttttttactctcatcataaaaactgtaattctaatgttttttactctttcagtaaattttttaaactcatatttgcaatatttttctctcttatcatcaaacatgtaatttccttttctttttttttacactttcactttcagcaaaagtgtaatactctcaggaaaaatgcaatttccaatattattatgttctttagcaaaaatgtatttgttcttttgcgagcctaagctcatcagcagaccagaataatcgtttcagttgcttgtataagagcttgccaattccacttccagtgctttcctccgaattacaagactgataaaaagttgaaaatttagtggttctcttagaacacaaaaagaaaatagcttcacaagtttagctacatggcagtacaaacaacaccgaaaccgctaggattttacacttggaacaagccacgccttgctgaacttgctcaattattatgggatctcacatgcacacagtacagttcgtccatgtgccgcaaccatggtgccttgcagctaagaacacacaattaaaaacttcttgatgagttcctgaaacagcaaagcaagaggagggacaaagtacagttaattaaaacgggagcagttgtggtgtctgcatcacatgccgcttgcacgttataaaaaattcctgagtgccaatcaggtgaagcatccgtgggattcctcaacggtaaatgtagatgcaatgggtcacattctcgtaaggataggagttatattttcaatatgctgcagtgatatgatttttttagtgttctaaatcgtaatgcaaaaaaaaactttaagttgtcaagaagaatagagataccatgcttgcaaattgagaattgcgatgttcattctgatttctgaacgaaaaatgtttggtatgaatatttgcagatgcaaaaaacaaaattcaatgaaaattttggaggcgttaccgttgatgagagggagaggttcttcttcttgacatcaactggcatcccttgcccgcagcacaatttgcggctaagcatcataagctcctccagtgtaaatgtgctcttgggaggactccacggattcttcagctgatcatcgtcattagcaacctcccagcttttctctgatggtgcccgtggaaactgaaaatctagcgctgaagtgtctccacttgagttgctgtaagcttctgtttctgaaaatgaataccatgtgccatggcgactggaaccacctgcgcattctgcagttccagatgcttccttgctgtctggaaatccaaatgcttccagatcaaaccctagagaatattcttcctcactttcagccaagaaagggtttagcgaggaaggagatacagaaaaatcagcatgatcaaacagcggatgaaaaggagatgcatcttggagaggcttcccgggcttttcttcccactggaagggcacgctgacgacaagtttcgccggagatgggcatgagatggctgatggcactggattggaaatggcccagtccttttttggcgctccaggcttcacctcccagagaaatgggactgaaatctgctgcttgacgcgctcccttggattgaattcagacagttcaagctcatccattttggatgtgtggttttactggtttcggaatggaatttgagctgttgtagatctttcaggcactgctgatataagtaggagagaacaggtggtttagatgagctgctcctgtaccacaatgctcttgttcaactgatccttcgctaccctgcaaacttgacacacaattagacagtaccaactaccaactcctctttagctcagacatgcagaaagaggtactcaattcagagtggttgatcttacatttgcattttccacagtactagaaagaaaagagggtgtagggagcacccgaaaaaaacagagataaatcctcacagggtttggtaatttgaccaaaataaccacttattcagatgcaaatctacattttacaaatgtgactggggacacaataaagaataaaaacaatgtgatcatctgttcaaaaaccagaaaacgttttttcctgttttaacatcctattctgctactgtaccgtgacgtcaggagatcatgaattagttctaacagactccaggtactgtaccacctctgccatgtttggtcgggcagatggtgtgttcgaagtgcataccagacctaatttgagcacttggactaattcagcctcaacaaatcccttcatgctccgatcaaagcagtctgacacagtcccatcctccaatatcgccctaacataatcacgcagaaccactgctgtcgccaccccagggctctccactggtttcctccctgtcacaatctcaagcaacaccacaccaaagctaaatacatcactcttatcactatatctcaagcttggagatgctaactccggggcaatgtacccaatggcagcatgcaatctactcaattcatagctacctagaataggcaaaagctttccaaatccataatcagataatttagcctcaaagtctttatctaacattatgttggaggacttgatgttgagatgcaggacttgtggtcggcagtcatggtgaaggtatgcaagtgcccgtgctgtaccgagtgcaaccttgaacctctgctcccaggagagaccaactctgctgctgcttccggaaaatgtatgaggactcccgtgaaggtggtcgtacaagctcccgttaaccatgaactctgacagaatcaattgcgttgatgatgaccagtagtaaccctgaaaagcaaccagattggggtggctaaggttaccaagctggcccatctcctgctcaaactcatcctgacttctcacccttcccagtgtttccaacttcttcacagcaatggataaaccattctcaaaggtggccttgtaaactgtaccaactgacccaccaccaacaaggcagtctttgtcaagcagtgccttagttcctgcctcccaatcttcataccttgaaggcaagctcttgctgaaaagcaccaactttccaataatggcatttgagccttgtctgccaggagatgcaagcatcggtgtgctctcggactccagcacctcatcctcctccttcccctcttgctcctctttactcctcctcatgtaagcctttatgttcatagcacaaacaatgcaaactccaataagtataagcgctgctgcgactatgacaattatgacagacacagccaattgtttcgccctccggctagccccacacagattgttcagtggaggtccacatagtaatgggttacccatgaaggcggagctaccgaaactctgtagaactggcaaggcagggatcatgcccgagagtccattgtaggacacattgaaatgggtcaggttagacaggttcccaagctctgaggggattggtccagtcagttggttctctgagaggtctagaagatcaaggtttgtgagctgtgcaagtgtcactggaatcccccctacaagatggttccgatgaagatcgagcaacttgaggtaagtcaagttgttaagcgtgtccgggatcactccttgcaattggttgccagacaaattcctgcagtagttcaaattagtctgtcagtacatgaaaccactgtaattcaaacgaattggactgggttgcgtagttaacagacactcacagctcaagcaagaactggcattggctcagggacaccgggatgtctccgatgagagcaagaccagcaagatctagtgtgacaagcatctcaattcctccgagctcggcagggattgaaccggcaatgcctgcatttcctgcgagcctgagcactgaaagcgacctcaatttcccaatgcttggtggtatgtctccagcaagagcattcgtccccaaatccagaaccctcaggctgcggcaattggccacactctccggcaccggcccagtgagccggttccctgaggcgtcgaagtaggagaacttggtgccgcacgttgcaatgttggggatttcaccatcgaaggcgttggacgagacgttgaagtaggtgatgtttaccaggccaagaaggccgaaaggtgccggtccggcgaaatggttgctcccgacgtcgagcaggtcaatgctccggcaagcgttgagctttccggcaatggcgccggagagcgagttgcttcggacggagatgtagctaatttccggcggcgcgcagagctgatccgggagctcgccggagaggcggttgtaggagaagtcaaacccggcgaggcgcgagcagttggtaatggcggtcgggactggccccgtgagggcgttgtgcgcgagggagacgtaccggaggcggaggcatgggtcgaacagcgaggcggggatctcgccggagaacgcattgtaggagaggtcgagcaggcggagccacgggaacgcgccgaggaacggcgggatctcgccggagagcgcgttgcggctgaggttgagcttgtggagcgtggggccgagcgcgctgaagctggaggggatgccgccggagaggccgttgccgaagagcgagacggactcgagcgacgccagccgcgccagcgacggggtgagcttcccggcgatgcccgcgccgtggacgcgcaggcgctgcacggcgcgggacgacgggtcgcacgtcaccccggcgaagtccacgcaggggtcccctcccgccgtccacgacgcgagcgcgccgttcgggtcggtcacggcggccttgaactccagcagtatccccctctccgccgccgtcgccgcgtccaccacccccacccaatgcagcaccacacccaccaccagaacggccgccgccgccgccagcgagcgcgtctgcctcatcgcgacagctggaggagcaggcgcagtgcgagtgcgagcgcatgcattacccccgccgcggtggcgacggcaccggcgctctacttctactgctgtgactactgactactactcccctcgtactgagagagagagacaaggcgcgccgagtaaaagagtggcgagtaggtggcggtgggtggcgtgcgttaatgtgcgggtggtgctgccgcgcggccatgagccctttcttccttgacgtcggttggccagaaaccacgttcttctgggtgtttggtgcgtggcgcgcgcggcgtttaccttcaccttacccgtggaaatctaggcgagacgcgcggtcaaaccgaaacgcgaacgcgaacgcgatcgggagcagcagcgcgcgcgcgcgcgacgtggtttggtgccacactgccaatctgccggcatgttgaggtgggcaggaagtgcgcggcgcaggcgcagcgaagggtggggtacggcatgggacgcgcggttggggaggaattttttctcttcaattcgctggctgcgcagccgcagccgctgttcacgtcaaccgctcacgcatcgtgccgctgttcacgtcaaccgacggccgcggacgtggtgtcgttgcccgtttcgcgttgcgtccgtataggtcgtagtactgtggcctacagggaaaccatgggtacaccacggatgcataaatgagcttattcactgctcgtccgtcgtgccggtacggtgctactactatggtgctaccaccgtgctgcggctgtacgcacagatctacagtaatagcaaagctactagtactgctactactagtattcattcaagcgtgagtggcaaacagatcagcatattgctgcgtgggcttcttgtatcatccgccggcgcaactgcgcgagcggacgatttaactactagctagatgtgccatctgccatgccatgccattgatgggaccaacataagatgcagtaggcatggtcgcatggagaaagtttgttggggtttggagttcagcgtgcctttctgtcggcaatgattcgtcggaacgtatcatcatggaccgacgtgcttgctaattaccccgatgatgcgttccagtgccatggctttcgactctcaaagcctgaactgcaaggtctctgtcaagatttggttaccaacctccacaaaagcattgccatggatgaaaacgatgccatcaccgggtccttaattacctcaaatagtaccagatccttgaaaaattgaaatgaacagaaacggcacgatcaaacttggcggaaatgaaggaaagaaacgtgctacctcatctactctactctacatgtctgtttcagaatagaaaggtctaatctgttatagtgctttgctacgatacccaagtactccctccgcccctaagttcaaatttacactaggggtaccaagtcctaacatctaaatcgatcccggcaaccaaatcgagccatcaaattgttcatgaattcgatgggcatgaagtaatgatctagcaatgtggcatttgaggtctgaagtactccaagttgaacttaattattcttctgttacccaatgtgtacaaacatatcacgtacaagaccacaagacaaacattatagcttacactctcatcgtctacttgttagcttatcagtcataagactcacaacaataaaaagtttaatttcaaaagaagttaaaccatctttttaaggagtaaagaggggttgtggcatcttccccctctctccccagtggtgacctcagatgacaaggagaacacctcaacggtgacctcagatgacaaggagaacataagctaggccatgatagtcgaggtggtagcatcaagtgatcaaggaaatcgaggcttgttcccgccattactgcttgtttccatcctcgttgcctccgccttagtcgttggatcaagaacgagctttagcagtagcactggaaagctccagccgataggaatgagctcaacggcaatagaggtaactatagctgatgatagcaataattgggtggcacggacacaggtcaatacacatatgtagatagaggcgacaagctcccaagtggtaagctctttacctctcttatcatcagctttcctcctcaccccagcctgaaatgctggtgataaagtaacatcttaccagcagcaacgcaaacgccttttcttatatagttgctttccactctcaaaacaccatgtcctctatggactacaaaacctttcttcaagccattttatttttctccactatggtagctctggttccgacgtgggtcaatgaagcttgtgtacccttgaatgttgaccggtaagcatggcctaaggtccatgtggtttcttcacatggattgtatatgttcgtgtttacaagagaaacaagtgtagcgtttttttttcaattgcaagaaatacgcaaacgtgcgcacaccatgcacaccgcgctcacatactagtaagtgtgcccccgaacacacgcttaaggagatggagactggcaacacatccttggacccatgaaattcctgatgaaagcatgctaacatatgattaatattcgtatacaccagaattttaaccctagtgagtagtcatgcacccatgacccaactatcacacgagtgatgctttcctgtctctgtagcaaatatagcatttgacttgacaaaaactttacatgtgtcgaataagatttgcactattaaacacaagattttcaggccaagtgaataaattaccatatcataaaatcagataatcgaaaaaaaaaatctaaaatctcatgcgtcacgagcagaggggcttgttggtataaaaagtgctattgcaactgctacgcaatgtggactctggttccttctcccgcacactacgattcggtcaacttgacgcctcgtggaccctctctggtctccatctaacggccacgatggtctaatctcacccccacgcgaatctcagaacttgtatccctctctccgtcttccaccacgacccgccacgacaaacacccccttcccccccactccactccccttccctacccgcccccgtcgccgtcctccttttcccgcgaatccgcgatcttccgccgcgcgcgtcactcgtcgacccccctaagccgccgccgggcgatggcggcgctggacccaccgagcgagctgttggtgacgccgaagacggcgaggaaggacgaggccgcctcctgcaatgcggccaccccgcccaagccctcgccggtgtcccccgaggagatgcgcgcggtggcgcgcaagttcgccgagcaacccgtacagaaccccgacgacggtgtctgggctgtcctgacggccatctccaagaatgctcgcctgcgccctgaggtccccctcccttaaaccctaaccctaaacccccaatgtttccttttgtaactgctagtactaattcagcattgccatgaaaagaggttgagatattgaatcgtaaattgctgagttagctcccaaaaaagtgctgagttagctgattggagccattttgtttaattgtagggaatgaacattcttttaagcgccgatgagcactacataggccgtgccgttcaggaatccagcttcaagatttcctctttgcagatcagtgggaaacattgcaagatatatagggacactgtgttgggggagcttaaccgcaatgaacctgtacctgttttcctcaaggactcgaggtttcttgtgcttctggttatcttgtcatgtattacaataaacagcaccctttcttaaattaacttattgtagcactgcagctcaaatgggacattcatcaactggaccaggcttaagaaaatttcacctccaaccaagcttaatcacggggacattatatcatttgtctccgctcctcatgacagtaaagattctgagcttttttcactttctatgatccaactctactgttcttataaacaattatgataaattcattgccttgtaacttttttagagctttcctgcacatggcctctgctagtttacctctgtgtacttgattatatttactgtgttttccctgtttaccttgcattgtttttcttgtatataatcgatatcgaactttttttggccatttatattgcgtgtttcatctacagatacttcctttgcatttgtctaccgtgaagttaatgctgtcagtcgtgcagagaatgaagttaccatccttaaaaggaagtcaggtaagagggaacatgtgctttcctaagatttggtgattacatttttccagctacattacaagtaatgatatatgtaccacaatttgtatttgatcttaaagaggatattcattctgaaagaaagagactaaaaggtcttgggattggttcctctgatggtcctgtttcactagatgatgttcgtcggctagagaaatctaatgctgtaagttgaccccttcaagagtt

SEQ ID NO: 58072 - DNA, 12205 bp, Oryza sativa
agcagctagttgatctgcttaccaagtccttgggaaggcagcgtttccaggagctgagcgagcttgttggtgtgatcaacacaaaaggccaaagttgaacttcacaagatttagggggagatttgttacaaataaacttgtgtcgatctgctttgtgtttttggttctggtagtttttccctcccctgtttttctgttgattctgttagagtcacgcacatgacctcgctggtttttcggccgtgtgcgacgttgggctcgtcgtgtgcgtttagttcgcacgggagcgcgtcatgcgcaggcacgatcctggtgattgggatggcagtcgccgttgagggatcgtgtccgcatcaaccgggccaacgtgcccatgatcttgtattcgcagaataaaaggaagaagacaaacagaaaatgctgctcagttgttcgcagtgccaaacatttgtgttctgtgtgattactgttcttctctctcgcgtccacgttcgcgtgcgttacgggtttttttgctaacagatctttctatgttgtgatctccccggccagaggaggagggatgtgcggcggtgtgcggtaggtgctctcctccggaatcgccgccgccgttgcgtggtggtggtggtgccgatcccaccccctaccctcccccccctccccccgcggtcgctaactctccgtcgtgcctggagagagaggagaggggagagggggaggtggagtgggaatggcacgtgggccccaccactttttattaattttggtgtgaaactgacatgtgggtcccacagggtttattatttttctataccgaattgccgcgtaagcaccacgtcaatgccaagaccgagtcaaattagctggtaaacgccacgtcagctaaaaccgccatccaaactgctgagggacagtcaagggatccgttgtatcttggttgaaaatcggattcatcgataagttaagggacctcggtgaacttatttctcgtgtaccttcatcgatccagcaccaatctcaacgtgcgcagcgccggagaaaaatccgaccagacttttgtttgttcagctcttcactcccccatctcgcactcagatcccgccgccgcccgccgccgccgccgccgccatgggctccgcccactcctcccactcctcggtgtccacggccgccgacatggacgaggacgacgacgacgagccatcggccgcgtccgccgcggctccggcccctccggcgcccgcgccggctcccccggcgtccgcgtccaaggtgctcgagcaggagcccgaggagctcccctgccgcgccgccgactcgccgctctcgccgcagccctccgccgcggggacgccgcgcctgctcgccgcgggccccaccatcaaggtgtgggacccgtgccacgtcctcctccccccgccgtcgccgcaccagtcccagtcggcgcgggccggggccggggccgaggccgccgccgcgctggaggtggtggtggtcagccacggggagtgcgccgcggcgatgcgccccgacctcgtcggcgggcggtggcccgccgcggcgctcacggcgcgcggggagaggcaggcccgcgcgctcgccgtgttcctgcgatcccgcggcgcgcgcctcgccgccgcgtacgcgtccccgcttgaccgcgcccgcgccacggccgcactggtctgtcgggtgagcgccttctttggcttccctccctagcatattccatgcttctgcattgcgcttgttcagtttaggtgtaggattttgtggcactaacatgtactaggattgaacagaaaatattagttctggtttctccattctgatttgtgattgttttatgcgatattgcgattcggaggaattgtctcaaagatggcagcattgtttgtagcaaagctgcaagcctgcaacatatcatgcatttgaaatcagtgccctttagcaatgggggatttcacctaatgtgatcttgaaaattagcgttaatgaagtgatttcggttagccttcaggcaaagcacttgtgggcttggtgtggggatgggatctttgtgatgtgatggggcaaaaattgctaaatgcttgtgttatgcagtaatgcagtgcatccttactctgttactcatcatggtctcatggatagcataggagtgcatgggccataagatacatgcttctgaatagagcatttagcagtatgtaaagggcgtccgttcaaaattgatgctgtcttgggtcaaagtctcttcaaagtttgctggtgaaattagctcaaatcatagtcatttgatctcttttggtctacaccatggccatcaataagcctaaatgtgaagtatgaaagcacttatgagttacggtgaccttcgatcttgtcaacagtgcaggacctgacagttccacttataggtacaaaaagacattcgaaagaataaacatctgaaggaaataggagtgagtcatttcattgcaaccttcttgatatacttctgaagggagtaccctgggtctgctactttgaaatggtaaatatttaactgtgcaaatgttggaagacaaaattaggggcattaatgaaaactagctctagatgagatgagcctattctttagtagtaaaaggtaggcagctttgaaggatctcttattgcctttatgtaaccggttgacaggtgtattgcatttccacccttgcagttgcagtctgtctctgttttttcttgtcttataacagccctaatattccttgtttgtcttttacatggactgatgtcaaagaaaaggaataattttgtatttgcgaacattacaaaatagtgacatggggatactctgcatgctaaaacaatgctttcaaggcatgctcaattgactttatttttgataaaattggtggctatgagttgtgaggacagtctggcagagctacagctggactttaattgggttttgctatgagagcagttattcttgtgcacgtaatttttcttgctcccacagaacatatggcttcttatgccttcatcatcaattgtaacctgacatcatgatcattaggcacttatttaatgtgtatttgtgctttagtgggcgtaactgtctcatcttagtatgtttgttggattgggtggcccaattacatttcatttgaaacaattgtcatgccgtatgcatctatggtagtattggctagccactgaattatgggtctatgatcattggttatctgttcctttgaaagtgtgttccgttattccagtgttcacaactcatgaccatggaatgcagcttgtatgggagctggagcacaccctctggtgaacatacaaactgtcctcttatgcataagagagttcacgcatagaggttctgccataattacgtgtttcccgccagaataaatcagcaaaataaaaaggtgtatttatttcatgtataaatacccttgtctcaaactcatatcgttattttgcatagatttagattgacttgcaaactctagtaagtggaaaaggcagaattgtttaccctcatgctaaaagtttagtatctggatgtttttatattagttagctccccttttacctgcctgcatcctttctgctctgtccctaaaagtttcacctagatttctagcctctaggattgaattcaatttgagattacaatccattattccatagatttatcctgggcagaaaagcccaatgccttgaaattttttattgttaatcactggtaaggctggttatccattatgtaaacaaatgaatgcaactatcctggtgtctactggacactggcaagggacatgtgcctgctaatctgctatacaagtttgactctcacgctatcaaatggtgacttacatattcttgtgttgtagacttgtcactgtcagtcttggacccaaatgccataagtcaggaaagacagattgaagaagctggggttcaaacccaggatttcatcaactcgctgctttactgttgggcaggctgggtgttcatcaatgtcatggcttcaacagccttagttttaaaaatcacacatatctatcaaaaaatcacaaataatattttgctggtacaaaattctatccaaacctagtacttccctagtaatgccagttatttctgacactactatctgggatagggattttccctggtcctgggatgtaaatgtaactgaaatttatatgtcattcattgctcttagcttttgggcccaggtccacatattattcagacacccggatttttttggaaactatacctcccaagctactttgtgctatgtaggtataaacttatatctgaaactatatctggaacatgtagcatttgacaagtagtggtcctgcaaatgtgcagtcttgttttaattattaattagggaagcggaggaactacagcagatgttattttccctcttcattagtttttatatatatgcattcctctgtttacgttttcttttgattggtcttcagcactgcagttcgtgacatctggcaatgttaatctgcaggaacttgattttccagaggagcagattcaagtatcagatgctctgactgagatgagtcaaggtcagtgggaaggctgcccgaaatcagaagtatatactccagaaatggtcaacctgatggatagcactcagccagatttctcagcgcctgctggtgagtctctcaggcaggtacagtttcggatgatggaattccttaatcagacagtcgtacggttaccagaaaaggtggcaatgggggactcactatcacaacaaaatgaggcgaagggtctgtctcggcaaagttccaccaattctgtccaagatggtcccccttgggatttgctttacaggctcaatcggcatagcctccaaaggaaaaaatctgggaaaagccggcttcagtttgtcacttcaggcgacaatgagactgaggatgacttctcaccaaaagaaataaatcaaaggcatatccttcatgaagcaaatctagcaccctcggtcacctccattgcaattttcagtcacgcaactcccatccgatgcctcgttgctggcgtgctggattgcaatcctatgatatcccagagaatttgcattgaagattcctccattacagttcttgagcattcactaaaaacaggatggcaaataaagaggctgaatgatactgctcatctcagacttctctaaatgcaagcaagctgttgtgctacgctgttcgagaggaatgtatctctttgtgcattgtacagaaactatcagatcatattcctcagatcagatgccaaggccatcggaagtgggagtcttctgattgtatttcatttgtatttactgacatatctaaatgccaggaagatctggccctgtgatagtgttgtattgtatttgttattattctttttttcttgagctaaattatttggtcaagtgtaatttccatgtaaggggggatacatttttaatgtatcattctttttgccgatcactctgttttcattttaatttatcattttttgtgcattgtccttggattagttccatcaaaacttcttgagggtagataatctacagtggatggtaggggaagatatgaaaattgtacgcattttgtagactaaggttaccttcagttgttaaagatgtaatttggaattttgcgatagttgagagtgtttgttccgatttaaaaataaattagaaactaactgtggtgtatggaacgatgccaaaccttattaattatcttcttgttagcattggtccaatattaaccatggacatattgtgttgtgatggcaaggaacaaaacaagaaaagcgaagcaaaagtgtaagtgagacaggctggaagataggcctggacattgtccatctactactacatggtttggttcacttagggtattcataatgcagtggaattgcagataataatcattaaatacatctttgttatcactttagatttcatgtttagagatttcttttaggtggatcccacctacccattttgcacatgcatatattattatctctctaatctgttattattatctgacacagtccatcctagcacttagttttacaacaaatattgaggagatgccttaacaatgtccagtgtaggtgaggttgaacaatcaccaaccgtatcattgccatctccacaataaaattttgtgttcctattctggtaattggcatcgctacctttttgttaagtgtcgtcactatcttctcttgattaatttctcctcatggtttctttccgcgtcacactggagatggccttaccgcccataaaccagtcagccgcaacaccccaccacaaaccaaccaaatcaaagatcactttagatccctgaaaattatcgccgagtctaaactttatccctgaatcacaatatcagatactataatgcatccctcgactcccaaaaccaacgtaaatagaaacccaagatagtttggatggtggttttgactgacgtggcatggacagggcacttaaactttaaaaaaatgtgggacccacgtgtcagtgagtgttcaattaaaaataaagaaattacagttgttacaactacgataaggccaggccagcgatcgatccaattcacagctagggttctacctatcggatatactccctcagctcgtaaatattcgatgttgttgttgacttttttaaatatgtttgactgttcgttttattcaataacttttgtaaaatatgtaaaactatatgtatacataaaaatatatttaacaatgaatcaaataataggaaaagcttaatcttttttgaataagataagcggttaaacatttttgaaaaagtcaacggcgttaaaatatttagtgacggaggaagtatatactacctccttccctaaatgtttgacatcgttaacttttttaaacatgtttgaccgttcgtcttattaaaaacttttgtgaaatgtgtaaaactatatgtatacataaaactatatttaacaataaatcaaatgataggaaaagaattaataactacttaaatttcttgaataaagcgaacggtcaaatatttttaaaaaaatcaacgcgtcaaatattttgagatggagggagtatatcgtctggagctgctgcgacaaaggtgaccgtcggcgccaccgcgcgctcctcgatcgtcatccgctgctgctcgcggcgtcccacctacgacagcgagctctctcgcagccgcaggcaggcgcaacgcttcctttgctggagctcgtcacgacctgtatatggcgccgcgccaccacctgctcgccggccgcatcgtgctcgatcgtccgccacggcgacgtcgcgcgcgacgagctaggctggcctgacgtacgcctacacgcgcgccggtgcccgagcccgacccccccccccccccacatcgacgacctcgccggccgagaactacggcggcggcggcgagactggaaggcgtactactgtacttgtgcgtgtccccctacgttggagacaaattactccctcgtatgacgccgttgactttttaaccaacatttgaccactcatcttataaaaaattttatgcaaatataaaaatactaatgtcatgcttaaagaacatttgatgataaatcaagtcacaataaaataaattataattacataaattttttgaataagatgataggtcaaacgtttataaaaaagtcaacgacgtcatacaggagagagtagtttattaagatgcatgcgcgtcgattaggagaggtacggccgccaataagctcagctagtagcttcttctaccgcgtaccgcctcgcatgatcgaggaccagatcgagaagacgacgacagggagtgcatgcatgcaggagtacgtacgtacgtacgtagctggtcagtgtcgtacacgtactccctctatactcgtaaaaaagaaagtcgtttaggacagcgacacgatctccaaaacacatttttgacttcttatttctataaaaatatttattaaaaaatgatatatgtatgtttttatgaaagtatttttcgagacaaatctatacatatagtttttacattttcaaactcaacaacttgggagttattcatgatttatattcccaagatttaacttaaacattgttctaaacgattttcttcatgagtacggagggagtacgctggtcggctggctccgttcggtcgcagcccgcgcggtgaggctctacctccagcgagcagagcaccaggcccgacccgccccgcccgcgcacggggtttatcgaggcttcagatacgagaagaagaagcgcatgaagccgcagcctaccgacgccagcgacgtcgacaaattaggagacctaaagtggacttattccttaaaaaaacacttatatatatccacaatatgataacagagtataagagtttatcgccatattaattgttgctgagatggaaatgagagagaaaagaaaaaaaacagaagctttattatttaagggcattcccaatataaaaaccagatatatatatagtaagtcattactagctacatgataagaatcatcgtgaccgcgataaatagtacaagtacgaggccacaagagtactatccaaagcaagcaaataagttagtcatatgcatagtattttccgacacagggaaatcgtggtgttcgtcaaagatgcagctagattcacattaccaataggggatgtttggttgcttactaatttaccaaaccacatgttagacaaaaatgaacggctagcaaaatgttaactacaacttagccaaagttagaaaaaaaaataagtgtatgatatgtggagccatatatagaaaatgtatagctagtcacaattgtgtcatcaactaaataagtagctaaaaaactgtggtatgactaactttagacgtggcaagttgtagcgtgcaaccaaacaagccttaatattcagttttggtaatatatatggagaatgccgtatatcctctagtgcagcatagtggggcccactggtggcaggcatagccagcccaattgaaacggggtacaagcgaaatgatgagctcaatgatttaaataaaatattaaaaaataacaatatacaaacagctagttattaattaggtaaaatttattatagaacattaaagtttgtgtaatttgctgctaggcatcgtaaaagcgtgtcaaagctgaaagacactcttaaaaaaactggtaatttgctggagaacactttcagctcaattgtagattgaaaatcttcaaaaagacaagaatacccctatggtcaaaagattttgagctaagattggagtgaagataaaatatgatgtatactagtgatgtacttggggtaatggtaaatttagaattacataatttctaaacttttactctaatgttgtgttgaagcatatgattctaggggcattcttgtctttctcaagaatttatcttgtcaattgaatcaaaacagtcctctagaaaattatcagtttttaagaatatatttcagccgtgatatgttttttcgatgtctatcagcaaattacacaaatttcaggtgttatgtagcaaaatttgcctaataattatatatttcttctcattcatctttttctgacgaggattattttcgagccaatggctggtagctctattgatctttagtctaagtgtgatagaaaaaaatccacgtgcataactgtgatagacgaacaagccgttataatctatttttcatcttgaattataggactggttttttattctaacttttaatttagaaccaaaaatacatcataaacgatggttttcaccgctattatagtgatttttggctaacataggctttattaactaggcccagttccatggttatggacctaattaaatgatacttcctccgccctaaaatataaagggttttggtttgatgtgatacatcctagtactataaatttggactagaagactgtccaaattcgtagtactagattgtgtcccatacaacctaaattccttatattttaggacagagaaagtatctgcattagaaaaatatgcaaaagtattattctagaaaaacagcgtacatttcaaacaaaatcactacaacatatgtagaaggtgaaaaacaaccgctattgttgtgcagagcgaaaaatggactgagtacaagggactttacccaatcatgagctcacctcgtagaagtacgtacgtatataggtcttgtttggatcctccgagctattaaatagccctctgaaatcttgctatttagaagtattaaacgtagattaccgacaaaaccgattccataacccttaggttattttgtgagacgaatctaatgatgtatattaattcatgattagcgactgattactgtagcaaatcatggattaatatacctcgttagatttgtctcgcgaaatagcctatgggttatggaatgggttttgtcactaatctacgtttaatactcctaaatagcaagattccggagggctatttaatagccctccggatccaatcagagccatagtactaccatgcttgcacgtacggttcaagactaaagtgttgtggctctatcattttatctattttaaaatataaatataataatacataagtataaatctatatttagatttatagaactaggattaattaatagaatacagccgtagaggcagcccacacgcgtcatctatggggaaaacaatgtgattagctaccaaggagagccaacatcgccgaatctatccaccaatcttaagattaaatgatagcataattttgataataacatgttaatttgatcaccaatagtttttaaatgatagcataatgcttgtgtctagaatttagcacaccttagggcctgtttagtagagctataactcctaaatttagcttcagtaattaggtttggagtggagttgtggagcagccaaaactcagcttcatctatcaaattcattttgtgagagcgctctactcagctccgatcttattttaggtagagctcaaactgtttaggtaggctccagctctagtagggatggagctggggctataccaaacatgcccttaatttgttttaaaagcatcaatggtgtgggtgcatgacttcactcacctggtgcctacaactattacccttatataggtaagctttctacatgaatttagtaagatcatagatgtgtcactagttttcatctatttgagcatgtgttaggggtgtatttgtgagggtgtgagtctgtaaatatctcgcgagtctggtgttgcatgtatagtagtgtatgctgcgctgacggtagtattgaatctactccctccgtcccaaaaaaaagacaaacccgggttttcgtgcccaacgtttgaccgtccgttttatttgaaaaaattatgaaaaaaattaaaaaaaacaagtcacgcataaaatattaatcatgttttatcatctaacaacaataaaaatacgaattataaaaaaaattcatatacaacgaacagtgaaagttggatacggaaacccagggtttgacttttcttgagacggagggagtactactctacctaccccattataaattttacaaattatctcttaattttttatattaaaaacaaccaaatttaaatagatgtccacatataaaattaataagtgaatatttccaagataggtaacatatttcatgaaaatatatttttatttatttgatataatactttctacttttttaaaaggagtatagataaactattttttttacttcggtattaaatttttcacatacttttttaatatctatatctaagctaaaaacttcttatattttacaacaaagatagtattatgatactccttccgtcccatattataagggattttaggtggattgaacacatctagtcctatgaatctggatagactccgttcagatttatagtcttaggatatgtcacatccacctaaaatcctttataatatgggacgaagggagtacatgttttttatatctataataaagcacgtgcatttaggctctcgtggatgtgacccatcatttctgtccaacctcgtgacgtacaaagatcaccatgggcttctcatgcaagtacagattgaatcacgagt

SEQ ID NO: 58073 - DNA, 6403 bp, Oryza sativa
agcgttgtcatgtttaggttaacccagaagatgtttaaaaaaaagtgttcggttttgttgtcgtgttttttttaccaagtatagtaaatatttacccaaaaagaattaccatccctgcaaaaagaaaaacaaaaaacatgaaaagcatccctcaccatcccaatcttttcagttttcacccatccgagttagtagtagtaattttcagcatgagctccctgtgagccctcctcttacagttgttcaccaaaccaaccacatcttccacgttcttcttctgccacacccattgactcctcaagttggcacaagaagaaaggtatagcctcaaccaacaagggaaattctccgctgtcgcaacatgaatcctgcatagtacatatgccctctccctgaaccctcctcatctcttttgatgaagagaggcaggagcatcctcaggtgtccttttccatgtggctttcatcagagggagggcacaagaggaaggaatcggcagctgcagtattacagccacatgaatacacagagacacagtccaaagcagtatcgctcctgctccttgcctgctgctcttgccagtcgacatgccactctcacctggtctcgatgggtgactgctaccagcaagccaccacggagtagtctgtggctagtagtaggagcctggcaggactgcagcaaagaggcagggacctaggactgcaaccaaaaatgtaccagatttactactacatgttacacaaggggagattggtgagcatttgccattttttatgcttggcataattttctttcatggttcacactggaacccttttgtcaggcaaacgctcagcacctcagaaacaatgtggattgccctctcttctttcaggctttgttgtatgatgaagcgttcctttacctgtttttcgcctgagattcttttaggggttttcttagtacggtccggttttttctttcacttatgttgtttgatttttgttgtcatgttaggttttccttgaccggatcctgtccccgggaagtttactcacgacttcggatggtcccaggaagttactcacgactttggatggcaaacagggattcattgtcgtgttatttaaccgcaaagtcgagctcactggcacgccggtataatagagctgaagcttctaccctgttgatagcaaacatgataaggagtttgagtcatgcgataaaacaggattcaatcaaacggattatcaatattcctcaccatcctggatgaacaacgaatctgcctgttgatagcgcccaattcaccttgtcagtcccgagggagttggccacaacatgggtgacccgatcatcaatttggttcgtgcaaactgcaccgaactgctcagcagtctgccacaaaggatgcatatggggattggcctctccaaccgggaaaatccggctaaagacaatacggcaaccaccaagtatcctctgctgctcagatgctagtatgctccgcacatcagcatcattgagattaggatgagaaaagaagttcttgtgaatgcgctcaataacctatttcaagaattcaacaagtatgtatatcataatcaagttgtattacaatacttaaaagttcagatgtagcagaaaccatcataccgcgagtgaagaagcaagagtaccatcctctggtctttcatctcgatcaatttcaagaagtgatggcccaggaagcccaaactgacgcctgctgcaggggaaataggtgtatctagaggaaaaaaatggaagggggcgtagtaagatgaacctgttgtactgctgttacctcatgtagcaagaaacattagacagattcatacctctctacaacaattaaattgtgtttgttgtgggccagactctcacagagtcatcaatgatcaccgctgcagattccatccccaacaccccatcaagatctttactttttggcactcgctcatcactgtcaaaaggatcaccatcatcgcctcttgagataacacgcccagcaaacagggttccagtaggatcaagaaccttagccatctcagtagcataaaccttgttgcccattgtgtacagatgcaactcataaagtttacttgcctacagcataagtaccaaacaggacaatattcaactctacagtggaaagatgcttatggtcatttgagagatatccaagatagcaaaccttctcaagaaagttccatattccaggtctcagtttggtccacattcccatatgattaaaacagaagagatggcgctctgccctctctcgatcttgttcctctttctttcgtaaaatttccccgtgaatatggtccacttctataaactgaacaggaagcatgtagtgtgttaacaaagtttcaaaaagtaaagttataggatacaaaaccaaatacctttgcagaattgaggagcgtgtgatccaaatcaagcaccaagcaaagtttccgtgctgcaaacatcttgtgttgttccttgatccgccttgccctttccttctgaatgagagccttctgctgatcatcataaccatcaaggagatgatcaacatctccatatgggctagcaggcggcacagcatcaggtgctgttacaggaccagtacttgttgcagcatcatcattagattcattctgtccagcagctaatcttggatctgccttatttacactacttgaagtttgctttgtattgccatgaggaggcataagtgctgtagcagctaactgtgaatttgagacaggatttgcattcatggtgactggccgtgctgatgatgtaacaggtagagaaggcaatgcaatagcctgaagttgctctgccttttggtcttggttgagcaaatggtccttgctgctctgagagtctggcggagcagttccattgcttttggcttgctcaacaccaactggaggaactgtatcgttcttctgcactatgttactatggagtatgcgacgaggatcacgtggtttcatacgtataactccagtatcattttgtgagtgctacacaaaaaagcatttttaaacataatattagtacgagatcctaaatattataacaaaaggatttggaattggcattagtaacacggtggttcaccgtggtatgacgcacaagctaatacgacctactcataataaaaacttagttttacctcatttatgtcccttgatatgcatataatatatatacttctataaaaagagttggcaataatgcaatatgatcactgtctccacacaacaaattgagttggtggattctgttaatggatttttgcgtgggcatctcaaaagttctccatgactcattgacgagacaaaaactatgcatgcaagtgtttaatataaactttgtggatgcagttttttctaacttatggcatgtttatttgagatcttttgcaaacttgcaaagcacatgccattaacatcatatggtatataaaattgtatttgaacccattaggaagcaaacagataaattgtaagtacaaacagaaaacacaggtgcactagtaagagagttaccatgggagctgactgcattggaacttgtggtctaacagaagggactgctgcaacttctgtggtctttggagcattgccaagtggtaaaaccatgccaggagttacattactagtcatgccaacagaagcagttaccttctgctgaggttctgatgctgacatcttctgctgttccatttgaatccattgcatgagcattgttggattgacagcaatgtcttttaacatagcaggcaatgaaacagcaggagcagaactggtttgcggagctgaattagtttggggtgcttgtacaattccaggactagttccactattatttgtcgtattatttaagttactagcaagtgtactatctgtcctgatattatgatttccagttgtgttatttccaagtcttgtattttgatttggctgaaacccatcactagaatatgagctaatattacctccatctttagcccacccacctcgacctgtaggttgcatatctctcaggttgccaatgacacccctagatctttttaacgcgttctcatccaccataggttcatcaactgccttattcttacggctattgattgatactccaccacccatggtcctatctttagaaggatttggttctgcaaaattcacacgtcggtttgcatctgcaacaccaccagtatcacgatttaaaaacttaagccttggatctctacttttagctgtagcttttagcaggtggttggatcctgaaacagagttttcaatctgtttagcataacctggtggaccacctgcaaaactgtcactgttgctgctaactgtgctaggtcgagagggcatctgattcacaattggcaacgcaatcttgtttgaagcagaaaagctcgaaacttcaccaaatacatcaccccctttgtctccagatttatctccatcaccagaaggagttggacttggtagatcatcgcttgcaaagttagacttctgcccatgcttctgttggtaatagcaaacagccttcagtgcatcgttaaaggattgatacgaagaattcttcgcaggctcaactctttctagaaccgatggtctgtcaggtgccattggaagtgctccatatccaatgggctttggcacatcaaaaggtggtttactatctcgagttggtgagggtaagctgttttcgtcataatctgcatgaagatccaacaaggggctaaccattctattctttgctggtatttcaaccttgctaaatgaatttcctgctcctgattcaaatggtagtctctctgataaaacctgaccagatggagctgcagcattagttgaagtggcatttggaccatttgcattgtcttttccatcctcaaacactaactgcctcacacggctatccagctgacacaaagcaaaagaaaaataaatgagcatgctaccacagccaaaattaataatggcagactctaaaaccacaaagtacaaggtttacaaacctcatctcgttggtcaggtgttagcatgtctgaatatctgttttttatgtggaataacaacctacacattcagacgagaacattttagtttatgctgcaaagaacacatagcacattagttctcaatgtgattagaaaaggatgaacttatattacttaagaagcatgttcttggtctgctccctcttcggcatgtcatacgaatttgccacctacaacaatgcaacaactgtgagctttacagtccacaacacagagccaagtcaacagtcggtcttacggtggtaatggtgtcgattccaacaaacgcctgctgcacaagggcatcaagcatgggcattgggctcccgctctctgggaataacggcttcaggttctcgaagcacgttcgcagacgcgtacatgcaccctcaaacgacctacagaacatcagaatcgggtccctcagcaactgaatcatacaccaaaacacatcgagcacatgaactttgccatatagaagtatcatcagtccatacttctcagcttcctcaatggagaccatctcaagctcctcgagtatactccccacacgctggtcaaagtccacttcctcctcctcagcaccggccggcgcggcgccaccgccatacatggccaccatcgactcggacttctccggcgcgtcggagtccaggtcgatggtttcgggcggctgcgcgcacggcggggacgaggaggaggtggtggtggtctgcacggcctccccctcctcgatctcgccctcctccttctcctcgtccgaggtgtccacgacgtgctccacctcgtcctcgtcggcggcgtcggcggcgcggggcacgagcggcttgttctgcacggcctgcgcccacgcgaagctgtggaacgccggcgcgtagctccgcgggatgttgtaccccatccaaaccctagatctctgctgcgccgcggccgccgccgccgcgccgccggcggccgacgactccttcttgaagtcgtcggcgctgatctcctccagcgaccccgacgagtccccgtcggacccctcccctccccctcccccaccgccgccgccacccgccgtaacgaggtctcccccgggtgccacgaccgccgaccgcggccgctcccgcgccatgagcaccaccagcctctcctcgtccttgggcgtcaccgtcacacgcatatgccgtccctctctctccctctccctctcccgcctccggcgaccgcgcgcctccgcaaaaatcgagtcgagctcccgttccacgcggccaaatccgtcgacccggagctcgatccgcagcgccccgcgccgcctccccgaccaaatcgccgcgccgcgcccgtggggtaccgagctcg

SEQ ID NO: 58074 - DNA, 14158 bp, Oryza sativa
gggcgtatcaatgcggtacacggtggctggcctttagctcgtgtgagtacattccttctgtgatgatgcaatggttgtgtgtggttggtttcttgtgttatccatgtgttggatgctgtattcatgctggttttcgtgggaatttactgtgttttgtggttattgttttacgattttttttctctcttcatgcagtttgggaattgaattcgcctccccgtcacgcaaaacgaaatacacattattgtatgattaattaagtattaacttttttaaaaaaaaatagattaatataattttttaaaacaacttttatttttttgcaaaatacacatcgtttagcagtttgaaaagcgtgcgcatggaaacgagagaggtgaattgggaaaactggggggaagaacacggcctaaataagcattgtggtaatgaatttggatctttgttcttaaaagatgagttctgcctagcttagggtaaaccaatgataaaagttattcgaaatgacttagttaagtgcgcacttcaatcaatattatttgatatttcagacaacaaagtcatactaaatcgcttattaattttgggcttatttggaagagctacatgcaactgcactatggcaacaacctacaatagctacgatggctgcaagggcagtgtaggttcaaccgcatgacattgtgacacgctcaccgaacggctgggttgtacaactgtagcctagaaattattgtttagctcttttgaaccacacctttttctctcttctttttttttcgggggggagggggagggagaagggttgggggtgcaccattatgccttaaacatcgtataaaagtgattggaggaagtgtggctaattaggatgaattctagtaggggaatgatatttttcggggatatacaaaaggattgtgtgcttttgtattaagatgaataaaactcatacatgtagggccaagcaaaagaaaagccagaaaccaaaagagggggaacaaaagatgaaacagaaaagaaaagaaaggacttatatattaattctattctcacgaaatcatttgaaacgacctagcgacataagcaatatactaatagtgctggcaatgatagtgagacaagatactggaggtcagcttcccgatccattgctccaccgcttccggcaacaaaatgagtggactaatagaatactcgactattcctctccttccaaatggaccaagttctaagggttgtgattgtgttgaagccgcggcggcattccatgtgcactttctttcgactagcgcacatccattcgttgaaagaggagatgtcagtggggaagcactaaggaaggccgagaactgagagaacaatccaccaaagctagagagattcagggcactcgttcgtttcctcaggctgatcgtgcggaacgatcaatttgtgtaaactttgattgttccaaatagggtcataacggatttggatcatgaaatatacttcaatttgctacggtttagggtttacatgtaacgaaatttccgagagagatatttccaatggcatttgtagagtctacatgttgttaattagttggttagagataagttagtactattaatattgaattagactggccatacataaacggccccaaaagagcaatgatatcatgaaccccttacatgtgtgattgcaattattcttcctttatttttttcagctaaatatataataagaaattttgctagctatgaagcgtagatgcaatgcaatcactcctacaaaattgatttttctatacaagaccgtctttaggttctagacgggttataagtgctctcgtctacaaaaatcattcccccgtgataggtttatgggccacatgcgaaaattgattttcacagaagggcctcttaatagacccacgtgtgaaaataagcgtattttcgcatacagacctgttaagtgacccgcacacaaaaatagccatatacccacacccatctctccccactcctttttcttttctccccacctctatatttcccgcatatatattctccccttcctactcctcccatctccccttcccactccccccctctacccactcttgacgagggcggcggcatcggcgaggacggcgactgcatcgactagggtagtggtggcggtctcccggcaaccgtggggagagcggatccgtcgtcggccaccacggggacgacggtggcaggccttgggcagggcgttgacgacgacggcggtggcggtagcgttttcccggcaatggcagtgccacgagaggagcattggatccacagccgctaggccttgggaggctagatccctcaccgacgaccccggggacgacggcggtaggcctcgggttggacaacggtggctggattagggttccagggctagggtttcgattttcggggcttttttgttgtaattttctattttcgcatgcggatgacttaagcgccctcacgcgaagttagattttcgattttcgcgtgcgggtacgccacccgcatgaaaaaatcgaatttttgcagaccttttcatgcaaatggatggaagatccgcacgcgggaataccgttttggccgtatggaaaaacaaattttgtagcagtgagtgctgcctttcctatacgaaatttgtaccataatagcccctttgtgcttgttttgattgctctggtggtgggctatccgtccagtttgtttgtggaatttgttgcgttaaccattgcttctcttataaacaaaaacaagacgctgtaattttggtcattattctacgcaggtgacaatctgactcaaaactattgaggatttggcatttgtctggggccacttttgtttagacgtcaaagttgactcgaaaccaccatgtggtcaaagaaatttttgtcccaaaaccgtcaaacctctcattttaggtgcctttcctaggaagatgcgaacaaatttgcactgaacctgcatgtgagaaatgtgtgtctgtatagtatatgtgtagtactacatatggtgtgtttagtttgcgaaaagaaaattttttggtgtcacatcggacgtttgatcggatgttggaagggtttttggacacgaatgaaaaaactaatttcataactcgcctggaaaccgcgagacaaatttattaagcctattaatccatcattagcacatgtgggttactgtagcacttatgactaatcatggactaattaggctcaaaagattcgtctcacgatttccatgcaaactgtacaattagttttttttatctatatttaatgctccatgcatgtgtcaaagattcgatatgacttttttggcaaaaaaaaatttttggaactacacaaggccatacttaatgtccaatgttgacacattatatagctcgtcaagtaatgtctaatgttcttcatacttgctgattcattccctagacctttttaagatacagggtacacctagtagatctcggaatacaagaactaattgttgttctctgtaaatgctgtttgaacaaggtaaggatcgaatccaaacagtgccgtgtgttacactcgccatgaataatgaataaatgaatgaagtacaacctggtacttaccatgttaggaaagcagcccaaaaagggacttcatgtcatttccatgttaagcaaccaaccgaacaagaatacaaagggtgtgttcacactaaaattgaaaatttggttaaaattgaaacgatgtgatggaaaaattgaaagttagtgtgtttagaaaagttttgatgtgatgaaaaagttggaagtttgaagaaaaagtttgaaactaaactcggccaaagatggacaaaatctggaggagaaaaacgagtagcggaagccagacaataaccaaattataatttggccaggcagacattactttgctttatgaaaaccccatcatctaaaatttaaaattgtaccgaacaaaaaaaaaacggcagcaaaagtacataagtaaactagtactagtagtagcaatcaatcgagcaacctaagtgacaaaattgttcgaaattacacgcaaatacacaccgatcgatgactagaagcgcaaagaatcaacttctctctgatgacaaatgtgctactcgagctagctagactgacgtctcttcttcatcaaacagaagtggcgatggtttcagagcaagaagaagaagaagaagaagatcagattcaggcggcggcggggggcttgccgccgccgccggcgacgagcttgtcgatgaggtcggcggcgtcctggatggtggtgatgctctgggcgttgtcctcctccacggtgatcccgaactcctcctccagcgccatcacgatctccaccgtgtccagcgagtccgctcccagctccgtgaactgcgactccggcgccagcttcgcctcctcccccagcgccagctgctgcttcactatctgcatcaccttccccaccgtctccgccttcgcctaaaatctcgtcaggttcagaaaaacattcagacaacacaatagaaatgccccattgcattgcatagttaacattcagacaaagaaagaaaggcacattgcattgcatcattgaacattcagacaaagaaagaaatgcccgttgcattgcatcgttaacattcagacaaagaaagaaaggccattgcattgcatcattgaacattcagacagagaaagaaatgcccattgtattgtatcgttaacatttagataaagaaagaaaggcccgttgcattgcatcattgaacattcaggcaaagaaagaatgaaagaaattaaaggccatctgcattgcatcactagcgagcgagttaccgcgcagaagacgcggaagcgaggggatctgagggagacgaggcctctccttgctgtcatcgtcttcatggagaccaggtttctgcttgaaattctgcttccctgcaagttttcagatagagtggtgcactgtcacaaagaggtttgcactgacagattaaccagagctggagttaattacatctacatgagcccacttctggatataattcttatgtaaagatgacattggcagtttggcaatagaaactagattgcacaagataaacctgtaggacatgcatggcgccataggtcacatatgggacatgttattaaagaagggattgaaattcccggtttttaattttggtcatacactggaaagagcacaaggaaaccttcaaagagtagtgcaacagtgtgctaagaattgtaagagtggtaaaccatcttttaaaaaaaaacatagaaaaacaacaacaagtttttagcctttagggttagggcaggggacatgctttcttaatattgtcatgtgattactgactaggccaagaggatttcactcttttttggcttcttttcagaacaaaactttatgtatattatgcatggttaggtcaagtagccctcaacattattccccttgttaagcagctgcagagcaagaaagcagacactaaccaaccaatgcctttgctgccccactttattaagcccctaatgacaacaccctttgtggttttgtaccacaaacacccccattatctcgagattagaaaaagaatagccgcaaattatgcaacactctcaccactaccactctaatcaagaaaagaagcaaatctacagaaacaatttgtaaataaaaacctacaaatcggaaaagatatctactgtagtaaagaacagcagcagaaataactctgtaacaactaacaagctgcaaggcatcagaaagtgcagggaagtcatcagttcttcaccttccagctaccgagcgccgccgccggcgggcagccgagcttggcggagacgacggcggacagcgcggcggccatggccggaggcggaacgacgaggaggaggaggaggaggaggaaggggctgggtgctcgacggagatggaaatgggaagagtaggagtaggattagatgagggggattagtaggggcaaatggaagctgacgtggcgtgaccgtggccgcccgctccagctcatcccccctatctgcgcgtgtgggcccggtctgacgaggcggtgacatgtgctgtgtaccgtgtcttttagagcaagtttaatataatagcaactattagctccaaatcatttataactaatgtaatagccaatttatacaatagttgtttattatactattaatatttggtcctacctatcatacacatattacatcttgaagtcggtactgcagctgactatagatctatagcccgctgctcttctctctcttcctttatctctttaaaatatatttataactggtttatagcatgctattatacctgctcttatactgtagcaagctcaacaacgattgaatttactgttgagtctcactgcaattcaatgcagaagaggttattgtcgctatacggcaagtgcaacgacaaatttaagctaagatcatctctaatagaatgtgaatttgactctccacactaaaatttgatcaacatagagaaaaaagaaagctatacaatagattctttattcgaatggccaaacgtagctaacctcctccactagcctaaggtgtgtcccacccccctctcccatctccctccatgttcctacaccacctcctctatctcttgtctcacccacaaataggcaacaacaccatcgtcgtcagggctactaaccgctatggatgtcgtcgtcgtctggcgtcggccctcatcgcgcgaaacaaagcccttgtgtcacgcaaaacagagcaatcgttgtgaatccgtcgtgtgagccacggctgacggagcgtggggctcctcaccgggagaccgcgcaggcccccctttgccggttcggccggggactcagggtgaaaatctaagctctctgggaatggaaggttcgcgagagtcgaaagagcataagacacgggcgacgtatacaggttcgggccgctgagaagcgtaataccctactcctgtgtttttggtggatctgtgtatgaaggagctacaaagtatgaaccagcctctcccttgttctgggttccgaatctccccccgtcccctctctaagtgggcaaggtcctccttttatatctcaaggggataccacatgcaccctctctctctttccaaactggacttgccttctcttcataaatggacggagatttgtatggttgctgtccgaatgaccttctgatgggacggcacatacctacctccacttccgccggaggcaggcgcgacgtgggaacgtggctgtctgctgacgacatgaccagtgtcagactgatcacaaatcggtcattcttgtccacgatgcgtcagcttaacagtatgcatgttcgcccttcttcacacaacatcttgcctgtaatggttaggatgaagcctggcgtatatctgacggggactaacgtgccatctctgggaggtaacacgctagctctagctggggacgcgtgcctagaagctctcgtcctgacgggatggggcgaggcgtgcgtcagaccgcctgtcgccacctaacccgtgatctgaccggtctgtgactggtcatagaccggatatacgagtgcactgcactgcgttacatgcggcgtgacacgctcagccaaaccgcaataaatgcggttaggtgagccccgctgtgctcacctaacccatacacgcggagcagaacccacgaggggtcggggcgcctcggccctcggggccgaggcgggaatggtccgaccccctcggggagactaagaggagggcgaacacatcaccctcgggcccgacgtcccccgagggtgccaggccacgtgggcgattgtgtctgcctcaagcctctagtcatgatactcccggtcccatgtcgccgacagtagcccccggcgttatgccagggcgatcgccctcttcaaggggagcggtcgggcgtgacgccactcctaaggcctggtgacaggtgggaccggtctccacaattgggcagaaacccaacggtcacaaatttcgcacatcggcaatggtaactcggctgtcaataatgagcggtctcttcaagactgccacattactcgagtagtacacgaatctggatgagccgattcgctttgccaggagatatggtaacgtcgcttcggtcggcgagcgtaattaacgcgcgcacgatatgatttatctcgactgccacaaccgcatatccacctcatgcgccgcaagcgggcgaatgggattagtggaagcgagggcgcgagatacgagggggcgaaatagtgggcacgagaagcgaggagccgggcacagcgttggcaagagtataaaggcactgaggaaaggatctgcttccttcctttcgccatcattccccttgtcttcgccgcttgcaccctaactccttctttcctgtgtcctaccttcgccacacgcgctcgctctcaatcttctcttcctccggcgccatggcacggggctccgctctgctcgatggtagcgtgctgccgccttcccgcatcgtgagcgagaggcaggctgggctgccacgccgcttcatgccggaatctgccaccggccgggagatagtcacgctgggcgagggacgcccggcgccagtctacccggggcggtccgtcttctttctcccctttgcaatggcagggctggttccgccattttcttctttcttcatggatgttctggagttctacgatctccagatggcgcacctcacccccaacgcggtgatgacattggccatcttcgcgcatctgtgcgagatgttcatcggggtgcgcccatcccttcggctgttctggtggttcttcaccgtgcagtcggtgtcgccgccgtcggtggtcggtggctgctacttccagccgcggaggccggtgttgaaccgctacatcccctgcgtcctccgcaagaagtgggatgactggaagagcgactggttctacacccccctcgccgacgaagcgcgcctccgacttccgagccagcccccggcgcaggcctccagctggcgggcgccggtagatctgggagatggctatgacgctgtcctcgaccacctggcgggcctgtgatcccaggggctcacaggggccatggtgtacggcgactaccttcgtcgccggatcgcgccgctccagcggcgcgcccggggcgcctgggagtacaccgggtccgaggactacatgaggacccaccagggggtcagatgggattgggctcctgaggacttcaagatagtggtccaacgggtgctgaatctcagctccgtggaggcatccctcattccccaaggagtcctccccctctgcagcgatccagaccgcgcctccatcctgaccatcatgcaggcggtcggggcgtcggaggagcgggcccctcgaggccacgatggcgcgggcgggagccgtaggggggaacaatctaccccgagagggggtcgtgcttctgggccccgcgacgggggcccggggagcagccgccctgccgacgcccgggggaagaggaagcaggaaggaacctcttccccatctcctccccgagggggcggggcggcgcgtgtcagtagcaggcgcccggagggggccgcgccgacatcgcagcccgagggggagcgcaagaagaagcggctccgcaagatgggggagacagaaccatctcggggaaacctcatttcccctccaaagtggtcgtttaaccgaccccctcgcaggttcgtctctcacccattgtggctgtattcattctcttaacacgagttttcactcacccatcttgttcgtcttctggtcttttcttctgtttcagcgagatcccgtcgcgtctctcccgccattccaagtccggccagtctgaggccgaggatccggcggccgcagaggctcggaggcgggaatctgaccggcgagaggccgcggatcgcctacgggaagccgaggagaccgcccaggaggccgcccgggctcgccaggccgaggaaaccgctcgggaggaggccgccctagcccgccaggccgagaaagccgctcgggaggaggccgcccgagcccgccaggccgaggaagccgctcgggaggaagccgaatttcgccaggacgaggcaatggcgacttccgaggcagctcgcgacgaggtcgcgggcgcgtcgcttgggcccacttcctcgggcgacgctcaggcgacaacttccggggcagctggcgacgaggctgcgggcgcgtcgcttgggcccactccctcgggcgacgcccaggaccaaccaggtccgagggacatccccgagtccggcacttccatcggcggcccgagccgcgtggcatcctctccaaggcggctcttccccacgccttctatcgccccgctgagcgcagagccccttctgcaggccttggccgccgcaaacaccgtggtgttggacgggttaagtgcccaggtggaggccctgcaagctgagcgggcggagctcgacgccgcatgggcgtgtgtcaaggaggggcggccctcggtggaggccatggtggaggtgggccgcaaggcacaccgccagcacgtctcggagcttgaagctcgtaagacggtgttggcggaaatcgccaaggaagtggaggaggagcggggagctgccctcatcgccaccaccgtgatgaacgaggcgcaggacaccctccgccttcaatacgggagctgggaggcggagctagggaagaagctcgacgccgcccagggggtgcttgacgctgccgctgcccaagaacagcgggcggcggaaaccgaagcggcgtcccgacggcgcgaagagacctttgaggcgcgcgccatggcgctggaagagtgcgcctgcgtcgtggagagggatctggcggaccgcgaggccgccgtcactatccgggaggcaacgctggcggcgcacgagtctgcctgtgccgaagaggagtccgcactccgcctccgagaggacgcactcaccgagcgggagcgagctctcgaggaggccgaggccgcggcgcaacggctggcggacagcctgtccctccgcgaggcagcgcaggaggagcaggcgcgccgtaatctggaatgtgtccgcgccgagggggccgcactgattgagcgggccgctgaactcgaggtgcgggagaaggagctagacgcgagggcgcgcagcggcggggcggctgcgggcgaaaacgacttagccgcccgcctcgcagctgccgaacacaccatcaccgacctgcagggcgcgctagactcgtccgccggggaggtcgaggccctccgcttggcaagcgaggtggggcccggcatgctttgggacgccgtctcccgcctagattgcgccggtcggcaggtgggcctctggagagggcggtccgtaaagtactccgccaaccagggaggcctcgcccaacgcctctcgaagatggccggggctctccaacggctccccgaggagcttgagaagacaattaagtcattctcgagggacctcgcccaaggagcggtggagctcatactagcgagttaccaggccagggaccccaatttctctccatggatggcgctggatgagttccctcctgggaccgaggacagcgcgcgcgcgcaggtccgggatgccgccgaccatatcgtccacagcttcgagggctcagcccctcggctcgcgtttgcccccaactccgacgaggagggcgatgccggtggtgcagacgacagtgacgacgaggccgtcgacccgggcgcatcagattgagcccccaggcccccgccaatcttcagtttcttcttcttttctttcttctaaggccttcgggcctttttttgtatagatcaacttaatctgtaaaaaatgaagaaattttttgtgtcaatttcattttgctatgtgtatgagatgaggatgatctgtgccatggtccttttgtgtcttagcttgattaagggctcgtgtccaagtcccagtcctcaaaaggcgcgggtcggggctagtgcctggggagatccacatgtcgagactggccaggccgggaacgtggtgaccgagggttatgggtgacccgattgtgggtttttgccgattcccccccggagctcaccacgccccgaggcacggctcggttctgggccccgtttggcgattttagccgacccgagcccccgagggcaggattgagcacgagtgacctatttcaagtcaagattcttcaaaaggaaaaaacagcacagatacagcctttaggaaattgaaatactgaaataagaaaaataagaatgtgcatgtgtggcagcccccggccaaccctgcacgcccgagggggtgcggggttggcccgagcccgaaacctgacacccgaccccccttaggggtagaagcgacgaaggtgttcgatgttccacgggttaggcagctctgtgccgtcgcccgtggccagccgtacggaacccggccgggggacgccgatcactcgatacggaccctcccacattggtgagagcttgctcaatccagcacgcgtttggacgcggcgtaggacgaggtcgtcgacgcagagtgatcgggcccggacgtggcgctgatggtagcgccgcaggctctgctggtaacgcgcggctcggagggccgcgcgccgccttcgttcttccaagtaatcgaggtcatctctgcgaagctgatcttgatcagcctcgcagtacatggtggcccgaggagacctcagggtgaggtcggatgggagaaccgcttccgcgccgtagacgaggaagaaaggcgtttccccggttgctcggcttggtgtagttcggtttgcccagagcaccgctggcaactcctcgatccatgaatcgccgtgcttcttgagtatgttgaaggtcttggttttaagacctttgaggatttccgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggtactccaaaccgggccgtgatgcccttaatgaatttaagtgcggagtgcttatcgatcttgacgaccggataagcctcgggccacttagtgaacttgtcgatcgcgacatacagatactcaaacccgcctggggcccgcctaaacggtcccaggatatcgagcccccagacagcaaatggccacgaaagtggtatggtctgcaggacctgggccggctgatggatttgcttggcgtggaattgacacgctttacatcgccggaccaggtcgaccgcatcattgggagctgtcggccaatagaaaccctggcgaaaggctttaccaaccaaggtgcgcgagacggagtgggctccgcattcgccttcatggatatcggcaagaagcataacgccttgtttccgaggaatgcacttcaggaggattccataagccgcgcgccgatagagggtcccatctaccagcacgtagcgtttggagatgcgatggacgcgttcactcccttcgcggtcctcgggtagagtcttatctgtgaggtatgcttgaatctcagcgatccaagcaatcaatctaagggtgctgggagtgctcccctcgggtcccgaggcctggactccgacgggcctcgggggccggtcaggcgcgtccgtctcccctaaggggtcgggtcgcgccgacgactgggcaagcctttcttcaaaggcgcccggtggggtctgggctcgcgaggacgcgagccgtgagagttcgtcggcaatcatgttatcccgtctgggcacatgccgaagctcaatcccgtcaaaatggcgctccatgcgccgtacttggcgcacgtaggcgtccatctgcgggtcagagcaccggtactccttacagacttggttaacgaccagctgggagtcgcctaacaccaggaggcggcggatccccagtccagctgccaccctgagtcccgcaaggagtccctcgtactctgccatattattggttgcccgaaagtcaaggcgaaccaggtatttgaggacgtctccgctcggcgaggtcaacgtgactcctacaccggcgccctgaagagacagggag

SEQ ID NO: 58075 - DNA, 3846 bp, Oryza sativa
tgactagcgggcggagggccaactctggtcgtcgggggccttaagccaccgttcggctcgagggcctctcctccctgctctctcccgggccaagtcggcacagggtggggaagcgcgaaatgagaattgtcctcatcgcgctccacaaccaatgccgcactaactacttgcggggtcgccgctaagtagagtagcaagggctcgtctggctccggggcgaccagaactgggggagagcttagatacgccttcaactgggtgagggcattttcagcttcctccgtccaggtaaacggtccggagcgtttgagaagcttaaataagggtaacgccttctctcccagcctcgatatgaaccgacttagggcggccatgcaaccggtgacgcattgcacatccctaagtttgctgggggggcgcatccgctctatagcccgtatcttctcggggttggcctcaatgcctcgggcagagaccaagaacccgagaagcttgcccgcaggtacaccgaacacacacttatcggggtttagttttatgcgggcggagcggagactcgcaaaagtttccgctagatctgtgagtaatgtttcctggttgcgcgtctttacaaccaagtcatcgacataagcctcaacattacgtcctaattggctacccaaagaaattcgagtagtacgttgaaaagtaggacctgcattctttaacccgaagggcattgtcgtataacaataggttcctatgggggtaatgaacgcagttttttcctcatcctccctagccatgcgaatctgatggtaaccagagtatgtatctagaaaacacaaaaggtcgcaccccgcagtggagtcgacaatctgatctatgcgaggcagggggtaaggatccttaggacatgccttgttaaggtcggtgtagtcgatgcacatccgaagcttgccgttcgccttgggaacgaccaccgggttcgccagccactccggatggatgacctcacggatgaatccggcctccagaagtcgcgccacctcctcgcggatgaaggcttgacgttccggggcctgccgccgcactttctgccggaccggccttgcgcccggccgcacggcgagacggtgctcaatcacctccctggggaccccgggcatatccgccggtctccatgcgaagacgtcagcatttgcccgcaggaaggagacgagcgcgtcttcctatttgccgtccagaagaccaccgatccgtgtggtcttggacgggccgtcgcccagggcaacctccttgaccgggacctcgtcgcatgtaatcatccgctgcctcggggtggcgggggcggaggtgccaagcctctcgttgccatcctcgggcttggacgcagtggcgaggtggtccgcgcgctgctccagacaagcgagcgcgactttgaggtcgccatggacagagatggggccaccggggcccggcatcttcatctgtaggtaggcgtagtggaccgccgccatgaacttcaccaacgcgggcctccccaggaccgcgttgtagggcagactgaggtccgccacatcaaagttcacccgctccgtgcggaagttggcggatgcaccgaaggtgaccggtaggtcgatgtgacctaacggccacgtgtgccccggcgtcataccgataatcggctgggacggccggagcaccatccccggggccttgatggcgtcaaaggccgcaggggaaaggatgttgagggccgctcccccatcaatgaggacacgccccaacttcacgttgcaaacggtgggggaaaccaccatcgcaatctgccctccccgggcaacgcacggtgggtggtcggtctggtcgaaggtgagggcaacctccgaccaccgcgcctgacgcgtcgcctcatgagtaggggccgcggccagaagctcttgcttcatagccttgaagctccggcgagaaacgtgagcacacgctcccccatcgatggtggcaatggtggccccaggctcttggaagcctaggtcatcatcgccatcatcgatgtcctcggcgggggccttctgcttggcctcacttcgccgattaccggagggaaccgccggggacctgccctcacggcgctcctgcctcctctacccctcccacttcctcgttcgctctgccaaacttttgactgcgcgacagtccataaggtcgtggagggaggtgttgtggacggtgcaccacttgccggctgggcgctccctgatgggagcgccggcctttttctttttgtcgctcgtaggcctccccttttgggtggcccgcgaagcgccctcgacggcgaggacatgaccctcgtcgtcggaatggactgacctcttcttcctcctcctgtcacgtcgccctgtctgagcggcggatccgggggcggccgaagctgccacaccggaaccggaggagttccaagtccaggcctcctccttgtgagccactcggtccgcgagctgaaaaagctccgcggtagtctggggctccttggaggcgatcttttcgagcatgcggttgtgccgcacgccccccctgaacgcgtagattaccgcgtgtgcagggatgcatggtatggtgttgcggatttgacagaaccgctgaatgtacgagcgaagtgactcatcatcccttcgctgtactgcgtgtaagtccgcttcttcacctgggcgcggatatgtgccctgaaagttcatggtgaactgttgacacaaatcctcccaggagtggactgacgcgggtggcaagttcattagccaaccccgcgcctgccccttcagggccatgggaaagaaattcgccatgaccctgtcgtcacccccagcggcctcaatcccggtcgtgtagacctggagaaactcggtggggttgacgctgccatcatatttttcggcgatggtgggccggaaccttgggggccaacggacattccgaagactcgccacaaaggctctacagccgacaccaccaaccgggggcacggagggctgattcccacgtccgtgttgaggtgacactctggacgaggaagcgccctccgttgcgtgggcagcacttcggtcattacgccggcgctcgatgctggtgcgggcgtccggccccccacgcagatcttctcgggtcgtaggagtcgacgaaggagtggcggccgaatggcgaacagcggctgccgctcgtcgtgcccttcgtcttgacgacgcggagccggtggtagcagcaccagaggccttggtggcggaggatcgcccaccagcatctaggcgctgccgtgccgtcatgactaatttggccacgtcgtccagccatcgttgggctggagactccgggtcagggacgacaggcgggtgacgtaagagcgcgcccgcagcttggagcgcgccctggggcgtgctgccgtcgccgtagacgaggagacgacgctccccatctcgccgttcttctccatcgcccgcgataggtgaagtcgcggatctttcgaccctctcgagcgcctccccccgcttaggactttggcgtggagggggcggcggagtacgagctcgacggcgtaggttcggctccccgtcgtcgccactcacactcggagagaggtcgtgcgcctttgcttgctcggccatcaggctgaacaggaaaagcttggcgcacaccgaagagcacaagagctcagaaaacacacactgagcccctacctggcgcgccagatgacggagcgtggggctcctcaccgggagaccgcgcaggcccccctttgccggttaggccggggactcagggtgaaaatctaagctctatgggaatggaaggttcgcgagagtcgaaagagca

SEQ ID NO: 58076 - DNA, 41976 bp, Oryza sativa
agtctatttatgcaagccaatttatttagaaaagtgttgagcgtataacatctttttttcagaaaaaaaataaaaaaaagaatttgaaacctatttaattactaccaaaacctaccaccatacccacaaatgcatgatcaaaatgtgcctataatctggtgaagggaggtgtaggtgccaacaacattgacgcacactcctatgaccagtatcccgacaatcatcgtcctctcgaagcagccaactcctcctcgggacatgtagatcttgagatagctcaggcacgggaccagcacagcaacggtgacgttcagcgaggacccgatgaacaacatgagatagccgaagaagggcaccgtgcatgccagcaccactgtgctgatgacgacggctatgctggtgagcaccctggtcaaccagttattctcaacgtccgtcgtcgctgacaacttctcctctatcgctgttgtgactggctggatcacaagcgtgtagttcgccagcggggtgatcagtgtcgtcaggatggcaaacctggtgtacagcttccctgtgggtaagttctgtgtcacctgcgactgcacatcctcaccatagatcagatatctcaacactactgtcactgcgtagtttaggctacacaacaccgacgagatcaacaaaacctgcacattaattggagagtaatagaacattattggagtactgatccatcatcatcatcatcatcatcatcatggtttcataaaccaaattatgataattggaactgataatccatgatcaattatcattggttgccaaatccctccaagtgaaagggaaaacttaaaaatgcaacatcattgagcaacatcatctgaagatatggataattgaatgcaacgtttgatcaatatctatcgttagatcatggatatgtatcagtaaaagaatggtgaaaggtccaagattgttcaagaaacttccatgagttaatggagcaatagtcaatctcctaccacttttgcatcttatccctaaaaattctcatacctattggttgagtctaaacttagtacaaaaatatatacaacacaatagatctctattttaacttggcatagaaaagtttatgatgcagcacatcttccaaatttagatatgttgccttttaatttatctaaaattgtattggactatacataaaattacttaaaaacaaattttgtaaactatgtattcaaatagctaatataattctttcgttttaagtgctagacacatcttctaactttaggtttaacatacaaactaaataacattaggcggcacatgattagctttatatttaagctacattgcttttacatgggtgtgtatgagtggtaaccaaatatagttgagaggcgaccctaattgcctccagtcaccggtttattccgctggagtgataggctgtactgtagcacagtacaccttcatgtcaccgcacacgttaaactggtcgaaaggccaacccaacattacccaaaatttacgtcattatgcaaaaaaaatattaatgctaaattgtgaatattgcacttgcaattaatttcatattgcacccgccattctatatcagtgtaaattaacattacgaaattgataactagtacaacattttttttagggatggaacaactttttttaataaatcattttaatgttgatttcatttgatcttaattcttaattttaattggatggtcaaaataaacttattggcttaacttttatttgcatgatgtatatacacctgctatatgatgggagtgccaacaaaatatattaagtatgatgagaacgtagcaactatgatgattaagaggtgtgcaagtatagtatgcatgattattgatgtatgagttctaaaaaataattatgagtgtgcgcgtcttccatgcatacatgtaataaaaaaacaatatgtttgtattcttactaaacctgttgctaatttatttcaccatttactattcaattttcattaacgataattctaaatttacattgttagttgttatcataaattttaccaaacttactatcaagttcaacacataaatacattttaaagtgtaccttaggaaaatccttcttggacttcattgaggagtacacggtcgggaagacgccatggccggcgaagcaaacgaagtagagggtgagggcggtgggcaacccactcagattcaagaggttgttgcccgccatgtggaagcccttgtcgggcacgccggcccagaccccgtcagcgccactgacgagatgagcccgactaccgagacataggtgagcatgctgaggttcttgagccacgtcatcgggaggatgacggcggccgtcgcgagcacgaacagctgcttcccgtgcacttggtaccctaggatctccaccaccgtgctggggaggagcttatcgaggttgtcgccctcgaggatgaggaagctgatggcgacgaggtagagctcgacgtacatgacgaggccgatggtcgtccagccgtaggcgccgaaggcgaggtagccgatgtctgggtagctccgtacacagcggtcggcgcacatgcagcggtcgataaggttgccggtgtagaagcagatggcgccgaccatggcaaagagcgccaggctaagccacccaccctgcaacggcataaccagaaatcacattgctaaagttgaggcagctcctcctgaaggaagcaccggtgatgcagaacgagacgccgtcggtagggaagagttgctgctccatgtcggtagggaggaggagctgctgctccatgtcgcaaatcatatcttcttctcgtgtttgctatggaggagagcctcatcgatagggctcttatccgccaccataatccccatgtctgtgtgtacacctattaaaccaaaaatcacccgacagatttttaaatcaaaaacacttagatttttaatagttacataatacacatatggaaatagcatgtataacttatcatatgtatcataacacataattcattattaaagataaccttatagttaaaaataaagtgcaacttacactcagtgaaaaatagaaaaaaataaattacatacaaatctaatagagattacattgtaatttaggcctggtttagttcccaattttttcttcaaacttccaacttttccatcacatcaaaacttttctacacacacaaacttccaacttttccatcacatcgttccaatttcaatcaaacttccaattttagcgtgaactaaacacacccttacaatgagtgaaaatgtaattattacaaattacactgtaaaagtactatatttacactgtaatttttttcctcgacttaactcctctctctctcatcattaccaggctttcatgccctgtatgcttttgggcaaagtgaagttgacaggaatgagtacactagacgattaaaaacaactttaaaatatttaattagtgagagacaaagataatcagtcatatgcatggttgtacaataccacgtagtccagcacacgcgagttaagagtttcgtgggagcgctgacacaaagaggtcacggatctaaagtttcgattaacggttgaaaaatcgacaaatcttaacggaaaaatttgtcgaggtatttttagcttaattgattattaattgagagttgagatgagatctaatttagaatgggcagaatatgtgagattagttatatgttgatatatcttgagtcgataattcatgagcgtaactaactggggcgctagatcaagctccaactcttctgtgctcatttgcacttcgtggactcgtacaattggtaataaattcgctttttcttctcctattttgtgtccacggttcaccattacgtccacaaccggtagagacttacatatgtaatcttgggacttacattgtaaatacactaaaattacatatgtaattttgagacttacaatgtaaatacatgttgactattttttcatgaaaaatatggcggaataaatatagatactctcaattaataatcactttaacgcgcggcagcatactgctggactgagagagcaaacaaaataataatctatctattattcccatgctggttgttttgccgcctgcctattggtccaggtggcacaacgcttttctgatgcgtgtacgatgctgcctatacacagttgtgcatggctcatgtagcatcatgggccaagtgccatgcacgattgaatggactaggtaggcccacgtgtgaagaaagaaaaaaaagaaaaagattgatctatcactgtacgtattgatttggttgcttctgtttacaccgtaattttgacaaattaatccttatattaaaactttaaaaataaaccatgtcaaaaactaattaaaaaaacagaccgtgaccttagcgccaaccctaatgacactaaactaaaacatctcagcaccacccaacatggcacaaattagccatgtaaaaggaactcaacgtcactatacattacgatgacctcttaataggtttaaaatatatagcatgtgctgaaatcctgagtagtgtttaactttattcgttttatcaaaaaaaagtgcctataagtaataaaaatagacaaaacaattttaaaattaagtagtgaatttaaatttatacaagtaattcatagcacatactacgaatgcatatgtaattttcaattattaaataaataaaccaagattagtattgctatgtcttaaacatatggtaaaggttaacatatatactttagagaagtgctctcacgaattgtgcttatcgttgggtattcttgcaaaacgctgttaatcctagaatgaattcatactggtacatgtatgtcttcctgaaaataggaaaggaacgtgcatttttttcaaaaaaaaaatatatgttcaatgtgttcaaatacaaaacatgcaatttcattaaaaaaaattacttattaacccaataaaacatagctagcatatgttaccactctttctgcaacctttttacaaacacaaaagtaagaaaaaatatttaagagttttgtggacatgagactgtctatatgacagccagctgaatttttgggtagtatcagccgaattttggatggtggaatctttcctaatctgacacgtgttaaaaatcctaatgccgcccaaatctccaaccactggttgacgtgtgtcacgatgagttctattttgagcagttaattaatgggtctgtcattgtcaatatcagttcaataaaactctgttgctcaactaaaatggcacgtcaactattcttaggttatgcggttctgctatacattacttcttctgctacacatcatacatccttttcgttcaagttgaccagctttatatataaaaaaacatagtaaaacttttgacatgaaataaatattatttaaaaatatataaaatgatggatttaacaaaaaaatatatgttttatcaaacttaaaaaagttggcttaacccaaaacgtccaaacaactttaagtttggccaaatatatagaataatatagtaatattttcaacataatataagtatattgaatggtatatttagtggaaccaatttgttgttgtaaatgtcactatgttttttataaactttgacaaacttgaaaaggtttaaacaaggacaaacccaaaatgactgaaaacacatagggagtagtacttaccgaaaaattatagttttattgcttttcactatctatcagccattaagtccattaagtaaaaattaaatttttttctattaatttcctactgtatagtcctcttcagtgcacacatcgcaattatcttcacctgcacgtgcttccaatctcaaaattataataaaataagagaagggcaaaacaaaaggaaattaaccctcgggcaagagatacgtatggaggtagagtcacaatgaaggaaatgaaagaaattaggttgttaaccaatttttcttatggaaacataatttttaaataaagcatgtttctctaaattttacaatgaaacaagcgatgggcagattaagaaaaaactagtgttcccaagtcagtgacggtctggcggattcagcatgggtggccccgctcaaacccctcctacctagttggatcaccatggagagcaaggagagtgggggagaaaaagaagagtagagggggctagagaaaggaggcacagatccccctctaattcaaagctagatcatacaaaacacatggtcctaatctacatatatacggcattagaatttgcagacaaaacaaagagtatggtgaatggagacaaataacaaaaaagggatataaaacgagcatactggtagggttaggagaaggcgcacacatgcagggaggaggcgccattggacggaagaaagggatatatacacctttcgttttgtaattatatgttgagttccgttccgaacttatatcagtatatcagtcaggtacttcgaacttaaaaattggtagttgttttcgttggattactctatatacctaataaaaaaattagtaaggcttccgtgagtttttttgtccgtcgtttttttcgctctttcttccttcttttttcccgtatttcttttttttccgtccggccttttttcgttttttttcttttttttccatgcgtcccttttttccgccgttttcctcttttttttctatccacttttttttcgacgtcgcttcttcgggttttttccgtccgctttttttgtcctttttcttcttttttttttgcacgttttttccttcttctggttttttcatctgcttttttccatctctattttttgtcactttttttggcacgcggtgaggattcggtttctaatccacttggtttttttttcccattgccaggatttaatctcaagctgttgtcctggccaaaccctagcgccaccgccacagtgatatgcctcccgtgcgtttcctactataactgattgcaaaaattgattccccaatactccctcattatttgatttcctcttaaaattcggctttacatcactagatttaatctccatttaacagtcatcattttcccataatttccccttttcaatttggatttaattcactagatttaatcttcgtaagccggtgatcttccccttatcgtttttatcccaagttttgtggattcgctctgatttgggaaaatctgaaaaaagagatactgatgtttctgctgttgtatcactaaaagatgtcttttcccgttgcaacgcacgaccatttttttcttgtcccatccaaattacaggagcaaggaaattacgaaaaaaacaagtatagaaggatatagcagaacattcagggtaactggccaaataacaacaatagggaaaaaagagaagaaattatagcaacgtagctaatttctcacctctcccaccaatttgtagatcgatggcggccacggcgcgcgcaccgcctacaccacaaccgcacgcacgggagagatataccggtggagacgcgcgtgacaacaatgacacggcgagctgtggtcaggagctctcactagcgggggttatggaagaaggttaaaagaaaatagcgggagaggattagatctatatatggaagaaggttaaaagaaaaaagaaaggaaggtagggttatgtcacgtcccaaaacgactctaaaatacatcctctaaattatgcctagaataattaaaaaccgtgtgaaagcctccaacaattaaaatgtgcaaagttaaaagtcaaacaaggcttagaggatttttgtatatttcctaaaaagcctaaaatatgtaaataaattttagtggaattttcagagcacaaataataattgttaagaaataaacaaagttaaaaaggttttataaaaagaaaaaccctaaaatccctccttctctctaatgggccaacttcggcccatctccctccccctctctctcctctccccgcggcccactcggcctctccccgcgcgcgcgccgctgacgggtggggcccacccgtcatccccgtcctcccgccgctcccgccgctccgcctgcgccaagcgccaccgccgccgccaaatccgccgcatcccgccgtccccgcgtgcaataaagtgggggaaatcactccccgtgatcccctctccctttccccccatctttccctctctctctcgcgttcaaatgggcggatttgcccccgcaaatctcgccggcgccattgatggcggccggacctcccgcgccggtttccttcccctccggccgctctctcccccttccaaccctatttaaaccctccctgcacctcctccgtccgtttccgcctctcgccgcccttcctccttgccggattcgagctcgcgacgtcgctctctctctccgccgtcgccgccgagctccggtccgccgccgtcgtcgccccggaccgcctcccacctcggcgccgcctccttcgggttcgccgcatcttcgccgacctcgtccacctctccgtttcggtcgccgacagccggaacgccgtcaaccccgtcgacccgagccgcgccgccgcctccctccgctccggccgcctcctccgtcgccgccgtcgcccaggggtgagccgtggaccgtcgcctcctttcctccttccctcccctctctcggccgccgctccgccgcgccagtggtcgccggcggcaaccatcgggacacgggcgcgccgcctcccgccgaccgcgccagcgtggccgccctcgggcgcgccgagtggctgccgcgtggggcccggccgtcagccgcccacgccctcgggtgcggctgacgtgtggggcccacggcgccggccggtgtgagcccgggtgcacccggtccaccgtggaccgtaaggctgccgcgtgggccccactcccgtggacccggtccccgcgccccttcccctcggctgacccaataaaccctttttaaattaaaatttaaatgaagaaattcgtaaatattcatttaaagagcatataaacttcaaatggccataacttggccatttgaactcgaaattggaccattcaagtctctaatttttccttaagaagtcaagaacccatttttgtgctttgttcttgctggttatatggagtttattagagtaaaagccttttcttttccgttggtcgtgtagacgctgcagctttggaagatccgctcttcgtggaggttgaagccgacgtttgggaaagcgagcaaggcaagtcacatcatccttgaacatattgaatcccagtttataaaattattttgatttaaattattgcattatcgctttatttaaattcccgcgttatcattgttttatctagtcatgcctatttacttttgttatgaccttattattgttattgttattattaccttgttcaccctagaataaacaaaaccccaactagtggacactctactcatggtaccactagtatgaatttagttagatgcttcgccgcttaattaggtaacattaggtggttttacaactctagactttgggatattcatatcacctggacactacggaatggttggattattgtggaattggattcacacctccccctctattcaaaatcctcaaaatggttttaggctgggctcggggtgcatggttttgatagtagcacctcggccatataaggaccggtcttcgggcctctattgcaaagcactaccgtactttcacatgtctagtgggtaaggcttagtttgtggctcagtctggttataaacaaaagtacacggatggagatggacgaagtcgggggtcgatggacatctctaggacaaatgaatgctacacgagctgcggcctggtagttgagatgtcatggcacagggccggtgtcctgctgctaggggctcagtcctgcctacctgtcccgggggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataacctattcgaatagccgcgccctcggttatgggcaagccgagcaatgtacccaagttagtgttttttaattcttaaaacctgcttaacaactaaaatgtggaatggttggcctgggttggcttgggacgagctgggacccagggtcgggtttccagttcggtctgaatcatagtaggccttacgttaaggcaggttcgtgtgggttcacggccttgattaataatcttgtatagctctaggatcgtatttacaaaatagctttgagcaactaagtgtcttttaatgctgtttactgcaaaccctaacccttcatactataaccccccttgtactcccttgcatttattctgcacttgtgggtgtgtcttgttgagtacggtggttgtactcagtcttgctcaatttttcccaaactcagaagaggagttcctggaagatcaaggctttggtgtctagctcatgcctgccgtcaagcgcctgtggtcgtcgccctagtcttccgctgtttcccgtttgtctttgtgtgtgctgggccttcgccgcccatgtaataaattaattatttacgcttccgcttgataaactctgaaatatatcaacttttgggtgtaccttgcttcctgggacaaggaataatacacgcacgtaaggaacgcccgttgggttattttcggtcgtgacaggttaggagaaggcgcgcgcgtgcgggtaggaggcaccatcggacggaagaaagatgatatatacgactttcgttttgttattatacattgagttccgttccgaatttctatcagtcaggtacttggaacttaaaaataaattggtagttgttttcgtcggattactctatatacctaataaaaaaatttgtaaggattccgtgagttttttcgtccgtcgttattttcgctctttcttccttttttttcccttctttctttttttccatccggccttttttctcttttttttctttttttccgtccgtccattttttccgtctttttcccattttctttgcgtccagttttttttcaacggcgtttcttcggtttttttttccattcacttttttttctgtctattttttagtcagattttttgacatgcggtgtggattcggtttttaatccacttggttttttctgtcgccgggatttaatctcaagctgtaccgccgccacattgatctgcctcccgtgcgtctcccgtgcgtttcctgctctaattgattgcaaaaattcattccctactactccctcatcatttgatttcctcttacagttcggctttacttcaccacatttaatctccatttaacattcggcgtttccccataatttaccatttcaatttggatttaattcactagatttaatcttcgtcagccggcgatcttcccctagtcgtttttatcccgacctttttggattcgctccgatttgggaaaaactaaaagaagatatactgatgtttctactgttgtatcactcaaaaaacgtctttacccgttgcaacacacgggtatttttttctagtcccatacaaattagagaaacagggaaattacgaaaaaaaaaaacaagtacataaggatatagctgaacatgcagggtaactagtctaataacaacaatagggaaaaaatcggaacgtagctaatttctcacctctcccaccaatttgtagatcgatggcggccacggcgcgtgcaccgcctataccgccgccgcacacccgggagagatataccggtggagacacgcgtgacaacgatgacgcggcgagctgtggtcaagagctctcaccagcgggagttatggaagaaggttaaaagaaaatagcgggagaggattagatctatatatggaagagggttaaaataaaaaaaaggaaggtagggttaggagaaggcacgcgagtgcgcggacgaggtgccgttggatggaagaaataggatatatatgcctttcgttttgatattatatgttgagttccgtttcgaaatcagtcatgtacttggaacttaaaaattggtagttgttttagttggattactctatatacctaataaaaaaaatttgtaaggattccatgagttttttcgtccgtcgtttttttagctcttcttcctttttttttctcttatttctttttttccgtccggccttttttcgcttttttttcttttttccgtccatccgttttttcgccgttttccccttttttttccgtgcactttttttcgacggcgtttcttcggtttttttccgtccgcttttttcgtcttttctttctttttttgcacgttttttccttttttccatttttttcatctgctttttgtccgtctctgtttttttagtcacgtttttttggcacgcggtgaggattcggtttttaatccacctggtttttttccgtcgccaggatttaatctcaagctgttgccctggccaaaccctagcgtcgccgccagattgatctgcctcccgtgcgtttcctactataattgattgcaaaaagtgattccccactactccctcatcatttgatttcctcttactattcggctttacatcactagatttaatctccatttaatagtcatcgtttccccataagtttcccttttaattcggatttaatttactagatttaatcttcgttagctggtgatcttcccctagttgtttttatcccaagttttgtggattcgctccgatttgggaaaaactgaaagaagagatactaatgtttattctgttgtatcactaaaaaaacgtctagacccgttgcaacacacgggtattttttctagtcccatccaaattggaggagcacaagtatagaaggatatagcacaatatgccgggtaactggcctaataacaacaatagggaaaaaagagtagaaattataggaacgtagctaatttctcacctctcccaccaatttgtagaccaatggcagccgcggcgtgcgcaccgcctacaccgccgccgcacgcccgggagagatataccggtggagacgccgtgacaatgatgatgcggcgagctgtggtcgagagctctcaccagccgggattatggaagaaggttaaaagaaaatagcgggagaggattagatctatatatggaagaaggttaaaagaaaaagaaaggaaggtagggttaggacgtacggggagtaggcaccgtcggacggaagaaacatgatatatacgccttttgttttgttattatatgttgagttccgttccgaacttttattagtcaagtacttggaacttaaaaattggtagttattttcgtcggattactctatatacctaataaaattattgtaaggattctgtgagttttttcgtccatcgtttttttcgctctttcttccttttttttcccatgtttcttttttttccgtctggcttttttcgctttttttcttttttttttctgccgttttcccctttttttttccatccacttttttttcgacgtcgtttcttcggtttttttccgttcgcttttttcatcattttttcctttttttttgcaagtttttttccttttaaagtttttttcatctgctttttttccgtctctattcttttaatcacattttttggcacgcggtgaggattcggtttttaatccacttggtatttttctatcgccgggatttaatctcaaccagttgccctggccaaaccctagcgccgccgccacattcatctggctcccgtgcgtatcctactctaattgattccccactactccctcatcatttgatttcctcttacaattcggctttacttcactagatttaatctccatttaacattcgtcgtccccctataatttcccctttcaattcggatttaattcactagatttaatcttcgtcagccggcgatcttcccctagtcgtttttattccgagttttgtggattcgctctgatttgggaaaaactgaaagaagatatactaatgtttctgcggttgtatcactaaaaaaacgtgtttacccgttgcaacatacgggcattttttctagtcccatccaaattagaggagcaaggaattatgaaaaaaaacaagtataaaaggatatagcagaacatgcagggtaactagcctaataacaacaataggaaaagaaaagaagaacttataggaacgtagctaatttctcacccctcccactaatttgtagatcgatggcggccgcggcgcgtgcaccgcctacaccgccgcctcatgcccgggagagatataccgatggagacgcgcgtgacaacgatgatgcggcgagctgtggtcgagagctctcaccagccgggattatggaagaaggttaaaagaaaatagcgggagagtattagatctatatatggaagaaggttaaaagaaataaaaggaaggtaaggttgggagaaggcgcgcgcgtgcggggaggaggcgcgtcggacggaagaaagaggatatatacgcctttcgttttgttattatatgttgagttctgttccgaactactatctatcagtcaggtacttggaacttaaaaattggtagttgttttcgtcggattactctatatacctaataaaaaaatttataaggcttccgtgagttttttcgtcggtcatttttttcgctctttcttccttttttttccattatttcttttttttcgtccagccttttcttcgtttttttttctttttttccgccgttttccctttttttttctatccatttttattcgacgttgtttgttcggtttttttccgtccgcttttctcatcctattttttgcatgtttttattcctttttccagttttttcatccgcttttttccgtctctatttttttagtcacattttttagcacgcggtgaggatttggtttttaatccacttggttttttccttcggtgggatttaatctcaaacagtttccctggccaaacctagcgccgccgccacattattctgcctcccgtgcgtttcctactttaattgattgtaaaaattgattctccactactccctcatcatttgatttcctcttacaattctgctttacttcaccagatttaatctccatttaacagtcgtcgtttccctataatttccctttcaattcggatttaattcactagatttaatctttatcagctgatgatcttcccctagccgttgagggagatccgtcttccccgtgatctcgtagtaggatgtgcattatcaactcaactctgctcatgtccccttctgtcgccgtctcgatgccacatattttaagatcggtgtttgtgctgattaggggctgttacatactacctccgtcctaaaagaaaatcaaaccctacggatgcgtgtgtccagattcatctctagagtttgattttttttttacgtatgcccagattcattcctaaggtttgatttttttttacatgtgtccagattcattcatagggtttgattcttttttagacggagggagtaagtgaataacaatttctcttgaagataaattgaacggttttgataattaaggtgggtccaatgccctattttagaattgggcggtgtatttaagataaacatagtaattcaggggatcaaatgggctcacccattgtaatattggaactatttgccacgagaaagcccatagctgtatagccgatttcttgcaccattagtgtgcatctcgttactactagttgggtttcgcttgtttcaactataatttacattccagagctaattttgaattttataactaaattttagaataaatttaggtgttcttttaatctctttcatcaatgaccgtgatgttcggactgataagagtaaaagtgtaaaagtcttaaacggacccctttagatagcagaaatggcaaaacacatgaatagaaaaaacacaatacttttaaaactgtataacgtgcagtagtatcgatcgagacgaaatacacatatacaaattttcaatgatgatctaatgctgtatgtttcttgattgtgtataatataataataagacaaacagaaaaatatgctagtgcttttgtctaaaactgcctgtttggaacaacatatttgggcaattggctaagatatgatataaaatttacccgtatgccgtgatggatcgaggcggcacacttgtcatctttcggtaatacagtaagagttgggccagaatagtattgtggctgacgtgtgggcccagcttagctgaaatggtattggggcttaacaatttttgccagcaaccttaatttgtctattattaatacactacgtttcagtactctgcaaggttacatatcccagatacagaaatctgcatgttccaactacttttacccagtcgtgtaggcttcgatttactccacaatctgcgtacagaatactgctgtttccagaaccaattgaagccatgacaccaatgcaacagtaactcatctgcagtatcatgggttattcttccatgagtcacagcatgtaaagtgagctagatgaatcatgatatcgcagcaagcaaaatacagaaagacaaggccaaatagcaggtacttgctccagacatccactcaaatcaccattacggatgaaacagattgaaatgacagttttttccgtccaatttatgttcctacccttaaaagtttattaggaaattaactatgaattaacccagtcacttctatattcatctgcccgatgcaatatattcctctgaacctttgttactgaagagataaaaaagatatcctcaaattaggcctgaaaagtgagctactggtagaatggtagagtgcaagatcaaaactcaagtttcattatctcatcatatatcccaaactactcctgaaaaaaaaaacactgcaagggtagatgatatcaacagtaataatgtgcaaaagctccatctaatgacaatcacgattatgcctccatcagtaactgagagccttcctctctaatcacaccccagaaagcctaactgagggtcttcgtctctaatccgactaaatgaaaaaaaacactgtaagaatcacaccccagaaagcctaactgacagtcttcgtctctaatccgactaaatgaaaaaaaaaaacactgtcagctgtaagggtagatgatatcaacagtaatgtgcaaatgctccatctaatgacaatcacaattatgcctccatcagtgactgagtcttcatctgagaaagcctaactgagggtcttcgtctctaatcacggcgcagaaagcatccctgtgacatgcaacatgaataacgtcatcagaaattcagaaacagatttcgttaataaaaaaagaattcagaaaagatcagttgcaagttgcaatcagtaaagcaattggcgcggatcggttgcaatcagtaaagcaatcggcgcacctcgatccacgtaacggagtgaccaacgatcagcccgagacccatcatgacgtagcaagccgcgtccaggaacctgccgctgtcgccgccgcgcacggcggcgaggtagatgacgtagagccccagcagcgccacggccatgatggcggctcgccccatgttctcctcgctcctggtgtaccgggacgggatgcgcgcggcggcctcgtcgtcgtcggcggcgcacgccgtcatcgccaaccccaggatcggccccatgagcagcgcgccggccagggcgatggcgcacagggccacatcgcccttgctctcgcaccaggggaagatctcggcggcgaacacggccaccatcgcgacggcggcgatgatgcagaaccattgcgggagaagccacatcagactacgatcgaatccggcgagaaaaaaaaaactgaggaaatcaacacggcttaccctaatcgcgaggagccatgggggcgtcgggttgcacgcggctgcgaccggaggcggccggccttcctcgagcaagcagaaccggagatcggccgccgccgccggagtattccccatgccgccgcggccaggggagggatcgagagcgcgtcggcggcggcgagtgtgcggcgagatcggaggaatttttttcgtttttagattttttttaatatttacagaaataatctatcgaccaaaaaaattacagaaatagcccctgccgccccaatggtgggcggcaagctgacgtggcagacggtgggtcaaccgcgccgtctgccaccgtcggccaaaattgcgattaggcccttgccgcccatacagagggcggcaaagggctaattgcaattttggccgccaataaagagcttgcggccgtacttttttcatctgggtcccttgccgccccagatgtaaaacgtacagccaaaagatttttctatgttatgttaataataaataaagaagtatttattggtaaaacttgttaatattgttataaaaatgtattgaagttggttgttgcgcaatttcatatgttaagtgagatattattttgtaccatattcgacgtattagtactcggataatttatataggcctatcgcagtctgggtcgtagaaacattatatggacttaaataaggagaattatgtaacatgaagaaatagtagtacaatttgaacatgatacaactatttgcattgcggttacatagatgatattagattcgaactaggagggaggtagtgtaatagttgaacacaacgacgatgtagtaatgggacaaggaagcatgacagtagaaatttcaatatgccaagttgtccgataatagctaacccctacgttaggatccctctcctctctcaaaccgcgctttagtaatcctgtattgctctggtagttcaagctgcacaacacggctaggtggagttagaacccttctggtgtctatccattctctatattgacatctccttggtggttcctgggaggaaagaatagatgtaaagcaagcaaagttagtaaatattgtgagaaaataaggattcatgtaatcaaaatattcttaccatgaaatcatcgtcaagaatatttggacaaacaaagaaccttcgacccaatgttgtaggatttatggaacgaagaacctgacaacgatcaccacacctgcatcttggacgggcttcccatggagggagtgcgtagttagcacccgccagtcgctctgttgttcacgacattgtcgttcataagccgtttttctctgtaagtattgctcagtactttcggatgcgaaataccagcgaccttcttgtaaacaagtggttaggtcgagaacgggattttctgtatcgacccactcgatgtatgcgcaagccgtagtgcgggtctgccgaatagagtagtgttacgaagaataaagcaattgcccgtacggaataaataagcatatgcagataataaaatacctcacggtcatagttagggcacctaaaaaagcgccttcctcgaatatcaggattcctcgaagccattagttggcatcgatcaccgcataggcagagaggacactggcaccaaggtggtagtaggtatacacaaggatcgctacgccagtttggatcctcaacaccccggcgtctagccattgacaaaagccggtcggatttgtaatgaagcaagtgggaaagagagtactgaatgtgactgagttctgaaagattgtgaggcctcactcgttaaggcgacttatataggcgcaaaaaatcgagtgatacccctgacatgtgaacgtggtggggtatggtgggtacggctgattggcgccgaaagttacatgcctgatcggcgccgaaagttacattggtcgtatgcgccaaatggcgggcaaatactcgtatcgcacgcgaataaaggaggctgcatcggtgcggcagaaagtagtcgtgcatgcgctgaaaggtatcgtgcatgcgccgaaaggtatcgtgcacatataacaaaaacgtagtcattacacaagcatacagtactagaaagtgaagcaaataaacaaagagaagactgctctactggccctgccccacgccgcgaccacgcttggtcctccgggcctgtgcttgcacgtggtcctgggagtaggtgaaacgatccggtggcacagcacgggtagcacgagtgtcccgcggaggagtggcctgcgcctggtcctgtgtctgcaccggcggtgcgcctcccagctgtgaggggccgatgacgtcctctgtcaagcctgaagcgaagtcgaagtcagaaatgtcgaagagcacggtggaaggcagcaagcggtccgacgaggtcccagcatggtccagtggtggaccctgactcgacgtgctagctgcctgtgacgaagtcccggtgtactgccagaactgcactgagtgcgaggtcgacgcagctgcctgagacgctgaccctgcaaactgggagaagtgggcggcctgcgtcatagcgaactgggcgaaacctacacatcgacaacgggacccttgtaagctaagacataaaatgcatgtaaattgattgtcgaagtaatgttgtttttttaagtacctgtggggggcacaacagaaggcctagccaaggaaggcggggtgctgaacagtgcacgaaaccctgaagcaatcggcaagtgaaacagctcacttatatgtgcgaggcatgtacagaaatagtaataaaaatacttacctccgtgcggagggggagtcggcctaggaacgtgcgcagctggacggggaccagtcggtacgggtggccgctgtacagctgcatctgcccgagcaacgtcgtctgcacgacaggtgagcactcggagaatcgagtgcatcgactccaccatccgcgtgtatgtcgtcaggtgctcctctacgggtaccagaatccccgcgcctaaacgttggatcgtcgttgaaccgtcaacgacgacccggttgatgtcgtcgacctgcatggttaatttgttcgtaaatattcgtaaaatttgacgaagagaaagacatgaaaacataaaggaatggtgcgatgcagggtactcacagcacgagcgaagtcctggtcgcggtgcctggcgtagaggtctctagtgctcgcaacatggggctgctgctccaagggagtgaaggtgaccctagtacgggtgtgtggccctccaggccttggcatagctaatagtatacttgtatgtctcttcgatgtgtcggattattgaccttggttcatatgtgagattatcgatgacatgcgcatacatctaagatgcaacaaatgcacatgtaatgttcttgtggtatttctgaacaccaggtagaaaacatgtatgcttggtaacaactgacactgtccaataatccttccatttccccttatatgcgtgcactctccagggacaaccatatttttccttaacacaccgaacttcatattgcgaccggttcgacttggcaacccaaaactctctatgaagtgacactgcaaaatgttttaccgcctccttcatatcttctgctctactataaatcgctccctgaataacctcattttctttgtactcccatctcacactatcctcttcagagacgatcagcccagaaaaatcctcactagcccattctgctggattaatatccgtctcatcatctaacgaatcaccttcctctacatgctcgttgtcagaatcctccctctccatttcatccacaatggcaccgacagtctccccctcgtcggccactccacctggttgaatgcccactggagctactacgcccccgtcctctcgtgcgttgacctcctccacagaagtctcatttacttcagcacttggtccctcgccatcatccatgttcatctgcacacctggatccttcgggtgaacaaacggaaccaaagctagaggccacccgcgttgcaatgcattttccaaataccatctccacactcgagagttttgaactggcattagttcccaataaaaaccctcatttgcccgacttactataacattgattgttatgtcacttgtctgtggatcaactctcaagcccctcattaaccatccttttatagaaggtacactcctctcagccggtctatcaattcccctttctgatacaataaaatctgacagatctaccccagttggcccgtaacggacgtttcctggtctatggtaaacttggaatatttgtttgttcgacatatctgtcaacgaaataactagatcatattactctttcatgcaataaacatctacaacgtaatatcttcttgtgtaagccaatgcaacggtaatgtattgattccaaactagcagatctacgtagttaccgatatctacaatacgcacttctagattagtacaactaaaaccctaaaaatataatgcatttattcaaacaaatttttaaaaaatacacactatttaactcaatagtcacatataggatctatgaatattacatgaaatcggtatctgaatccggcagggcttcgccccttcttttcttctcctcccctctcttctttttttttttcactggaactgaggagggaggaatgagggctgggggctgggcggtaggccttttataggcagcgaggcctgccgccccaccagagggcggcaaggggccacctgcaaaatagccggccccgactggcttttttgcattcggaccccttgccgccccaccagagggcggcaagggttttcctgcaaaaaaccctccctccgtcaccgcccgttcctcccccgtttgccacgtcagcttgccgccccagaggtgggcggcagggtctatttttgtaatttttttggccgatagattatttctgtaaatatttaaaaaaaaatctaaaaccgaaaaaaattcgagatcggagggggcgtggctgtttcggattcgttggtgagaaaggcccaatttgtaacattagttgggccagaaaagtattacgtgcaggaaaaaagtacactttaactctcttaaaaaagtacgtcgaatctaattcgtacctctcaaccagaaaaccagataagacaacttcccaactattgaaactagtgtaatttaactcccttagtggttttgaagtgtggttttgctaacatggcggtgttgagctggtcttcatcccacgtggcgcttaggtagcattacaacccgttttagttgggcgaatttgatatatatttgtcgacaaattttccatcaaaaatttgacagatgtaattacaatacaatcgtggtataattacactgtaacttgtatgtaattacactataactataatgtaacatgtatgtaactttcaaaaatctctccataacatttatttcggtaaaatggaggttgtgagaacaaatcctttcacatatgtgtgtgatgtgatttttcttcttcgtcaccagaataaattttttaatagatctaacgattcaaaattacgtgaaacttatatacaagttacactgtaattacatacaagttacagtgtaattacatacaagttacagtttaattacactatgattgtactataattgtatctgtcaaatttttttagaagaaaatttgtcgacaaatatataggtggtccccttttatttgggctagatctaacggaacaaatgagctcaaactaatgtgccaaatttttttatttgccgtgcgttgcatttttttgtgatacatccggtattaggtagggtgaaaacggtatggaaatagacggaaaccacctttatcgtttttgtttttatattttttttagaatcagaattagagtcggaaaccccggatacgaaaacggaatcgaatattattgaaactgaaaacggagcaaaaataaatcggcgcgaatacggtaacgaaaatttatcggaatacaaaaatccctcaaactgataaatccaattctcaagtctcaatggtcaacaattcatcataaaacacaatcatataagtccaattgttaagtctcaacagtacatcataaaacacaatctatggaataaattatctatgtttaagagagtaatgctgttgataaatcccaatataggaaaaaaatattattatgtaccctcacatttgcataacaaataatttttaaaaaataacagccaaacaccatggtattcactattcagtgtttaaaaaaaagaatccagggtatttcagtcacaaaatttctggaaatttcgagaaaatttccggaaattttccaaccgattccgagttccgacgaaaactacccttatcattttcgattccgtttccttgaaaatatttccgaatttgtttctgtttttgaaaaattccgaaaagaattccaaccaatatattccgttttcgaaaataggtccggaatccggaaagtttccataccgttttcacccctattaggaactgagcaacgaattgaaacatttggatcgctatataatataattgaaaaagttaatgaaaattgttccttggttttgggtctttttgtgctggagctgatccgaatttggtttattccagtaaattaaaggtgaaatgaaagggagaaatcaagagaaaaatcacgagagaggagggggaattgatttttgcaatcaattggaggagaaacacacggaaagatagatcaaagtggtggtggtcctagggtttggtccgtctgcagagtacaataggtcggatgagataaaaattcgaccaccgaaaaaatagaaaccggatgaaaaaaaacacgaaaaaaaggaatctggcaaaaaaaaaacagcgaaaaaaaagatacgaccaaaaggtataccataagctttacttatttttttaattattattattaggtatagatatagatagatagatatataacatttgttttgttattaaatctatctatacctctgtagttcaacaaatgattccactcattctttcattcatcactcaacggtctagattgtctcgctaagatccaacgtcccagattttcctccacctccccacgaagatcgcaccaaataattcctcccacctgcgcgcgcatacgtaccccctcccacctgcgtggatgccgccgatctctccaaaaatcacgcgctcgtggcaatgccagccggaatcgctggggcggtctccttctccctgaccttcgcgacgatggcggaggcaaggaaaggccgcccatggatctgctgccgaagaatcgtggtgccccttctgcaacaaagtcagaggtgatgtgctcctgcttccgtgcactcctccaatctagtagcgttttcgatgtgcattagacctgctaaaaaggtacttttcgtgttgatctggttacgataaatagttcactagctgtaatttgcctttctatcttaatgattactatcgagaatatagattataatttgtattttggttgggaggcagctgtagaagcagtttctgacgttgggaggtttcaagcaaccatagaagttaaaggacaagcaattgtcatgagtttggcggaccaacattcttcagttggatctggttgatcctacagtttaacaaatggtttcacttattcttttattcatcactcaacggtaagattgtctcgctaagatccgatgtcctagatttgccccacctccccacgaagatcgccccaactgattcctcccacctgcgcgcgcatgccccctcccacctgcatggatgctgccgatctctccaaaaatcacgcactcgtggcaatttcagaaaccaaaaaaaaataaatcatgcactcgctattctgccccaaaaataccgcatctcctagccctaaatgccaccgtccaccggatcccctccacctcgccctcaagtcgccacggatccgtcgccggcggacagtttccgtcgacaggtcaccggcaatcgctcaccatcatccgtgatcccccctccctcagtgccgcctcaccgtccaaggcaaccgggcctcgccactgccccatccgccgaccaccgtcgcctcatcgtcaagtcatcgctcccttgatttctcggtgccagctcgcatcaactccacacaggccaagtttcagggcgctagctactcttttttttttcaggggatagtattagttttatatttctgttggatatgaggtatttttttattatgtttgctggagtgcttacttttatatcttttatggtttaaattacaatttcaatgaagcttgattatttgttcttctgtgcatgcaaatggattgccttgtgtatagagtatgcaaaatgttagtttgaagcaatatatattgtgggagatatacatttgttatataattagcaatatattaaaccattctttttattatctgaatcatatatttctgtattgttaaatatatccgtagcgttagcacgggcaaattactagtgtagtctaataacaaaacaaattatagattccgccaagaaactgcaagacgaatttattaagcctaattaatccgtcattagcaaatgtttattgtagcgccacattgttaaatcatggtgtagttaggcttaaaaaattcgtctcgcaatttcttggtaattggtttttttttctacatttaatactctatgcatgtatcaaacatttgatgtgacagcgtataaaattttgtctgggaactaagcagcccttagtatatcctaagtcgcacatgtccgtagcactggattcggtatgctaagaaagcaattcgattgagtgtgcttagatgaggctagcccaaatgtccctgtcacaagcaattgctcttcatgttagcttacctctaaagtctgaaccaccttccatttgcatgccaaaagaaagagggcactgtcgttggttcgtatgcccgatttgattgtgtagctcttaatgctcatagtcataattaagttgtaagcagattgtttgaacgagtctcatcttctgcttgaattgttagcttatatatgtgtcataaccaaaattttatttctagaacttaatgttgacttttttttcattgcggtatatttttcaacattaacttactgctaataacatagacataaaagttttacatgtaaactattttcattactttatttttttttatagttcatgagttagagtcgaagtcaccaccaaagacattatttctctccctgtgtggcaactacttgactcctcatttggcaactacttgatagggctagatgaggcacacctctgtgaagtcagctataaaaaaaatttaagttctcaaagaatatggttatgtatggctaaaatagtggcactctaattgtagtattgaatcaaattgttactcataagcagggacagatccagcgtggccttagagggaggggagggaggggggctcgagccccgttggatctctatggagagagaaggagatagtggagggggaaacaggaagaggaagaaattatatcttaaatctcaggcaaacttgtcacatcacctataaattattacattctatagctcaatgtaagtatgtcaaagtatcattctaaaatattttaacatataatcatccattatttttataatatttaatatacttttatccataaatttcacatcaaagtgtgggccatcatctagtttatcatttatttattatattctcgagctcaatatgcaagcatgttaaattactattccacatcattttgaaatatttcaacatatgagcatccatcattctaaagtatttaaaacacatttatccatgttttcgcagcaaattatggggtataatatattttatattgtgctccctccatccaagaatttaacatactgtttcgagagcaagttgaaagttagagtggaatggagtaatggagtaacgtatctcactctttgggtattctttccatgcctattccgcagacaaacgctcactttccaatcatccaatatgctgatgatactctgataatcatgaaaactgatcaaaaagaactgttttgtctcaaagccttgttgaacacatacactctctgcactggtttaaaaataaatttccacaaatcttgtatgatccctaccaacacttatagccaaaagttgaaaatcctggctggaacctttggatgcaccataggggccctacctttcacatacctgggccgcccaatggttactaccaaacaaaaaaaatcattgactttgccccactcattgacaaaattgaaaggagactcccatcaaccacagctttttttgaaccatggtcaaagattaacaatggttaactcagtcttatcatcgtttccaacatactacatgtgcatcctacatcttccaaagaaagtgatctagcacattgacagagcaagaagacattatctatggagaaaaagcaatactctagaaactaaaactcattgcttggctacataggatctggtttgcaaacctaagaaaaaagggggacttggaattatcaatttggaacttgagaacacggctctgctaatcaaacatctagacaagttttacaacaaaaaagacatgtcgtgggtacacttgatatggaataaatactactctcactctaccatacccccacataaagaaaaaggctccttttggtagaaagacattttcaggctaacccccctgttcagggcaatcacatttgtacatattggctcaggagaaaccactcttttctggaaagacaaatggaacaattcttgtctacaaaataagttctccattttattctcatatgcaaaaaatgaagacatatcagtacaagacttcttatcaatccatgagttcaaacataattttcacataccattatcaaatcaagcaatgcagcagtggcacatcctagagaataatcttctaaacattgacctcaccaatgaacctgataaatggaaatacctatggaactctgatcaataccaataaaaaaaggtctataacatgttctttggacacatcacaacaaacaaaccattgatactgatatggcatagcaaatgtactatgaaattaaaagtgttcctttggctgatgttactggacagtctcaacacaagagaaatgattcaaaagaaaattttcaacattaagagtggtgacaagtgtgttatgtgtcatactacgctcaatgaagacatgtttcatttattcttctcctgcccttttgcacaacaatgctggcaacacattggaattcaatggaatctgacaggagaatttataaatataatcactgtcatggttacggatatggcataccttctatcctacggcttatggaatatacggatatggcataccttcgtatgtatgatacatcttcatatatgataaggaaatcaataagagattatggaaataatcctcacgggtaagtgaaaagcagagtcctactcgaagaggattaggattgtactatatcgtgctgggttcggtatctccgagttctacttagagataaagttaactcatggtataaatacacaccccctgggaggggtcctatggcatcgaatcatagcgccaataccaccaccatagcctacaattcggaggacgtgaagcctactcgccgggagatctcgtcgaaaccatctcgacaagggtctcgctggtaatctcgagatcgactgttctctattgtaatccttggttttccatatcaatctcatataaagtggattagagctattaccttacgaggagccttagccagtataatgtttgtcttcttgtttgcttgatgtcgtattgtgtagatcctcgtaccaacgtacccaataccctatgtatccggtctacgtgtatcccccgtcgataatcacaactgcctataacaatttccatcacaaattcttcattaaattgcttgcaattggatcttggcacatttcgagcagaagaaatgattacgtcttcaacaatatttcggtcagttttgataaatggaaggacagctttaagactgaatttggcttgcatatgcacatggcaaaagaagtagacaaacccctatggtaatcatggatagatagcattctgtaatttcgtttctttttctttttctttctttctgtttcttttctttcgtcctgtacgtaaacccctattattattattattattattattattattattattattattattattattattattattattattattattattattattattattatagcacaataggcgactctccagctgtttcatgtaaaaaaaagtaatggagtaagggagaatgtgagggtagtttgatccaattatacttataataccatactaatacatatggcatgtcttttattcctctcctaaaagaatccaagccggctatcatcgtggaggcatacaactacaggaattcaagtctgctacagtgttgctatttatattccatggtaacttttacctaagaaattacttaaaaataaagtgaattgcatatcgggctgtttttattttgaaagttttactttggatcacctttaaccaatcctctcactttggactatctaattttacatttgttatattttgaacaaaccaaaataccttccctagacatgtcaggtctctactctagcaaagggtatagtctatgcatgtataagaggttggccatttattaataatggtgtagtatataaatatatgtaactattatatgagtggactactaaatgacgtgtcaaatgtgtttttacctaggagagtgggtggtaatgcaccattcgttctaaaatactactgtattcgacatcacctagtttcatccagatgagatggtggtatctagtacagtactatggatctcatctttttgcttatgcttatgtttatcagtcaaaatttgaattttcaaccttaaatttgaagctgattttgagttttttttttcatcgaagtttatttttcagcctttgcttttaggttgctaagaacacgaatataaaagttttattcacaaattatttttcatctgtaaatatgttgtttttcttattcgcgtatgttgatataatttagtgctaccagtatgcttatagagcttattttttgagtaaagtgcaatgccggtccctaaacttagttcgctcatgtcatccaggtccccaaactctaaaaaatacatttttagatacttgaacttgttaaagtgtattattaaggttctaaattttcatgatccctctgagatcttacatggtgctcacgtgacatgctacatgggtgttgactcattttatttatctttttctccattttttctgttcttcctttcttttgatgtgggaaaaagagggaaaaaaaagaataaaatgtagtggaggaaaaaaaaagaaagtttggatctgaaatgttcatgtgacatgttattttagtatccacgtggcacgatatgtaagcatcacgtaggatcgtagaggggtcgtggtaatttggagtcggaataatacactttaccatgttatatattttaacatgttaaatgacatagatgaataaatttagttacatgtgtcgcattttactcattagtattatttttagtgaatatttagagcggcgcaacagggatccgcttctctcatcatttgcaggcactagtgattagcgccacacgcacgaactccatccacacgttctcttcccccaacaaataataaacaatccatggacagaatgcatcatccccccaacattacatcgcctccacaaaaaaaaaaaaatatccaaccaccttttccacttccaccaccgctctcttctccaccgcgatccaaaacccaaaccaatttcatttttatgcaccccaaaataaaataaaaataaaaataaaaaagcttcgtcgcgccgggaaagttggagaacgaacgccatgagcgccgacgaggacgcggcgtcgcggggcggcggcggaggcgggaagaggaaggcggtggcggaggggggctcgccgtcgccgctgtcggtgctggcggacgacgtgctgctgcagatcctggggaggctggagggggacccgcgggactgggcgagggcgtcgtgcgcgtcgccgcggctcgccgcgctgctcagggcggcgtgcctcccgccgcgcctgacgcgggcgctccccgccgagctcctcccgccgccgtcccccgacggcgcgcccagggcgtgggccgcgctccacaagctctccgtctgctgcccgggcctcctccgcgccggcgtcctcctcgagccctccgatgacttcggcctcgagctcgacatcggccccgacctctccgtccccgccccctccccttcctcctcctccctcgaccacgcctccaccgctacctccgcccccgccccaccccccgactcctcctcctcctccgccgccgccgccactacgtggtcgctctacgacgacctctacctcgacaccgcctacgactgctccccctccgaggcggcgcagatctcaaacacggctgcgacccccgcccccgccgcggcgcggcgaggggtggcgtcggggagcaggaggcgggcgcggcggtggctggggacggtgggggcgcacctggcgtccgggtcgtggacgctgagcagggagcaagggaacaagctgctggcgagcaggttccgcggcgaccgcctctacatctgcgactggcccgggtgcgtccacgccgaggagcgccgcaagtacatggtgttccgcggcgtgttccacgacttcccgaggtcccaggtgcgccgcgccctgcgggacacccgccgccccaccgtcgccgtcgactgcgccttctgcggctgcaccgaggcctgggacctctacgccgccttctgcctccgcagcttctacggctaccacgacgacggcgagcccgtcgtccgcgcctacgtctgcgagaacggccacgtcgccggcgcctggaccgagcgccccctctactcctgactgcgacacccacacccatggttcggtatgcccactctactgcttttgctctctcatggatgtgcagccatggccgccattgccaagaatgccaagcaaacctttacttgtgcttgtgataattactccatgtgtatatactactagcaatgtgggtatcagatcatcacctctggagattatgcagggctgatgtgatgtgatatgcatctctttgtcttgttagagatgaatcagatgatgcttaagctagcttaataacgcgattaccgcgcttccgtcgagcgaattctcagcgcgattcggcgcgatcgattaagagtgtaacttctgatgatttgcacaagaacacagttatgatgcaggttgatgttgtatttgatattaggcagtgactcggttacgctctctacttgctgatgagctggggattcagaacttgcatcaactgttcttgcttgctgctgatttgcagtagacctgattgttgtacatgcactgcaacctccttcagctttattatcttcatgaagtagaatttgcaaggttcttgctctctagccttagttctgatacaacctgaaaatgctttgcttgccctttcctgattggatttaaacttatcatcgatctagttcatatacctaatctttggctactcagaggcaactaacctcactcatactgtcatacacactgtcaatcatgcatgcctctcctttctgaatattgtagtagtagcttgcagcctgcagaaagggcttaattttttatgatattatcaatggcaacttggcaatgacagccacttgttgctctttttttccccctaaactaatgggtaatggcagtggaactgtggaagtactaacagctgagtcctctccgaaccgcaggagatagttgcccgcctttgaaccaaactctagggaacgctcaattgcctgacggtttacctgatatagaaagagggagtgtgtaacatacaatttttttggatagccagtgtgtactttgtagcatggtataagattagtttatgagatagtgtatggctgttgattctcctgccttttcgggactgattcactgccggctacttgcctgcctgctgcatggagcgttggagctgatgatgctgcaaaatggcgacgcagaggcatttgttttatccattgcgttggcgtggcagccgctcggtcaccatctgacggacagaaacttatcatgttggttcttgtatattattgtatggtatgacaaattactagtagtacctttctgtcattctgtgtgccgtatccaggggcggaccggggctagagtcccatggaagttttgggaggaagtagaacgtacgagtatgaagcaatgacgtttcggtttgcttaactccggggggaattataattcgttttcgcagatgatttaggtgaaagaaatcacggtcaatgaatctctaaagaaaatttacatggaactgttgtaggttttggccctgtttggatcggagggctaataattagccctccaaattcttattatttaagagtattaaacgtagattactaaccaaacccattctataatccttaggctaatttgcaagccgaatctagtaagcctaattaatccatgttttgctacagtaatcatccgctaatcatggattaacataccttcttagatttgtcatgcgaattaacccaggggttatgaaatgagttttgtcagtaatctgcgttaagtactcctaaataataagattttggagggctaattattagccctctggatccaatcagggtctgtttctaatcgggagaaattttctgctatcaagagagggtgggacagggctgtctgggtaacggtgcttctacgagtttggtgacaaatggtctggattttttatgttttggccccttttaagaacttattttataaatagatcattagaaaacttattccagaaatggattattttataggtaccaatgaacctagcgccgaagtataatgatgttgggcattggcgccgtccccctcacacccgagaggccaagacatagaggggtcagtgcccaacattatggcgttgatgacttgtttgtaaaatattttttgaaaagagtcaaaatgtacatatttttttatcacaaataggcctgatatcaatatctttggtgttgaggacctatttataagaaaaatatttagattttaactctttttgaattttctttataaataggtcctcggcgccaaagagtttagcgccggcccctttcatatcagcgacttagctatcacaggggctaggatgtgtgccgagacattgaatctcggagccaataaccctgaacccgagaaaaagggtctactcctgaaataagtttttttcaagggtatatgttcaaataagttttcaaaatgtaaaaattccaagacgaatggtgggtgaaaattttagctttcctaagacacggaagacggggaacctccttcacacactggtccctcttcccctccatttttggtggctctctggcaacacgctagggggagggggtaagggtgggcattcggttagaccaaaaattttgatctcggtcttcggttttcggtctttcggtcagttcaattattgaaaaatgaagaccgaatttcaacacaaaaatgctaggaccggcaaattcggtctcggttctgaccgaaattcaacaaccgtttcatatatacaaataaatcatataatttttcaacacaaaaatcacaaaaaaattctaagcacgtctcagtaaagactcttattgggatgcatgcctataaggagtagggatgtgaaaattagagtttaatcatattggagatttttaattcggtcttttcatttttgggttaacggagagactaaccgaatggatcaaacaaaattcagtctttcactgtttaggactggatttctcggtctcagtcttttcgccttttcggttcaatccttttctgattctactccctcaccaataggctaggcttccttcaatccaaatatttgcttgggctattcgttgaaaaaaacggtgggttattgtgtatgattaattaagtattaattattgtaaaactttaaaaatagatttttgaaaaaacttctaggtaaaatggtttacagttagggaagtgcgctcacgtcacacaaggcttacttttcccataccgtgcaaacgaacagagccacatggtgttgcctcaaagtaagccatgtggcgttgcctcagagaacttcggtactagtttcggtgtccatctccttctcgtggtagtgatggagtgtccatcttccttagagcacccgcaatggtaaagtaaggtgctctctataaaacatgtacatctcagcaatagactagattaatagtaaaccacagcaatagtatgtttacgtgggtatctatagctctctcatgcattgcctcgtttttctttataaactatctccaggttagtagatagctttgttatctctcttcatttaatcttttccaagtaggaaaatatgctgacatggatctcttgtagagagcctatagataaccattgtgggtgcccttaatccttcttacgatggtgattgattcaatccactctagtagtggaagatgtttttccctatggtcaaaacctattttccgtgcgggtaggccatccttatgtctgaaagtatctgagaaaatcgttatttttatgtgcgggtggcgcacccgtatgcgaaaattctgattttcgcgtgcagatgattatgtcgtccgcactgcacgcaaaaaagatattcgaaaaaaaataaaaatccttaagaaaaacctagctaggtgtgtcgtcgcctcctttgccgggcaccttctagtgccaccgtcggaccagcgcaggggatggctctgccgctgctatcgtcgcccctcacctcctccatcaagctctggacccgcccttcccgagcccgaagggagccactcccgctcgctgccggtgcgctcgagcccgccaacactactcctacccgccaccactactctcgagcctaccaccgtggcttaggagaggaggataagaatgaaggagaggatgtgggaggagtggagaggctggagtggataagaatggagaggataaggagagagaatgagggagtgggtagaatttttaaggtagagggaggtaggctggacttttcgcaggtggacctcttaataggcccgaatgagaaaataggtgtccacttgcagaaatgtatttccgtatacgggtcttttaaggagctggatgcgaaaacacaagttgatttttgcagatgcgatcagttatagcccgtctgtaacctataggtatccttatatagaaaaatcgtttatatagaagtgggtgttccatacgtgtaatttgctttgcaataattttgaccctagtttctaacatctcctcgttgggaaaatcggtatgtctcggattagcccatagcattttacaagggtttgtttgtaatattgtatgttcctaaggacccttttgtaattctatagtataaaaaaataaatagcaatgcacataattctctagtatagatattttgggtggaacattcccatggtggattttttaaaaaaaataatataattttcattttgttctttattaaaattaatatattctaagtggccataattagttttcttaatattttttatggttcttgtttagagttcaatatttttcgtgaaacatctacaagggcgtaacaaccttttagttgcaaacttgatggtcattggtcaacaacattacacagtgataaaaaaaaatagaaatacatactaaggaggatggtcaaagagaactgcaaattttcagtggcaaaagtgataatacatttataatgagtggcaaaaggaaacaaatccctttctgtttttagaagaggagccatcaaatttctagccattggatgtcaaatccaccgtctctaatccttgcaaaatgatatatatatatatatatatatatatatatatatatatatataatatccgtctctctccttcccaaaccctatcaacctccacctcccacctcatagccgccatcgctgaccgtggcccttcaccttgctgcttactaacattggtctaatggcaggaagctcccatcggcctccctttgccacttcccaccacccttatgttccccttccaaccacatgttttctattggtggagctctttattttctttggggaaattggtttagttgtgctattcttccccgtctttagtggttatctccattgatttgtcgtcacctctaaccaattggcatctctcgcctagtctccaaccaaactcattgccaattcatcacacatggctttcgttagcagaaactcctctccgacttctctctaaatcatcattatcactccaatctctctttagatctagaacctaccaccctcaactccaatgctgaacctaagtccaaatgtcaataaaagaagatgaaggcagcacagagcagatggtgataactcgagtagggatctccacacgaatcaaaggtcagaaaattgcatcttttttgggttattttcatctaggatatcctatagaatccatatgcattctataaggatatcctagatgagcacacttaatattccatatctaaattcatctgcgatggacaaataagaaatacacattgcttttataagaaatcaagggaagaaacagaattaataactcatcaacagaatttgttagttctagttggattactaatatgcattttatttatttattttgcaaaaaaaatgcggtacacatgatttcatcttgacatatataaaccctatttgctagtgtaagtttgatgtgaccatttgcttcatcattcctgcatataaaagtgcattcatccagcatacatttgaaaacagaataacacagatagtagattgatatgtagaatcataccattatatatgttgctgcttgtattatctaatgaggccaaggtaataggaaagagattaagagatacgttaagttggggaacttgaactcattattggattgtatcggtactatctatgtctattgttcccgtaactgccatagttggagtaggagcaaactaaaacaaaattgggcaaaaacttagcaagagaaaattgttaagtcaaaaataggaaatttataaaagtgacaacaagcaagttgccatgtttaatactgtttattttaattggctatgtgtaatcatgttgaattcaattttatctaacccaagccacctaccctaggacttacatactctctaattttagtgtgtgggtcatgtgggatggtccctctaattttacaacttcagtttgaacgaggacatgtgtaacagaaatgacaaaaatcatcaaatgcttctccccctccatctatttagctatttctcattctcattctctctctctcgtttctctccatctatttctctctccctatctttgggactctttcacaacttagtttgaacggaaatgtgtgtaatggaaatggcatcttaccaaataccccttcatctatttcacactctctaccttccctgttctctccatctatttctcattctctctctctctctctcttattgtattgaattgcattgtgttgtgttgtattgcattacttcattgcattgtattgtattgatactatgtctaataatctcatcggcagagcaggagcaaaacaaactaaaatagtgcacaaactcagtgaagataaaaattattgatggatcttttgtgaagatgttaatgcactactagaaaatagtaactttgttctatcgaaggttgttaagtcaaaaatacaaaatatgtaggaaattataaaaaagacaatgtgttatatgttggcattataatggctttaattggctacgtataatcatgttgaattcaatttccagctacctattattggactttctggtatgttcttggtagcttatatactatggactaggcacacttccgaagatcctaaattttactatttccaagaaaaaaatatccatcaatctttcttagaaaaacctttttaaaacaacttatcaacttcgtaatgtttaactcattttttgtgcccttgaataattgttataaactaaatttcatctatgttagaatggtgtgtctaattttaatcttgaaatttatattctttcctctgactaggtttctgtgctaaatataagttgttttggaacttccatacactttttcatctttatcattttgtgtatgtgccaataagtgataccattctcataaaagaatgaccgtgttttccaacataatataaacaaaaggaaaaatcgttacaagtccacactattttatatttaaaattatatggtttaatatgcttgtatctagaggagcctataaaatgatttctttcatctctatctaaaaacaaatattagtatcttacaatggtacacttcaaccatcccatattataagggactaaaccaattttcttaaaagaaatggaggaagtagtcgaagaaaaataatgtacaaaaggtgatagatgaaacaataaagtagtaaaaaattgataggtgggaaaataaactaataaaaaatagatgatggggaataaactaataataaaatggatatgtagataataaagtactgtctcatgataaaaaaaaatatattatggaacaaggagaattccttttctcttttaacacaaacaaacatggtaaagcttggtttttatagaaaaatcattaacatgtggtggcgattacaattacagtagcccactgtaacatgttcacattggataaaatcaagatccacaccctatttttagtgttcttctacaatataggaaaagcttcaactgtgacacataataaaggagttccaaagctttatctctaatgatctgatctctccccctcatataccctttcacaactttattttgaaacatgtaaacgtataaacggcaaaaaaaaaaaatctctccccgtctatttgactgtgaaaagtagtatttctcatttttctctatctccaaactctctctgttgttcccatctgccggaggccggagtgagggagcagccggcgaggagggaggccggcgttggccatcggcgtggacgacctcgcccaagacgacgccgacgccgccgccgacgacgacgactttcccgtgtgcggattggccaaggcggtggggttggagggaggggaggggaggggggtgacgcgcgcggccggtgcggtgcggtgcggcgcggtgctccccccgccatctccggtcggatcggatcgaaggtacgcctcattctcttcctccgttccgcttggatgatccgccgcgtggcgtagattggggggcaagggattaatcggtcggtctgtttatttttccctcggattaatcggtccaactttttcttgttactgatttatttgatgcgttgtttgtgtggtactaatggaggattgtgtttgtgaatgaaattttgtgatctagctttgtgttgattagacttggaggaggaggaggaggagaggggggaggttttgggtttttctccttccctggcaatggcagcggctgcggggatgggtggcaacggcaatggcgcggatgacaaggcacgtgatgtcacggatcagtccaaggctcttggtgggaacagctgcgaggaccgcgcgctcccctctgctgtgcgtgtcactgtcagtggtgatccggtggggacgtttggctctt

SEQ ID NO: 58077 - DNA, 63110 bp, Oryza sativa
  unsure (1)..(63110): unsure at all n locations
gggtggggggcgaaaatttctaaaattttgacccgaaattttcatccatgttcagatgtacccggaggccagagacaaatccattcccggtccataggaccaacaccagttgatgcctgctccatctagaataggaatattttgactaagcttatgcatatcacctcacttatgctgtcccccttgccctcggctcaccctagccccgggtacatactattgagggatgaggttaattaggggtagtaagaaagctcaaagttagtggaacgagcttagttccgatcggcttgaactcaaactctaatgatttatgattcaaaccatgctatatttttaggctcatgagttaatcagtcagttcacgatcgtcttgtttaactcgttagtagaagagatcgtcatatttttatatacttagtgcatctttacgagtgtttaaacttctagttatatccaaactatttgtacatttgtatgtatagtaagttattcataagttagttttaattattatgttaacatataatataataaaatagtaaatttaaaattacaaagctaagctagacttaacaaagttaacgagtcaactcacgagcaaagctaagctacgatttcagctcattatgctcaatgagccgagtcaagatggctcgtcgagataagaagatcaaatgaaccaagtcttagcgagccaagctgacttgttatccaccatatagatgaggtgatgggtggatgaagcctatccttattaaatcagactaaccatctagaattaagtgctcaattgcctattacagtactcaatctatccaaacaaaacaacctattagtgaataaagttgaaaagctaaaaatctattcggtttgcacaggagtaccgtataaccttcttgccttcgagatccgattggaattgagttttattgaagttgttttcggtgaatttggttggatgaaaggcaaatgcactatccaaaattttgccagttagtcattttagtggtactcctaaggcaaaacatagaaggaaggtacaattaatctcatgtttccgcaaccaagtgcccaaaacccggtagcccatgagaatcgtattgtgcaaacgtgcaaccaagtacccaatgccccgtgcaagcattgggcttgtttgggggagcttctagctgctgcagcttctcccaaaatcagaagctccctcaaacaatcaacttttgatccagattctgagaagaagatgtagttgtagaatctagaagataaactagaacccagaagttggctaccaatcagttgtttcttaaaattttaagctccccaaatagaattattttcatccacacctccacctccacctccatattcacatccacatctatgtcaaactcaaacatacacattcacattactgtggcgctcattaagaatggccgctaaacttgcccaattaatttattgcgagaaaatatgagaacataagtttctgatattgtacaacatgcccaatacacatctttattaatttattccaaacaaactgcagctagcatgataaataagggtgatacaactttatacatatataaccttttacatatgatttattcgttgcatacatattcctgaaattaaacataaacataaatactattattgggattgatctcacatctgcatatactgctacacggtacgacgtatatatgtatgtatgcattatcgcattgtacgcatagcctatgtatatgctagatttatttagtgcatggtgaccttggtgtacttggacatgtcgatagtggcacgactgcctgcctcgagtgggaagtagaaggggtagatctcgtagcgcgcccaacagctgctgtaatcaatctggcatccttgagcgctgttgcaagttttgtcaaacttggacactatctccgataggcaccgtgcgcacgctggcggcgctaggtctcgcgtgcactgtgctaacgcgtaaacactcacaaacggcgtgtactgctccttcgccctgcctagcccactcctacccactgcaacagcttgtgctgtcgcctttcccatagctttccccgctgccttctggaatgccttggggttgtccatgttctgccaatttatcatggtcacgcttgcatccctcctcgtatccacttccccgatgaagtcgtagttgtagtaccgcatgaagcagtattcgtacctgtaagtacatatgcacatcacccgcgcgcacaagcacataaataaggagaaaattaaacaatcgacgtgaaatcatgtgtactctcttatgttccatcattcttaatgtttgggacaataatatggtccttaatacgacttctacaatgatttttacatattataatataaaaaaaagtaaaattttaatttttttaaaagtaattttaaagaataatgtatatatcatgttctaatatttgctttcaaactaaatattataaaaatcatagatagttaaagtttcaattattagcttgtcaaaccgttggaactagatcgagatacaatatactagcatgtagaattaggatccataataatagcataccatattctggagtctgatgtgtagttgcagttggagacaatctgcttggcggcttgagcgaggcaggcgtcgcagtcgccgccggagacgtcgccgcggcactgcgcgaggtcgaacaaggcgtcgtaccccctgccggctctggaggtggcgaatccgtcgccggtgcgcgccttggcgacgaggtcggagaccaccaatttaagtctgcgccggctgacaacggcctaactgctgttaagatcgccgtagttcatcccggactccgagcagaagctcccgatgggatacgtcgtcgccgccatgcccagtgggagcaatgcagcggccaaaaaggctgtaactagtaccagctggcttaatgccgccatggatggcgccaaattactctcactggtcacttgtatgtagagatgtgatgagctatagaagatgtgtgtttaatcgggaagaatggttggagcttataaagacgagaatttgatgggaaggagagtgagatcgatcgatgtgcttgcatgcatttcaggggaacagagtatcaaaatccttgttcttgcttgcagactattttgactattctagtggtttgcatgcagtgatcagactatgggcaaactattccatgcagtgtagaaaaagggggccgtacgtccagttgagtacttcaaatttcttgctcgttctttccaggctagtaggattagattctcctcgttttccgttagcacgtttttcaaactactaaacggtatatttttttacgaaaagtttctatacgaaagttgcttaaaaaatcatattgatccatttttgaaaaaaaaaaattaacagatacttaattaattatgtgctaatggaccgctccgttttccgtgaacactgttgagagtggggagaatctgaaaagaacgcagcctaagataaggctaataaaattggagccatattttttttgcatgatattgcatgcttgtatgaggttaaatatgtactaactattattagtggatgaactttatacgaagtatatatagatatgattctcggccggctactagtttctgggctgtttggctgcagaaacaggagatcgactacattcctgctggtttttgcctaggaatgaatcaattagtatttgctaattggcaaaattattggatagtttatttgcccttcatatccaaccagattcagcgaacgcaaactcaatcaaactatatatgcagtgctcctgcaaccgaatagcttttcatcttcactcatcactaatgtgctgttttgtttggattgagcaatgtcgtaataatgaattgaccacttaatccatgatggcttgcttggtttccgtccatcaccagggttttcaatttcgtttggaccaatattttaaatagcgggccaaggcatttagcggttagcttctcaaacagctatagcggcagctatagcgggctaaatagagctatagcgactaaattgtacatgtgaacaaatagctagaacccttctcaaacaactagagcgggagatttaaaactctggtttagaccgaaagtttcgggattttggtgtcactgtaatttccgaaaatttcaggaattttcatactttttgcatgaaattatttagaaaataaactgaatttaaataattttttaccaaattaaccaaaattttggaaaaactgaattttcggtcgatacatttgcttgttggagggggtgaaattgcggaaatttcgaaccgaaatcgtaaaccctgtccatcacctatcgatcacctcatccctcaaaactagtcatagccccccggaagcccacaagaaatggtagaaagcaggtagttagccactagccagctagctagtccgtgatatccgcaagagtatcattcattcataggtgcaaatgcaatagctttgcccacagtctgactcgatctgatcatcactgcatgcaaaccattagaacagtcaaaacaaatctgcaagcaagaacaagggttgtgatactatgtctgtctactatgttcccctgcaatatactgcaagcacatcgatctctctctcctttccttccaatcctcgcctttataagctccagccattgctcccgatcgaacacacaacccagctatagccacctacatctgctgatcgacatcgatcgatctctactactccagtagctagcaagaattgaatctaggtgaagtgagagtgtgagagtacataattggcgccatccatggcggcattaagccagctggtactggtcgccgtcgtctcattggttgccttgctcccactgggcatggcggcgacgacgtatgatcccatcggcagcttctgctcggagacgtggatgaactacggcgatnncnncagnagagaggnngtcanaacgattgcgcnccnncccctggnngtaagggacccnnncactaanncgcgcnccgncgccgnactcgccactcacaagagcggcaagaggctcnnaggtttttnnacggcctcgcgcagttgccgcggcgacgttctccggcggcgactgcgacgcctgcctcgcccaatccgccaaaaagggggccccccccaaaaaaggggaaaaaattttgggggggggttttcccccttncccccaaaaatcctggccaaactacccaccatccagaacttcccagaatttggtatctatggattctaattctacatgtcatctacacacatgagtgacactgtatcattctagtagatttcaggccggttgtttaatatatttctttcgtttatgtgtgcttgtggcatgtaggtacgagtactgcttcatgcggtactacagcagctacaacttcatcggggatgtggacacgagggaggacgcaagcgtgaccttgaggagatggccggacatggacaacccaaaggcgttccaaaaggtggtggggaaggcgatggtaaaagcaacaacacaggctgtctcggtgggtggcaacggtctgggcagggcgaaggagcagtacacgccgttcgtgagcgtctacgcgctggcccagtgcacacgagaccttgcaccgcctgcgtgtgctcagtgcctatcttcgacagtgtccaagtttgacaaggcttgtggcgctgcgcaggggtgccaaatcgactatagcagctgttgggcacgctacgaaatctaccccttctatttcccactcgaagccaacggccgtgccactattgatatgaacaagtacactaaagttaccatgcactgaataaatctagcatacatatgctacgcatatagtacggtaagcatgcgtacatacatcgcgtagcactttaatttcacgaatatgcactagctgcagtttgtttggaatgaataaagatgtgtactgagtatgttgtacacttaagtgaatcgaatatctctttatcattattttgccacaatatattaattggccaagttcgtcaaccattcataatgagcgccgcaatagtgtgaatgggaatatttggtcgagttaatttgatatagatgtgaacagtgacggacgtaggaattcatggccggatattcacactttaaaaaaatgttttatacaaaacacaaatgttgaggaggataatacatattaaattacaatagtgacataaatcatataggaataatatattataaaaatctcgagaatttgagcacactataaaataacaaaatggcccaatcttgagaacaaactcaagaacaggagacaaaaaaagcatacataaataacaatatatctatatataatttattttttcatgaaaaatgggtattcttgggagtactcaggacctactccccccatcacataaaaaaacaacctatagaataaaatgtgatagtacaataaatctagccaggaatatgggacagagagagtacgtgggatccatccatggatgtgaatatagaggtgaaggtggaggtggaggtgaatgagaatgtttgttgttgtgttagaatgtgaatgccagattcgcacgggcatttggtgcgaatgttcgcgcaatacgattcttgacgggctaccagccgggttttgggctgctagctgcagaaatcggagattgtcccttcctgatggtctttttgcctaggagtactccctccgttctaaaataaaccaacctcatattaggatgtgatatattctaatacagtaaatttggacagtatatccagattcgttgtactaggatgtgtcacgttttagtacaatgctagcttattttgggatggagggagtactactgaaatgaccaaattcacataattattggatagagtatttaatatgccttttttcagtgtaaaaataaatatttgccttccatccaaccagattcagcgaaaacaacgtcaatcaaactcaattccaatcggatactaattaggtttatacagtgctcctgcaaaccctataatatgataaatatttcaagacactaattagggatgagcgctatcctctcttaacaattagttaatgactaactagtaattaatagtccgaagccaatgacaggctaatctacgacaaccactacgacaagctctatacctccataaattattcaccagtaatccaccactagtccatcataatcttgatatattaattagtttattacatgccattgttgtttatagacctatgactttatccttttaaactctcttcaacacatcccttcatttcatatctaagttttatctacataatgcatggccttttattgttatcatctcgattcgtcttcatcctatcagccacatctaccctataccctatagttcaacaaatgattttactcatcactcattctctcgttcctcacgcaacggtctagattgcatatgcgaaatccaacgcaaggtcgtctccacctcccacccctgtatctgcttacgcgtcaaacgcccacagtccgctccacgttccacattgctcgcgatcttcctccacgcccgctgattccacccctctctttcaaccaccaccgccgaattccctcacagccgtcatcgtcgcgattgccaccgatcccccaccttgggttcgtcgtcgcggtgaccgagcccccgccgactgtcgtgccgcgccaccctgcctcgccctagcgccatcgctgattcgtttcatcgagatctagccgtcggcttcgtgccgcccgagagcaggaataacgcggggttggtgtgagggatcctcggctcgatcgaggcgcagcccgtgctgactaacggcgccgctgcagccatcttcatcatcaccggcctctaccctcagatgggaaaggaaatcttcatgttcatgtgttccttttctcctgattacaggtcatgtcgttgttttggcttatgtttgatcgtgcatcacggccttcataatttctgattgtatttgagctctatctccggataccctcatgttgttcgatgaaatgctcgtacacatacactgcaagaaatcatgtagtacatggagcatatgttcatgggtaatagatgtgttcatggcttttagggtaacatttttttttctaaaattaattgcactattgtgctgcacatacagcaattactgaattgggattgaacatcttaaatttttatgtgttacatgtaaacatgccattacatgatctggtggccgccactgccctttagctacaacatatatttggatcattcatatatttatatatttctgaaagtggtccaggtcatcaaggttgtctaaagatatcgaaactaattcacgaactaattcaaaaccaatattattttcttaagatcagacatttagactgtatatatgtgaattgatggcaactattgaataaatatggtcaaatatctcatgaacccgccttttttttcagaatccttttttttgtgaaaaatcaaaaccatctcattatggtagtacccgagttgtgaagttactgatgaaaacattcaaactgaatttggttgctgcatttaggatgtcataggtattttctttttaaatctctctcgctgatttggtttcattcatttagatgagtattgaaaacctttctcttgtgacaattttattcagttatgtatttcattcagctgatgaattatcctttgatcatagccattataaatgaaatataaactgaattgcactatctgcatgatataacttctacaattggattatgtttttcgattttggcatatattgtatatgaatttcatctacttggataaccgtgtttctggtttttttagggccttaggggggcatgtttctgaaatttaccgtctggaaaaaattctgacattgcttattatatactcagattttccaaaaaaatgcttatgtattgccagccttctagcacatgagtttggatgcttgttattgactgacataatgatagcttgcaatattaaatcggaatacaaacagtgagtataaaaacttttgtatgaatggaaccgtttgtgttattagagtgaggtttacatttggtcaatattatattcccgtttatgttcatgaaattcatcttgtttctgttcagtgcagtactcccttattgattccttcctcatttctgaacaaaaaggactcactaatcttagatggcatcatctacactattgacgcatcatctgcactattgacctccttatgttcatgcgacggatattttttcagatcagtgtggtacaatcctacttttgattagtgataaatagaagtttgattgttgaactgatcaatacaagatcctaatttgtaagtagcatctattgcacctaaaattttgtatatgcagtacatatatattagttaggatcatgtatattttggtattgctggcaaatataactctcaccttggatcacaaatgatttcagctaaacaccatctatataagtttaacagatatttatctaaactcaaaactgaaacaaaaaatgtgtttaatgtctgaaacttgcaaggtgctactatgatctctgaacaaataaacgttctgagtttcctagcagcaaattgatttgttcagagatttaggtgggggcacgccataataaatcgttgagactaggtcatataacaaattaatatgattttttaaagcaacttttctttatatttttttacataaaatacacagatcggaaaagcgtgcgtataaaaagaagtgagtataagtaaggaagatggagtaaaaagcacacccttaacccactaacatatgttttgcctcattgtaccccttgaactactaaaattggtttgctcgagcatttatcttcttcgtctctttttatacgagtcatattctaaagctgatattttgtagggccagacataacaccattatcaaagctctaaaatatttttaaaaattttcatgactattgtttgaaatttaaaaccacgatgtttaaatcatgcttactgctttgaaatatatgtatacggtggtaaaaaaaatatgaaaaatgttgagaggtaggttataatgtatctatatatcaatcctaccaaatttgcttgcaaaatacgacgtatatagttgtatatctttatctacttaaaacattcatagtgtttttgccgtgcatcgtagaatagtgtgtctcacacaatttttcatccgacatgtgaattgttggtccgtttccatgtcccccgcaaacgtccgactctttcgcccacgtgaaacggaaacaatcacatataaaaattcagtttccaatccgagcacgacaacatcacgcacccgctgcatgtagcctcaagcagtgacatgtgcctcccctatcacaaaaacgagactcatggcggtcagttgtcttttgagctgatagagattttttgctggtgggtctcacgaatctgtcttcaagtgtatagaaatcttgtgaccgccaacagttcatagaatatactttactcccttcgtttcatattatttttttcactcaaccagttttagctattaattatttggcaaaatttgctacaggacacgcaaaaaacgtgtaattagctgagagacaccgtgaaaacgtgacacggctgatggacactacaaaaaaatgtgtaattggccgtaggacaccggtcgcattattttattatttccgggtcaaaagaggtgagaaaattttcaaaatgacaagattgcccctggagccatattcccccgcgccaggagcggcagacggcgagagatcctgtgatggcggcgatggctgctgccccgcccctggggttttggacacgtacggctccatcttaccgtagagccctctgatccagcccatgtacttctccgccgctgccgcccgctcttcgaccagaacccatagtactggatgttgtagagcgcctgccggtgcgggaacggcgtcaccgccggcacgacgcggaccatctcgccaccgtaggggtcgaggatgagcagcccagcaccgtccttgaggagccagctccaggtggtctcccagacttggctgggcatgttcttggacgtacggagtcggacttggccttcaagtacttgtccggcttgctggtgtccatgtccaggagcatctccaatggcttccccgtgccgtagaacgtgaagtagagcacggactagatccacatcatctcgatgcagtcgctcgcggtcacaccgagctccaggaaggtgtcggccatcgcggcgacgaggccatggcgtgtgccgactaccgaggtacagggactcgaactacgcgttctggttctgcactacgacgcggagaagttcctgccgccgccgcctcggatggcccagaagaggtcctcccccatggcggccctatcgaggagcctccccctcggcgttcaccatggtggcacgacgacgaggtcggaggtgaggccatgcttccgcagcatcaggctgaagccgccgccgctgaggaacccgtcgacaccgaccgtcccactcgggccgtcgcgctgcccgcgcgtcgttcctccgctccgccgcgtgtgtgaggaagaagaaggatatgagagcaatgtgggcctgttgacaaaaaaaatcgaacacaccggcctgggagatctgcttagctcctgtgcaggtccaaaggttggtgagatgcgggcgtgtcagtcagtttgatcctgcaaccgacaagatttgtaaacagtagatcaaatagccgatcggctaaacagccaatggagcaatcccagccgattccgataccagccgatagcgatagggtttaagcaatcggctatatgtccaatgtagatgatgatataaaggcaatcagctgatgatgatgtaataaactaacaataatataatccaatagaaaccaatcggctaataataacatggtagaattagcactgatccgaaggttaaaacatacatcggctggaggtccgatgtcataaaatccacaagattagattaaacagtgaaaccttcgttgtcatcggctaaatctaacttatatatacaattcttataagccgatgcaacgtccagataattcattggctgaaaccccgatgaaacccttattggcagtcaacaagcaggctagggattatggttctaagcacgacttagtagatcaaacttaactgatgcagcactaagtatgaaaagaaacacaatatctagacaatcaagcccttgactgattttgaggatggtagatgcctaagctaatctaatctagcaacacgatttagccgatatcggcagaaaccctaaagcgagaagcagccgatagagctaaattaatatgctaagattagattaatagagacatatgataaataggtaggcaaatatatcatccaaaccagagcaatccaagaggtcgaatgtactgatgcagccttgaacgacaccgacgtagatgacagattcaccagggcccgacggaacgtaggacttactccttcgccggagatcgaactgaaccgatgcagccccgcgtcaggtgcccaaattccgctgaaagataagtaaaaacctcggtaaagagggtggcgatgcgccgagagtagttgtattgatcgatagataaaaattacagggacccctggtacacaatttatacccttgggtctatagagtccttgtcgaacaagaaacaaactttctaaaagataaaaggaaaacataaagtccttatcggacactaaacacactttcctaaagataaaaggaaactaacaaactattcctaattaatagataaattgccatgccgcatcctctttgaactcggtcgtttatggataagcttcctttagtagattgatttccttaaccgaatatagtaggaatccaactattggtgacttgataacttccatcgaccgattccgaaatgatgtagccgataatgactctaagccgatgatgactttaggcttaccaaatttcactgttaacaggggcccacttatgattagcaaatagtaatcaccctactaattaggtacaaattagtccatgacgcgtggggccaggtggttaaatacctattaaaaattagattaaacatacactgtctatgacatttgggacccactggtgtttaaagaaggaaagagaaggggcaatctgggcatttagaaaaatatctcacctcttttgaaccagaaataagaaaataatgcaaccagtgttctatagccaattacacgttttttttagtgtctatcagccgtgccacattttaacggtgtctctcagccgattacatgcttttttgtatgtcctgtggcaaattttacctaattatttttgtttcacggattcaccagttgcatatataatactacctccatattttaatgtatgacgccgttgactttttatccatcgtttgaccattcgtcttattcaaaaaaattatgtaattatcatttattttattgtgacttgattcatcatcaaatgttctttaagcataacataaatatttccatatttgcacaaaatttttgaataaaatgaatggtcaaacgttggttaaaaagtcaacggcgtcatacattaaaatacggagggagtagttcattttcttaaaaaattgctaccatatcatccatatgtgtcatacattaaaatacggagggagtagggttttcgcatgtggtttgtgctgcccatatggaaagatactaaaaaatattttttatagtgataagcgtcgttatagcaaaaaaaaaatatttagacctagcagcctgcaagaacaggttttagccaaaggcgaaaatcattttttatagtgataagtgcccttgcagcaaaaaataaaatctttataccacactaataaataattacaccttcaactattgattatctctacgtgaaacccacatctctatcatatgttccatccacgacatgcctgagacccacccaggttcataagaaagccccccaaatatccatcatctaactctccgccaacgtccacgaaaaaaaataacatatgtaatttggatttcctatcacaatgcacgagcatctttgctatttttttttaaaaaaagagaaatgagagagatgaaaggaaaaggttcacttgaggtcccttatcttgtcatcgagtttcttaattgtccctgaactaaaataccagatataacaaatccctaatcttacaataccgggtcacgttaggtcccaaggcagtattgctcctcggttttggtgacgtggtggctgagtcagcgtgggacccatgtgggtcccacatgccagccgataatcttctcccacctatctcccctttcttcccgtctcaacccaaacctccagggcagtcagcaacaggtggggagaagagtggcgactgacggctgcgtcatggacctacacggcaaagagcgcgaagaagcgaagtaggaagggctcccgacacgtcgtcccctcgggttacaccaccacatcgttgcgtggcagctcgccgcgcatctgcgccgcgtccgcatcatggttgcatatcagccacaccgtcgggattggcgggaggatctccaagagttgggagatggagtacgttgcgacgcctgagcatactcgcgagcaccactgactgcatgagtgcccgtgcatgcaagcgaaaaggacgccagacgctgaatcgcgggaaaggtgtgtggtggccggtgaccagcagggaaaatggtggtggttgttgggcggcggcgataaataaaagcccgacgacggcgcttggcgatgggtggggagaaggctagcaacgaacaaaaagctttgcgatggccagcgttggggaaaagggcgcatgcatcgaggaccatgctaccgcaacgtggagtagatggagtcgacatcgaagaccatgcggcggaaccgcgtgtttgcctctgcgaagaagagctaaacctcggggacacgtgaacacatcggcttttgagcagctcgatgggggcgactatgagcttgggggataggagcttggccagcgtgacaaggcggaagccccagccctcacgcgtgcccgtgaagacgacattgcagttgtagttgggacccgtgccacaccccgcacgtgcgcaagtccatgacgtgagcgctcctggtcattgggagccacgtcagctggcggcctccgccgtcgagcttttccccgccgaccgacacccttctccccacccatcgacgaatgccctggaggtttgggttgagatgggagtagaggggagtgaggtggaataagattgctggttggcttgtagggtccacgtggggccctacactgactcagccaccacgtcaacaaaaccggaaagcaattctaccttgggattaaaagtgatccgttttgcaagattaggggttcaaggccgtttaaaattcaacgacaagaaaagggaccttagatgaacttttttgggagatgaaaaaactccagcctcatgggcctgtgcatatgacccataggcaggcgacaccgcggcagcagagcgctgcacgacctccgcctcccccaatccgtcccgtctcctcgcccgccgccctcgactcccgtctcctcgcctgccgctggcgccgatctccatcctgctagcagaggtggcgccggcgtcctcctgctcccgccgcattcgctcaccggtgagcatcctaatccatcccatccggtctcggtctcggcctcggcctcgaatttcgtctcctcgcccgccgcttgcgccgatccccatcctgcgagcagaggtggcgcccggcgtcctccttcttccaccgcatcgtcgctcgccggtgagcatccctccctacccacacctcatcagttattctgcgttatccctcaaaaagtttgggggttcaaccgaaacagggttagatctccctctgcctagctccacctactttcaagttgttaattttgatttccgtttttagcagatgtaatttggttactgaatctcatccaaacacccttagaacgaaaaatgtaagctcacataatttgtactcatccaaactcacataaatttcttaagaagaatctagaccacaaactacccatagtcacacaaaatatctttttatcaaggtatattcttataagtaatttttattccacaaaattttctaaaggacatactgtgacacttggcattaatctaatttaactttttttctttatcaggttataaattttctaagacatttgtgccacttggcatgaatctaatttaacattctttctttatcaggttataaattgaaaccattgaatgtactttgtcttcccgtctctaaaacattgtgatatatctataatattttaatatttttaagtttaaaaataatttagactaataatatagatatttaaattaggtaattaataaattcaaatcaactatagtttagaataaaaaaacaaaataatatatgccaagtacaatctaataacaatagaatgttagaaacaatatgaattcaatatttttataaattttaagtacgattcatacataaaattaaagaaaaatataaatttatatataagtgagaacataataaaatgcaagttaaaattattaaaggaaaaatattattaataaacaatgatgttgatgtatttctaaatattttcacgtattatttattaagtgtcaatgattgaaatggatgatttaccatgtaacagattaattattaaaattatattgttttcatccgttacaatgcacgggcattttactagtctatataattgatcgctctatcaataaaccttaatatcgacaagtaaccacaacgttaagccattgatcgacaacctaaaagctacaactgaccataaatttcactggcttagatgagatgtaaacacataaataaaccataaaaaacgagaattcggagatgatggcaccccaagtccccaactccaaaccattttccggacaaaaaaaaaacattcaactctaaaccacagactcatgagaccatgtaactcaagcaaatctgactaacaaagataactcgaaatcaaatcgagaaataaatgcagatttgctaaaaagacgtgtgtgaaccggtcccaaattctcacaaatctgatccatgaaaatctgcagccgttatgaacttccaaatttggttccaaactctgaacttttgctcgccctactaacccccctcacaaatcgcccaaaatccgaacgacgccgccgccggaatccgccaccgccgccgacggaagcaagggcaggtcaggccgtcgtcgggagggggggagaggagaggcgcatggcgaagctggggccggggcaggggctggggtgcgaggcggcggtggggttgctggcgccaagcaggaagagggagtacaaggcgtgcaacaagctcaccgaggggaagcggccgctctacgccatcggattcaacttcctcgacttccactactacgaggtcttcgccaccgtcggcggcaaccgcgtaagcatccccttcttgttttgtttttcttttcttttccccgtttagagttgttcttattagtgatgaataatgatatatatagagagagagaggaaatagggttttgatttagcaggctgtggattttgggggaacaacggattttggtttgaaatttggtggaaaccgcgctaagcatcccatcttgtttttagggtggtctttgccatttggagttgttcttgtgaatgaatgatagtaaatgataagtgtagtaaatgataagagagagagaaactagggttttgttttagaagattgtggatttggggaagattacgcagattttggttcgacatttgatggaaatcaaaagctagtaaaatttccttggaatttgaggtttctaccattttccttttgcatcgaacaatctgcgatttggcatacatttcggcagatttgatgaaaattgtggtttttctgggatcaatcatatactagacaaactcttttaatggcaaatatgatgaaagatggttgtctttagtgggctcgtgtgaccaattgtgttttcttgatcttgcaggtgacaacctacagctgcctcaaggatggtaattttgctatcctgcaagcatatattgatgaggatgtaagctccgcaacaatctccagtgtgtgcagttactttttttttaaaaaaaaaaaaactttgattgtgacattgtgtgacacttctaactctttttaaaaaaaactttgattgtgacattgtgtgacacttctaactcttgaggtctgcattcttttctcagaaggatgaatcgttctacacactgagttgggcttgtgatcttgatggcacaccgctgttagtggctgcaggaagcaatgggatcattcgggtcatcaactgtgccactgagaagttactcaaggttcgatagtgccatattctcatatgcttctatagttcttggcaaacttcaatgaaaattcatttttgagaatctatgctcttttgttatccgacatacccatgattgaagctatgcttcagataatagttgcttctttggtaaatgttgatctgtctatcttatccatttaagaaggtcacttgatatttgcgttgattaagagttgcattgctatagaattgtttttctttttgggtctacaaaagtgtaatttttgggtacactcctgcttgctacgtggctgatatgacactatctgttgattatgcattatacgtggaaagttttgataatactatgatacatatttagaacaccacaaaatagggcacatcaacaatttactcttaggcataaaattactatagttcagatctattttgtgctcattgactcttgtgcgtgtattttatggcctttcatttggctatgaatgagattaatctgctgaattggcttttgtccacaaggtttgctttgtagtcttatataggagagaagaatggtggaagatgtagaacctagtggatcttttccagtgggacagtcagaaaattgggcatatcaattatttactgtcatatactggtgtgagggatttagggtgaatgtcttatttctgtatatttgttcagacttttgttggccatggcgattcaataaacgagataagaactcaagcattaaagccttcgctcatcatttctgcaagcaaggtttgaagatagccttttctggagctggatctttctatgtttaattatttctgattctgtttcacatggcattgcataggatgaatctgttaggctgtggaatgttcacacagggatctgcattttgatttttgctggagcaggaggtcaccggaatgaagtattgagtgttgtaagttgattctatttcccagtatgatgttatttagaataatactcactacaaaccacacttccagcttctgatatcatctttttcattgagctgaacatgttttagttgattccatcagtaataaaataaaaattaggttccacaatgacagtcattttatttgtagtccgattacattaggagaaatgttgatcaactatgctttgctgcaggacttccacccatctgatatctaccgcatagcaagttgtggcatggataacactgttaaaatatggtcaatgaagggttagcaagccatctcaacatagcttttttatttgcattcactttatgcttatcattgacactgttagttaatattatcatagaattctggccatatgttgagcaatcctttacatggactgaccttccatcaaaatttccaacaaaatatgtgcaatttccggtatgctaaatatcttttgatcatctttgaactattattttgcaagattttgttatttcatccatgtggcatcataccaatctttctctgcttccaggtcttggttgctgtagtacattctaactatgttgattgtactagatggcttggtgacttcattctgtcaaaggtcaaacttcatcttctttgaatggatttatggattggtagagatacagtgctcataatgcatccatactactgatgcaaaacttcagtaggattctcatcaatgctaacttcaatttgcagagtgttgacaatgaaattgtgctgtgggagccaaaaacaaaagaacaaagtcccggggaggtgttataattcaacttctctagaactacagaccttaattcattttacttgtcttctgatctgatcatctcaacagttttctgtcatgttactttagttttcactatccctttccatacgtctccctctcaagtaaaattactttttttttttcaaatgtagggtagcattgatattcttcagaagtatcctgtgccagaatgtgatatctggtttatcaaattctcatgcgattttcacttcaatcaattggcaataggtaatatctcccaaattgtgttgttactttggaaaatttgtgacaatattgaaaatgttttgtttgtgggaaacggtcatactcagtactcacaagtcaaaagattacattcaataaaaagaattgtggaatgttgcccagcacccttaatgttgtgacaaaaaagaaactaattcacatatttaaactcattgggtttagattattatttttaaacaaatactacactgaatactcaaagataaccatgtgcttatttaaacaggcaaccgtgaaggaaaagtctttgtctgggaagtacagtccagtcctcctgttttaactgctcggtaagttccaagaacttcagttgtttcccatcctttatatgcacttggttttggacgccactaaatcttgtatttctgcatgccaacacattatttttacaggctgactaatccgcaatgcaaatctgcgataaggcagactgccgtgtcatttgatggaaggtgcttcactaaattctaatatccaatcctcataaagtgcatattccagcttttacttgcccacaattcattttggtgaagatcctgtgcattaagtggatgcatcgttttctgcttgtgtccttgtttggtcttcaatgccccgacatgtgtgacattttttctctcttgttcagcacaatccttgcctgcagcgaggatggcagcatatggcgatgggatgaagtggaccatccaaaagcatgaaaagtacccttatagacagaccatggcaatgccagattaagattgacttgggaattcctgcatgtgtactttgttgtgggggttatagtaatcagtcttactgttgaaaaaaagtgcaatctgatactctgaaattagaaggattgacagctgaatgctggggttaccaacttgaatgttgcaaataggatactgcttctgttatatgctgaatgtttcaagttagggcctttttgtaaatgggaagattcggctatgccagatttttggaaaagttgccatttgctttgttaccaaagttgcatggcaaagattggcccagctcaaatttctatagttataaatgagttgccaaatattttggcttcaaacaaatgggtgccactttttattttttggtattgccaagtgccaactactagaatggtttctatcaaaaaaaaaaaaaaaacctactagaatggttcagtttggctgtaaaccaaacaaaccctatatgccctatgcctctatgtatttgcttgtattgaccattattgttctaattttgaccatcggtaacattttaatgattagattacgagtaaattgcacccacagtgcatcagcttggcaggtgggtgtaatttagtgtaagaacttgagaaatgagcgttctagtataacaacttggcatgtaggtgcaatttagtataagaactttataagtgatcgtataaatgcaacaacttgcaagatatgtacgattttaataaaataaattaagaagttatgtggcagtttaattattgagagcatttttttatacatacaatttttaagtacttatgttgacaatatactagcgtggatttggatataaagaaaacaaaaattcttaaaggtaattggatgtgcagtataattcttaaaagattaaattcaatattataaggtgatatccataggattgctatgtaatgacatattaacatcgtgagaaaaacttacctagcatatgcctagctattcttgtactaaaacgcaaccacttgtcaaattgttgcactcgagcgttcaattctcgagttcttgcactatattgcacctacccgctaagttgttgtatcgtgtgtaatttacttttagattacgataaataaaaaagagctaaattgtacttgtttttatgcagaagttgatttttgttaggacggtggagactgtagtttagtgaaaatctagaatgaacgtagctcaactggttaagttccttgtgatgaaaccagcacactcgggttcaaatcctaaatgtgacatgtgtgttcgtatttacgcctaatcattcttttagtggtaagcgacataccagttgatagcgaggcacctgtggtgatttcatcaatctcaattctcaagatttgctagctcagtttactagaggtgctcgtagaggtagtttgtgtgcgtgttgtcggcgtatgcattttaactatgtttcaaagaagaaaagaaaactgtgatgaaggttgtgaaacggagggaacattggttgaggtctgagggccgtatcggacggctaggataagctccagttaagacgatccgacgcggggggcaatttcggtacaagaaaaaaaaatccttcattttctctcctcctctcttccctttcacttggccgtcgtctcctccccccgaccccgccgccgccgacctctctcctccgcgccgccgacgaaccaccgccgccgaatccccctcgccggcggccacccggatctccccagccatgtacggcggcggtaagttcccccctctctcgcccccgtccatccccgagctaaaccctaaaccctagagatctgtggcactggcgctgcttggtttttttcgcagatgaggtctcggccatcgtcatcgacgtggggtcctacagctgcaaggcggggtacgccggtgatgacacccccaaggccgtcttcccctcggtgaggcagaatgcttcttcttcttcttcttcttctcccctcctgggttggctcgctgtaattctgtctcggagttggaactgtgtggtctgtgttttgttggtgagagttcgtgcgggtggtgtcatggaaatgatagggctctgtgcgcaatgcaatcccactggcaattttgtgtgttttctccccataattttgagctgttttaggtcgttgactttgaattctgatttgaaaaaaaaaagaatgatgtgttagtgtgtggcgtcatgatatacagacatatgtttattatttaggtcaagctgtgaattttgctgcgtgcattagttcctcctaggtccccagccacctgattaatggttttattcgagcactggatcttagtctgggaacatgaataacagcagttttttttttaaaaaaaatgttagtagcaggctaactcagatattggatagtaccacagataagacctgcacttaccttttgattttgacatatgcgtgcaaaattatgatgtattgactgcattgttagtttacctttcagctttgtcttagctgcaaacctgtgccattgctcgcataggtagtagttagcagtgttgcatatgtgcactgagagtcaaatgccaaactgaatttttaaagtgctaaaagaatctgcattgtggtttctgtggaattgctacatgttggtactagacgttaacttcaaatgctatgacaggtgaacttctggttactgtgtttgtaacgggaagtacttttcttgtgtattatgtcaaataggattgtactctttctgtcccaaaatataagtatttctagagttttgcacgggtattaaggaagtaggtggaattaaatgggggatatgatttttttgattggttgagatgaggaagtagggggtgaagttactatattttgggatgcggtatttttttgtcttaggttctacagtattattttttaaaatttttttcttcctttagttaacagacttatattggggtaatttgaattcttggagtagattgctaatttctctttgttgccgaggaagtgagaaaacatataatttagtgacatatagcaaaacaatcagctgtaaggtactaaaaagtggtgtgtgaatcacacagaaaaagtgtttttgagtttcactatttgatgtcgctgctaatagattagcatattttcttctcctttttctacataacgtggcagtagttgcaagatatgtcattggttcatgggattatgcatctgagctacctaatgggtaatttggttttagaagttcttactgtggttggtgcacattctgttgtgttaaggttgttggttcaattgagcaaacgggagaaactgatgaagcaaaggcagacaaggaggctgaagctgcatcagattctaagaatggagccaaacctatggatgtggacaaagccaagacaaagcgcaaattgtatgttggtcaagaattggagttcaggagggatcatatggaggttagtttatgcagattctcaagtatcaatattgatgctcatgattttgttaactattgtttactgattctcttcctacccaataggtgatttcaccaatgaaagatggaacagttactgattgggatattgttgacaatatatggaatcatgctttcaggtgagtttaactatctatttgatgtagatctgagtaatgtcgtgccaaaagtgcgcgctgaaagagctggccacacttgtggcaaaacttgactagaaaataaatatctgacatgcggggcacttgagtaacaaggtttggcacattgcttgtgtggtttgccaaacacttgccagttgctgcaaaaggccaaacatgccttccttgattctggggaagtttgggatgaaccatactctctatttaacatagtttgcttagaatctgcaacaaagttcatcttctaggcctctagggcatcttttggatgtcaacatggttactgctttatgccattgcccaccatctttttaccttacatattaatattgtgcttttcaaatatactgatagtgaaattccttcttacgtgtacaaactggataaggctttccttcttgggttatttacttttattggattctgtggcatctctattagctaacattgattaaatactaggatttcctctatatggtgtggatatgcaactattgaagtttctgctttgttagcttttatcttcacactgacttgctctacatttcaggcagcggctattgatcaatcctgaggagcatcctatgttgatagctgaaccatctacaaacacaggacagcaaagagagaagtatgcctatatgttctgtatttaaattaattgtgttgctaagttgcgtcaaacctgaaaaacattgcttgttatatgaactagctgatttatagcacatttatcttccatgactcttatcagtcatgagaactgtattggtaccaggatttactgcatgcttttctacttctccatttaatgtcagaaatgttagtttttctgtgtttctgtacttcaggaatggacaaatatggaattgttgatcaccctgtaaaacttataaataccaataagcacaagctgagatgatatgaatccgagttatatctattcattgcctattatttttgtatggttctatgaaaaagacctgactgtttttctcatgttccatagagcagcagaacttatgtttgagaagtacaaagtgccggcactgttcctagcgaaaaatgcagtatgtatttgtcaaaagtgataattcgtgtaattagtttattagttctaattgttgatttggttgtcaggttctcacatcttttgcatctggacgtgctacatcgttggtagttgacaggtgagcatgtccttaattaaattttatttctgcagctgtaacttactgtctccttgtagataaaatgtttcatttagccttaacttataaacaaatgcattataacttttgaattctgaaatatttttccaccagtaagtgttagggcgttaggcacagtgcacaaatattgggtgtatcttaccttgtcaatcctccttagaatatgatgacaaatgtccatggaagtagaaaatggctgttatatcaaagtcaatctgtcatgcacagtatttcaaatataaaaccaaactacacatagacaaacaagacaaatcctgttgaaactgaacttagaaatcaaaaagcaatttttaatgaccatctgcatcattttttatgaaggatgcgcttgcatccaagggtggaaagcgagaaacactatccttgtctgttctgtcaatcccacttcccacaccattcaagaatcaggacatcaatattttctttactggtcatcaatattgtacttgagttgattgatgctcttctttccccctttactgtatcataaattcctaacatcatcttggtatagggtgtaagcataaccatctaaattctttcagcatgttttaagccatagtatctgattgtctcaaatttgatgcctgacatgtccaccgatgtctctattggactttaatggtgtcaagcattttatgacttatttcatttttgttctcatggcttttgggctttgttatgagaaacattactggaatgagacaatgttgtcattttttgtgcagcggtggtgggtctactgtggttgctgctgttcacgatggttatgtattgcaaaaggtatgatctactatttaatactgattgtcaaggcaaagtgcataatgcactacttgcatgtgtctaattagttatttttaccctttttattctctactttctcatctgaaaactgggaataagggaatcttcttttaagacaataagtttctttttcttgttttacatggacgcttgctcacataacatggacagcactctcaccttgcctctcaggaagtatactttttttcccctacttgttgctaacttatttcatgttgcagtctgtggcgacttctccaattggtggtgaatttttaactgactgtatgatgaaaagcttggagagcaagggcgttgttgtaagcatctctcttgcttaagatagcatactagtcttcttgtatgttcatatccaatttgttcaatgttcaatttgcagataaggcccaggtattcattcaagaagaaggaagtcggccctggcgaatataaggtctagtttatttaacacttcgttgatattcatattttttccctgagagctacaaagttgactgtttaagcttacctttttgttgaaaatcaactataacaatatatgcttagctattggtatgttcgaaattagttcacttgataaaaatatgaaacagtgaaagcagcaaacataaactacaaaaatagttaactacctatggagtgacttcacagtccacacattggcatttgattactggcagaaaaggtggaagatcctgaggggcagtctgtttttttgctgaccttgttttcggcaccgaattaagtcttctccatgccacatctctcaaaatatactttcgtgtccttcctctgaaagataaatttaatcaccaattccttgtatccccaagtgtggatggcatccaaagcatccaaaaagtgaaattagtcaactactacaacacctttagtctcaaacaagttggggtaggctagagatgaaattcaaactgaagcacccaaaccaatgtaccacttaaaagtgcatgcttttggcacatggatagctactctccacaaactcctatcaaaaccaaatccacacacacactgtgagttaccttgagtatgtctatgtctattcatggagaggaatactatggtcattatttcttagcatttatgtgggggcctatttcttggtggtcaaactcatttagtctattattaagggtctgcattattgtgttacttgatcatgattatggttccactttgatacatgtggataccatgatttttgctaatccctggcttctacaagattttgctgccattacactgtatgattgtaagggaaccaacaccatatggattatttgacggcatgcttgtcttttcaggttgtagatcttgatcttccaaacacaacggagagttacaagttatactgcatggtattttcattgacagatcatttatttttgttctctgttgtttaattttgtctgaatgccttcaatggtgatgcttcatatgttcacagagagctattgctagtgatatcaaggagtcagtttgcagggttccagatactgccttcgatggtataatataaacacatttaatttatgaatggggcatttgcaaatttgccaccggttttttcaattttgcaaggatgccactcgagtgacagttctagtggcatttttgcaattttctagtggcagtcttgcaataacgattcaaagtagtggtaaatttgcaattgtccctgccgtacacgcactagttggctattttttattattatctgaagtcctgtaacataaattatctttgttgcagggactgttttaacctgtccttttatgttcttttttttatgttctgctgtttacttttccctgttttattttcatgcagaagtggcatatgcaaacgttcctacaacttcatatgagcttccagatggacagtaagttgtatatcaaaattatttatgcgcatattttttttccagtaggtttagtggtttaattttgtaatggcttattgacgtgttccaatacagttagattatgagctacttttctgcatgtgcatctgctgcatctgtgcatgatacctcagtacaccacaatgattgtttataaaattgatataccacaatgaaaatcaacaatatattgacataaaattaatactccctccatcccaaattataaggcatatatattttttacatggtcttcaatgacatactttgaccattaatttattccatgtcatcttcccaatgaatatgaaattagcatcacatgaaagtacttcaaaatatgaatctggtgatataacatgcataatacttagcattgatatggttagtattattattagtaaaaagttaccgagtttgattttccttaaaaataagggcgtcctataatttgggacagactacagagggagtataccacaatttgaactagttcagtgaaatggaagtcaaatagaagggagaacttgagtgcagcactaagatttattgtcctttaaccttcccatgtaccttcagcttctatatgttgtgactttgcagattggtaggtcatctcatgaacccaacttctttaaattgtcatggtcatttgcatgttattttgagagtggcgcatgatgcaccaagagggtgttgagatgcaccgatatagctgaacttttccttgctattttctacaacattatggttaagattttgtttgtgcaatgtacctttcaagcatctttaacttgctgtctgatatctggacagaaccattgaagttggtgcagacagattcaagattcctgatattctgtttaatccatctctttctcaggtgaggtttgatgaagagaataatacttgctgtacacttgtatttcaggcaggatttgtaactggtgctggtactagattaccttgttccagaacaaaaccagcttgctgttttcttcttcagtagatgctgttgatggcttgaaaaattcttttgaaccatgttgaattgctgactctcacatgcacacgaattttgtgatgcatagactattcctggagttgatggatttgcagattcaatgtcagttcgtggccttccacgaatggtgagttaaatgagagctagacttgcatttactgttgcgcatccctggcagttcttcatattactgaagttgctattgctgttactttctcaggtcattgatagtgtaaataggtgcgatgttgacattcgcaaggaactgctaagcagtattctggtaaatgcctataaattcttcaaccacattttactagctctcttggtgttgccatccatgagcttagtgatatctttcccaaaattctcttgtgaagttctgttaatacaattctaacatctgcaaacatgcattgtggatagctttcaggtggttcatcatcaattctgcagttgaaggagaggctagaaaaagaagtacttgaggtatattttttcttcagaacaaactaggactgccctggcctcatcctgtttatacttcccatttttaaatgtgcaccattttatagcctgtgcagccaaacttttaaatttttaactactaaagtacattgaaaatattccggggttgctacatggagaagtagtggtaggtttgcctttttcatgaaaaagtatattttatcattatatgaataacatataattataaatgcagaacttagaaacagttaaagatttgtggttggagtcctttgatgtctctaatgccatctgttttcaaacagaggaaacaacatataggagtcaagcctatgatctttttctttgttcttgtccaatatggaaatacaagaataaatgaatctcattttttttcttgggatagttaataacgggccagagtgcaagttaatagaactctattctgttttcaggctattgaaaatgtttccttagaccttgtgcaaggcttgttcttatatatacctcaaaatattgcaggaatcttctggtaatactcgtgtaaaggttttggcaagtggaaattcagtagagaggcgattcaggtattcccttttatctttgtagtctttatccttcccaaattcaattgaacattttgctctactgctcactggagaagtttgaatgagtgccttttggctctgcaaagtgcaactctgttgcttgtttttattgcttgaaaagcttaacacatgaactaccaaaatatactgatcactttgttctagtcatacataccttaagtcattttattctgcagtgtttggattggagggagcattctagcatcccttgggtcgttccagcaaatgtggttctccaaagcagagtaagcacaacacagtattttaggttatgtttcccctatctcgtcacggacagctcacaagttaatgtgatttatctcactatagatacgaagaacatggagtatcctacatccaaaggaagtgcccatgaagttgtggagcatcgctacgatttgtgaccaaatttggtgcatgtgggcaatcgtattacagccaccctgttgttgatctatatcgactattatccgacgatatttatcattatattatgactagttagtttgtagattttgagagggcaacataagaagcaatccagcttaacctgttatgttcttgatggtagattctagttcatgtgttgaatctgttctccctgctgtagaatgtatcgagttgctgctctctactctgtacttttagaataccttttcaatcatttggagtcagctgattgttgtactacttatacgccacctgattagtcatgtcaacaattaaacttgagcactggttaagttaagagtggcctgattgtagttgataatcacattttattcgtagacattgtatgctggatctttatcagccaccgtcagatcatcctctgtaataaatcttcatcagacgtgtgtgccaatcgcaaggaacacgaaatgcatccgaaatgttactctgagttaatcaatactataattcttggtcaaattaattatttatatctataaagtttaaattaaatttaggaaaatgaattcatgcaaatcttgtggtaagttgtcaatttcataaaaaatccagcttactactccctttttaggagtgtgttgtggctgcacacttctgccttttgatatatacggttctattctcggtgtactcctttattattattaaaacaatcccagttacttggtaagtgctaatcacgaatcaaagtcaacataacaaatcatgtgcgtacagctataactcgattacacaaacaacaaaattcatatttgaacataaatccagttgtagcatatctggtagtataaagttttttttttgtatagaagagttttaatttctgtaagttttggaaagcatttaatcctagaaattgtagtgtagctcaactaaaaaataaatgaacttgaatcgaaattgggttgtatcataaatctttaccactcaaacgaatatttatcctaaaccacaaatgactcttttcatcaaggaatgttttgttttcagcattttaaaaaaaaacttttctaatatggttttcatgtttcgttcttttgaaatttaacatctatttaatttgcacggctccataaattcaacggatacatattctgaataattactaaggaggcatatatcggctctcttaatacaaccgcttgtttctcaaaatttattttgagttttgtctacacattctcaaggacggtacaaacacactatagatgttcacaattttttttttctaaagttgattgatggacaaatgtttgaacatataaacatataagcactgaatatttgcttatgcaggaggtatttatatcaagttcgatactttactaccatagtccctaggacactaaaatgccttcaatgatctgatgaagcctaagagagaatattgatcagtggagcgacttgcaactacacatggcacaagtagactagacacggtatatattcatattaacttgttaaaattttactacttaacagttcacttgtggtgcatccatatcaattcttacttacacaatatttgtaaaaacaacctaacactataggatgacctagacaacctttatgtcaatcacacttagaagatgatcgtctttttaataaataatgtgtactacacaccatgctctccatatagatcaagatctacaaacccttccacttataaaccttaccaccaaaaactcattaagttgcttcatttatctatgctattaagaaaaaaacttatttcgtttatgccatttctagaaatggctagtcacactattcacaatattatataataaataaaagtttcaaatattcatccaccaaaaatcatcaagtcgtgggacttatatgttaattagagaagtccctttgggtgcaatcgattttggaaaccctaaattttttctatacatagaagagagagatgtctagttgcaattgcttttgcgatgtgccaaccacccttctagctttcatccacgtctacttaattgccattcttcttcttctttttcttcactattactacctcctatcttagcgaatcttcttcttcttcactattactacctcccaccttagtgaattcatcctcattgttcacaatgacattgctaagttaactaggtatgctaagtacacaattagaatataacctagagcctttgtttccatcatacttaaaagatgacatttttatatagataaagtgtgctactcacaaggcttactatatatatgtatgatacacacaaactccacaacccaaaactctttcaagttgtgtggcccatctatgctattaaaaagcccatttagcccatccaacatgagaaaccctagggttttttccctataaaagatacctaggttattgttgcttttccaccccgcccgccgccgctccctattcctatttaatcccatctctcttcctcatcaccgctctcctctctccaggcaagaggtacgcactttttgtttcggatttgaaatctttgcttcgttttactatcattggtcataagttcttttttgaagatgtttgagaataagtttatcattgagattatcgtcacttgtgataggaagtacgcaacctcaagccggacaagacgtgagcaaagatgggccccactagtaggaaccataaatcatctcaaaaagagtaagtggtattcttatatagcacacattttttaaggatatatacatgtttcccacaaatgtttcaaacacatatagtgatatatttaaatccgacaacatttgaattgaagtgtggcaccgaatgaagccaaaccaccccgatatccacagcgcaaccgctccatcactgcctctgcctctgcctctgcctttgcctctcccgctgttgccaactccagagttgccaaggaaaggccatcttcatcaactgctggtgaaggtgaaccacaggaaacggtgctaaagcttccaagcatcccaacacttcctgcacggatggcaaagttggtgccattagaggggttgggatgcgaggcagcggtgggatcgctaacaccgagtcgggagcgagaatacaaggtgaccaacaagcacactgagggaaggcgccctgtctacgccattgtcttcaatttcctcgatgttcgctactacgacatcttcgccaccgcctgtggccctcgtgtaagatttcttacgaggcgccatattgatcttactagggaagtagtagcgcttcatgtttctataaatagatcaaaatctagtatttaccttattatcctattcgcattagatgtttttaatctgactttgtgtcacgtcccttttttcatgtttcttaatttgcctattttgaaaattcacattcgtgttcattcacctaaaatagcttaatgaaaatttcataaatatttttgtttaaaatttgactaaataaaataatcatgctgccatttattttattgtttgttaattggagttatggttttttattcgagtttggaagtggagctcaactctgtgaattattatcaatctagaaatattcctcaaaattatttttgttttatatttattaatgtaatcgtgatgtggttatgatattaccttttgttattgtgtgtgctagagttgatctgggactaacacattatacacagagggatcctagttggggtcccgacactttgcgaatgcgctttacactttaaaagtgcattaaaaaatataattttgttgaatattttgataaaaatataattaggggaaggaattataagatcatagatttcattgatcataaaattaaattttaaggatggagttatgcacatatgttattttcaatgtgtttatgctaacacgttgcgccctcgtgacctttgcagctttcaacctaccgctgcctcatgaatggcaaatttgctcttctgcaaagctatcttgatgacgatgtaagctctgccaataattttgagtgttcagtttattatctacaccctctgttccaaaataaaccaattccttgctatggatctagagatagcctatgttcagagctgtccagatccgtagtcaggaattgatttattttagatgaagaagggtttgatggcatgcctttttctaaccatggtggggtctccattgccttgcagatgaatgagtcattcttcactgtgagctgggcttgcgacattgatggcaatccattgttagtagctgcaggaagcactggaatcattcgagtcatcaactgtgccactgagaagatatataaggtctagtagtgctagtgccattttttcttctttgccactactgcaaccttggataaactttgctctgtatcagtctatatatgtttttttttcagtaatatatgccaagctatggttctgttgcttatatattggaaaataatttcttatttgatagattctgatttatctgtgttatccattccaggaggtcacatgtaattcgcttcgattaagaactatagcaatcttttgactttctatatagctactaaattgtgccttttctcttctaaacatttgtggtttcagtgggtctttagcatgtctagtcagaaaattggcatataaattatgaaccattctatatcaagtacataactgatgtgcggccagtgttttatttctgtttatgaaaaataaaataaaattacagagtcttgttggccatggtggttcagtaaacgaaataaagtctcaaccatcgaatccttcactcatcatttctgcaagcaaggttagaagattacattgcctaatctgatatctacatctatttcatttttactgatgttctttcatacggcattgtgtaggatgaatctattaagctgtggaatgtgcagacagggatcttaattttggtttttggtggagtaggaggtcaccgacacgaagtacttggtgttgtaagttgcttaagctccactgtagcattttttataaaaaaaattgtaatgctactaattaacttgaaattgtccttaaaaataggactcatccagcttctgatgtcactttttttattgagcagattcaattttattcatttcaccaggagtgaaataatccttagtcactgaaattttgcgcattctttctttacattacgagtgcaaatattaatcataattaattaatattattgcttcaggacttccacacatctgatatctaccgctttttaagttgtggaatggacaacactgtgagaatctggtcaatgaaaggttagtgaaccatctcatgataaaaagaaaaggcaattgcatgatgcttatcggtgaaagtgtgtgaatgctgtagaattctgggaatatgttgagaaatcctattcatggactgatgctacatcaaaatttccaacaaaatttgtccaatttccggtatgcttatagtatctgccaatcatatctgaatctgttctttaatctgtaatttattagtatgtataaccaatatggtatcatctctctcctttcaggtcctgtgtgctgaaatacattctaactatgtagactgtactaaatggcttggggactttgtcctgtcaaaggtaaaattgttattgctcttttgaagtcaatatttatagtgcttacaaattattatatcttggttttatcctattcataaagggctatacatactgaattactgatactgcaaatttccaggctgtaccaggaacagccttttcaatcattagattagtgttacagattggttttcccatgacaattgggttacaaaaaggacaaattcattagagtaaaatttttattactcttttgaagccaatatttctagtgcttaaaaaattattatactgtgtttttatgctagtcataaaggacaaatttattttctactgctagtgcaagttttccaatccttagactagtgctacaaattgggttttctagtgaaaattcggttatttctgaaggatgaatacatctgatgtctgctaaacttgaattttcagagtgttgaaaatgaaatcttgctgtgggaatcgatcacaaaagaagaaaaccctggcgaggtaatataatttaatttatctctagaattacaaaatcttactcgtctacttatatccaaactaatctggctatgtttattttcttaaagaaaccatgttactttctttctccatgtccctatacatactacaatacatactatgtcttcctctaaggaaaatggttcttttgatttgtagggtcacattgatgttcttcagaagtaccctgtgccagaatgtaacatctggttcatgaaattctcatgtgattttcaccacaatcagttggcaataggtaataactaatgttgcactgttctctcaagaatcattttttttgtaaggcttgacgaatcattttgttgttatcgttctaaattattacacaatatacctttttcttggaagacaatgaatatgctagtatttctttagataatggatatgcaatattgattttgatattctttaaaacaaaatgtgaagtgctgaaggataaccatgtgcttattcaaacaggaaaccgtgatggtaaagtctatgtctggaaagtacagaccagccctcctgttctaattgctcggtaatgttaacctcaagaactcaacttattaagtttcatcgtctgcatttaatttggtatataggtgttgcctgttgggtgttaatttctaccaattctcatgtcttctacatgtgtgcttatcatcatcatgatcatctacaggctcaataatccacaagtgaaatcagccataaggcagactgcagtgtcctttgatggaaggtacattactacattcatcctgttcatactataaatttatccctgcttattcattctgatggagctagcctatcatttgcactgtgtttatgcttctgttttattttttatttttgttgtttgttttcttcttggaagattaaaaaaatgttttattgtgtttccattttcttcagcacaatccttgcctgcacagaggatggcaacatatggcgttgggatgaagtggatcacccaaccgccccagtcccaagcaagaaacaaaagtgaagcaaggattatattaattgaaattaataaggctgaattggcgatttgttcttggtatactttgttatactactttgccttagcgttcatcaaaactgccatttgattttccaacattcagaaaactctatagctggatgtaagatttattatcgcaagatattcaggatgttggtcggtgacttggttttatcaataatttgctgggaatatagtacttaatctcataatttgtttctctgtgaaatcgtcgtaaaaaagtgtttatcattttttcaatgttaagcacgggtgatttggtgttggagtcatgcatgattccaccactatgatttaaatcctagtgtccaaaaatatcaaaaaaatcctagtgttcaaaaatatcaaacacatgtgttgtgctatcaataaaaaaaattattagtgagattagggatttgttgttggcttagtctctttgagtcacgggtgtgcatttcccttatggagtaataaaaaaaagaattgtttatcctgcattctcgttaacactctaaagcaccagcaaagcatgcctacattttaattacctgatgccttgtacgttttattggtaattaatttattccaaatgtccaaaataaacgattcatcatcagtccaaatcattttatcgtaattaattataagcttctgaacatgaagccactgcaattaattagatttaagctgacctccggttctgtaaagagtcgtatgaggaagaccaagaccagccatggaaaatgtagacggtgacggcagcgatgggggatgtggttgccgtttggcgccaaaacgatggcgttttcatggccgtcggcttcttcctcgcgccattttcatggtgacttgaaggagacgtattgtttgaacagccaaagcatatatacgtgtgcaaaaaagagagaaaaaaaattatgaaaagcaactagattcacatgatactttgtttctctcttcttttttttttcttttgagggacactggacacatgatgctttattggtaaaagatgatacacaagggaatacactgctgaagcacggcagcgatcacagttcacatgggaactctttgtcttttttcttttttgagatttgactaattttcgtggagtctactactctactccctctgttttcaaatagctatcggcggtatctattgttatttcaaattgtccactaataaactcttaataatagttaggctatggtgaatagaagttttgtggttatgtttagtatacatttcactttgataatatatatcgtttttcttaagaactagtaaatatcttttaagaaaaaagaggtcaaattattaaaaatatagggaatactatgttaaggtttatgcttttcctgatcatctagtttaaaatacaagtcatctataaaaaaaatgtacaagaattaaagaaattgttgaatgactacattacattttttaacgaggaacatcattatcctttttactcaaacttagatccctaaaattacttagactcatttgatacagatacagaggattgaaatcctacataaaacaatcctgttaggtcatttggataaatgattaacctccttaaaatcctttggctcatttaatggtaattttggaggaaaacaaacatgcgatctagcctcatatattatgtttttgtgagacactttttggtactatgtattggttctactatgatgtattgtaccctatttgttttctaaggtcctaatggcctaatataatcgtattatagatatatagaatggttaaatggttattgtctatgtgatatgtaagattgttgcttcgacttgatatccgaataaatatttgtaaccgatagtgtacgtatccattttggtacgtatttgttccatattttttcccgccattatccaagtttgtatccgtattcggcactatccgtgttcgacccgatttcgattataaaatatgggttaggatatgggaagggtgatatccaaccgaacccgacccgttttcaccctaccgcacacgccgctcgcatgagtccagtgcttgcatattgggcctaccttttcaactgggtcaattaatacccaataaatagaagaaataagttcactttacatcccaaatcgaacgcccatctcccaactcacaatactccttcgacagtatagcggccagttttggctaacatggtgagtgagagccatgtgtcaacgtccaactcttttgccacatcacaatcggcgactgcaaggcgggggaggtcgtgccccgctcatcactgcgcgtgcaccgcggacgccagccgcacaggatcttcgcctaaaagtgatcagtgccgtcgccaagagatacaaaccactgcacgcctacatcacacactcgccatgagggacaccaccgcccgcaccttcgatcgatcactcgtggttgcactgttttcgggcgaagatgctcacctgcctcttctgtaacaccccaggtttacttacctagaatgctacacactacggtacagaaaccaccaagtcctaaattcattaagaatttcgacagagtctcacatgtaaattcggacatccacaacaggtaattgaagttaaactaataataatatcattcccacggagcgatccatccttataatccaaactattaactcggtaggtaagtgaatacctggggtgttacatctacgactatgatgtcgtcgacaacaccgatgacctggccacgcacgacatccctagggcgcggacccccttggctcctaaaggcgtagggccggcaattgtcacacctcaatctgataccgccgtacaacggcacctgacaggagcgtgtcgtagggaaaacggcgcgaacagcttcctacgaaaccgcgatctcggtaccagtcccaggacatagtgctggtacccacggtgacaaatatgaatcatagcaatccttaaaataaatagaggacttatttaccttaacttaggttgcagctcagacagcccgagaatacaaccgacgacgcggacgaggaaacaccaacagcagcagcagcagcggaaccaacggtctaacacccaacaccacaggcgacggctgggaaccaggacgaaaccctaatcttcacttcactttatcttctcttcagggtggaggaactatatatatatatatatatatatatatatatatatatatatatatatatatatatatatatatagcaagggtgagtactttcgtactcagcaagtcacgggaatttaggtgtttaatgcaagcttggaagagaggcaaggttgttttgcaaatcttttgtttgaaatcattttgaaatcactaagtgatttatttctttttaagtttgggccgaaaagagacttgcgtctcgattcgactttaagagatgtttttcaacagctcatttggtaatgtactgacctcccgggtcagatcattacttctcggctcccagagccattccacttgattaatcggctcccagagcctttttcattttctcggactcccagagtccagctgcccagcagcaaagcaatccgcttccactcgggaagcctagtctatgatgcccacagacatcccgaatcacacagattcgtttctgaccactcaggtcatccatctgccacataggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagacacgaacttactccagacactggccggtgtcagaggttcgcgacaaagcctttcccaagccgacccagggatacctcatgccacatagaaggatcaaatcctcacataaacataggccattttaggcgttcacaaatcaaactccaaccacctcgatcggtaattcagcaagcttctcgttcttgcattaccaggaacctggtttggctccaaccgaccccgccctggcgttcccaactattggcatgcgaggtttccctgaaccgactagttacttagccagggtgtcccattccaccttgtggttgcactttgattatgttcgatgagtttcccacaggaatcggtccttatatgtgaatacgggacagtgccacataggcacaacccccgcatcgcgagttttcacaattcattttattttcaaacacaccgacaccacatgtcgggttttgaaggcttcacaaacccatttcccaagttttcgacaaacaacggtgtatgtgggttatttggtatacgcgctcagagagcacgaataccgaggtaccacaagggtggagagacaaggaatcagggtagtacgacctacggaaattagtgcgactactgggtaggtccgtcggtttggcacgcaaaccgaggccaagcaagttaagtgtgtgattctaataatgcaagttgcaaacaaaataataatgacttttcaattataggggcaattgatcaagggtgacttgccttgctcaaggtcttcacaaagcttcacgaatcttcgagaaaacccgcgatcgacgaaaatccgataaccgcaactatacgcaaacaatcgaaaacctaaacaaaagaccaaaagaaagatcctatttagactaattagtagtgccattaaatagatctcaattttatgtgaatactggaagttgaacggagtcaatcggacgagcggttggggagatatggatttcctaagattatttggattttctgtctaaaggaaaaggatttatcaaatcctttggaaaagaaaaggaaggagggatgtcatttagacttactcggcggcttaggcgcggcccaaggggtcatgcgcagcgcggtcaggccattggccagcgcgggcgcgggtggtcggcccattaggggcgcgcggcagggggaggccgaccggtggatcgggtgcacctcgcggggtcccgggtggggcccgcttgtcggtgactgggttcactgagggaagggctcacgggaagggcagcgatagggtttggtggacgtggtttgggcgcgtgcgccgggtggagcgaggcgcgatgggcccacgtgcagccgcatggctcatcgtggtctgcgcgcgcacgtagggggaagcgaggctggccggtttgactcggtctagccgagttggcaccggtgtggcgcctacgcagcggccacgcgggccggcgagaggaggaagaaagggggcgcggccgaatggacggcggacggcggccgagttcaccggaggttgtcgcgacgattcgagagggagggagcacaccggaataatgagacggaggagatagagtgcgccaccggctcggattcacggaagggagaccggcgacgacgaatcgcggcagccctcgccggaggtgagaaaaggggcaaacggtagaggggcgacgaggattcaattcgaggcggtggaagcatctccggggttcaaggagtccgtttccggcgtcggatggggcggaagagcaccaaggagggctggtgacgagcggcggcctccgggagcgggcggcaacggcggtgaggccatgccgggcggcggcgggtctaggggcggcgtctacgcgtgttcgggagtgccaccgagctatcgcgcagactagagggggcgagggagagcgaggaaggggaacgggaggaggcactaccgagctaggcgggcagtgatgggcggtcgacggcgcggggcgagttcttcggccttgggccggggaaggggaagaagaagggtggccggagtcctcttcggctcctcgcgcacacgccggcttcaccagcacgcgcgacggcgaagggaggcgaggtcggcagctgcaaggcggcaacaaaggcgcggcggcggtggaagagagatgccgagagagaatgagatagggaggctcggcctaggctttatagatggaaaagaggcggtttgggagggggaactgacataggcggtcaagggtgcaaggacgacgagctggtgtggtcaaggtggtggcaggcggtgacgccgatggtggtcgggcaaaaggaaaaaggtggagaagaaagggagctctgctccttgctgtttcgggataaaggaaagggagagggagcgaggccgagggctctgtctccctcccttggacgcatgcgcacaggcggggctgggcgacgcgcggtcacgggcggcgtcagggctgacgcggcggcgaccgagcggctcggcgtcagggctgacgcggcggcgaccgagcggctggcctcgagcgagcgcgcgcgcgcgggaacgagcggcacggccgaaaatcgaatggcggcagcgggaaaaatcggcgatggcggcagcgctggcgtgggagagagagagagaaacatagagagagagaggaagaagacgagagagcgagagaactgagagagcgagcgacggctctctctcggctcgcatgcgtgcaacgcacgtgcgaggtggggggagaagatgatgggctgggaggggagatgggccgggggaggaaaatcggtccatccaaaaatacagggaggtaaagtagacctttttttaaggagatagatttggagagaatttgaatttgggggaaggaattcaaaataggaatttggttatttttggagtcagggcgaatatttggcaaggattcaaagagagggattgaatttcggaatttgatttggagatttgagtcgaaggaggaattttcgaggtggaggattttgatttcgatgagagggaacaacgggattaaattgagatccttggcacaacttagactctcacacaaagaacgaaaattttcacaattaggattttgccgaattagtttttaacgcctcacgaaaagcggagcgttacagcaatccaccggatttgggtgccagacagcagttgcggcaattcacatgggaacacaaatgctgaagcacggtagcgatcacaattcacccgggaactcttttcttttagagatttgactaactttcatggagtctactactctactccctctattttcaaatagctattgactgtatctagtactatttcaaattgtcaacgaataagtcttaataatagtcaggctataagttttgtgcttatgtttagtataaaattcactttggtaatatggtacttttttttaagaacttgtaactatttttaagaaaaaagaggtcttttttttaaaaaaatatagggaatactatgttaagatttatggtttatctgatcatctggttttaaaaagaaagccatttataaaaactgtacaagaattaaagagattgttaaaatgactttattacattatttaataacggacatcattgtcttttttactcaaacttagaccctaaaattacttagggattcattaaaataaaagaaaaatggagcaaatatagaggattgaaatcctacataaaacaatcatattacttcacctagtcttcgataagtaaaacgtttaaggtcattgggacaaatgaccggtctccttacaatcctttagaacttggaggaaaaaagatctagactcatttttctggtttgaatccgtatgtttttttgttacgtgttgttaaacaatttttgttgtaaattcctatatattcatttcctccagaattcaagaagacatgaaatcatattatcgaatcctacgttgcaaaggagacatatatttaggaagggaggcaatctaaattgttttagatttgtgcacaagaacaaaagagattgttaaatgactttattaccctcttttaaaactactaatgtatggtttgattagaagctgagacggttggttttcttcccaacctcactccaaaaagtccaaatacacattcccacgctcaacctcaacccccgcctccgctcgccgcggcgcgccatggcgccgacgccgccgtctcgcccgcgcctccctctccgcccactcctcctctccctccctctcctctcgctcctcctcctcctcctcatccaccgtccccacccctccccgccgcctcccctcctcgccaccgccaccgccacgcggcgcgacgacgagccggcgccgcggcgagcggcgtcgtctttggcgcccaaggcgacgacgacgacgacgctggcgcacgtggtgttcggcatcgcctcctcccgccgcacgctgccgctccgcctcccgctgctccgcctctggctccgcccgcccgcgcgcgcgttcctcttcctcgacggcccggcgccggccgccgccgccgcgtccgagccattgccgcccaacctccgcttctgcgtctcctccaccgacgcctcccgcttcccgtacacgcacccgcgcgggctcccctccgccgtccgcgtcgcgcgcatcgccaaggagctcctgcagctcgacgaccaccaccacgcgacgccgcccccgccgcggtggctcgtgctcgccgacgacgacaccgcgttcgtcctcccgaacctcctgcacacgctctccaggtacgactggcgcgagccgtggtacctcggcgcgcgctccgagtccgcggcgcagaacgcctggcacggcttcgccatggcctacggcggcggcggcatcgccgtgagctggccgctcgccgcgcgcctcgcccgcgtcctcgactcctgcctcctcaggtacccgcatctctacggcagcgacgccaggatccacgcctgcctcgccgagctcggcgtcgagctcacccacgagccaggattccaccaggtaacctttgcttcttattgtttacattttctcatcaacatgctactgccctaatggaatgttaggttagattgctgattgctcattaattcaattgtgttgatagatagaatgatagatagatagatactggtggattgataaagaatgaactttttaaaatcaaaatttggtactcttgacacctgactggtgagtagagcaggaattgtctcaggatatatctgaccatatttgataattgtattttgtgccgcgtaaccaccatcacgggcggtttgtataacaatgattgtattactgtaataattaaatcattatgtagtacaaccatgttgttcctcacaaaaaaaaaattgttgtaatctattcagccttgcttagtcacaccgtagttcagaggcatagctagtctttgatattaagttatcagttatggaagagaatcgttgggtgaaattttggattgtatcaggtcaaaagaaaaaaaaatagtattgagcttgcaaaatcattgcctagtatgaagggattatgttgttaatggtagaaaatcttaagctgtcagcactctaaactttttttttttttgcttccactataaatttttagtgtacattgttgtctgcaattctgcatacatttgtgccgtacattagacttttcaagaaaaagcttatcctttagaatgctctcaaggaatgcagaaccacaccacaccaatcctgtagaatgttgctaagttgtgtacacatggaaccatactgattacagaacataagcgatgggtactggctaacaactacaactacgaattgcggaaccaatacgaaatctttgctactgcccactggatttagtgatccatgcttgtgcatcgactgattttgatgtgagggcacttgaaagtgggtgctttggtccgcatgccacacatccctttcagattatcttaagcttcgccatcactatcttaatgctgtcaaaatgggcatcttccaagataatgatgttgtcaactagaactgttggctgttgctgaaataagtagtgcagtgggtcgctgtctgacagttaaatatggcagcagaaaatatttccttttgctccacctatgtgtttcacttactgaattgtatgacttacactatataaactgcaaggtattgctttcttcctcattttcagccactgaaaactatgagatgtcttcttcttgacgactctttagacgcgaaacattcccatggctttacttaatattatgcaacaaaaaaaatcttgattcttaacttgtgtgttgtgttgcatttgttatatccagatcgaccttcatggggacatatctggactcctaagagcgcatccgcttactcctttagtttcactgcaccaccttgatcatgtatatcctctttacccgggtatggaccgtgcaacagcggtgaagcatttcttcagagctgccaatgctgatccagcaaggatccttcagcagacagtgtgctatgaccattcgaaagcaattacagtgtcaatagcttgggggtattcagttcaggtgtacaaaggcaatgtgctgcttcctgacctccttgctgtgcagaaaacgtttgtgccgtggaaaaggggtcgcaatgctactgatgtttttatgtttgataccaagcattacccgagggatgagtgcaaaagagctgctcttttcttcctcaaaagtatttcttcaggtgaaggcaagatcaaaagcgattacactaggcagctgcctagaaaatgctcacctaacttgattccattgaggaatcttcaccaaataaaagtggcatctgagccattacatctggttcctgggaaggtatggctatgatggttgccttcatcaattgtgacacaaatttcagtgctcgaattaagattttgtgattgttcttttactgttgtgtgtttttaggctttaagacggcattgctgtgatgttgtgtcttcctcatctgaaaccaacatggatgttaacatcaggaaatgcaaagaagacgaactgattgcgatgcattcttagtcacatcttcaatcgaactggatgcaatgctcttcctctgtagtaagttcctcctcacatccctttgtattttcacagaattttcctggacacacgcctcaatgttttatcacatgaaacatgcgtttccattttattttgggtcccaccaggtctgacataacttttctcgtagcaatttataattttcgtatgatctttgcagtaattccattgtactagcttcctagtacagaaagtgacaagacaagttaagcagactagcattgtaatagattctccatgaagtctcacattctgccgtttactttggtcaactggaatctcctttacaaaggagtggaggcaccataatctgtttgtgctatacaatgacctttttagcttgaagaaaaatgcatagtggacttgagtgcggccctccttttggtgatcaagacgacttctggtgacagtagtactactgaaactagaacagcatggatacatagatagatacttcctccgtttcacaatgtaagtcattctagcatttcccagatttatattgatgctaatgaatctagacatatatatttatctagattcattagcatcaatatgaatgtggaaaatgctaaaatgacttatattatgaaacggaggaagtagttgagatgttgaacaacacacttcattattattattttttaactttacctagcaaatgctcatatttatatatgatattttaccttgagcactttttgttgtggaactttgagtgtacattgggactgtctgtacatctcaatatctcatacagcaggagaaataatttcaggtcctgcttaggattacattgcaatcctgttctgttgaactgcttctgatatgcatggtttttgggcctccatcctggcccatccgtatgtatgggccggttttttgaccttggatgtggcaggatttcggcctatccaaagaagggacgtttgttggattgggcctcttctgaagtgtcaatgtaatcttatgctggctaaacttggctggttcttggtctatgttgggcccttttggctgtgtttcttttgaatatttttttagattctattcatcgtttgccgcgcgcctgccttctaaactgttaaatgtgtgtttttaaaaaaaatatagaaaaatttctttagaaaatatattaatctactggggcaattgaaatctagattatttgtaagatttttagctaatatttaattaatcatgcgctgatgcatcgctcttatttatgtggcggtacggtggttcacattaccataccaactgtagtcttcacacatataagacccttaggttcaacatactcggcctgctccaaataagagtcatatatttataataatggtaatccaaacgaactcagccttaggttcacgttaccataagccccaagtatggtaatgtgaacggtcaatcaacttgctccaattaagatagtcatctttgtagtattcatacatataagacttaaataaaaagataaactaaatggttgatcggaacctgagtagtaatttcaatactccctccattttaaaatataaatatttttaaaatagtgccaagtcaaatatttttaactttgactattaatagaaaaaataaaaagatcaatcatgtaaaattaatgttgctagatttatcattaaacaaactatcataatatgtaactcttttaaagtaacaatatcttgaaaactgtgtcgaagtctaaaatgcttatgttttgggtcggtataattacaatataagtatactttaatcagtaataatatctaaaaggttctaaactagtaataaaattgttgtatagctactttcttcgatatttgtcatgtaaacagtgatgattatgtcgtgttatccagcagacaagatacttttcatatagctaggcaagtaggcatgaacacttgcgctagtaggcgatgcagagtggctaactttgtccttccaattgacaaatgcagccgcatgtggcccatcaaatttggtactagtactaatctctgtgtacctaacgcaaacttttgctgttcgaccagttgacctaatggtctgttcatccattggtgtctaatgtgtctccattcaactattcatggcaatgtctccaacatttatatatcggcagttgagctctcttttcccatcaagtacatgtacgtacatgccgccatgtattttggaataatggataaaatttaatggagcctaaggttaactacactcacaatcaatgtttatctcagtctataacatgttttaaatttgtgtctcgaatataatagtacagtttagtcctccccatatgatatgtgtgtttgcagatttttttttcccaatttgcttagtaccattaaaaaattacggagttaaaaaatacggttgtatgtaccattgatacgtacgtaggtctaggttccacatgtcattcttgatggtattttataacttatatatatctttctgatggtattttccaaattctctctcttttttttttgccagaacggtaaagtgacgctggccaagatatattaagatgtgtttgtgagttttctgaaatcaagatctcctcatctaccaaccatatactgtgccgggaccaacatatagtacaagctagagattattattgagtccttatcggttcatcagagtgtgctcatccgagtgtgcttttcagatcatagatagcctttggtgacaaacagttttagctaatattccttccgttatacgatatcatgttttgggtttgtcgattgtcaaatttatttaagttttgctatgtttatagataacgtagtaacatctaacttcaaattactttcattaataaagccactgtttgtatataattttatagcatatatccattttgtgtttgaaatattactatgttttttaatataaattaattagttaaacttgaagaagtttagtttagaacaaacctaacacgtgatatgaaacggtggaagtataccctgtacttgtaactctatcgtgaagaataatacatgtcgcaactataaatatatatcttccgaagcagtaaaacttgtactcctaaaagtgctctcaatctaaggctatccataatgtaatggaaaagtaggaaataataggcattaagacatccttactactgcattgtgaaagtggtaaatagctagtgccaagtcataggcttattattaggatataagcaatttaagttgagtctcaccttgtttattttattgtggcaattctcatgttagacataggttgaactttttttttaaaagatgggcccaccttattttccactctacacatgcatatggattgaaatcctctaacgtaactttcctctgacgtggtgactaacatatggggtccgagagtgatgaagtgaatagtaacgtcacgatgaatggtaacatcaaaggatttgcttctcatgggcacatcgtggtctttccaacctgctaacgccacttgacacggttcaccttactgcctagttggatcgtaaacattgaggatgcccgaaaggggtgagataaagcagtaaaacgacaaagatattttcatcaaaattaattaaaaccagcagatacttgtgcagatctgaacacggcgatctctttctgactcttcatccttgtgacaggaacaagcagctaattaagctagcgtcgtactccacagtagtggtagttaacagccggtctgaacacataggcaagaattcaacgacccggcccagcaatagcagcttattgatgcaccgaattaagcaacaattatatatatctggatccaacaataattcatccgatcaactaattactaatattgcgggccatccgatcctgaccgttgaatcgggcgatccgatggtcaggattcagtccagggtgatgatgatgatgatgatcctgatcctgatcttcctcctcgatcgacatcttcccgacattgtcaacatctctttcgatcggtcgatctgtagctgctcctgctgttacgcttgctagctactccctccgtttctaaacgtttgacaccgttgatttttttaagtacatgtttaaccgttcgtcttatttaaaaaaattatgaaatatataaaactatatgtataaatgaaagtatatttaacaatgaatcaaatgataggaaaagaattaataattatttaattttttgaataagacgaatggtcaaacatgttttaaaagttaatggtgttaaatatttagaaacggatagagtatatatcatcaacccccagtaccattaatggaggaccactagctagctgggtcttacattgcatgcagcagcagcttgctaggccattcgatcgatcgatcgatcatatatatatatggatgagctacctacactgatatgatccaccacaattaatgtgctcgagacgacgcagcaacaaccgccgcgccattgatgactaattgagatcgatcgatagatagtataagagatcgaccacgagctctcgatcagcctagctatagctatagatagatatacaatctctctctctctctctctctctctctctctctctctgattgttctcttctgcttgcctcttccatggagtgggctcgaggtccagccatggcggcagcggcagcggcagcggtggtgatggtcgccgccgttctggccggccaggcgatggccgccggcgcgacgacgtacacggtgggcgcgccggatgggctgtgggacatggagaccgactacaaagagtgggtcgctcgccggacattccaccccggcgacaagctcagtcagtaatccaaatccaaatcgagttttagttatctctgttttcttgggttttcttttgtactttttaaccatttgaatttttaatttcaaaaataaaccattctaaatctatttccagaatctgaacatttttggcacaccaaacccaccagacttgacaaaataacgtcaacacgccagccgtagccggcgtcatagtttagttttgtactatcataccaaccatatcgatcggagtgggcaaataatagcactgccacgctagttagacctgcgtcggtgttgtcttggtaaaagcttcaaatcttaattacatataagttttggaagagtttaattattttttaaattgaagattaaaaatgttctaaaaattaaaacaaattcttgcgatgagcttaatcctgttcttgatttggatcaatgcaagtgcagcgttcacgtactcgcgtgagctgcacgacgtggtggaggtgacgaaggcggggtacgacgcctgctccaacgccaacaacatctccgccttccgctccggcaacgacctcgtcgccctcaccgccgtcggcacccgctacttcctctgcggcctcaccggccactgcggcagcggcatgaagatccgcatcgacgtcgtcgccgccgcctcctccggccccgcagccgccgccgcgccgctgccgtcgacgtcgtccgtgaccgccgccgtcgccggaagccgcctagtcctcgtgctcttgtatgctcttctgccattgtggtagcattaattaattagtctcttgtgtgtatatttttgtaattgtaagtttaagtacacgtatatgctttgatttagttaatattttgtacttctggttttaatttgtggttattgatcggattttagatatgcatgcatgccttaatttggtttcatttgactgaggtttgtgttacgacttgcatggagagagaaatgattgttctcttctacaaagctaggatttttttttcaaggatttttatgaagttcaattgttcaaggattttttttgaagttcgactggtcaattttttcaaggatttttatgaagttcagaattgctctcaaactaaccataacgtattacaatatgcaagatgcatgaagctcattcatatatggtctatttgatgacgttctaattaacgtacctttctggtttttaatacatgatgttattcacttttaaacatatgttcaactatttgtcttactaaaaatttacaaacaacactacactggccaaggtcacctgtgacgggcccaaaccctcatctttgacggcttcgcgcatggtcagtgatcagtggtcactggtgagtccagtcacctttgacgggtggccggccgtcacaggtgacacccacctctgacgggcaagttactagaaggccgtcagaggtgttggtctccgctagccttgagcgagttaggacccgtcacaggtgactcatctctgacggccctttaaataaaggccgtcagaggttgaggtctccgtagttagaagctgtcacaggtgatctacctgtgacggccccaaaagtaaaggcccgtcacaggtaggtcacctctgacgggcctttatttgctagtccgtcacaggttatgttacctttgacggatttttgttccgacccgtcactgatgagttaattccagaaaaaaaataaatgctaaatattggctagcctcaggatttgctagccatgccctctgaaaaatagaaacatcacagatatattccagtcacagatccatcacagatacatcaccccccaatataacatcacagatccccaacaacacatatatgcagttcaaatgccacaattttgcacagcaaattcacaccccttgaaagccacaatttcggtcgttgctcatagaaccgcatatatacttaccaaatggattaaagccataatgtcatcgacctgcacaacctgtcaataaggaaaaaaaaaggagaaaacagatgaatagtacaacataaatcgtagttgatcaaatgtgatgacaatttagtaaagtaccataaatattgcacatatgaaagtaaattacattgcactctataaaaacataattttttacatcgccagaaattataaaaacatcttttttacatcacaataaattatctagccaagttcatgagtctatttggcatgaaaacgtcctttcttgttcattatttctgcaagaataaaagcgcacaattcgcctctgatagcgggggggttgatgggtgagatcttgaagccagctctacctttctgtttaataaataagaggttaattagcacgttttgaatagcaatgtagatattgaaatgagcttattcgccattagcaacaacctcagggtcgaaatctttcacctctcttagaagtgttgacatgttgtggcacacgtggaaaccacattggtctccgatctgttgtgcgcatgcaaacttggtgtcatgataaagttcattcttgccctccttgtgcctaccacccttttccacatatgggccccaagccatatttaaggccttggtgatttcactgaaatcataatctttggacttattggagttaaggtaggtaacccgactccacttaggtacgatgactaggagaatccaatgtcgcctgcgcagtggttatgtagcgttagtactaagaaccttaacttcaaaaacaatatacacgaagggtattgtcctcttactcttggttgtgtgcgcacatgatgtactccttgtcttgatgggcccataaacaccggttgacatagtcaaccacctcagtgaagctctgtcgtaaattaacctcattcaccatggatggatcaaggaacccaacctgattaccatggcgacgactctcgatccaacacaaccttaaaatatgtacgtattagaactaatttaattaggagatatagtccagtcatatcacaagtatagaaggtatgcacttacaaggagtagcatttaagaagaccagtgtccaacttccggatcctgaaaaggtcgaagaggtcatcaaagcctatagttatataggcaggcgacgataggaacggctggtggtcgtgatgtccaactatggatgactccctcattttccgcttggcattgcttagctccatgtattgcttatgtagctctcggcaagcaatacccatcacagctaacacattgtcctccaccaatggcatgcctagctcaaattgggctggcgccctcacgaccttccccgatttgctcaccggcatcgacgtcgcagccttgcccctttttggctccggcgccaactccccgaccttccccttgccgcgttcacgcttctggcccttgacaagtggtggggagctatcggcctttcttgtggtctttattggagccaagctttgagctatatctgccaagtccatatcagctccaccgggagaatgaggtactgacaatgccggtccacggggagcctcaattgatagcttagacttgggaggtgtaagctccgtcggtcgacttggacgaggagtcatcttcacaactatgtcttctttgggccattgtatgaacgtcttgcgcgcatcgccgaaagtcatgatttcatcatttgggggcacgggcagcagatagcctgaccaggtgtcctttactgtatcgatggacaccttggcatacctagctagcaggtctgcgccgtggaccttgtctgtaaccgagggcttgaaagccatgccctcagcgacttcaggagcgaaagttgggtggactctcgctagtaggacacactgtgctgcgccctgcataaggtgaaagtttgaatttaatattggaatgtgtacatgtcttttattagatatggatcggataacaacaattacctcgatgtggtccactgcagctagtggtgcgatcgggagaccaggggccggcacctctgtggatgcacaactactcctatgctgtgacggactcgcgtcgtgttgtacacgaggagttggttgcacagcaggtgttgtgactcggggtatattcatgtcggcgaggaccttgttaaccctttcttccacccttgcattcatgctagcttctagttcttgaatgacctcaaccttaagttcggccttcaaacgagcgtccctctcttccttggagactttccgtttcctgtattgggatctgtactgagggagtccatgcttccagggcacatcgctaccaattccccgagttcggccaggatgttctttggttccgagcgcctttgtgaggatgtcatcttcgcgcctcttcggcgcggactcaacctcgctttgtgaagcttgttcagtaaccaagcccaactagaaaagaagatagtcatttatacgaacttgtactttatacgaacggaaattagttaggttaagtagtgaactcaccagttcctgatagacgacggcatcacttttgttctcaaatgtgacagagccgttcgggttgaccttaccccttgcccgcgcccagttgcgagctctttgttcagggatgtctgaaaacggggcagggacattcgctgctgcagcggctgcatcttcttgggcccatattgcctccttgccgatgtaccctgcggtgcccagccgatgcgggtgctcattccgctgttgcagtaggcgatgtgcctcgcttgattccctaaactcttgggtggtcttgagagagcagaattcctcccaaaccgcttcggttatttgagggtattcatcgaacggcgtatgattgccgggcgggttgacaaactcggtgaagagcttcgacttccaattcttccaagctttgcccatcttttggaatgccttccgcttgagcctatcctttgcttcggctggaaatgtgaaccatttctccattgccgtccaagctcgctctttctcggcttctgtgaccttcccgatatctttatggaggatcccgaagttctcacgtgccgctatcccgcagcagttagaccatcttccaatgacagtcctgggcgccgtgggcctaccactagcgtcaacctctcttataacttgcactgtggtcggccatatattttgtgaccgcggatttctactagacctacttgcacttgtcccgcccgacatcgacgtatgttgttcatgcggcaattctgcagcacaaacagaaggcaatatttgctaaggggtgctagctaaaatttatgtggtcatgtggtgaaaatttatcctataaattaccatgaatttcgggttgttggaccgccgttgtcgcgggatgaccttcggcaactgcctctgtggctgggtttgcttcttcctggatcctcgcaggtgttggggagggcgggtttgcgccgggcgttgacatggtttaactttcgcgaaaaagattataaatttcctaccattagactaaatagcattagatccaatgtaatacggggtatactatgaaagatatggcctcagttttgctgagaaatatgcatcaattacaatcatttgcatgaagggataaaaagaggaaatcataacatcaaaagagcaagtgcagaaaatctgttcttatgcataaaaaaaagaacaagtgtagaggtatataaccactgaatcaatcatgcaaatttaaaaaacagcagcagcaagggtacagaatttgcatgattgacataaaacagcagcaggaggagtatatatgccacaggggtatcaacagcatgggtatataaatgaacaagtgtaggggcaaaaaaatgaacaagtgtagataatatgttcttattgagcaattcatcactggccatttaataaggaacacattgggcagcagcagcaagggtatataaatcatcaaagaatgacagaaaacaagtgtatatagtctcctcttatcaatccagaaaattcgatggcctcttcggtggtgtaactctcgatgatactcccctcggggtgtgaacggttccgtacataacccttaaggatccccaggtacctttcgcaaggatacatctgcgtcatgaatgctggaccacaacactttgtttgcctcacaaggtgcaccggaagatgttccattatgtcaaagaaagttggaggaaagtacatctcaagatgacatagggttctcacaagttctgcctgtagtttatctagtccctcgggatcaatgatcttctggccgattgcatggaagaaggaacacaaccgctggatcgggtgtcgcaccttaggaggcaaaatattccttattgcaacgggcaacagctgtgtgataagaacgtggcaatcatgcgacttcattccaaccaacttaagatcttgcagtgaaacgagcctactgattcttgatgagtaaccagatggaacctttataccactcaaacatgttagcaaatcaatcttctcttctttcgagagagtgtagcaggctggaggaaggtaaaccctgccggattccgtggttatgggatgtagctccgaccgaacacccatatcttccagatctcgtcgggcgttgagaccatcctttgtagtacctgggttaagcagtaatcccattaaactctcgcatacattcttctcgacatgcatcaaatctatgcagtggcgaacttcaagatccttccagtatggtagtctccagaatattgacttctttttccacatgctcctctcttttgtcttttgtttttccacatgctcctctgttttttccttcgatgtgctcttctcttttcgctttccaactttcctcttttttccaaactcgttggttattcccatcactaagttgtgcacctctgtccctgttagctctgtcgggggtccggctgtatctctgtgtccattgaaattctttctcatattcctatacgggtgataccttgggagaaatctcctgtgacccatgtagaccgtcttgtgtgaatgcttcaaccatttgcttcttgtttcctccatacactccgaacacgcccatttccctttcacagtttggccataaaggttgccaagggccggataatcgttgatggtacaaaacagcatcgcatggaggttgaaatactcttgtgcatatgcgtcccatgttcgtgtgccctcattccatagcctttcgaagtcatcgattatcggttcaaggaacacatcgatatcgttgccaggttgtctcggtccttgaatgagcatggcaagcataatgtactttcttttgaaacacaaccagggaggaaggttatagttaacaagcagaactggccatgtactgtgacgactgctcaaatcaccgaaaggattaatgccgtccgtacacattgcgaaacgcatgtttcttgggtcatttgagaattcctggtaaatcctatcgattgtccttcactgcactgaatctgctgggtgcctcagcatagtatcgactttccgttcttcggcatgccagcgcacaagcttagcttgttccttgttcgcaaacattctcttcatgcactccgcaattgggagataccacaccacctttgctgggcctcccctctttgacttacttccttcaccttcactctttgctcgtttgtatcttgatcccccacagatagggcagacatccaagtcagcgtattccttgtaatacaaaatgcagtcgtttggacatgcatgaattcttctgacctccaggcccaacggacataatacttgcttcgcttcatatgtcgtctgaggtaaattgttcccctctggcaacagatcctttaacagctcaaggagttctgtaaaactcttgtccgaccagccattaatagccttaagcttcatcagttccaacacgcatgacaacttgctgtgcttcgacttgcatccatcatacaacggcatctggcaatcttccaccaacttactaaacttctcataatctctgtcgttgtcctctgcgtcttcaatgtcatgcaacattgtagatagacattgagtgtccaaatctatggtctctccacctaaaggagaaggtacgaacatgccttctcgagctgcggcggtgttctgtacaccctgatccaacacttcttcagctgcgacatcaggcgcctcttgctctccatgcttggtccagcaggtatatttcttcatgaatccattcattatcaaatgagcatgcacttcatccttgtcttcgatcatctgttcattcttacagtccctacatgggcacaacatgtgcatgctcatcctactttttctgtcattatccgcaaatgtgacaaattcagtgaccccctctctatactcggtagacgaacgatgcgcatagtacatccatctacgatccatctgaaatcaacaacatacgaagaaaaataaatgatgatcgatatgttgagaatgaatggagaataatgtgttttttaccttgaattttagtaaaaaatcgccccccttgccctcccaaccgatttgtgaacagtacaatggtcgggatggaaagcagttggcagtttgggggtatttatagacccaacacacctcaaacgggttagataaaaaaagcccgtcaaaggtaatgctcatacctttgacgggc

SEQ ID NO: 58078 - DNA, 82055 bp, Oryza sativa
  unsure (1)..(82055): unsure at all n locations
aaattagtagaaattaattccccgtcctaaatagttttctcccttgtttctcttcttgtgctcctgtctatgccagatggtgcttactcgcagcaatgggaacggccccaacaacaacaacaacaatggagagaatcccacgcttgcccaagtcctggctcaacaggcacagctcatgaacatgatgatgcagcaactccagaaccagcaaaaccaggggaacaatcatgcacctccccagaacaagttagcagaatttcttcgtgtgaggccgcccactttttccagcactaccaatcccgttgaggctggtgattggctgcatgccatagaaaagaagttggacctgcttcagtgcaatgatcaagaaaaagtctcctttgcttcacatcagcttcatggccctgcctctgagtggtgggatcacttccgtctcaacaggaccactacggaaccaatcacttggcttgagttcactgctactttccggaagactcacataccctcgggagtggtgtctctcaagaagaaggagttcagggcactcactcagggatctcgctgtgtcactgaatatctgcatgaatttaatcgtctggcctgttatgctccagaggatgtacgtacagatgaagagcgtcaagagaagttcttggaaggactgaatgatgagctttcttacccactaatgactggggattattctgatttccagaagttggtggataaggccattcgccaggaggataagtacaaccgaatggaacagaagaaacgcaggattgctcacttcaaagctcagtaggggaatagtcagaggccgcgtcttgctatgggacctcaggcagtgtcacatggagggtcttcgtcagttgttcgtccgcagagtcagttctacaacaacaatgctggcaacaacaaccgcaaccaagctccacgtcctgttgcaactccagcccagcaccagcctgccaagagggagtaaggaaacaagccaggagtgtgctttaactgtggggaaccaggtcattattctgacaagtgtccgaagccccaacgcgtgaaggttgtccctgcacagaacaactccaccgcaccagcgtcaaaggctcgtgtcaatcatgttgctgctgcagaagcccaaggtgctcgagatgtgattttgggtacgttccctattaactcagttcctgcaacagtgctttttgattctggtgctacacattcatttttgtctatgatttttgcgtgaaatcatgggatggagatagaagatcttagatgtcctttgatggttagtaccccgagtaaccaagcactctcatcacaacgtagcccctctgtcagaatagagattcaaggagtaccatttctggctaaccttattctattagaatccaaagaccttgatgtcatcctagggatggactggttagcccgatataaaggtgtgatagactatgccaatagaaaagtaactctcaccagcaatgatggtcaagttgtaactgttcatgcattgccttctgagcctttaaggtcaagtctgaaccaagtaactttggaagagattcccatagtacgggactacccagatgtgttcccggatgatttacctggcatgtcgcctaaaagagatatagaattcagaatagatctggtaccaggaacaactccaatccataagagaccttatagaatggcagccaatgaattagcagaggtcaagaggcaagtagatgatttgcttcaaaaaggatacattagaccaagttcgtctccatggggagctccagtcatttttgtggagaagaaagaccatacccagaggatgtgtgtggattactgtgcactaaatgatgtgactatcaagaataagtacccactgcctagaattgatgatttgttcgatcaactcaaaggtgccaccgttttctccaagatcgatcttcgatcagggtatcatcagttaaggatcaaagaggaagatatacctaagacggcttttaccactcgatatgggttgtttgaatgtactgttatatcttttggacttaccaatgcccccgctttcttcatgaacttgatgaataaggtgtttatggaatacctggacaagttcgtggtggtctttattgatgacattcttatctactcttgaactaaagaagagcatgaagagcatcttcgccttgcactagagaagttacgagaacatcaattgtatgccaagtttagcaagtgtgaattttggttgtctaaagtaaagttccttggacacgtcatctcagccggaggagttgccgttgatccgagtaatgtggaatcagtaaccaactggaatcaaccgaagacagtctcagagattcgcagtttcctgtgtcttgcaagctattaccgaaggttcatagagaatttttccaagattgctaagcccatgacatgactgcttcagaaagatgtgaagtacaagtggtcagaagaatgcgagcagagttttcaagagttgaaaagtcgcttaatatcagcacccattttcattttgcctgatccaaagaagggtttccaagtgtattgcgatgcatctaagcttgggttaggttgtgttctgatgcaagatgggaaggtggttgcctatgcatctcgtcagttacgtccgcatgagaagaactaccctactcatgatcttgagttagccgcagtggttcatgcgttgaagatttggcgtcactacctctttggtactcgtacggaggtgtacacggattacaagagtttgaagtatatcttcacccagccagatctgaacatgaggcagcgaagatggttggaactgattaaggattatgacatgggaattcattatcacccaggaaaggctaatgttgtagcagatgctctcagcagaaaaggctattgcaatgctacggaaggacgacagttgccgtgggaattatgcaaggaatttgaaagattgaatttgggaattgtcagtagaggtttcgttgcaggattagaagcgaagcccactctcatcgaccaggttagagaagctcaaatcaatgatcctaatattcaagagattaagaagaacatgagaagaggaaaggctattgggtatttggaagatgagcaaggaaccgtatggttgggcgagagaatttgtgtcccagagaacaaggagttgaaagatgcaatcttgaaggaagctcatgacactttatactccattcaccctggtagtaccaagatgtaccaagatctcaaggagaaattttggtgggcaagtatgaagcgtgagatagcggagtatgtagctgtgtgtgatgtttgttagcgagtcaaggcagaacatcagaaacccgcaggtttgctgcaacctttgaaaataccagaatggaagtgggaggaaattgggatggatttcatcactggtctacccagaacgtcatcgggccatgactctatttgggtgatagtcgacagacttaccaaagtggctcatttcatcccggtgaggacaacatattccggaagccgtttggtggaattgtatatggcaaggattgtgtgtttgcatggtgttcctaagaaaatagtatccaatcgaggtagccaatttacttcaaagttttagaagaagcttcaggaagaggtgggttccaagctgaactttagtaccgcttatcatccacaaacagacggacaaactgaaagggtaaatcagattttggaagacatattgagagcttgtgctttagacttcggtggaagttgggataagaatctgccttacgcggaattctcatacaacaacagttatcaagctagtctccaaatggctccttatgaagcactgtatggtcggaagtgccgcactccgctgttgtgggatcaaacgggagaacgtcaggttttcgggaccgatatcctgagggaagcagaagagaaggtaaagatcattcaagaaagattgcgtatagctcagtctcgtcataagagttatgctgataatcgtcgtagggatttaagtttcgaggaaggagatcatgtgtaccttcatgtcacgcctcttcggggtgttcatcgttttcacaccaaaggaaaattggcaccgcgttttgtgggatcttataagattgtcagtagaagaggtgaggtctgtcagggttacgggttaggcataccctttacccttcgatatacgtcacatatcggtatggtatacccacgcgcatacggatacttcctgcatattctaaggaaatccttcacgaaatctatagattggaagaatcctactcggacaagactgggtcgttgacgtatcgtataaggtctgataccttcgagttctacttggaaacctccagacctgcgatataaaagggaccccccggggagcctgcaagggatcgaatctcagagccaacacaacccacacagcctacgaagccggagcctgcaaggagccaagccatcaagatctagtcgaaccaactcgactacgatctcgccggatccgacaagttccactgttccctttgtaacctgtgttttccactatataatcccacatcgactggattagggctattacctatcaaggggcctgaaccagtataattctcgtcttttgtttgcttaatgtcgtattacatagatccttgtaccaacgtaccccaataccctctatatccggtctacgggtaccactcgtcgacagtggcgcgccaggtagggggacttggtgctcaaggttctactattatgtcatccagcttcgtcgacaacagcgtcaacaccaacctcagccaagtactccctgcttcaacgatgctggtgtggactcaagtcagtgaaatcgtcttcctggtttacaccacaatgccgatctcaaccggtcccccaatgaccggacacgagaacacagtggctacaagccaaggcgactccatgtcgaaaaattgtcccgccgagacggagaatggagcatcgacaacatccgagctcgagaaggattctgatacggccaaacattgtccttccgacatgaaccgcgagctgacgaagatgacttccgaagccacaaggtcctggtgtcctatccacaaaaccaggaaacacactctgcaagcctgctgggttttcctcaacgtccgcgctgaaattcgcgcctgcaaagaacgtggaattcagcgtacttctccaactcgtgatgtctattgtcctattcacaagacaaagaatcacgacctctcaagctgcaaggtctttctcggcaccatgaaagctccgtctcctaaattatacgtccccatcagggataacggcatggaacaaggagcgactccaacttcagatcgattcgttggggtaatcgatatcgatcctcacgaaccattagtcttacaccttctcgaagactatgggtcatcgacaacgagcgcgccgcgggaggtattggccatcgatgacgttggcatgtcagcgcacgccaacgcagaagcggggaatcaatcgactactccagcccagcacattagggccgttcaagctatactgagggaaactccctacgatcccgttctgaacgatgacctcgagcgttggacagaacgactacgggaatcagtgaccaacctcagcaatgcattcgaagaagccgctaccgcagcgcacccggagcagccaccaattggcgatgccaatggtgaagacccggaacgaagggaatcacctcaacgagctacccctccacctcgcggcactggcgatctctgagatcaaatcaacagccaccgagaagcacgacgcacacgagacaatgtgaatcgttctcggcgtcatgtctcttcatggcgccatgataatggaaatcgaggagaccgctcaaacgaggaccgagaccaggacaaccaccacgatcacaacgatcgcgaacgacgggtgccagacaatattggtcgaggccgtcgccataacgacgatgatgacggagatcggcgccgagacaacagcgggagacgacgacaggattcccgagatccaggccgacatcctcgtaatcgtacgccggaaccaagcgacccattgtcatcgtcatcatccgcgtcctcctcatcgtcaggcagacatccacgaaggacacacgaccgccgacaacccaccgcccctaacgctgggtgtagggctttctgtcgtttcctgcgagatgtcctatggcctgagagattccgacctggagcaatagaaaagtactctacgctgttgaatgatgggagcaccgacccagaggagttccttcaagtctactccacagtactctacgctgccggagcagacgacaacgcgtttgcgaattatttaccaacagtgttgaaaggttctgcacgttcatggctgatgcatcttcctccctactcaatctcttcatgggcagacctgtggcagcagttcgtcgccaatttccaaggaacatacaagcaccacgcgatcaaagatgacctacacgcgttgacacagaactcgggtgaatcattgagggaatacgttcggcgcttcaacgagtgcagaaatacaatccccaaaatcactgatgcttctgtaattcgcgccttcaaatccggtgtcagagatcgctacactacctaggagttggcgacaagacgcatcacaactactcggagattgttcgagattgttgagcgatgcgcccatgcagatgatgcgctaagacgcaagaacgataagccgaagaccgggggagagaagaaaccagccacggacgcatctgagtcaagcaagaagaagaatcgcaaaaatgggaaaaggaaagctcaagcggaagtcctcgcagcagaatacgcgaaccctcccaagcgcccagacccacaaagtagcgacataaagaaagcatggtgccccatacacaagacgaacatacattctctggaagattgccctgttttcaaaaaatcgctcgagaaacacatcacatttgaaaaaggcaagcaagtacgcgtgatcgagaagaacgaggaggcggttcctcacgaatcggattcagcgtatccagactccgacctccacgtttcacacatcttcagcggttccacaacatactcctcaaagcggaaatacaagaaagtggaacgtgaagtctgttcgacatggcagggggctgcacccaagatgaagtggtctgaacagaggatagagttctcggaagaagatcaccccaagaccgccgtcatcccaggacgatatccgatcgtggtcgaacccactattcggaacatcaaggtagcgcgagtccttatcgacggtggcagctcaatcaatcttcttttcgccagcactttggacgcgatgggaattccgtaaagcgagttgacaccaaccgatcaacccttccacggaattactccccaatcatcgtccagaccattaggcaagattacgttgcccgtgactttcggccaagccaacaactttcgaacagagcagatcacctttgatgtagctgaattcgatacaacttacaacgccatcatcgggagaactgcacttgcgaagttcatggccgcatctcactacgcgtatcaagtgctcaagatgccgggaccgaagggaacaatcactattcaagggaacgcaaagctggaggtacagtgcgacaagcggagcctcgacatggtcgagcaaacgcccagcccacccgccacgactgagccacccaagaaagtgagcaagacaaacaagacgccgaaaccggacggcgccatcaagattgttccactctccagtgccaaccccaacaagaccgtcaaaatcggggcgacactaattgagaaataggaactcgcgctcatcaccttcctccgcgataatgccgacgtgttcgcttggcagccgtccgacatgccgggggtccccagggaggtgattgagcacaaactcatgatgcgacccgatgccaagccagtaaagcaaagactgcggagatttgcaccagaccgaaaacaagccatacgagaagagctcgacaaacttctcaaagccggcttcatcagagaagtacttcatccagagtggctagccaatccagtcatggtgcggaaggccaacggaaaatggagaatgtgcgtcgacttcaccgacctcaataaggcgtgccccaaggatcacttccctctccctcgaatagatcaactggtggattcaacagccggctgcgagctgttgagcttcctcgacgcttactctggctaccaccaaatcagcatggcaaaagaggatgaagagaagacaacattcatcacgccgttcggggtattttgctatgttaagatgtcgttcggactgataaccgcagggaataccttccagcgcatggtccagggcgcacttagggaccagctcggcaacaatgtcgaggcatacgtcgacgacatcgttgtcaaaaccaagacaggcgactcattgattgacgatctgcggcaaacgttcgacaacctccgacgatatcgcctcatgctcaatccagagaagtgcacgttcggagtaccgtcgggcaagctgctcggattccttgtttctggcagaggaatagaagcaaacctcgagaagatcaaggcaatcgagaacatgaagtcgcccacaagactcaaggaggtacaaaagctaaccagatgcatggcggcactgagcaggtttgtcgttaggatgggagaatgagcacaacctttcttcgctcttttgaagaaacaagacaaatttgtatagacacaggaagccgaagaggcattcgttgcactcaagcgctacctatcaaaccgccctgtacttgttgctccccaacctaatgaagaattattcctctatatcgctgccacgccatattccgttagcaccgtcattgttgtcgagagagagaaagtacaacgaccagtctattacgtcagcgaagctctccacgacgcaaagacaagatacccacagatccaaaagctgctttacgcggtcatcatgacatcaaggaagctacgccactactttcaagcccacagagtcacagtcgtctcctccttccctctcggcgaagttgtgagaaacaaagacgttgtcggctgcattgcgaaatgggtagtcgagctgagccagtttgatgtccactttgtgccacgaacagccatcaagtcccaggtactcgccgatttcattgccgattggactatgccagataacaaatcagacaaccaagtcgacaacgaaacatggacaatggcgttcgatggcgcactcaacagccaaggagcaggggcaggatttatcttgacatctccctctggagatcaattcaagcacgcaattcacctcaacttcagggcgaccaataacatagtagaatacgaaggactactcgccgggataagagctgcagctgcacttggggtcaagcgactaatcgtcaaaggggacttcgagctagtcgcgaaccaggtgcacaaagattataaatgctctaaccccgagttatccaagtatctcgcagaagtcagtaagctagagaaaatgtttgatgggatcgaggtccgacacatctaccgcaaggacaacatcgagcaagacgacctagcacgacgtgcgtccagacgagaaccgctcaagcccggcacttttctcgacatccggacgaagccatcagtgaaagaggttagcggcgaagttagcccggacacccccgacattagctcggaggtcaccaaggcagaacgcgccgttgccgatatcgagaccacagacaactggcacatcccactaatcaaattcatcaacagcgaggagttgccagaggacgatatagaggctgagaaaataacccgtaaagcaaagatctactgtatggtcggcaatgatctatacaagaaagcgtcaaacggggtacttctcaaatgtgtctcgtccgacgacggcaaacacctcctcctcgatatacatgaaggcatttgtgtgtcacacgccgccggctggacattggtcgggaaagcttttcgacaaggttttttctggccaaccgcccttaaagatgcatgcgacatggtccagcaatgtgaagcctgtcaattccacaataaacacacaaagctacccgcgcaagcgctccagactatccctctgacttggccgttctcgtgctgggggctcgatatacttgggccattcccacgaggatagggcggctacagattcctattcgtggcgatcgacaagttcaccaaatggatcgaagcagtacccacgggggaaatcaaggccgacaacgccatcaaattcatcaaagggatattttgcagatacgggctaccgcaccgcatcataactgacaacggctcccagttcatcagcgccgatttccaggattactgcatcgggctgggggtcaaaatatgcttcgcctcggactctcaccctcaaagcaacagacaagtcgagagggcaaacagcatagtactacaagggataaaaacccgcgtctacgacagactcatgtcacacgacaaaaaatgggttgaagaactcccatcagtactatgggccgtacgcaccacaccgacaacgtctaacaaggaaacacccttctttctcgtgtatggctctgaggctatgctccccgacgagctacgacatcagagtacacgagtacagaagcactccgacgaggaccaggaggaacagtgggacatcgatgtaaatcttctcgaggagcatcgtgaacgagttgccatttgagcagccagctatcaacaggcactccgccgttaccacgagaagcgcatccgagcacgcatactttcgatcagtgactatgtcctccgacgggttcaaagccaagtagggcggaacaagctctcacccaaatggtaaggaccctacacgatcacacaagtcttacgtccaggcgcattcaaaattgcagacggcgaaggtcgcgagttagcaaattcttggaatattgaccaactacgtaaattctatgtatgactcaatgccatccgtacctgtaagacaccttacagtatcaataaagcctagtcttaggcccatgtcacaatcaaagtgtttttgcccaatgatcccttaccctaatgacacctagcgttgaaacatgtcctcatgtccctttacgccgtcttgacaaggcctccgaggaacctaagggatcttcggctggggacacccagagccgataaggccttgtcagatcctgtagagatgaaagaccatgtaagatctggtcgtgtaagagttctcgccgtgcgtattaaccaagccgtgaaatcagaaatcaactttccaacttcatggctggggactaggatcagagcttattcaaccaaggcgggtcaaaggtccaagagccttatcctccgagaaaattcctccgacgacaaggctaggggctagggagagtgtacgactcaaacggctgactaaagtcgtgaactgagaacgcactcttacacacgacatccagagtaagaaacatctgttaaagatagatttcttttctatttcacaaaatacttcttacagttttttacacaaatctttcgctacattatacctttttcctaagatatctgtcacagggtacgaatactaccaagaaggccaacgccagtccatagactggaagatcttctcggccaatggcaacatcgacctcgccagatggtctatctccgccggagtcctccgagaacgagcaaaaccctcatggagaaagtcgaggtccaagcgcggacgatgatctcgtaggcaagccagcacgtgtcctccggcgtatcggctcgatcgacgacactcctgcttcaaggcctcgtcgatacgcttgccgatgccatcgagttgggcacaggccccgttcagccatgagatgtatccggccaccgactcctcgggatctccgcgaaccattcgaagttctctacagaccctggccatggatgtgcagcaactcttcaagtacgagttaaaccacacctcacgacctcggagcgtttccacagcctgctctttcttcactgccagcatggttctctcgagttccgctacttcaaacttcgtcttccagtattggatacgacgatcttgaccaacaagggcaccctcgagatctgcttaatgtgataacgactaagtcaagctgtacacctctttcgagtacacagttgatctagccgggagggcatcaaggggtgaatggactactaacctgaggaaatcgtcgtcatccctgtctccataacaagggtctggtccacattgtcgggcgacacgtgtggttcaaactcgagaatcggaattatcaccagtgactcgggctgcccgcgctgctagacatcctcgttatcagcatctctacaaaggacaaaagctcccgaggtcaacacacaaaagtaaactagaatgataattgcacgcgcgaaggcggtcagaactcaagttttacacagcatgtcttggaagtacaagaagtcctactcttcaaataggggagaacagactcccctagatcgccgactccttccatcacctccttacgcgtgtcgctggccgccccctgatctaagatctcgcgcagatcgagttcaggatgcgacagctttacacacgcgaggacatgacacgcctcggtgtagatcccgttcgacgtctcctccgcaatcctggcggcatgcttggaagggatttcccccatcgccgtcaccagttccgcaagggaggaggtcagcgagaactcgtcaggattcaccgggatggtagacttgagctgcactccccggcgaactggtgcaggccagtgtaggtgacccgcaacgaaccccggatttccgacaggttgttcccgagttccgacatgcggtcctcgagccccttccattgtcgctcattgccggccaccaattccctcatcttcatgaggtcttcatgggcttcagccaactcgcgcaccagtcagtcagcacgcgcgttcgccagcgctgcttccgacctcgcctctgcaatctcgcggctgatgccgcgagcaccagcttcgaggaggcgccccatcttgacttggagctcctcctaggtgaggacggcaactggtggatcatgacctgccgcgggatcgctgactgggccgctaggcgtcgcctcccggctcccagctgcaggcacgacatccgtcgaggccgcggcaagcgacacgctggaagtccctccggacctggcttgcacagcctttgctcgcgtctccctacgggacgaccacgggtcagacaacgcttgaatggaatcacggaaacctaaaaattcatctacttacttttcgccaaccgtcacaagacgttgtcgtcgtggaggcgggggagacgcgtccaaggcctgaaagacaaccaatgtgaagtaaggcaaaatccttctggctgcgcgatcttgcgacaggataacttaccgagggggtcgacgccttgcgacgatgtccgcttacagaggagaacttcctcccctttgtcggaacattgccaccactagtagtggcagcagcagcatcagacgcctcctttgcgaccttctctttcagggacgccgccacctgatggtccgcgagcggcccgatgatgtcagtcagaggaagagcctacgcttaatcaagtcataaggtgatctcgaaggaaaaatgcgcgatgcttatcggatgcacttacgttgatagcatcatcacgttcggccgcccccttttcacaaaggggcgtggggatgttgctcgccattgtcagaccgctgatcatcacctggccaacacggcgctccacggcttcgctattcagacctgtgaatcgagaaccaaatttcaatgagtcaataagaacgcgaacataagcatgtcaggataaatgcgagaaagatacctcgaggagaaacccgggtcgcgtcctccggtccagaatagttataagcgggatgggcctgagcctggagcggctggattcgcctaccaacgaagtctgcaacgacttcataccctgacaagcctcgtactcggagatcatcgatgatgttgataaacgactgaaggggggctttgcggtccaagacgaaatcttgtccggttgttctttgggaacaacgaagacagggttcgaatctttgatctcaaggtagaaccacctattccgccatttgctgcgagaagatgggcactggaaggagatataacgcgacttcaggccatcccgaagtcggaacccgacgcaaccagctaccctgttggactccatccaacgcagttcatagtaagagcgaaagagatcaagaaaaggctctaccccaatgtaggcctcacaaagatgcgcaaagatgctaagaaaggcgatagaagttcaaaaccaggagaagaaactcggaaggcggaggaagaaaaccgtagagaacataatcttcgatcgtaaccatgtgacccaagatgggctagggattagtacctcctacttccctctccatggttccacggccaggaagggcaccgtcttcctgacgcttcttcagcgacgcactggtggaagatgatttgccgaggtccattgctgatcgaagatcgccggagaaagggcttaggttgatgaactggggtttcttgtgccggcgaagaaggcgaagatcgctcacaggtggaatgttttcaacacggttggcggacttcaaaatggatccccaaaatttctttaaataggcgcactaccgacggtgcgaattccaaggaacagagagagatgcccgccagaaatttctgggtccgttacgcgcggcggttttttggacttcagtttaaaattcgctcgtgaccgttgggcttcaaatggcgtgctcgactacggcctgtctctgcggtcctcgcaccgggaacgacaacagtttcgacacccgaagtcgtgaatggttacacgagctcattttaagcggaagtcgggggctactgtcagggttacgggttaggcataccctttacccttcgatatacgtcacatatcggtatggtatacccacgcgcatacggatacttcctgcatattctaaggaaatccttcacgaaatctacagatgggaagaatcctactcggacaagactgggtcgttggcgtatcgtatagggtctgatacctccgagttctacttggaaacctccagacctgcgatataaaagggaccccccggggagcctgcaagggatcgaatctcagagccaacacaacccacacagcctacgaagccatcaagatctagtcgaaccaactcgactacaatctcgccggatccgacaagttccactgttccctttgtaaccaatgttttccactatataatcccacatcgactggattagggctattacctatcaaggggcctgaaccagtataattctcgtcttttgtttgcttgatgtcgtactacgtagatccttgtaccaacgtaccccaataccctctatatccggtctacgggtaccactcgtcaacaaggtcgcctatcagttggagttacctcaatccttggcaggtgtccataatgtgtttcatgtgtcacagttaaagaaatgtttaagggtacccactgaagaagctaatcttgaacagatagaaatccaagtggatctgacatatgttgagaaaccaatccgtatcttggagacagatgagagaaggaccaggaatcgagttatctgtttctgtaaggtccaatggagtaatcactcggaagaagaagctacttgggagcgagaagatgaattaaagtcagctcatccgcatcttttcgccagctcttccgaatctcggggatgagattctgtttaaggggggtaggtttgtcacaccctgaaaatactaaatttataaattgttgtttaaatggaattattagaaatgattttaaaagccgagaagaaaagatctaattttaaataataaattccaatataaaagtgggccagataaaattttattaaatacttcacttgattctatagttcttagatttttctgggatttatttgagccaaggaagtatttttaataaatagaattgcatttcatgaataagttaaaaagaaaaaggttttaaaaatcctcttttggctttgggccgaaagtcggcccaaaacctctctctctccccggcccaagcgcgccccggcctagtcagcccgccgagccgagccgccgctctccccctctctctcccgctgacaggtggggcccacctgtcagggtcgtcgtccacctcgcgccaccgcagccgcgccctagccgcgcaagccaccgccgcccccttccaaaatttgcccgcccctttcccgatccgatcaaatcaatagaggggaaatgatccccaggatcccctcttccttttctcttttggaatcgtcggctaatttcgtttggaaataggtggatttgagttcgattcggatcgatctctctcctctaaccctaaactttccattcccgtcgccggtcgccgtgggcctccatcgccgccccctagcccctataaaagtaccccgggacctcctccgtccgccgccaccctcgctttagctcgccgctgcttgtagcgccgcctccgcgacaatccgtgcgccgccgtcgccgctgcgagtccagccgtgcgccgccgccgccgcttcggtcgtcgtcgtcgctcgggaaggccgccgtcgggatcgccaagtcatcaccgtccccgtcccgtccttcgtttccgtcgaagaccgccggagcaccgccgtcgtcgtcgacccgaatgcctccgccgcttcgacctcgtcgccgtcgtcgtccgttgccgtctgccttcgtccgagccctcgatgagtttgccgcgtcgccctctacacgtaggtgctctccgtttgcgccgccgcgccgccgttcgccggcgagcgtgagttgctgagccgccgctggtgatgacgtcatcgctgacatcagcgccgcgtcacccgtagacccgcggtagatcgattcgatctcggccgttcgttttggataagattagatctcgaccgtccgttccgtagaccgtccccgtgcacccgatccaccgtaaacccgagcccgctgacgcaataaatcatttttctttttcaaaaaaaattctttattgcgtcataattcaattaaaatctatataaatgatttaatccgatttaatctttaaaaattcataactaattcatcttagctcgaatttagttggttcaagtctctaaatttttctaaaattgagatctacatgttaaaaatatccacatgtactgttcatgattgtttatatgctgttttggtgattttgctcttttatgcctagattccgacgttcctggagagtccgaatttgcaggagaagattttgaagagttccaaggccagcaaggcaagttacacagatcccaaacaaccctttgagcatgttgattccatttaaagctattgtttctattcaactattgcatttatttttgaatgtcattgggtgggaataacctattgcctttgttatagccctttgttattgattacctattctttgtcacctggttaataatttgattagctagaacattatatggttttagctaaagtaattaggatgcttagccatacttagagacactagctcatatgaatgggatgattaataattcactattacttaatgatggcttaatgatagctcatgatggttaatcatgataggttgattaattaagatgccaactaaaacttgataatggtgggttgtgagcacatggttttgatggtcgtgctcatgacagttaaggaccggttcacgattttcggttatgaaacattaaccgtgccaaccacaagccagcgtgggcaacgactttactttttgtatagtatggttcattgtagagcaccagactgtgaagtggcggagataagcccacgggggtcgctggggagtccatgccttgtttgtaagggggtgattatgatccagaaacggtgcactgctttgaattgtgttatgcgaagggtattgtcacaatctctattcgggtacttgttaagtatcgcgacgcatggttgacatgatgttgaggttgtgtcttgtaggtacagtggtacacctctagccagagtaaaactattcgaatagtcgtgcccgcggttatgggcaggtctaacaatgtctttcgtgattagtctcatatttcacaccataataaatgatgatgaaaataatttgtttagctcctggtttggaatggtatattcctggtttggagttagaactgtgcaaccgggattggttgttcataatggttgggcctatgcaacgggtgtgttgtatagcgttggattaatattgtttaattaaatactttacagttttattaaattctaaagtattcattaaatgccatttatgcaaatgagactatattattccatcctttgttatcccttgcatttgtatattttctgcgtggcttgttgagtatgtcatatactcaccttgcaatcattcatcagaggaggatttctacagtcatgccgaaggtgtggaggattaggcgtagccctggtcaagctgcttgtgggatggagtcgcctgcgctgtttattttattttccgctgcttagaactttattgtttgagatgaactatctacctctgtaatgactttatattcgcttattaattagaatattaattgcactctattatcgatttgttattgtgtgcctcggctgattcctagacgagggtctacacacatgtaagcgtttggaattttggatagaaattccgggcgtgataagatggcgctcctccatcttcaacgacagtcgccgaaggctctgctccctcttcggcggccatatccgccccggtgtcgctttcctttcgccttataaccttctcctttacgactttcttcggtggcattcgctcttagtggtttcgttcgaagatccccacgatcggcgccagctgttgtcgaaacgacaactgcatatgtcgaaagacgtggttacttaacagtgattggaaaaaggtaaagtgtattgattagagaatttctcttgggatccccccattacatggccctatgagactatttatagcccctattacaggttcttactactagggttttggttatacaggggaatttacatggttacccttatgaaagggacatttacaagggtacatagtgtaatagaggttcatggaatcctgatgggccgttaggcgattgtcggcccaatggcccctaggcttgatgggccggaaaaggcttcttcggccctcgcgggggcgagcttgctttggcgaagtcgtctcccttcggcatatactcttcgccctgtatccttcgctcaagaggcctccggcttggcagagtacccgcacgatccttcgcctctcgcccgtgtccttgttccatagtcttcgccttgggggggaggggggcttcgccccaactaactttgacgtctcgggcttggatccccattcctcgcatagctttcggcagattttggtcgaagtgcctcgtaccataccgccaacaatacatatatatactcttctaatcaagtgatcaaatgagcctaatccaactatctaaaatctgtgtgatttggacccaaaaatctgtcgtgtgatgaatagctagtcccagtttgtagaaaaaaatagtaacattttcaattcaagacatattaattataaaatatatattcaattattgatatgatgaagctaatttagtattataaatattattatatttgtttataaacttagttaaatttgaaacagtttgactttgaccaaagtcaaaacgttttataacgtaaaacggagggagtaatattaattattattattacaaacttaattcttatttgatttgtttaataaaattctatatacaaaatattattttaaccaaagcaccatttagtgttttggaaagcctgctcatgaagaatgagaaagttgttgttctaacaagctaaaactaacggagcctaagtccactccgacggtaataaacctccgttatttcataggtggcgctgctaactttcggtataatgtttaatcattcatcttattaaaaaaatcagtgtagatatgaaatactccctccgttcctaaatatttgacgccgttgatttttttaaacatatttgatcgttcatcttattcaaaaaatttaagtaattattaattattttcctatcatttgattcattgttaaatatatttttatgtatacatatagttttacatatttcacaaaagtttttgaatatgacttacagtaaaatatgtgctaaaaagttaacggtgtcaaatatttagaaacagagggagtataattcatatttaaagttttttaatggtaaaacatgtcataacaaaataaatagtatttatataaattttttgaacatgataaatggtcaaacatcatcttaaaagtcaacaatatttaaaaaccaaagaaatggtgaaatgtcatctattaaaaatcaaagagtacgatatttgacttgcactccgaaccaccgtctaaaataactcaattactaaattgtttttcaatttaaggtttgttggtttcggagccaactttcgcctgccaatataaaatttgtgctattataggaaaaaattggtagcataccaaatacttacgtgatactattaagttatcaatatttttgtagggcacaagttatcttcaatccaaataagcccttaacttaaactgagaaacctattaatcgaatgtgtgaggaaactacaaatgacaccgaatatactaaaagagatgaggtcgtcgatatcatatatgtggtgatagtcacatgttttacgtgcgtgcgatgtacgaaaacctatcattgcgcgctacacattcatttattatgtaattaccaataccagtactatataattattgattgaaatttttaattattaataccagtttcattatgtcctaaattattggcctaatttgtttttcctttttcattcttctctcctcttctctgtctctctactattataaaaatttaaatttaagatgtttttgccactaatttgagccgtcgcctctttcatcagcttcatccgattccccattttcgaacgcgatgcttccatcgcttcgcagtcggataagatttatgagtaaaactaacaagctattaacaaatttaactggcacggtttgtgggcagcaacgataagagcccagggcccaagacacagctagggatgcggtcgggcacgacgggcacgggtagttacccatgtctgtgcccgcgagataattcatgcccgcggacatgcccgttacaacatgacggacatttctccacatgcagagacagtcaacaatacaaacattataagttcaacaataagacaacttcaaatgtcatactttagcacaattacacaatcaacaaacttcaattacacaagtttcctcttcttcctattcagcttgttttgcagttggggatgcatctacagaagcctgtgaggcttgctcacgccggttgctgctgaccggtggagtagcacactggctgctactggccgaagtagccattggttcaaatcactaccaatcaaatcggaaataacagatcaatgtcagtaggtactagatcgaaaaaataaataactagatctagagtacgggagaaggggataccttgctcagcgcaggggaggacgttgccggccggaggggagctcggcggctcggcacagaggaggcagtggcgaccggaggtgggaggcgcgactggagggaggcgcggttggagacgttgatgaccggccggaggggagctcgcgcagacgggtaggaggcgaggcgacaacggctagagggtggagccgccggcgacgacctcccgtggcgcccctcccagcggcgacctgacctcccgcgcggacctcccgtggtgcctatggcacccctcccggcggtgacctcccatggcacggtggcgcccctcccatgtccgcctagagcccctcccggcggcgacctcccgcgtcagcttggcggctgtggaggagaaaagtcgaagagaaggagatgcggcggctatgaagggaagagaagaaaattctagggtttttagatgttggtttttatactaagttgattgagggccacatgtcagttgatgttcgcgggtaaatgggcgaagcgggcccgtgtgcccgtttgttacaagttttaacccaataagaaacctatgagtactaaatagagaacaaacccaactctattagggtttttatccacaggtaaacgggcaaacaggtcaaattgctatccctagacacagcccacgaagtcatttgcacggcccaccatttgctacgtgtgcaggttatacagagacaataacacatggtgtgcagttatacgtggaattcaaagtatttcttttaccaaattttcactttttccctactaatctttacctttatttaaaaatttagaaaaatatcattatctattaaaaaatcgaaatgtttatgtctgcttgtctgtttcatctatcgctaccggtgcggtgcgagataggattggatcactcccgcgccgccacgcgtgtgtccatctcatatcacacatacgataatgagtctatcgtgcgcctgtctccatgccagcaagagaaaatagaaccccgagctacgcatatgcataacgcccctgatagttcgaccaccaccatccaggcatccactgtgagtagtgtgtgtacatcgcacatatgataatcacatattcacgtcgggcaactgaaagagaataagtacatacataaatctcacatcaacagccatgattttttttctcttttaatgaaaggcattagtcttgctgttatggaaatcaagggtcaattcactctatggaccaaacttatggtagatgtcatacaaactagaccgcatgacttcacccgttgtaatgcacggacatttctctctagtttgataaaaaaaatgtcagatttagccatcaacgcttgcatctaagctatagtaactagatcatgtgctcgaactctccagctatcgtaatatatattagtagtactagaaaataagcatggcgaagccgattggggcactctctagttaacctgtgcatactataattttactctccatttcaaatatagtaacttctagcgtgaaatttttgttctagaatatagcaacttcttaacacactctctagcctctctctttaaaaccaacaggagcactagtatttcattgagagaggagaaaaaaacaccattcttcttgggtttaggtgaaacaaagcgggttcacagatatttacatcagggacctcgtcttaagcattggggaggctatccaggaagaaattttaagtttttgaaacaccgtatatatgtaacttttacttatatgtgatcccctaacttccgctgagcaacgccctcctagcttgattaggtagaaaacatcatcggcgctgaaatcttcattgattacaccaaacgttggagatccctttctaccaaacgttgattacactgataattacatgtcatgttaaggtggaggttatttgtccatgttgcaattgttgcatacatctttgtagctgaagtgtagtttttttagaggagtagttgaaagatgaggcatgtggtcgtttcctcatgatgatcgtgaaacaggtaggtaacgttgtgtggccatacgttaattgaatggcgtgctaggttgtcagcggttaacctactggctaatttgaaccaatcataacatctttcatttaatttatacacgtattttctcatctcaaccgatcataacaattgtatgtaatttcatccctctctttagttcccatgaaaagttgagtataattttgaggaataaatcaaagatgttagtataataagattttctttaatttcgcataatattgtttaactttaacatacgaatagatagattttgctctcgataaggtttgctcggctctgttggtgtcccatggtgtgatacgtctttgtttctttttccttatttacatctaggtgtgccatttaccgtttcatcaggttgctcatagcttgttctttcttttttttctccatctgatctaggctctaccatcatgtgtagatgccggtttgtttgttagttggaacttaccgctccctgtgcttctctttgattggctgacgcagtggttagcttagtaaatgaggatgagttactgccttcgtgtgatgtagcaaatagtagtaccaatggagtatcaatcttctctatctttccactggtcgctgtttcaggctgccgtcggaaagcaaaattctttggcatatcagccaaacttcgcattttcatttcagccaaagaatttccattgattggcgtatttcttgatgttggatcttctgtggcttaatggttgcagctctcaattgatagtagcattcatatatgatgggtttagggattagcaaaaaaaaaatctcaattgatgtaagttgtggaagtaaattactatcataattaatttgtagcaatatatatttagtaagccatataatctctcagttgctacatgtagtcgtcatcctcctcagggttgggttcctcatcatcatcctatggtgagtgaacatacatctcgtcaaactccttgtcgttgatgtccggattgtcgtacaccgtatccaacacaaaattatgtagggcaaagcatgctgtaattttttttgtttgccacttcgtgttatatgagggtatgcctcttaaaatcttccacttggttttctaagcatgtagataattaaaattctcttgcaagagttccggattgcagccacgaaaatccggcacatggtaccattcacccctatatggagccatatatcgtggagccaaggcatatccagtatcaaccaagtagtacttatctgcacaacaagacatatatttcagaaactcggccaattgtaactgtattaaaaaacacttgcacatactgtgaggtgggtgaggaaacaaatcagatttgtctcctctcacgacgcggttgaagacagccatgtcatggcatcttcccttcatcccagcggcaacaaaagtgaagcgcatgtcaaagtcacatacgaccattacgttttgactagtgtatccatgcctacacatgtaggtcatgcactcctcttgtggaatgatgactgggatatgggttccatcaataactccaatgcaattgatgaactgtggggaaaacctagattgcaacaaccttccatgcacaccacgaaaagcaggatcacgtggttggatgatatcattggaaaattggagcatcactttcaaaatatccctaaatttccgatgcacggtgtctggtgacctttgaaaacgcttgcaaatctggctttgcgataagtcgaaatttctttttaggtttgtgaagttgctttgccatcaatctttcatttgtgatatgtgcaaatctctttttatattttcccacccttgtcgattcatatattgaccctccatgttcatctgagccttttcatgaaggcatcgatcaaggaatgccttggtcattcgtcgagtccaattggcgcggtcgtggctcatctgcataggctgaagtaagtggaaaggtagcatgtgcagtgggttgtctactctcaattatacatagtacatatcgaattattgggttaatgtattagttaagtgaccacatcatttctttcgaatgaaagtagtgaatacataaataatatgtgttcacacatacctaccttgccgtgttgcaaatgagcaactgtggagtgcaaagcgtatcgtcgttggtttatcctagagcacgatgaggaagatgatgttagagatgtgcgcgggcgttatttttattttgtagtacctatttggcatgtaattcatcatgttgagcgtgggaactgagaagtactaaaaagaaaataatcattcggcaaatcatgcatgtcattttctttcttttccatcctgaccaagaagtaatataatcagattaagatgtctcaagagacatgcaataacttaacttatgcatccatctcttggaactatctcaatttgttgtatgtggccttccagtagtttctcatcatcatatccaaagatcgtgtagattttgccatttgcacaaaactatgcatgttgaattgtagttgtggccactaattgtactccttccatcccaaaatataaaactacgtatgttgcattgtagccgtggccactaattgtactccctcaattccaaaatataaggtacaaccgaccaagaaataattgttggttgtgccttatatttttggtatggagggagtagtacttaattcatttaggaatcatcctttccatcatatttatatgctgccattacttatgtcatctactcttaaagcaaaaggtgtttgcttcactccacatacgtccataattagtagactatacacactgacacactgatgattcaaaagaataatgtttcaattcgcctaatttgtggagccctattagatcagatgcatattatgatcatcatcaattactcatacattcatgctaatgattatcatcaattactaatacattcatgctaatactttgaagtattctgcgtgttgtattaaattacttatcatttttattttttaggagctgataaggagtatgtcgtggcacaggggttgagtcgccagggggagcttatcaatgggttaaatgccaaagttgtagccgtgctcacgaagattgcaaagatccgcagagagattttggtccgaacactgagccacgggtggtaaaaccgcaaagcttagaaaatagcttcggtcttactatgtggtttcatatggtgtcgtgaagcctaaatataaaacaactttggtcttggaccgtcaataatgattttttcttagaatttggatacttaatcgacctgcttacttctattatgttaatactaattactattgtaggaatcctggttcttatttatattgatgattatatgtctcacgatgagggatatttaagattttttttatttatataagttttttcaatacttccatgttgctattggttatacaaatttatttttttagagcttgtggaatgtgttcctatttattgatatgcttttggtttacacgaccaattgcaacgagtgcttgtcaaaacaaaactttggtaactaatcgtcctatcgatgagctttccaactactagcagatgcgaatgataagagggacattatagtgccaaatccttatgtattatttactacggaattatatgccattatctgatcattagaattaaagtaatataaacttccaaatactgtcatatactttgatatctttacttgatgaaactacagatgaagctgtttttgtaaggtcaagtatatgatgctaatgaaccatgttagaaactgccaatgaagttcattcgatggtgatgaacgttgttggtatttcttacgttcataaataaaatccacaagtgcacggatataccgctgtaacacttcacccagaagtattccaatatataaaattttcactgggaatgtgtgtgtttagctcttctttaggtttatcaaggatacaagatataaatgtaggccaaagggtagagatgatattctaatgtggtacagtgttgtttggaaggcttaactttaattttatcgctatgcttcaggcactgctcactactaccagaatgcgctctactctgtacccgacatggaggactacaatgatttcgagggctgtcaccacctctacactaacctctaacgtacggtgggatacgtagccaacaatagtaattaactatctagacaccatgtctatgcaattaattactactctagcgttagctaaacactaaagtaatcactttttcttaatgaacgatagtgaacaatgatccgcgttagctaaacactaaaataatcactatttcttaatgaacaatagtgaacaatgatccagcaagctaaataggacctaacttaggccctatttgtttcagcttaagattattgagccatattactataagctggattataatagccgacatagtataagttgttagctgtttgtttatctggatgataagttatttgttagctgttagccctcaataatataaaaaaagcacctttagagtggattattagattatagtaatatggcttatagattgtaataatctatcatgataagctatctgtttatttcagcttactcctaataatacagattataataatcctaacctgaatcaaacagggccttaagaataccacacaagataaatctcaatgacttgattaaaatattctcaactagagcaaagcaattgctaaggtacaaaagaacaattctggaactcctccaactctttctttctcactctctcccttagtctaagtataaataaaagaatacaaagagccttataattcagctcacatattggtgtgttgtgaatgagggaagagaggggtattttataggccaagagacgccttgggagtatgtagatcctaagcatctaaagagcatcttcactcttgagctgccaagtgtccctccatgagctgccaagttcccctccatggcggtttattccgatagaaatgatcacaatcgccttggatagtcggtaactaccgacatgtgaaaatcgagggctagatgggctgttcctgagttggccgacccctggttggcccttctggcccttggttttcttttgggccctagtaggtactttagtatttctgtggagttggcccatttaattatgatcttgttgggcttgttggctcaaaactctatgagcttggatatggaagtaatatttccgtccctcatgtatagttcatctcaactttggtagtttatcacctgcatacaaatatacaccgacactagtggaatttgttagaaataaaccttaccactatgttggatgttttatattttcagatttatgcaggtattgacggcgtaaatttcgtatttaacagccatcaacaaacgcgttcaatcctttgaagtacttatatatggttgattatggggggcacgatagccggttgcctcatagtaggccttttgggccgcaccgtacagggtgggcaaagcgccccaggcccgtgtggttagtttgtatttgaggaaagtaatattagataagggaatcaattttgtcccttgtaattagattaccatcggaccgccgaccgccctagctctatatagggggtgccagcataaaccctaaggggttaggacttttgcatcttttctccacatacgtgccgtcggctactccattgctgacccgcgcacttggacacagatccaatacatctcaactggacatagggtattacctctcgacaagggcctaaaccttagcaggtgagtcccgacgtcatctgctgacgtcgtcgggactcacctgaacgcatctcgggccgacgtcaccagatgcgttcaagcactacgtttccccgccgaccgagttccgctccggatatctcgacttcatcaccaacaaggccggcgtcctcaagctcgcatctccttcagctacaaaccaccggccatggcctctccagtgccgatcggcatccccaacttcgccgccctcaccattagaattaccgtactaccagtggcaaaagaacggcaaaaaaaaaaatgccaaaccaagaatgtatctaaccaaatgttaactcaaaaagttgattaggcaccacacaacaacgccgtttcaaaatgcaccacacaacaacgccgcttcaaaatgtcggtcatatttgtgacatggcagagagaacacggaaatgtaaaacctgaacaatcgataattattcaatggcgtacagccaagtgcaaagaagtataacattcacaaggcacttatagttttaatttgcctttcaagggtttttacagttaagcgaggacatctacaaccaccgcttagaatttcaactctaaggtatttttcagtagcaaccacagatctaatcatctttcaagctaaacatatccctctgtttctttataaaaaaagaaaggtgaacatatctgtacaaaaattcgttggcaccagttttacaactggaagcaagtgtgaaatgattactgcagcaaaagtaaccggcccgtttcaatatgaactccatgccgctcaaggttgacatcaatagtaaacagagatctgtgagttaacctgatggttcatgactgcatgcatgtgttcataactaaaatgcagcaatagtatctactacttcctaagtatttaaaatcatagaccaagaaaccacgctgctcatcatttccccaaaaaacctgtgccgtgatatacctgcaaaaaaagtatatatcttagtagagagtagtactccaagcatagaccaaagttcaatcacttatcagataccgcaataaaaatgaacatgcatctcaagttcttaacaaatcaatatatagaagctcatagatgagttgatcttcgtcttaaaaatatataaacaaattgattgtgatagtccaaaatgaattgcaaagagttataaaagtagcatcgagtttcctgcaccaagtcacaatagttctaccaaaaaaatatatatatgtattgaggaaagatgggcaatctatacatatttcatcattagggagcaatttcagctcctatacaatgtactctttgctctattattttactaagtgttgaaacaccatgtaataaaggaaatttatccataaaagaacaaaaggcttaccttcaatacaagccctaagtagcctaatgaaaacaatgatagtacacataaaagcaatcagaataaacataataaagtttctgaataataattccactgtatttttctttaaaaaaatgatgctttctcatgtcatcacatattccaaagctttgagcataaatatgttttaaataaccaaagtcttatatgtgaaagcaatactgctaaattgttcactaaaaatacttcatgaaaccttttttttttctgtaaatataaccaaaggttgatatgtgaaagcaacactgctaaattggtcactagaaaagtacttcatgtgacagccttctttaaattctacaaaaagaaaacatcaaagtaacatattccgtagagcatcaaaggcatcaaactaaatggaaccaagggagtacctgcaaaggaagagcgaaactcttctactaacaaaagaagaggccaaaccatttatgctacagaaaggctccgcagtttgtcacagtgaggtgtagggtagtccttggcccattggcgcctttggagttccacatgacagaatcttcccagcatgctcttgtagtctttaaaaacatactgctcaagattatctctagaagaacttcctcgtggaaactgctggtcgaattcttgtttgctgacaaagtactccaccccatgcttttcagtgacttttgatatagaaaagtagcttgtccttttaagggaatactcaggatgccttgctggaatgaaagcaaacaagatgaaaaacaaaacccctgcaaggtgcaccaacattgttaaatttatgcctgacccaccctgaaccggatgttcccgtctctgttgttgctgttgcctcactgttcctcttgctctgtaggcattgtgagactggaacatattatcatgggtcccataaaagaacgacctgaatatctcatctggatctaagtcttcttcataaccatagaagctacttcttgcttgcctttgtcgccttgtagttctctgcctcatgacattggaatactgataattaaactcatggtcctcaatggcacctgtttgatcataagttctccttgactgatcattgcttaggcacttgaaagccttgctgaccaacttaaatgcatcctctgccccaggagccttgttcttgtcaggatgaactttcagtgacaacttcctgtaggctttccttatctcttctacagagcaacttctctccactccaagaattgcataataatccttgttctttgtgatgttccgaaccactctaacattttcctcagtgtaacccttatcaacattagaaggaccaacagattctttacgcaaattttggctttcaccaacttcaccacttctagccctgtattggcgtacagcaccatccagggtatcatacttcttgggtgtgcccagcatatcatcaatcggaaggctggggtccaatctttgggcaattcgaaggaatttttctgctcgctgtctatctccagatgcaagtgcagtttctgcaagtttgacagacctcaaggcctcatctttgtttccatccatgcccttagtcagcctttttacaactggatcatatataggtaggacacccaaattgaaaaacttttgaacaaggacagattttcttcacctatgaagcagatatcattcaaaatcaatcgaaattggacttgatgccataatacaaatagccgagtaactctaattcgatagcatcttgtacttgcagtgacacaaaaatgatatctaatcagaaggtagatcaacccgagaaattagggtgtataaacaagtggtataactaagagtacaaaaactaaaccaacaaacttaggaatctctggtaaagcagaaaaatagccaaaattttgtgaacaaaagataacctaaatgaaacagattgccacaatgcatagtatggaactaccagagtacaacagaatgctttggttggataaaccaactgagcatggtcaacacaagtggcaaaaccatgccaaacaagcatgacttttaactaagaaatctatttacactccatttccacatgaaccacatcaacttggatattttgcttatttcactaggtaaaactactacgatggacacagttgcgctagcacttaaaatgcctacacctgcaagaaatatcacatttggaggaaagcattaaagaattaagcatcataaaggcattcaatgctgaattgctgagaaagaacttaataggtcttaaagaaaccaacaaccacttggatcaatgagcacaagaccagcttccctaggcataaccccccaatgtaataaagaaaaaagtttgtgctaccatcatccaggcagtacaaagtagtgccagagtagccgtttcagccaaatgaattcatcccagagaaaaatactcgtttgctatgaagttgaggcagatcacatttgccacaaagttcattggcatgtaaaaatccgacataatttagtgggaatcaactcatttgccacaatgccatgtgaaatgtcaaatttttcctcatcttcgttatgtgttaatctctctcctctactgccggcaaccgctgctccccatcttcatctagcacctagctccctctgctggcgcaccgcacacactttcctctacctccagcagccggcacacgctttcctctacctccggctgccggcacacactatcctctccttccagccaccaccgcaccccagctcagtttgtcagcaaacacacccaaagctccagtctccaccaacagacagctgaagctagtggcacgcgatagcgatcagacctatggaacactacacatgcttgtggccggagatgagctaagaggaacaagattggggcaaatttgcatcacctgtggcaaaggggtgtataaactattgaggaatttttgcaggccaacgatttcattcattgcaaatgtgattacacacatcaaccccttcgcgaaggaacaaccaatttttctcctatcgcaacaacatgaaccatcgaactagacagacaggctccacgtgtactgaaataccccgaatcgtcagccagcagcgaccagggaacacgatggactcctaacggcgggatcctcgcaaaaaccctaggttagggccgcggcttgggcgccgcctcgtgaccaagcaagaaacgataattccccccaagtcgcggcgagggaaagccaactaactaatcgaagatccggagcgggctctgagcccatctacggcgattaaacttaccccgggtcggagagatatccccggcacggctagtcggcgacggggagacgaggacgacgaggagcaccgccgcggcgccgccggagcggggagagaaagaggagagaactgcgcggtggcacttttccacggagcccctcggatttcctctttatttaggagcgcccatcgagccgagacgagagtgcgtgctggccgcgtgggacactgcgctgtggggcccactagctgtttgccgctgacgggtggggccacgcagccagcgcgaatcgtaaagcacgcggaccccgtctcctttttcatacatatcctcctctcgctctcgccccgctcgcttccgaagcttctcgagccctcctcctccgccgccgccgccgccgcctccgcctcgccgccggcgcagagtcgcaggttagctccgtactccgctcccctccccgaaccaagccgacgccgctgctggaatcctagtactcctgcgcgagttctagcgtgctctctctctctcccgtcccgtgccgttgcgtcctcgcgctttagttctctcggttgagcgagtgcgcgagtgttctgcttggttctccggtagatttggtagcccgcgatcatatctcctaggttttttttttccttcggttgagcggggcagcaattgaattcgtggtcgtcagggtttctgagagctggagatgcagtgctatgcttggtttgttttgctgtttgcgtgttatcgttacgtggcttgacgctacggccattgttggatttgtgcgtgctaatttagctgacttgatgtttgtctgtcaggaacgatgagccgacgcaacagccgcaccatctatgtgggcaatctccccggagacattcgcgagagggaagtggaggatctcttctataaggtgagccatgattacattacggattaggcatgtgtgtgccatgtaacagtgttatcctctagtactaaagtggtaggtcagtgcaaattttgttttggtatcagcgagtacatcgtaggctgcttttaggacttaggaggaagatatttgggggcaatactgctttcttatggaattataaatttgctatgttgggccctatggttttctgttgtgtggttggagcatttgttaaatacttcaatgtgaactagatatctaagttgcgtcttcacgcgaccataacctgtcttttatttacaaatatgataatgaattgtttgtaacagttacctatgttaaaatttaattcgtctagttgcagttttcaaattctacaattgaattttgttaaggattgaactttggagagtatttggcccaatttccgagcaattaggttgagatatagttttgcgttatgcatatcagtttgtttttctatttgttggttatggatatatctgtaggtgataggtattttttttatcttaattattcattctggatcatttctataaccgacacatctgaattttagacctgccagtattgtttaggacttttgtgaatatatgatttattatagttctattgacataaaatccatataatacacattattcgttatgtttattgggtctctgtggctatgtaaagatagtagtgataatcatttttatgtgcagtattttcactttatatggatttgatttcgctatatttattcatgtttgtaattgaatttatgaacaaattgagatagcaatcgaggtgtaagtggtggccatggatcgaagtactgacacgggtgatgttggctgaggaaatatatttcaacttgacagaagatttatcttaatatgagtttcacatcttgttagtaaaagagtttattttgcttttcttctaaacttgacctaggcgcacggagaaaagaggatggagtttgggcttgcagctgttgtagttaggatgcataccgatccaattaggcctatttatgtcaccgagttatacatgcaccacagctagagggtactctagaatactcctacatttttaacaactacttaagtttcatccaacggtaaagattgtttcgacttattttgtctttaagcgtatctgacggttcatattagtcagaagaagtggcacatcctggtttctttttgagatttacttttcacttggagagattccaccagtcggttgggcacttgggcacctctttgttgttgccatcttatgtggtgaactggtgataccgaaggatgttactggtagaagggtagaacaatggcatcttgtaattactaaattttctgatatctttattttcttgattattcatacagatagagtttaactttttttttcattacttttgcttctgcagtatggccgtattgtggatattgacttgaaaattcctccaaggcctcctggttatgcttttgttgaggtaagggattaagtatgttatggtgattacttgctatgagcacattttctatctagatttttgctcatctttttatatataagctatcattttatttagtcataaccttgttgttatttgaggatttttttttggggtctgtgagcaaatttagcacatgaaaaccgactacagacattagctttatcaaaatctaacccgaattggttgctattttttttaacttaaaaatggtccacactaaactggatagccaaagaaaactggacctttactaattcttttcgtatggtcaaaagttgccaaattttcataagataaacttcggcttggcgtgaaataaaacaacccctggataacaaactttagaggttctgttagaatgatgtgttaatatgaacccaggagtgttttgagctttgaataggaggtagcgaggtgggtaagcagagtgcttgcattctacccctgaatggacttcttcccaatcatggcaagaggactctaaggccggcaagtagatgcaagttgatgattaaataaatttcttggtttgaaatgaagcattctatggaagcttatatttcaggcatctcttagcaacccatgcgattagtttagagctgaaacaaaggaatatactatcgcaacaatttacccctaacgaactcctcaactggcttgcctgcttgcttattacaatgtgtgactacctctatataccttgctcagggaaaggaataggcaaatctctaaaatggataagctggcaagcacaggtttataaacaggagttaggtatgggttgtgtgatttgaacgatcaagtaacggatacaagacatagaccccctccaggtgcaaacattattgttctcatgctttgccttgctactacttctgttctttttatagaacattttttttatctataatcaatatatcatttttattatttttaggaaaagcagaatgggtagatcttggcgcgcgcgcgtgcacacacacaaaaataataataaaaaactggtttaagaatatctcgcttttgttatgttggacatgtggttctcattggaaactatgatgactaacgaaagtgcataggatgtgagcaaggggcaacttaagggttactatggaggcaagagaatggaaacacccaaatttgtttctttaagctcatgaggaatttgggggtgacggagactgacaaaaaatgtaggggatgagtgaaatttgacatacgatcaatgaatttttccatgtagcataaagacaaaggttagacaaacttgctttagaggaaacttaacaactagcctcaaatccagttttgccaagtgttgctgaactatctaaagaaatgcttgtcaaaattaaccttgtgcaatctgattgtacatatagcaccttagaggctaagaggacttgatactaactaaaagtggttccttatgcagtttgaagaccctcgtgatgcacaagatgcaatttatggccgtcatggatatgactttgatggccacaggttgcgggtaagtggatcttgcatgatatccgttatctttcttgagagaataccaggtggtgaagagggtagttcatatttatttatttttgttgcagcagcaaagaggatagttttgttctttgtcgtaatgttaatcttatacctttatttaggtggagttagctcatggtggcagaggcccttcttttgatcgatcaagtagctatagcagtgctgggcgccgtggtgccgctaaacgtactgattaccgaggtacgtacttctaaactcaagctttacaaacttgattggatacatcagtgttcttatttgctctattcatggaatgtgcagttatggttactggattaccttcgtcagcatcatggcaagacctcaaggtattgatgcagatgaactcccatacaattattcactcttcacgaatcttgagttttacttccattttcaggatcatatgaggcgagctggtgatgtctgtttctctgatgtttaccgtgagggtggaggttagtactgaacacttctatgctcttctgttgctgatattaattttggtatgaattgggcagtagtttgttttgataatacagcaaccatttaagctgtattatctttttccattcatgtttcagtagttcttacttcttaatactgaaatttcatgtgtttcagcaactattggaattgttgattataccaactatgaggattgaaacaagcggtaagtttgaattagttctatgcattttactttccagaagtgaacactgccatgtgccatctggaaattcatgttttggttggttcctttaataatagaaaaagggcactttgtgatatgccagacacctactttctccccaatcatgcatgttcttatcttcccgtgaagatacacctgacaagcagttttttgttaccttacagataagaaagcttgatgactcagagttccgtaatgcattttcacgggcatatatcagggtatggtcatactggaaatgtttctgcacttcatttaacctaatctcaagttgaagatttacgtactcatggacatgtctgttaaaggtgagggagtatgattctgctaagcgcagccgctctcgttccagaggtagaagccacagccgctctatctccagaagcagaagccgcagccgctcgatctccagaagcagaagccgcagttatagcagaagcaggagtccaaggtatggtttgaatctcataatgctcaaatgaatttgttatggtaacaacaacatgaatattattacaatgtgctgttttttccttccagatctaggtctgcttctcggtctcactcacctgtgaaagaaaggtatgcacagttccattttgattttgaatttttcaaagttaagaaactgagtagctttggcatgtgttatcttcatattggctattgaaaaactgcacatgattttttaagaaatggaccccctccaatgttgattattgaaatttgattatgtaattagcctatgttatcccatatctccctcaaataattgcaagaaaggaaatgtcgttaacttaaatgagtttactgctgttctctgcttccagatctaggtcggcttcacagtctcgctcacctgtgaaggaaaggtatgcgtagttccatttcgattttgaattcataacatattacatagtacatggaatgctttcgattcattgcgatggtgtgatactgagattctcggattaatactatgttacaaagttaagaaactaagtagcatttgcatgcgttatcttcaatttgccaaaaaagaaactacatatgattttctaagaacccctccaatgttgtacattcaaatttgattatgtgattagcctgtgtgatcccatatctatctctaataattgcaatacacgaaatattgtaaaatgaaatagggccggctctttatattctcatataatttgtcatttcctttctggtttgtactttaaatgttatgctttcgagatgcattttttcttctgtacatgcactttgagtttccactctctgatgattaaacatgcagaaaactggatagctgtcatttgttgaaaatttgctcttgtctttcctagatttgggacatgcagctatttgggttgcgttggtaggatattggatgcgttgagaaccaaaggatggtttggaacgttggatagttctgctggctagtgacatactgtatgacaagtggactacaaccagcgataggagcaagatagggctggctctaaacatatttggacttatggagtgcatttcgtggtataattgaagtactattgacttacgcatttctattctcaaatgtaaacctcggccttgcacccctattggttattctcaaacataacctcaccttaatgttgaagtttatttctaaattacactttctgatgaaataagtgtgtttagcgattagctctttaaccaatttgtgatctattgtggcttcaccttcatttggaggactcgtgattttacttataaggtctgtcatagtttttcaaaagatgacatgttacatgtacagtggaaaaaggtggtccctttacctatgctcatccaaaacacttctccacatgtttactgtttattgctctcaatctcatgtgtattgatgttaccatattcacacatattttgatcaaactgttgtaatatccctttactgagtaacaatttcttggcttttggaacattttgcagatcaccatcaagatccccaccccctgctacttctgtaagttttccaaacaagtaacttatattctataaatttgttccatatagtaaccattgtctcgtgcagcctcctcgtgaaaagtcagcaagcaagagccctgtcaagagcagaagtttatcccgatccccatctcctgtccgtgacattaaccaaaaactctgtatttttgtgagcctttaatatgcttgaagtttcccatattgatatggtcaatgcttcctttcaggtgaaatctgagtgaagatggatgcacttgaagcctgccagaaactatttcatgatttgtggagctgagtttcggaaggcagtagattgtggattatggtttatctgtttctgcgttaccattgttgttacttttcagaagagagccgtgttatttcactgttgcttggtcatgtcgtaatatctgtcagaaacattgccttacatgcttagcgttttacttgccatcaccaatctatcagacctcgtagcacatggtgctcgaacttcatgctatacatacagcactatgaactctgctatattctaaagctcaactatctgtagtaactgcaggaagcctttgcgcttcaattattgtctttttactctagttttttagagcttgtgcttgtgtacttgtatgcacctgttatgttgtaattctacagagtggttttcctcgcttaattgttgacatgttttgtcgttcggtgtaattgtgcgaccactgatgcgtgatatggtcttgctgacatggcttggcttggattggcttgacctaccctagtattgttggttttgtttcgttcaatccgtgatgaccttcgactttatcccggttgtcttgattggaagttgtcatccacggagaagacgctatgctcagctgactcatcccatctcgggtgtgtttggttgcctgcagtggactttacctcttttgttgtaaagtctatttttaaccgccaaacttttactttagttcaattttattttgaaaaataaaactcaccctagcctttcaagaccaggtgagttataccctaacagtccgtttggttggagagagtttttaggaaggattgggagtttagagagatgaggctattaagtgttttgtttggttagaagatatgggaattttggtgggatggggatgaggaattgaggaaggaactccctccttttcaatacctgggtaggggcagttaattgagagggaattcctcctttactttgtctaagtaaatcttagccatccgtttttattaatgacctaatctccaactaaactcactatcaatttccatcacatctaccaaacaaaatattgggattaaaaatcaaattcacatcttaatctcattatcaattcgctcgtgtaaacttccaatccccttccctcgagttaccaaacaagccataggtgattttcgtcatgcgaacttttttcttttttttttcatacctaaaaccaccatcaagatcagagtcggggtgaagtttgcctggttttggaagtgcaaacaatcagtttatttagcttagggcgaaagatagacttggtaaaggttcaagggttacaaatagacttcaaccttttttttcttcgactgttttttttcttcgactgttatgtttgtaatttctatttctagaattgtttcagctaacatcctgatccacaaggcagagccctcacctagctattatatcatagacatggattttgtttaatatcataatgaattcggatggggataactagctatatcatagacaagtatttcgtttggtatcaatatgaattcgaatataaataagtccatttgatgccctaatcctttactttgtccaaaactcaatctttcaatacagtgcatttaacaacctaaacttttaatacagtgcatttgacccctcaatctttttcacttggttttcacctacgtgacgctgatgtgatggtctagccaacatagaaatcataggtcatatgtgttattctctcgtccctttagtactagctcctctagcttcatccactggtgatcatgaaggcaacatcacatagtgaatggtagcttccaatggctttctcgatagtagaggcttcaacaacaacgccatgtttgggaccatgatcatcccccttatcgctgccgccatgaggacaacattagggcagcgccagtgctaaatccagaatgtggagctccggctgattggaaagggaggtaccttggcatcattgattactcggctatcctcctgtgggttctagaaaatgctgagattaccgccgttgctctatcagctgggtcagcaaccgtggcaggagttggaatgggtgctgtcggtgcagtgggagtggcagcattgggtgcaagtagtatagatggccataaggcccgaggcctgatggcccggcccaagcacacacgacccgattggggtcatgcccgggccggcttgacctgatagctgggccatgcctgggccgatgccttggtacggtgggccggcccggcacggcccgatccaatgaggagggagaaaaatagttagggactaacattagacttaatgcagccatataattcactgcccaagagagaagggatgcaaatagacttattaatcattcagaaatggcccaaagaaatgagggaaggaaattagacttctttttttacgaagaagcacgatggactgtcgtgccttcgagccggcccagcacgccccgagtcgtattgggccgtgcctggctcgatgcttcagcacatgggccgagagggcgcagcccggtgtattggtcgggccatgccggcccgatagattctggcccgagcacggcatgcctgggccgtgccgctcagatggccatctataggtgcaactggtcctgcagctgttgctggtttgactgccgctgcagtaggggctgctgttgctggtgggttaacagcagaaaagggtgtggcaaaggatggactaactgctgctgatcatttaggagaagatttctacaaagttctgcttcagcaagaacatttcaaatcaaccacagtatgcattttactctatcatgaattattatgcatatttggcagtgttttttttcctctttgttaaatgtcgatcatttatagagtccagtcagtctcaaattatttgttatatattctaccctgaaccactgttctgctgtgtggctacaccgaagtttggctatcctaattacaatatatgccgcaacttggcatgattaaaagcttcctgtgatttcttagctgcaacttattgttgctaataatagtttggatatctgtcctcttcgcctcagttgaatattgcatgatgatcttctgatgtaaatcctgctaaccttcattttttctcattattgtaggttcgatcaattgtagaatcctaccgctggtctccttctgtctccattacactggacacttccatgcttactgtactaccgttgctaccgaagtacaggttaaggaatgtcccagtgattgagcctgataagccaattactcactccgtttcaaaatgtttgacaccattaactttttttagcatatgtttgaccgttcgtcttattaaaaaaatgtgaaatatgtaaaactatatatgtacataaaagtatatttaacaatgaatcaaatgatataaaaagaataaataattacttaaatttttttgaataagacgaatgatcaaacacgtactaaaaagtcaacggtgtcaaaaattttgaaacggagggagtattaattaagaacttcattactcatactggtgttgttaaaggacttcagcagttgcaaaggaagggattggtttgattatatttcagcactccctctctcggacttgggacttccgtttatgtcacttgatgaggttattgcgtctccctaatccaattctttactaatgagaaatcatgtcccctacattatcaagataaaagttatatctcaagctgaaatgtacatttttttcacttcactttgcaatagattggtaattgaacaatgctgtgctttcttcaggttatcactgctaacagtggtgatctaatcttttaagcttttaaggacaacaaaattggtggtgtgcctgtagtagaaggtcccaacaagtttcaggtatcaaaccatccgactatttgttaccgcgtgagtcattttttaaattttgcatttccatgttcctaatgataaatcttccatacatacaggcaacttactgtcatggagttcatgaagaccataggctccaccgttcttgattcagggaacggcctggtgaagccacctctcacctgttcgcctgacgcttctcttggcagcgtgattgacagcattgcatcaagaataacccaccggatatatacgtcgtggacggtgacttcgaggttgttggtgtcgtgacactgcgagcacgagacgtgtgatctcttgctttatctatgagcctcctcgttattgtgacaactatttggcaccagccatggataattaagcttgaggacaaaggtgcaggttctgtggacacaagttgagcctttttatgtaacgtgaacaccaaaataacagactgaattagggagcatgcagtagcaacactgatgtattcaggtttaatttgtggtgttcctgcagtgaaagtgtgtagaacaagagtgatgctgttactccatggtctcttaatgtagtttgctttgtgttacttaattcctatatagggaaaagttaatatatcctcagtaaaagttcatctaacacctcatactttgaagtcagataaccaactctatcaacttcatagtactgttcgtataaccgctaaaagtaacttttatctaattattttattcggttttatctaattttacatgtacaatagatgaatttagtgacgtgacactcccactatccgaaaataactctatttttagtcttgggtgttcaaactaaggtcgagagaaaagaccaaagtctccttatcaacataaaaatagcattccattctgatgaatggatagatagataaaggacattgaaggagtaaaacttaaaacagtattgatgagtagatagataggtaaaggtattgaaggaataaaacttataacaggataaaagtgaacttatttttcatcaacaaaaaaacagtattacgagtgttttagaataaaaggtataaaagaaataagatttataataggctagaaatgaacttattttagaataaactgttcaggttagaaatgaagttatctttggaccgaggaataaatatattcaagatatatgtcaaattctcccttagactcttttttacaccaataacggaggatcgatacaatgacaataatcgaggatcaaggattaatgaagtgaaaatttatcatctttgttaaccaaaaccttattaagtatctgtatacggaaatcagcatgtccaaaacaacctcagaagttatatgaacaatattatgtagtaagttgaagcgtttaggttagggtgttagatatgcttgtatccaaagttatatttgtatgacgttagaacaaactgagattgtgtgccttcctcggattgagatccattgacttacttccttccaactttgagtcactgacatgtggatctactctgtcagtgacctacgtcagaattaagtagaggatcctcttttgtcttcctttttacccagagggatccgtgtctatccctccaagtactaatttgttttggggtgaatcgcttgtaaggtccttcaacttatactttaggttctatttggtcctgatattttatattattcaaaaagactttaaagtttatcatgtaacttaatataatccatatacccgctaaaaacgataacttagaatgccgcaccatacttgccttgcatacatggttaaaattgatattttgattttatccttacctatgccaatttttttaagaaaaagagaaataaagagaaaaggagagaaaaaggacaaatacaaatgtagtaaagacacaaagatacaataatcattatgttttgccgtttcctttcttctttcttatttcatacattcttcaatgcggtcaggtaaggagagcactccacacgtccacatccgacgcctggaagggtgtttcctctcccaacgcattaaggctttatgcattgtgcataaactctacagaagggtatcaatgtcattttaacagtcatgcgctcggtttacgatgatgtcctaatggtttacgcaaacaactccaaccagcaccagtacccggatatcctgccagacgatatggtcaccgctgtcgccggagaagatagacgttgcacatggtttacattagagtaaattaatatagttatggtttatgctaatagagaaggaccatgggcaacgtaaaccatgcggtgggagaggatatggtcaccgccgtcgccggataagatagacattgcgcatggtttacattaatatagttatagtttacgctaatagagaaggacctgccatggccgctgctttatttagcgtttatagaggtagaacacaaggtaagttatatatgtagtttaaatgaactttcgtacaagatccggataagtgaatggttattcgtttatataaattcctacatggttacgcaaaaacttattgcgagttacatagccacagcagatccggactaaatgaatggattatgttctattaaataataatgttatgttgtgggtcagcctcacaaccagggtttgtaaaaattgtattttttttaaataaaagactgaaaagaccctgcaattcatagcggatggcccaacagaagtacatgaaaatagcccatctgcgttgtactattttactactaaaacccttacgttttcataattatgctcaagtttttacatctgtattccatttagcaccttaatatttttaggatttattaactactgttagatattttatttgatacccatagattgaaaggtaattatgtttgaatctctcaaaggtaattgagtaaatcatcatgtgactctcataggatctaccacaactactattcatcctccttggaacatttaaaaattggattacgccaagcaggacgacaggcagggaatcagcccatacaccaaaaaagatggattatatgtcaaggacaacaagggttacgccaagcacggaatcaacccatacactaccagctgctgtctacgccaacaagatgagagtttatgctacaaaatggtcaaattccaaggtttgtacgcgcacgcgggcatcgcgaggtgccctacatggtacacacccacgtgtggatctcgcgcgtaaacacatccatgctacgctcgaaaggttaatgtacacgcacgaaggatgagtttacgtctacgatccacgggcaggcatgaaccatatgtaggcaactcgacatcctccgtgtacgcaccaccaattacgcctacgtggggaaaccacatccatcctacgttcacagtgtcgttgcacgcgagacgcgacgtacgtgcctgaggcgtcgcaacactctgttgtcgctaatcaaaggacttgcaactatgcaatgagtagtatactagatatacgacgaagaacactgggatgcgaaagaaaaaaactctgaagtaacatctaacgataacaactccaacacttaacatggagatacgaaagaaaaggaagtctgaagcaacatctaatgataataactccaacacttgacccctcccccagcccagccagccggcacccattagcccattaggcccagcgtgcaagccaggcccaggaggtagggaaagaggccacgaggagggcgcagtcgtgcacatatgcacggtacaactaagggccgacgtgtcgatttgacgtaagccgtgcgcggtttacacgtacgcaggcatcgagaggtgctctacatgtggggcaggcgtgaaccatatgtaggcaacacgcgatcccccactcccccactccctgaccatccatgctatggtcgattgctcgaaaggttaatttacacgcacgaaggatgagcttacatccacgatccacgggcaggagtgaaccatatgtaggcaactcgcaatatgatcccccgcgtacaccatttacgctctaaaggttcacgtcaaaaattccccatttacgcatacagatgaatgggttacgcaccaccaattacacctacgtggggaaaccacatccatcctacactcacggtgtcgttgcacgcgagacgcgacgtacgtgcctgaggcatcgcagcactccgttgtcactaatcgaaggacttgcaactatgcaatgagtatactagatatacgatgaagaacactgagatgcgaaagaaaaaaactctgaagttacatctaacgataacaactccaacacttgacatggagatccacacgaggacacggtttacatgtacacggatgatcgcgagatcaggtgcccaacatggttcacgcccacatgtggatctcagacataaacacattcatgctacgctcgaaaggctaatttacgcgcacgaaggatgagtttatgtccacgatccacgagcaggcgtgaaccatatatagggaactcgcgatcccccgcatatgcgtaaaccttcacgcacgtctcgcgcgtacaacaacactgtgcccgaggtgtgtgcattatgcctaagtcgggatttcggacgtaaacacgtacatagagcgtaccgcctacaacacggtttacgcgtatgtgatggctgatatgctatttcgcgagtcgtgcgtgctctacgcgtacccggagatcgctaggtgcctacaaggttcacccctgtccgtgcctacaatgctttaacgcaactcgcaaaccactgtacgctaggcgtttacggcatacgtggatggtttacccacacgatgggattgcgcacataaacaggcacgtcgaacgtatgagtagaatcgatgtgtttacgtccgcaatccgaggacggtggtggcccgaggagaagaccttgacaaaattataaactatatatatcacattttcaatattttggataataataaggagctaacaataaaatcgatgatgtgtttggctcctaatagttgaaatataaaggactattatataaaacaagccaaaatgggcttcataatggactgccattgggatttactcctatcgttattcagtacacggttgagaggattacctgctaaatttaggtgggcctagcccaccataaatattttttcgttctcacagcatatactagagaagtgctatcgatcttatgtggctatatactttgtattttctatttgtagaccaacgtaaaccgaatgtaaccccaatcgcttggttttagctaggatcttctacatcagatcatttgtaccactatttacgtgtgtcgatgcaatggctttctctagacacgatctacattagaggcgcgatatagagcgtaaaccataaaaactagcacgtaattgaactttccactcgcctcttagctttccggggattcctttgtcctctctaacgaactctaacactgcgtacgttccttcggtgtggaatcacgacaagagtgaactaactattagagtttacactggtgtccaaatgaccgtcatacccctcggataaattaaccccattatttactcagctaacaggtggcgctccctcattggttgtgcctacctttatgcagctttatgctgaccgcacttaagaaaagctcttcttattttctatggtatatataaggtagaatgaacattttgattttaactatgtatgctaggatgatgtggcatgtatgtataacagtttcggtggatcagagactatatcaagtcacatgataaatttagaggtttgtttggacaatataaaataagggattaaactaatctctactattataaaaattgaagatgtttttgccggtattttagtacatcatctatgtatgagtcggttttttaatacagaaggaatcatataatagatttgtttaaaaaaactcgcatgctagcttgagacgatcggtcaaaccacctgctaactcctcccaccacccacctcttctcagctgtctcgcagaacagtgcagtaacacgacggtcaacgtgcagtaacactgcgtcttatgtgtagtaacagcgctcaaatattgttaacatatagtcatgatggatctacttttgataagcgttttttttctagcatcatggtgcaaacgattttaaaaaatagtacatcatgtgagagatattgttcttcaaatcttggcttttttagaatttgactctccacaagtagtaatgctatagcattacttgttactactgtcagttgcacgttactacaatcccatcgcatcgttactgtaagagtgcagtaaaaattataagtttttgcagtaactgtgttttactgcattttttggatagtgttactgcataaacatgtggtgacatgtacttgcctttgcagtaacactccacttttgtgtagtaacaaatatatttagcatgtgagacattaacctatatatcctccacatgcagtaacactatagcatcattgtgaaaacagttttaaaaataatatatatcttgtgagatattgcttttcaaatattggcattttgaactttagcactacatatgcagtaacagaatatgtaatttgtagtaacatgggtatatacatgcagtaacatggttttaccaaatgtataaaattgttcaaaacactcgtacatcaatcagacctcactcaaagccacctacagactttacctatagcccacctattcgatcttcatctcgtaaaactgacaaagtaaaactacgattatcgtgtagtaatataactacttggaagtggtaatatgcacctattatgtagtaacacttctacttttgtgcagtaacaagtatatggttagcatgtgagactttaacccatatatttttgtttcgattcctggtctactacaattttactacgacgttactgccaaaagtgcagtaacgtcctacgtgttctacagtaacgtcacgtgttactgtacttttacaacaatgttactactggagcatagtagcatgttatgagtttcggtagtgaaagatattagaattgataatcatattactttctcacaaaattcttgaaacaaatagcatcattagatgaattggttaaaagaatgtgctttgaactatgaggtcatgtgttcaagtcttgaatttggcaatttattttttatttttctagaaaaagagaaataatctttcagggagaaaaaaaacagaaaaaagaaagagagagagatcgggaggagggagggggaggggaagcgagagagagagggagggggtatagaataactattctatactcgggtgtagaatagtcttaccctctatatatatatatatatatatatatatatatatatatatatccaagcgaactcccacagtgaatttcatcttaactaaaccatataataataataagattaaaatagacctcatccgttgcaacgcacgggcattttttctagtcatacaaaaaattaagagaccgcattggctattcactcttgttgtggaagataaaactgtgcaagcgtaagtacgtgcgcaacatgctagtgatgccatccccggttgctcacttcacagatgtaggatctgttttgttctttgccaatatcaaattttgggcaatagcaagaagtagtggttaccatttttttttggtaaagatgtactttatcgactaattatttatccatcaactgaggctcaagtaatttattgattattccaatgattaatgttctagtgcgatttttttagataatatggttcaatgtaacccttcatgaagtataaataaaccacttaaaaaaataaaacacccaataaaaagagaatctcttgtatcatagcagaataaaaaacaggacatgcacaaacagagccaaagggaaagtgcaacagctcatatagtgcttaatatccataacaggatatggcacataaagtagtaccatggatatgcatgcgtataatgttgtaagatctgatcttagaaggaaacaaactggataaaatatatctctatcctctggccggccactgcatgcgctaatcatcctcagcccatgcaaaccaacgccaaacctcacttcatgtgaccaatcagcacgtatagatgagatagaatccaaattcatctcggtcacctcccttaacgctagcacagacctggctcctggttatgctttttttcagatcaacaccagaaggctttgattgcaatgaaaaatacaagaatccatatcatgtcttcatgttgtcaagctattcactgtgcatccttgctgttgtccatctaaaaccatgcatccatcaagcaccagcagaccaaagaacatgatgatctcatcaggcgtaccatctgcaccttttacagcactagcccaaaatctcatatacataaatctaccgaactacatgctatagttctctgctagtaactatagcaaataactgatacttctctgcacacacgcacacacgcacgcgcgcgcaacacacacacacacacacacatatatatatatatatataggatacccatatatatatatatatatatatatatatctaactcttgagcaaaccactcaacacttttctaaataaattggcttgcataaatagactaactaaaagccaaattatgatacaaacaagccgctcaggttgattcttaacacagtgtataacatcctttttttcagaaaaaaaataatttggcttttacttagtctatttttgcattgtgttaagaatcaatttttagttagtctatttatgcaagccaatttatttagaaaagtgttgagcgtataacatctttttttcagaaaaaaaataaaaaaaagaatttgaaacctatttaattactaccaaaacctaccaccatacccacaaatgcatgatcaaaatgtgcctataatctggtgaagggaggtgtaggtgccaacaacattgacgcacactcctatgaccagtatcccgacaatcatcgtcctctcgaagcagccaactcctcctcgggacatgtagatcttgagatagctcaggcacgggaccagcacagcaacggtgacgttcagcgaggacccgatgaacaacatgagatagccgaagaagggcaccgtgcatgccagcaccactgtgctgatgacgacggctatgctggtgagcaccctggtcaaccagttattctcaacgtccgtcgtcgctgacaacttctcctctatcgctgttgtgactggctggatcacaagcgtgtagttcgccagcggggtgatcagtgtcgtcaggatggcaaacctggtgtacagcttccctgtgggtaagttctgtgtcacctgcgactgcacatcctcaccatagatcagatatctcaacactactgtcactgcgtagtttaggctacacaacaccgacgagatcaacaaaacctgcacattaattggagagtaatagaacattattggagtactgatccatcatcatcatcatcatcatcatcatggtttcataaaccaaattatgataattggaactgataatccatgatcaattatcattggttgccaaatccctccaagtgaaaggtaaaacttaaaaatgcaacatcattgagcaacatcatctgaagatatggataattgaatgcaacgtttgatcaatatctatcgttagatcatggatatgtatcagtaaaagaatggtgaaaggtccaagattgttcaagaaacttccatgagttaatggagcaatagtcaatctcctaccacttttgcatcttatccctaaaaattctcatacctattggttgagtctaaacttagtacaaaaatatatacaacacaatagatctctattttaacttggcatagaaaagtttatgatgcagcacatcttccaaatttagatatgttgccttttaatttatctaaaattgtattggactatacataaaattacttaaaaacaaattttgtaaactatgtattcaaatagctaatataattctttcgttttaagtgctagacacatcttctaactttaggtttaacatacaaactaaataacattaggcggcacatgattagctttatatttaagctacattgcttttacatgggtgtgtatgagtggtaaccaaatatagttgagaggcgaccctaattgcctccagtcaccggtttattccgctggagtgataggctgtactgtagcacagtacaccttcatgtcaccgcacacgttaaactggtcgaaaggccaacccaacattacccaaaatttacgtcattatgcaaaaaaaatattaatgctaaattgtgaatattgcacttgcaattaatttcatattgcacccgccattctatatcagtgtaaattaacattacgaaattgataactagtacaacattttttttagggatggaacaactttttttaataaatcattttaatgttgatttcatttgatcttaattcttaattttaattggatggtcaaaataaacttattggcttaacttttatttgcatgatgtatatacacctgctatatgatgggagtgccaacaaaatatattaagtatgatgagaacgtagcaactatgatgattaagaggtgtgcaagtatagtatgcatgattattgatgtatgagttctaaaaaataattatgagtgtgcgcgtcttccatgcatacatgtaataaaaaaacaatatgtttgtattcttactaaacctgttgctaatttatttccaccatttactattcaattttcattaacgataattctaaatttacattgttagttgttatcataaattttaccaaacttactatcaagttcaacacataaatacattttaaagtgtaccttaggaaaatccttcttggacttcattgaggagtacacggtcgggaagacgccatggccggcgaagcaaacgaagtagagggtgagggcggtgggcaacccactcagattcaagaggttgttgcccgccatgtggaagcccttgtcgggcacgccggcccagaccccgtcagcgccactgacgagatgagcccgactaccgagacataggtgagcatgctgaggttcttgagccacgtcatcgggaggatgacggcggccgtcgcgagcacgaacagctgcttcccgtgcacttggtaccctaggatctccaccaccgtgctggggaggagcttatcgaggttgtcgccctcgaggatgaggaagctgatggcgacgaggtagagctcgacgtacatgacgaggccgatggtcgtccagccgtaggcgccgaaggcgaggtagccgatgtctgggtagctccgtacacagcggtcggcgcacatgcagcggtcgataaggttgccggtgtagaagcagatggcgccgaccatggcaaagagcgccaggctaagccacccaccctgcaacggcataaccagaaatcacattgctaaagttgaggcagctcctcctgaaggaagcaccggtgatgcagaacgagacgccgtcggtagggaagagttgctgctccatgtcggtagggaggaggagctgctgctccatgtcgcaaatcatatcttcttctcgtgtttgctatggaggagagcctcatcgatagggctcttatccgccaccataatccccatgtctgtgtgtacacctattaaaccaaaaatcacccgacagatttttaaatcaaaaacacttagatttttaatagttacataatacacatatggaaatagcatgtataacttatcatatgtatcataacacataattcattattaaagataaccttatagttaaaaataaagtgcaacttacactcagtgaaaaatagaaaaaaataaattacatacaaatctaatagagattacattgtaatttaggcctggtttagttcccaattttttcttcaaacttccaacttttccatcacatcaaaacttttctacacacacaaacttccaacttttccatcacatcgttccaatttcaatcaaacttccaattttagcgtgaactaaacacacccttacaatgagtgaaaatgtaattattacaaattacactgtaaaagtactatatttacactgtaatttttttcctcgacttaactcctctctctctcatcattaccaggctttcatgccctgtatgcttttgggcaaagtgaagttgacaggaatgagtacactagacgattaaaaacaactttaaaatatttaattagtgagagacaaagataatcagtcatatgcatggttgtacaataccacgtagtccagcacacgcgagttaagagtttcgtgggagcgctgacacaaagaggtcacggatctaaagtttcgattaacggttgaaaaatcgacaaatcttaacggaaaaatttgtcgaggtatttttagcttaattgattattaattgagagttgagatgagatctaatttagaatgggcagaatatgtgagattagttatatgttgatatatcttgagtcgataattcatgagcgtaactaactggggcgctagatcaagctccaactcttctgtgctcatttgcacttcgtggactcgtacaattggtaataaattcgctttttcttctcctattttgtgtccacggttcaccattacgtccacaaccggtagagacttacatatgtaatcttgggacttacattgtaaatacactaaaattacatatgtaattttgagacttacaatgtaaatacatgttgactattttttcatgaaaaatatggcggaataaatatagatactctcaattaataatcactttaacgcgcggcagcatactgctggactgagagagcaaacaaaataataatctatctattattcccatgctggttgttttgccgcctgcctattggtccaggtggcacaacgcttttctgatgcgtgtacgatgctgcctatacacagttgtgcatggctcatgtagcatcatgggccaagtgccatgcacgattgaatggactaggtaggcccacgtgtgaagaaagaaaaaaaagaaaaagattgatctatcactgtacgtattgatttggttgcttctgtttacaccgtaattttgacaaattaatccttatattaaaactttaaaaataaaccatgtcaaaaactaattaaaaaaacagaccgtgaccttagcgccaaccctaatgacactaaactaaaacatctcagcaccacccaacatggcacaaattagccatgtaaaaggaactcaacgtcactatacattacgatgacctcttaataggtttaaaatatatagcatgtgctgaaatcctgagtagtgtttaactttattcgttttatcaaaaaaaagtgcctataagtaataaaaatagacaaaacaattttaaaattaagtagtgaatttaaatttatacaagtaattcatagcacatactacgaatgcatatgtaattttcaattattaaataaataaaccaagattagtattgctatgtcttaaacatatggtaaaggttaacatatatactttagagaagtgctctcacgaattgtgcttatcgttgggtattcttgcaaaacgctgttaatcctagaatgaattcatactggtacatgtatgtcttcctgaaaataggaaaggaacgtgcatttttttcaaaaaaaaaatatatgttcaatgtgttcaaatacaaaacatgcaatttcattaaaaaaaattacttattaacccaataaaacatagctagcatatgttaccactctttctgcaacctttttacaaacacaaaagtaagaaaaaatatttaagagttttgtggacatgagactgtctatatgacagccagctgaatttttgggtagtatcagccgaattttggatggtggaatctttcctaatctgacacgtgttaaaaatcctaatgccgcccaaatctccaaccactggttgacgtgtgtcacgatgagttctattttgagcagttaattaatgggtctgtcattgtcaatatcagttcaataaaactctgttgctcaactaaaatggcacgtcaactattcttaggttatgcggttctgctatacattacttcttctgctacacatcatacatccttttcgttcaagttgaccagctttatatataaaaaaacatagtaaaacttttgacatgaaataaatattatttaaaaatatataaaatgatggatttaacaaaaaaatatatgttttatcaaacttaaaaaagttggcttaacccaaaacgtccaaacaactttaagtttggccaaatatatagaataatatagtaatattttcaacataatataagtatattgaatggtatatttagtggaaccaatttgttgttgtaaatgtcactatgttttttataaactttgacaaacttgaaaaggtttaaacaaggacaaacccaaaatgactgaaaacacatagggagtagtacttaccgaaaaattatagttttattgcttttcactatctatcagccattaagtccattaagtaaaaattaaatttttttctattaatttcctactgtatagtcctcttcagtgcacacatcgcaattatcttcacctgcacgtgcttccaatctcaaaattataataaaataagagaagggcaaaacaaaaggaaattaaccctcgggcaagagatacgtatggaggtagagtcacaatgaaggaaatgaaagaaattaggttgttaaccaatttttcttatggaaacataatttttaaataaagcatgtttctctaaattttacaatgaaacaagcgatgggcagattaagaaaaaactagtgttcccaagtcagtgacggtctggcggattcagcatgggtggccccgctcaaacccctcctacctagttggatcaccatggagagcaaggagagtgggggagaaaaagaagagtagagggggctagagaaaggaggcacagatccccctctaattcaaagctagatcatacaaaacacatggtcctaatctacatatatacggcattagaatttgcagacaaaacaaagagtatggtgaatggagacaaataacaaaaaagggatataaaacgagcatactggtagggttaggagaaggcgcacacatgcagggaggaggcgccattggacggaagaaagggatatatacacctttcgttttgtaattatatgttgagttccgttccgaacttatatcagtatatcagtcaggtacttcgaacttaaaaattggtagttgttttcgttggattactctatatacctaataaaaaaattagtaaggcttccgtgagtttttttgtccgtcgtttttttcgctctttcttccttcttttttcccgtatttcttttttttccgtccggccttttttcgttttttttcttttttttccatgcgtcccttttttccgccgttttcctcttttttttctatccacttttttttcgacgtcgcttcttcgggttttttccgtccgctttttttgtcctttttcttcttttttttttgcacgttttttccttcttctggttttttcatctgcttttttccatctctattttttgtcactttttttggcacgcggtgaggattcggtttctaatccacttggtttttttttcccattgccaggatttaatctcaagctgttgtcctggccaaaccctagcgccaccgccacagtgatatgcctcccgtgcgtttcctactataactgattgcaaaaattgattccccaatactccctcattatttgatttcctcttaaaattcggctttacatcactagatttaatctccatttaacagtcatcattttcccataatttccccttttcaatttggatttaattcactagatttaatcttcgtaagccggtgatcttccccttatcgtttttatcccaagttttgtggattcgctctgatttgggaaaatctgaaaaaagagatactgatgtttctgctgttgtatcactaaaagatgtcttttcccgttgcaacgcacgaccatttttttcttgtcccatccaaattacaggagcaaggaaattacgaaaaaaacaagtatagaaggatatagcagaacattcagggtaactggccaaataacaacaatagggaaaaaagagaagaaattatagcaacgtagctaatttctcacctctcccaccaatttgtagatcgatggcggccacggcgcgcgcaccgcctacaccacaaccgcacgcacgggagagatataccggtggagacgcgcgtgacaacaatgacacggcgagctgtggtcaggagctctcactagcgggggttatggaagaaggttaaaagaaaatagcgggagaggattagatctatatatggaagaaggttaaaagaaaaaagaaaggaaggtagggttatgtcacgtcccaaaacgactctaaaatacatcctctaaattatgcctagaataattaaaaaccgtgtgaaagcctccaacaattaaaatgtgcaaagttaaaagtcaaacaaggcttagaggatttttgtatatttcctaaaaagcctaaaatatgtaaataaattttagtggaattttcagagcacaaataataattgttaagaaataaacaaagttaaaaaggttttataaaaagaaaaaccctaaaatccctccttctctctaatgggccaacttcggcccatctccctccccctctctctcctctccccgcggcccactcggcctctccccgcgcgcgcgccgctgacgggtggggcccacccgtcatccccgtcctcccgccgctcccgccgctccgcctgcgccaagcgccaccgccgccgccaaatccgccgcatcccgccgtccccgcgtgcaataaagtgggggaaatcactccccgtgatcccctctccctttccccccatctttccctctctctctcgcgttcaaatgggcggatttgcccccgcaaatctcgccggcgccattgatggcggccggacctcccgcgccggtttccttcccctccggccgctctctcccccttccaaccctatttaaaccctccctgcacctcctccgtccgtttccgcctctcgccgcccttcctccttgccggattcgagctcgcgacgtcgctctctctctccgccgtcgccgccgagctccggtccgccgccgtcgtcgccccggaccgcctcccacctcggcgccgcctccttcgggttcgccgcatcttcgccgacctcgtccacctctccgtttcggtcgccgacagccggaacgccgtcaaccccgtcgacccgagccgcgccgccgcctccctccgctccggccgcctcctccgtcgccgccgtcgcccaggggtgagccgtggaccgtcgcctcctttcctccttccctcccctctctcggccgccgctccgccgcgccagtggtcgccggcggcaaccatcgggacacgggcgcgccgcctcccgccgaccgcgccagcgtggccgccctcgggcgcgccgagtggctgccgcgtggggcccggccgtcagccgcccacgccctcgggtgcggctgacgtgtggggcccacggcgccggccggtgtgagcccgggtgcacccggtccaccgtggaccgtaaggctgccgcgtgggccccactcccgtggacccggtccccgcgccccttcccctcggctgacccaataaaccctttttaaattaaaatttaaatgaagaaattcgtaaatattcatttaaagagcatataaacttcaaatggccataacttggccatttgaactcgaaattggaccattcaagtctctaatttttccttaagaagtcaagaacccatttttgtgctttgttcttgctggttatatggagtttattagagtaaaagccttttcttttccgttggtcgtgtagacgctgcagctttggaagatccgctcttcgtggaggttgaagccgacgtttgggaaagcgagcaaggcaagtcacatcatccttgaacatattgaatcccagtttataaaattattttgatttaaattattgcattatcgctttatttaaattcccgcgttatcattgttttatctagtcatgcctatttacttttgttatgaccttattattgttattgttattattaccttgttcaccctagaataaacaaaaccccaactagtggacactctactcatggtaccactagtatgaatttagttagatgcttcgccgcttaattaggtaacattaggtggttttacaactctagactttgggatattcatatcacctggacactacggaatggttggattattgtggaattggattcacacctccccctctattcaaaatcctcaaaatggttttaggctgggctcggggtgcatggttttgatagtagcacctcggccatataaggaccggtcttcgggcctctattgcaaagcactaccgtactttcacatgtctagtgggtaaggcttagtttgtggctcagtctggttataaacaaaagtacacggatggagatggacgaagtcgggggtcgatggacatctctaggacaaatgaatgctacacgagctgcggcctggtagttgagatgtcatggcacagggccggtgtcctgctgctaggggctcagtcctgcctacctgtcccgggggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataacctattcgaatagccgcgccctcggttatgggcaagccgagcaatgtacccaagttagtgttttttaattcttaaaacctgcttaacaactaaaatgtggaatggttggcctgggttggcttgggacgagctgggacccagggtcgggtttccagttcggtctgaatcatagtaggccttacgttaaggcaggttcgtgtgggttcacggccttgattaataatcttgtatagctctaggatcgtatttacaaaatagctttgagcaactaagtgtcttttaatgctgtttactgcaaaccctaacccttcatactataaccccccttgtactcccttgcatttattctgcacttgtgggtgtgtcttgttgagtacggtggttgtactcagtcttgctcaatttttcccaaactcagaagaggagttcctggaagatcaaggctttggtgtctagctcatgcctgccgtcaagcgcctgtggtcgtcgccctagtcttccgctgtttcccgtttgtctttgtgtgtgctgggccttcgccgcccatgtaataaattaattatttacgcttccgcttgataaactctgaaatatatcaacttttgggtgtaccttgcttcctgggacaaggaataatacacgcacgtaaggaacgcccgttgggttattttcggtcgtgacaggttaggagaaggcgcgcgcgtgcgggtaggaggcaccatcggacggaagaaagatgatatatacgactttcgttttgttattatacattgagttccgttccgaatttctatcagtcaggtacttggaacttaaaaataaattggtagttgttttcgtcggattactctatatacctaataaaaaaatttgtaaggattccgtgagttttttcgtccgtcgttattttcgctctttcttccttttttttcccttctttctttttttccatccggccttttttctcttttttttctttttttccgtccgtccattttttccgtctttttcccattttctttgcgtccagttttttttcaacggcgtttcttcggtttttttttccattcacttttttttctgtctattttttagtcagattttttgacatgcggtgtggattcggtttttaatccacttggttttttctgtcgccgggatttaatctcaagctgtaccgccgccacattgatctgcctcccgtgcgtctcccgtgcgtttcctgctctaattgattgcaaaaattcattccctactactccctcatcatttgatttcctcttacagttcggctttacttcaccacatttaatctccatttaacattcggcgtttccccataatttaccatttcaatttggatttaattcactagatttaatcttcgtcagccggcgatcttcccctagtcgtttttatcccgacctttttggattcgctccgatttgggaaaaactaaaagaagatatactgatgtttctactgttgtatcactcaaaaaacgtctttacccgttgcaacacacgggtatttttttctagtcccatacaaattagagaaacagggaaattacgaaaaaaaaaaacaagtacataaggatatagctgaacatgcagggtaactagtctaataacaacaatagggaaaaaatcggaacgtagctaatttctcacctctcccaccaatttgtagatcgatggcggccacggcgcgtgcaccgcctataccgccgccgcacacccgggagagatataccggtggagacacgcgtgacaacgatgacgcggcgagctgtggtcaagagctctcaccagcgggagttatggaagaaggttaaaagaaaatagcgggagaggattagatctatatatggaagagggttaaaataaaaaaaaggaaggtagggttaggagaaggcacgcgagtgcgcggacgaggtgccgttggatggaagaaataggatatatatgcctttcgttttgatattatatgttgagttccgtttcgaaatcagtcatgtacttggaacttaaaaattggtagttgttttagttggattactctatatacctaataaaaaaaatttgtaaggattccatgagttttttcgtccgtcgtttttttagctcttcttcctttttttttctcttatttctttttttccgtccggccttttttcgcttttttttcttttttccgtccatccgttttttcgccgttttccccttttttttccgtgcactttttttcgacggcgtttcttcggtttttttccgtccgcttttttcgtcttttctttctttttttgcacgttttttccttttttccatttttttcatctgctttttgtccgtctctgtttttttagtcacgtttttttggcacgcggtgaggattcggtttttaatccacctggtttttttccgtcgccaggatttaatctcaagctgttgccctggccaaaccctagcgtcgccgccagattgatctgcctcccgtgcgtttcctactataattgattgcaaaaagtgattccccactactccctcatcatttgatttcctcttactattcggctttacatcactagatttaatctccatttaatagtcatcgtttccccataagtttcccttttaattcggatttaatttactagatttaatcttcgttagctggtgatcttcccctagttgtttttatcccaagttttgtggattcgctccgatttgggaaaaactgaaagaagagatactaatgtttattctgttgtatcactaaaaaaacgtctagacccgttgcaacacacgggtattttttctagtcccatccaaattggaggagcacaagtatagaaggatatagcacaatatgccgggtaactggcctaataacaacaatagggaaaaaagagtagaaattataggaacgtagctaatttctcacctctcccaccaatttgtagaccaatggcagccgcggcgtgcgcaccgcctacaccgccgccgcacgcccgggagagatataccggtggagacgccgtgacaatgatgatgcggcgagctgtggtcgagagctctcaccagccgggattatggaagaaggttaaaagaaaatagcgggagaggattagatctatatatggaagaaggttaaaagaaaaagaaaggaaggtagggttaggacgtacggggagtaggcaccgtcggacggaagaaacatgatatatacgccttttgttttgttattatatgttgagttccgttccgaacttttattagtcaagtacttggaacttaaaaattggtagttattttcgtcggattactctatatacctaataaaattattgtaaggattctgtgagttttttcgtccatcgtttttttcgctctttcttccttttttttcccatgtttcttttttttccgtctggcttttttcgctttttttcttttttttttctgccgttttcccctttttttttccatccacttttttttcgacgtcgtttcttcggtttttttccgttcgcttttttcatcattttttcctttttttttgcaagtttttttccttttaaagtttttttcatctgctttttttccgtctctattcttttaatcacattttttggcacgcggtgaggattcggtttttaatccacttggtatttttctatcgccgggatttaatctcaaccagttgccctggccaaaccctagcgccgccgccacattcatctggctcccgtgcgtatcctactctaattgattccccactactccctcatcatttgatttcctcttacaattcggctttacttcactagatttaatctccatttaacattcgtcgtccccctataatttcccctttcaattcggatttaattcactagatttaatcttcgtcagccggcgatcttcccctagtcgtttttattccgagttttgtggattcgctctgatttgggaaaaactgaaagaagatatactaatgtttctgcggttgtatcactaaaaaaacgtgtttacccgttgcaacatacgggcattttttctagtcccatccaaattagaggagcaaggaattatgaaaaaaaacaagtataaaaggatatagcagaacatgcagggtaactagcctaataacaacaataggaaaagaaaagaagaacttataggaacgtagctaatttctcacccctcccactaatttgtagatcgatggcggccgcggcgcgtgcaccgcctacaccgccgcctcatgcccgggagagatataccgatggagacgcgcgtgacaacgatgatgcggcgagctgtggtcgagagctctcaccagccgggattatggaagaaggttaaaagaaaatagcgggagagtattagatctatatatggaagaaggttaaaagaaataaaaggaaggtaaggttgggagaaggcgcgcgcgtgcggggaggaggcgcgtcggacggaagaaagaggatatatacgcctttcgttttgttattatatgttgagttctgttccgaactactatctatcagtcaggtacttggaacttaaaaattggtagttgttttcgtcggattactctatatacctaataaaaaaatttataaggcttccgtgagttttttcgtcggtcatttttttcgctctttcttccttttttttccattatttcttttttttcgtccagccttttcttcgtttttttttctttttttccgccgttttccctttttttttctatccatttttattcgacgttgtttgttcggtttttttccgtccgcttttctcatcctattttttgcatgtttttattcctttttccagttttttcatccgcttttttccgtctctatttttttagtcacattttttagcacgcggtgaggatttggtttttaatccacttggttttttccttcggtgggatttaatctcaaacagtttccctggccaaacctagcgccgccgccacattattctgcctcccgtgcgtttcctactttaattgattgtaaaaattgattctccactactccctcatcatttgatttcctcttacaattctgctttacttcaccagatttaatctccatttaacagtcgtcgtttccctataatttccctttcaattcggatttaattcactagatttaatctttatcagctgatgatcttcccctagccgttgagggagatccgtcttccccgtgatctcgtagtaggatgtgcattatcaactcaactctgctcatgtccccttctgtcgccgtctcgatgccacatattttaagatcggtgtttgtgctgattaggggctgttacatactacctccgtcctaaaagaaaatcaaaccctacggatgcgtgtgtccagattcatctctagagtttgattttttttttacgtatgcccagattcattcctaaggtttgatttttttttacatgtgtccagattcattcatagggtttgattcttttttagacggagggagtaagtgaataacaatttctcttgaagataaattgaacggttttgataattaaggtgggtccaatgccctattttagaattgggcggtgtatttaagataaacatagtaattcaggggatcaaatgggctcacccattgtaatattggaactatttgccacgagaaagcccatagctgtatagccgatttcttgcaccattagtgtgcatctcgttactactagttgggtttcgcttgtttcaactataatttacattccagagctaattttgaattttataactaaattttagaataaatttaggtgttcttttaatctctttcatcaatgaccgtgatgttcggactgataagagtaaaagtgtaaaagtcttaaacggacccctttagatagcagaaatggcaaaacacatgaatagaaaaaacacaatacttttaaaactgtataacgtgcagtagtatcgatcgagacgaaatacacatatacaaattttcaatgatgatctaatgctgtatgtttcttgattgtgtataatataataataagacaaacagaaaaatatgctagtgcttttgtctaaaactgcctgtttggaacaacatatttgggcaattggctaagatatgatataaaatttacccgtatgccgtgatggatcgaggcggcacacttgtcatctttcggtaatacagtaagagttgggccagaatagtattgtggctgacgtgtgggcccagcttagctgaaatggtattggggcttaacaatttttgccagcaaccttaatttgtctattattaatacactacgtttcagtactctgcaaggttacatatcccagatacagaaatctgcatgttccaactacttttacccagtcgtgtaggcttcgatttactccacaatctgcgtacagaatactgctgtttccagaaccaattgaagccatgacaccaatgcaacagtaactcatctgcagtatcatgggttattcttccatgagtcacagcatgtaaagtgagctagatgaatcatgatatcgcagcaagcaaaatacagaaagacaaggccaaatagcaggtacttgctccagacatccactcaaatcaccattacggatgaaacagattgaaatgacagttttttccgtccaatttatgttcctacccttaaaagtttattaggaaattaactatgaattaacccagtcacttctatattcatctgcccgatgcaatatattcctctgaacctttgttactgaagagataaaaaagatatcctcaaattaggcctgaaaagtgagctactggtagaatggtagagtgcaagatcaaaactcaagtttcattatctcatcatatatcccaaactactcctgaaaaaaaaaacactgcaagggtagatgatatcaacagtaataatgtgcaaaagctccatctaatgacaatcacgattatgcctccatcagtaactgagagccttcctctctaatcacaccccagaaagcctaactgagggtcttcgtctctaatccgactaaatgaaaaaaaacactgtaagaatcacaccccagaaagcctaactgacagtcttcgtctctaatccgactaaatgaaaaaaaaaaacactgtcagctgtaagggtagatgatatcaacagtaatgtgcaaatgctccatctaatgacaatcacaattatgcctccatcagtgactgagtcttcatctgagaaagcctaactgagggtcttcgtctctaatcacggcgcagaaagcatccctgtgacatgcaacatgaataacgtcatcagaaattcagaaacagatttcgttaataaaaaaagaattcagaaaagatcagttgcaagttgcaatcagtaaagcaattggcgcggatcggttgcaatcagtaaagcaatcggcgcacctcgatccacgtaacggagtgaccaacgatcagcccgagacccatcatgacgtagcaagccgcgtccaggaacctgccgctgtcgccgccgcgcacggcggcgaggtagatgacgtagagccccagcagcgccacggccatgatggcggctcgccccatgttctcctcgctcctggtgtaccgggacgggatgcgcgcggcggcctcgtcgtcgtcggcggcgcacgccgtcatcgccaaccccaggatcggccccatgagcagcgcgccggccagggcgatggcgcacagggccacatcgcccttgctctcgcaccaggggaagatctcggcggcgaacacggccaccatcgcgacggcggcgatgatgcagaaccattgcgggagaagccacatcagactacgatcgaatccggcgagaaaaaaaaaactgaggaaatcaacacggcttaccctaatcgcgaggagccatgggggcgtcgggttgcacgcggctgcgaccggaggcggccggccttcctcgagcaagcagaaccggagatcggccgccgccgccggagtattccccatgccgccgcggccaggggagggatcgagagcgcgtcggcggcggcgagtgtgcggcgagatcggaggaatttttttcgtttttagattttttttaatatttacagaaataatctatcgaccaaaaaaattacagaaatagcccctgccgccccaatggtgggcggcaagctgacgtggcagacggtgggtcaaccgcgccgtctgccaccgtcggccaaaattgcgattaggcccttgccgcccatacagagggcggcaaagggctaattgcaattttggccgccaataaagagcttgcggccgtacttttttcatctgggtcccttgccgccccagatgtaaaacgtacagccaaaagatttttctatgttatgttaataataaataaagaagtatttattggtaaaacttgttaatattgttataaaaatgtattgaagttggttgttgcgcaatttcatatgttaagtgagatattattttgtaccatattcgacgtattagtactcggataatttatataggcctatcgcagtctgggtcgtagaaacattatatggacttaaataaggagaattatgtaacatgaagaaatagtagtacaatttgaacatgatacaactatttgcattgcggttacatagatgatattagattcgaactaggagggaggtagtgtaatagttgaacacaacgacgatgtagtaatgggacaaggaagcatgacagtagaaatttcaatatgccaagttgtccgataatagctaacccctacgttaggatccctctcctctctcaaaccgcgctttagtaatcctgtattgctctggtagttcaagctgcacaacacggctaggtggagttagaacccttctggtgtctatccattctctatattgacatctccttggtggttcctgggaggaaagaatagatgtaaagcaagcaaagttagtaaatattgtgagaaaataaggattcatgtaatcaaaatattcttaccatgaaatcatcgtcaagaatatttggacaaacaaagaaccttcgacccaatgttgtaggatttatggaacgaagaacctgacaacgatcaccacacctgcatcttggacgggcttcccatggagggagtgcgtagttagcacccgccagtcgctctgttgttcacgacattgtcgttcataagccgtttttctctgtaagtattgctcagtactttcggatgcgaaataccagcgaccttcttgtaaacaagtggttaggtcgagaacgggattttctgtatcgacccactcgatgtatgcgcaagccgtagtgcgggtctgccgaatagagtagtgttacgaagaataaagcaattgcccgtacggaataaataagcatatgcagataataaaatacctcacggtcatagttagggcacctaaaaaagcgccttcctcgaatatcaggattcctcgaagccattagttggcatcgatcaccgcataggcagagaggacactggcaccaaggtggtagtaggtatacacaaggatcgctacgccagtttggatcctcaacaccccggcgtctagccattgacaaaagccggtcggatttgtaatgaagcaagtgggaaagagagtactgaatgtgactgagttctgaaagattgtgaggcctcactcgttaaggcgacttatataggcgcaaaaaatcgagtgatacccctgacatgtgaacgtggtggggtatggtgggtacggctgattggcgccgaaagttacatgcctgatcggcgccgaaagttacattggtcgtatgcgccaaatggcgggcaaatactcgtatcgcacgcgaataaaggaggctgcatcggtgcggcagaaagtagtcgtgcatgcgctgaaaggtatcgtgcatgcgccgaaaggtatcgtgcacatataacaaaaacgtagtcattacacaagcatacagtactagaaagtgaagcaaataaacaaagagaagactgctctactggccctgccccacgccgcgaccacgcttggtcctccgggcctgtgcttgcacgtggtcctgggagtaggtgaaacgatccggtggcacagcacgggtagcacgagtgtcccgcggaggagtggcctgcgcctggtcctgtgtctgcaccggcggtgcgcctcccagctgtgaggggccgatgacgtcctctgtcaagcctgaagcgaagtcgaagtcagaaatgtcgaagagcacggtggaaggcagcaagcggtccgacgaggtcccagcatggtccagtggtggaccctgactcgacgtgctagctgcctgtgacgaagtcccggtgtactgccagaactgcactgagtgcgaggtcgacgcagctgcctgagacgctgaccctgcaaactgggagaagtgggcggcctgcgtcatagcgaactgggcgaaacctacacatcgacaacgggacccttgtaagctaagacataaaatgcatgtaaattgattgtcgaagtaatgttgtttttttaagtacctgtggggggcacaacagaaggcctagccaaggaaggcggggtgctgaacagtgcacgaaaccctgaagcaatcggcaagtgaaacagctcacttatatgtgcgaggcatgtacagaaatagtaataaaaatacttacctccgtgcggagggggagtcggcctaggaacgtgcgcagctggacggggaccagtcggtacgggtggccgctgtacagctgcatctgcccgagcaacgtcgtctgcacgacaggtgagcactcggagaatcgagtgcatcgactccaccatccgcgtgtatgtcgtcaggtgctcctctacgggtaccagaatccccgcgcctaaacgttggatcgtcgttgaaccgtcaacgacgacccggttgatgtcgtcgacctgcatggttaatttgttcgtaaatattcgtaaaatttgacgaagagaaagacatgaaaacataaaggaatggtgcgatgcagggtactcacagcacgagcgaagtcctggtcgcggtgcctggcgtagaggtctctagtgctcgcaacatggggctgctgctccaagggagtgaaggtgaccctagtacgggtgtgtggccctccaggccttggcatagctaatagtatacttgtatgtctcttcgatgtgtcggattattgaccttggttcatatgtgagattatcgatgacatgcgcatacatctaagatgcaacaaatgcacatgtaatgttcttgtggtatttctgaacaccaggtagaaaacatgtatgcttggtaacaactgacactgtccaataatccttccatttccccttatatgcgtgcactctccagggacaaccatatttttccttaacacaccgaacttcatattgcgaccggttcgacttggcaacccaaaactctctatgaagtgacactgcaaaatgttttaccgcctccttcatatcttctgctctactataaatcgctccctgaataacctcattttctttgtactcccatctcacactatcctcttcagagacgatcagcccagaaaaatcctcactagcccattctgctggattaatatccgtctcatcatctaacgaatcaccttcctctacatgctcgttgtcagaatcctccctctccatttcatccacaatggcaccgacagtctccccctcgtcggccactccacctggttgaatgcccactggagctactacgcccccgtcctctcgtgcgttgacctcctccacagaagtctcatttacttcagcacttggtccctcgccatcatccatgttcatctgcacacctggatccttcgggtgaacaaacggaaccaaagctagaggccacccgcgttgcaatgcattttccaaataccatctccacactcgagagttttgaactggcattagttcccaataaaaaccctcattgcccgacttactataacattgattgttatgtcacttgtctgtggatcaactctcaagcccctcattaaccatgcttttatagaaggtacactcctctcagccggtctatcaattcccctttctgatacaataaaatctgacagatctaccccagttggcccgtccggacgtttcctggtctatggtaaacttggaatatttgttgtcgactatctgtcaacgaaataactagatcatattactctttcatgcaataaacatctacaacgtaatatcttcttgtgtaagccaatgcaacggtaatgtattgattccaaactagcagatctacgtagttaccgatatctacaatacgcacttctagattagtacaactaaaaccctaaaaatataatgcatttattcaaacaaatttttaaaaaatacacactatttaactcaatagtcacatataggatctatgaatattacatgaaatcggtatctgaatccggcagggcttcgccccttcttttcttctcctcccctctcttctttttttttttcactggaactgaggagggaggaatgagggctgggggctgggcggtaggccttttataggcagcgaggcctgccgcccggccagagggcggcaaggggccacctgcaaaatagccggccccgactggcttttttgcattcggaccccttgccgccccaccagagggcggcaagggttttcctgcaaaaaaccctccctccgtcaccgcccgttcctcccccgtttgccacgtcagcttgccgccccagaggtgggcggcagggtctatttttgtaatttttttggccgatagattatttctgtaaatatttaaaaaaaaatctaaaaccgaaaaaaattcgagatcggagggggcgtggctgtttcggattcgttggtgagaaaggcccaatttgtaacattagttgggccagaaaagtattacgtgcaggaaaaaagtacactttaactctcttaaaaaagtacgtcgaatctaattcgtacctctcaaccagaaaaccagataagacaacttcccaactattgaaactagtgtaatttaactcccttagtggttttgaagtgtggttttgctaacatggcggtgttgagctggtcttcatcccacgtggcgcttaggtagcattacaacccgttttagttgggcgaatttgatatatatttgtcgacaaattttccatcaaaaatttgacagatgtaattacaatacaatcgtggtataattacactgtaacttgtatgtaattacactataactataatgtaacatgtatgtaactttcaaaaatctctccataacatttatttcggtaaaatggaggttgtgagaacaaatcctttcacatatgtgtgtgatgtgatttttcttcttcgtcaccagaataaattttttaatagatctaacgattcaaaattacgtgaaacttatatacaagttacactgtaattacatacaagttacagtgtaattacatacaagttacagtttaattacactatgattgtactataattgtatctgtcaaatttttttagaagaaaatttgtcgacaaatatataggtggtccccttttatttgggctagatctaacggaacaaatgagctcaaactaatgtgccaaatttttttatttgccgtgcgttgcatttttttgtgatacatccggtattaggtagggtgaaaacggtatggaaatagacggaaaccacctttatcgtttttgtttttatattttttttagaatcagaattagagtcggaaaccccggatacgaaaacggaatcgaatattattgaaactgaaaacggagcaaaaataaatcggcgcgaatacggtaacgaaaatttatcggaatacaaaaatccctcaaactgataaatccaattctcaagtctcaatggtcaacaattcatcataaaacacaatcatataagtccaattgttaagtctcaacagtacatcataaaacacaatctatggaataaattatctatgtttaagagagtaatgctgttgataaatcccaatataggaaaaaaatattattatgtaccctcacatttgcataacaaataatttttaaaaaataacagccaaacaccatggtattcactattcagtgtttaaaaaaaagaatccagggtatttcagtcacaaaatttctggaaatttcgagaaaatttccggaaattttccaaccgattccgagttccgacgaaaactacccttatcattttcgattccgtttccttgaaaatatttccgaatttgtttctgtttttgaaaaattccgaaaagaattccaaccaatatattccgttttcgaaaataggtccggaatccggaaagtttccataccgttttcacccctattaggaactgagcaacgaattgaaacatttggatcgctatataatataattgaaaaagttaatgaaaattgttccttggttttgggtctttttgtgctggagctgatccgaatttggtttattccagtaaattaaaggtgaaatgaaagggagaaatcaagagaaaaatcacgagagaggagggggaattgatttttgcaatcaattggaggagaaacacacggaaagatagatcaaagtggtggtggtcctagggtttggtccgtctgcagagtacaataggtcggatgagataaaaattcgaccaccgaaaaaatagaaaccggatgaaaaaaaacacgaaaaaaaggaatctggcaaaaaaaaaacagcgaaaaaaaagatacgaccaaaaggtataccataagctttacttatttttttaattattattattaggtatagatatagatagatagatatataacatttgttttgttattaaatctatctatacctctgtagttcaacaaatgattccactcattctttcattcatcactcaacggtctagattgtctcgctaagatccaacgtcccagattttcctccacctccccacgaagatcgcaccaaataattcctcccacctgcgcgcgcatacgtaccccctcccacctgcgtggatgccgccgatctctccaaaaatcacgcgctcgtggcaatgccagccggaatcgctggggcggtctccttctccctgaccttcgcgacgatggcggaggcaaggaaaggccgcccatggatctgctgccgaagaatcgtggtgccccttctgcaacaaagtcagaggtgatgtgctcctgcttccgtgcactcctccaatctagtagcgttttcgatgtgcattagacctgctaaaaaggtacttttcgtgttgatctgagttagcgaataaagtagtgtcagctaggctgctaatgttgacctattgctatgcttacatgaattagctatccgagcaatgatagagttaataatgttgctattcttgggttgaggagagtcagtctgctagagagccagttgtgctgagcgtgtgggcaggtgttacaagcacacncatagagagttagaagcgacaagcaagtatgtcatgaaagttatggcggagccagacatttcttgcagttaggatctgagttgatttcctaccagttctaagcaaatggttatcgagcttattcttttattcatcactcaacggtaagattgtctcgctaagatccgatgtcctagatttgccccacctccccacgaagatcgccccaactgattcctcccacctgcgcgcgcatgccccctcccacctgcatggatgctgccgatctctccaaaaatcacgcactcgtggcaatttcagaaaccaaaaaaaaataaatcatgcactcgctattctgccccaaaaataccgcatctcctagccctaaatgccaccgtccaccggatcccctccacctcgccctcaagtcgccacggatccgtcgccggcggacagtttccgtcgacaggtcaccggcaatcgctcaccatcatccgtgatcccccctccctcagtgccgcctcaccgtccaaggcaaccgggcctcgccactgccccatccgccgaccaccgtcgcctcatcgtcaagtcatcgctcccttgatttctcggtgccagctcgcatcaactccacacaggccaagtttcagggcgctagctactcttttttttttcaggggatagtattagttttatatttctgttggatatgaggtatttttttattatgtttgctggagtgcttacttttatatcttttatggtttaaattacaatttcaatgaagcttgattatttgttcttctgtgcatgcaaatggattgccttgtgtatagagtatgcaaaatgttagtttgaagcaatatatattgtgggagatatacatttgttatataattagcaatatattaaaccattctttttattatctgaatcatatatttctgtattgttaaatatatccgtagcgttagcacgggcaaattactagtgtagtctaataacaaaacaaattatagattccgccaagaaactgcaagacgaatttattaagcctaattaatccgtcattagcaaatgtttattgtagcgccacattgttaaatcatggtgtagttaggcttaaaaaattcgtctcgcaatttcttggtaattggtttttttttctacatttaatactctatgcatgtatcaaacatttgatgtgacagcgtataaaattttgtctgggaactaagcagcccttagtatatcctaagtcgcacatgtccgtagcactggattcggtatgctaagaaagcaattcgattgagtgtgcttagatgaggctagcccaaatgtccctgtcacaagcaattgctcttcatgttagcttacctctaaagtctgaaccaccttccatttgcatgccaaaagaaagagggcactgtcgttggttcgtatgcccgatttgattgtgtagctcttaatgctcatagtcataattaagttgtaagcagattgtttgaacgagtctcatcttctgcttgaattgttagcttatatatgtgtcataaccaaaattttatttctagaacttaatgttgacttttttttcattgcggtatatttttcaacattaacttactgctaataacatagacataaaagttttacatgtaaactattttcattactttatttttttttatagttcatgagttagagtcgaagtcaccaccaaagacattatttctctccctgtgtggcaactacttgactcctcatttggcaactacttgatagggctagatgaggcacacctctgtgaagtcagctataaaaaaaatttaagttctcaaagaatatggttatgtatggctaaaatagtggcactctaattgtagtattgaatcaaattgttactcataagcagggacagatccagcgtggccttagagggaggggagggaggggggctcgagccccgttggatctctatggagagagaaggagatagtggagggggaaacaggaagaggaagaaattatatcttaaatctcaggcaaacttgtcacatcacctataaattattacattctatagctcaatgtaagtatgtcaaagtatcattctaaaatattttaacatataatcatccattatttttataatatttaatatacttttatccataaatttcacatcaaagtgtgggccatcatctagtttatcatttatttattatattctcgagctcaatatgcaagcatgttaaattactattccacatcattttgaaatatttcaacatatgagcatccatcattctaaagtatttaaaacacatttatccatgttttcgcagcaaattatggggtataatatattttatattgtgctccctccatccaagaatttaacatactgtttcgagagca

SEQ ID NO: 58079 - DNA, 2738 bp, Oryza sativa
gtaacacgctagctctagctggggacgcgtgccctagaagctctcgtcctgacgggatggggcaaagcgtgcgtcagaccgcctgtcgccacttaacccgtgatctgaccggtctgtgactggtcatagaccggatatacgagtgcactgcactgcgttacatgcggcgtgacacgctcagccaaaccgcaataaatgcggttaggtgagccccgctgtgctcacctaacccatacacgcggagcagaacccacgaggggtcggggcgcctcggccctcggggccgaggcgggaatggtccgaccccctcggggagactaagaggagggcgaacacatcaccctcgggcccgacgtcccccgagggtgccaggccacgtgggcgattgtgtctgcctcaagcctctagtcatgatactcccggtcccatgtcgccgacaacggccattgcggattctgtcgcccatcgtcggaaccgagccgctgccgttgtggattcatcacgtgaaaatgtgctgccgacagcggcgctcccggtcgacgtgccacctcgtctcgagcatccatcgccgcctcttcctcattcagctgggttggttggggagggccaccggctggatggggaaggggaaagatgtggatggagagaaggaagaaaaagtgtagagattgatatgtgggtctcattgtcagatggaagaacttaataaagatgcagttagagtgaaagataaatttgaccctctaacttttctgacaaactagctaaatggacatttggagagtcggatctgaagatactgctgaagatgctagtatatccacattaacaaaaaggatgaaatggtgaggagagagaacatgagcggcgacaaggtcaggaaatcgaatggcacttaaatgtacaaatccaaaggaaacctataaggtcatgaaatcatacatatagcaaaatgcccatgctttgctatggatagaaggaaacaatatcataatatgtcatggaaaaaaatactccctccctcccaaaatattatggcttttagccctgaagatttgttaaaaatataacaacttctccaccaacgttctcttcccaaccaatcacaaccctctatcatttactttttctcacctacctccactactcatccaatcacaaccctctaccactcacttttacctactttctaataaacttgtccaaccctaaaactttttatattctggaacggagggagtacttttttttatcaaatatcttagtctcacttgtttgctcatttgattatctgttattcacttgtttgatcaaatgctggactatttcataatattaaaaaaatatcaggtgacaatttgtaaaaactgtaaaaataaactagaggttttaaagaagtatagataagacatccaaaactcagatacgaataaaacctagtatgccactcttgaactaaaatatgttgtagtatatatgaccaggggcggagacaagggtggggtaattatggcttgagccctagacttaggaccaaattcccattaaaatcttatacaaaatactgtgaaaaactgaagatataaagagatttgctggtcctaggcgtgatcaattattggctccgtcactgtatatgacgcatgttttgatacgatcgataaagcaatcaacgttttggactggtacaccactacacctaatggtggaccagcgccagcaagctagccgccatctaactaagcttatgtgtgtgtacattcaagtgccattcgaaggctacacaacaacagagttgacttcagttgatatgcaactcaagttaatttgcattgtaaaccacaagtacttgtactatacttcgtatattaattagtaaacaattagaattacctcctaaactgttgagatagtacgatttacaccttcaactcaaatactagatattttacaccctaaactattttatactggacaaataacctctcaagcaatattctagacggttttgatctggttttgactaagggtggcatatgtggtgccgaagtagcatctctaatcaacagaaagttttttttttaaaaaaagaaaacataggggttactcatttctatctccttgcacccctctctctctctctttctccccaacatgcgtggcaaggaacaccccagcatctagtgatggtggcggcagtgaggagtgcccaatagtggtagcagcgtcgacagctacgaggagcacccagtgacgaagaacgagcccaccaatggggctcgaggagggcacggctctagccttccaatctgtccgcttctcctcaccgcctctacctccactgaccgccatcgcctccgcctccacagaacacttgaggaagagaaggcgaattggagaggagtgcggtggtggtccccgatcagtagctctgaggcagggtcttgtcgccgccttcacctcgacctcccatatcaggtccgggatgcgcaggagccgcatctatttccaggatgaagacaatggcaagaagatggtgcctaacttctagcgcccaatctgcggagatctcgagctccatcaatactagcttccttcttaagcgagctcccccttcttcgccaccccgagcccaagcctctagcttggctccgcccaacccaccgcccctatccctcgttccgaccgctaccgttccttgctccagctgcctcccccatctggccatcccgatccca

SEQ ID NO: 58080 - DNA, 1835 bp, Oryza sativa
aaatatccaatagatcagaaaatgccccttgaatagataaagatagaccaatgatgttgtacctgtgacatggcatagcatatccaaatataagtttgataagaaaacaactccacagagccaatttataataatatatgcataaataagttcgactaaaatacatgtattctaaaattacatcctcatgtatcacattagatgttctcaagaatgagtaagtcacaatattacaaatagttgaaatacagaatgaaaataatcacatactgcatgatgcaagacaacatggacaaataaataagccatccatgttagaccatgcttatgggaagcatcccacaaaagatgcattatcacctaaatctcgaatttgtaggataccaagtttcgttttagttcattttctattttctttcaggttcaagttgttagtgccaatctctatttaagagatattgtgatccgcagatcgcttctactgtcccatcaggaccatgacacttcaagaataggaacatctagaatcatgtttcaaattcacaagtacaaaaccaaatagtacaaatctgtcaagttccaactaatcatcatacatcagagccattggtctaatagtgtaacatggaccccaaataccattctcctagtacaatagttactagttgaagacaagtatgtggacatgaaaaataatgcacaaattatgaccaactacaatcattgaatctaacaaaaaaatacaataaattaccaataattaagtcaataaaagtagaggttacatagatgaaaaaggcaatcaaaataacatatatgaaatgctataagcaacaaactcacccactcagtcggatttcctccaacaattttcttgtcttgttttgttggacatcttcatcactcatcttgcttttagcactttcaagttgatcaggaagactgccagagatttgtcctctccaaagagaatgtatgcattggagcaactgtaaatcagacaattaacacagttagtatgatagttaagaacgactcaaaggcacacaatattaaacaccgtttggtctatgcaattaagacatgaactagggaattggaattgggcttaggtaaatattgcagttaggatggaataggaacaggaatagattttggagctcaattccagttggatttgaggacaacaaaaacaacacctccacgattcaaatccccacccattggtttgggaggatacctccttatccaccctaaccagctaaccctctgatgcgacctcactggagccatgactgatccagcaatgctgaacttcacagttttcatggctactgaatctgaaccatgcccgcttacttagtgatatagtgtccaaagaccactgacgctgagctacactatgccgccaccaccctgggtaaaatttgatcatataccctccgcttagactgaaattgaggatttaccctcctgacccccatgtaattgaccatggttaccccacgtcattggcatgggaaggtaaatccttaatttccaatctgaagtgagggtatatgatccaatctcccccacgatggccattgcaaataccatggccatcggtgccaccatggctgcaactgataccaagttccatggaagctgccatagggaattgggaatttgaggcgtcgaactccatggtagtcaggggaagtgatctccctctcctacggtggcatcaaagtcgatggtagaatagagaaaaaagctcagactctaagttaggagaaaaaaattccactcgacgcaattctggtcaaaaatatacacaagcatgaaatggagtt

SEQ ID NO: 58081 - DNA, 3095 bp, Oryza sativa
cacaaaaaatgggattatacaattccctctggaattgaattggaggcccaattctatcaaccaaacgaagactcgtgcgtattcaactcaactatgtattaataatattaggttaattgaacatttacctgcaatagaaagggaagcatcaatcttaaaagagaatgaagatcgcagaattgcatctcaatagactccaatgtgctttgtcggagatcattttcgcagaacttcacaactttataaaccatctccaagaaatgatcagagaatagacaggttaggccaaatgcagagtgcagaaatgtacttctccactctgattggacccatattttgttgaggggcttaagaagatagtgaagtacccccttatactgttcagacctgtaaaaggaacttaaaggtaaggaatcactttttgttatataaagtaaagtcattaccaatactcctaaataagtgacatattttccttacaaaaaatgatcgctgacttctataatatcatgttaatggaaaatattaagaattgaacaatatcattctcatttaggcaacctaatatattatacgtgtatcaatagctgattgctaaatatgaccacactttttttagaaaatcatgtatttatgaatagagtaacaaaatatagcaaaatatcaaatgatgtcataccttaaacaggatgttacaacatcaaatgcttcacataaaatattatattctgcaagaagtagacagcccttaacttgatggcaaggtactgcaccattgttgcactgcatcatcaatgagaagactttacagaaagaatatgcttgacagcacattattataatgcatgttaaaaaagaaaaaaaatacccgcattcttgggtgaattatatcatcgaatttatttgacatgttagtactatcagtgtcatcttgatggatcaaactactgcaatcaaaactgctcaattcctcacgcctgaattttagaagatgctgcaaatggagaaaaaaataccacatattaatgtccactatatatttatgttcatatagttcctgcaatagacattttacacatacaaagcattattaataaaagagaacattcatatagacctgaagcatcctagcaccatgacgctggacctcaggagggaaatcattgctgaccaacagaagagatgcatccaccaacaagtcgacatagcctttctctctctcttttacctatccgtagggatcaaacaagatcagtagttatatatatagtttggtagatagaaggaaacaaccaaagaatgagcaaaattttgaagcgtgcaaatccaatacactagtagattcttaaaactgtgctagagaaccaggagatgcataatctagtgctgcataaccacattattttgcccagcgttaagcgcgagaaggcaagagagatacgaaccggctccggctccaattcaacagggtaggaattcctggcgcaagtattgacactgctacaagcccaagccgcggcgggaccagcggcgaccgaacaagtgttcatcttctcagttagctagctgagaattgggggagaaaaagggaaaaactaggttactagacctagttggcggcggcgcggggcggagacggaaagagagagagaggctccacctgcggcggcggaaggccggcgcgcgtccaggcggcggggagagcgccggcgcgggggcccggtgcgtgggggattcggggcgtggggttagggggaacgaactagtacaagtcgacggggttggctgttgcgtgcgcacctctctttatagtctcctcgcgtagttgcgtacatacgttatacaaatactctacaatggttgtacgtagatatacaaagtatatgtgtgtatttatatatatattttttatgtataccaaaataaattgacgtatacacaatatacatatatacaaagtactccctcaaatatgaaattagcatcatatgaaagtattttaaaatatgaatatatatatatatatatatatatatatatatatatatatatatatatatatatatatatattaaatttgtttggtgttccatggtgcccgggcaccataattgaaattgagtatatacccaattcgaatgagtatgaaacttttttaaatgtttaggtattaacattaactactgtaatatatatatatatatatacacacacatatagagagagagagatgggaggaggagcctacggctcaggcaaccgatccgattggaacaaaatcgggcattgatgtcagcacccgatttacgtggaaaactactttaaactgatttttctcctaaattacttatccaaatcattatccgattgcaccattaaattcattgcaattaaatcttcaaaacaagaccacacatggatatattccgatgaaaaaaaagcttattattgaattatttttaaatgttgcacgatgttccaccaggtatatcggaattgtttcactaagtagatcgaaaatgtttcatttgtttaaatcgggtgttgtttcatcttatataaaaacaatgtttcagtaaatagcgaaagaaagaatgtttcagttcactacaatattagatctatacatagtgaaacattatgagtacattaggtgaaacatttttcggtagaatggaaaataaaccaaattcccttaataggggtttccaaaatatgtgtttttttttacaatggaatgtctagttcactgcaacattagatttagacatagtgaaacattatgagtacactaggtgaaacattttttgtggaacaagtaataaaccaaattcccttaatatagagtttccaaaatatgtgggtttttcttttgcaaaacaatattttaattcactgcaacattaaatttataaaaagtgaaacattctaaatacactaggtgaaaacatcttttatagaaaaaaaggagggagaagtgatgggcccagtaggtagcacgtggggggagggggggagggggagcgcccgatccggttcccccgcgccgatcgtccgagcgtaagtattattgatatatatatatatatatgtgt

SEQ ID NO: 58082 - DNA, 3833 bp, Oryza sativa
acctgtggaagatatgcaatcaatttagtggaagttccagtaacaacctaaaaaaagttaacataaagctcttcagttaattgcaaggtgtaatctacattgcttatgatgcaacacctggaataaaactaatgtgaacaagatttaatgttcaaccttttcaaaggtttgccaagtgttatccttctcttgtaagattgcccaataatcctgacatcaaaatcaatttgaaactagcattattaattattaattgaaacaaaagagattaatgttcacgaagaaagacttacaataattccttgaatagtgtaacgcctgggaagggaatgtcctgtgaaaacttcatttttgaatttttctacaagctttgagaaacactcattgtcctacataaccaatcaataaaattaatactgtgtaagccttgaacataaaaaacttattcatttactaaacaaacatacccaattgacagagttactgtcgatgtcaaaaaaaccttcagcattgagctcactcatcaaactcatcagacgatctttaagctgggtttgttcatatcaattcagaacttagtcaacccaacaaaaaaggcaatgtaaaacgtgcatttctaattaatacttatcaaatgtttactagcttaacgaatataatacatccctgtattttggctggtatttataaaatggcaaataaataaatatttgtcagttttcttgtttactgatccagcttgttagattaggaaattcacatgcaccctttttcattaacatgctttgtgctatcaacatttaaattaagacctattatctagttgctgatgtcaagcgttcagagatcaaacaatcacaatgcagttgtgcatcatatacaagatttaaacaagtccctaggagtctaaacaatatatatgaagtttctatcaagcaaataaatcagtcagtggtactaaagtttttaccaagccaataaacagtcaatacaatatacttcctaaagtgcaaataagttttcaggaaaggaaaataagacgtgatataatcatagctttcaggatctgagcattcaaaagaacaggaaaaagtgaggatttcacatattctagggaaaaaggtttccaagatgcgaaaaagttgcccaacattaagtaatcttgcattcaatatgaccagatttttttccttttttgacaaacccagtgtcacgaagatatttggccacttaatagacaacggagtgatctgtgatctgaatatccaatgatgtgttagagaaagcaaaataactatgacatctaaatggttcacagtttctaagttgagcagattttgctctgcgcatgaaaggggaaagcgggggatgcctgttttccaaatttcaattcagcaaagcagacgaagcttaatatgtcccaaataaaacggtatacagcacttcgcattttttatatgctgatatcttgtaaagaagatgtacatcctaagaactccattttcaaaatatgcactcttggagcattttgactcaaacaaaacagatgtaaaaggtttttgctttataacttggaatggctgaagatttcctccgaaaacggactgagttggaattgcattaataaattctttttttctacgggattgtttataacctttctttagtatggttctgcttactggcttactgttaccaattaaaaaaaaaaactacaaagtggcacctacaagagatgacatatggaaaccaattaaccagatcactcgaacacaccccaaaacatcctcagttctgaatttgcaaaattagttttatcagaagatggaaactaaatgttattgtagttcagggtgacaactaaacacaagaattaagttgaaggaacaaaattggaattctcgtaaagtattattgcagtagtgttttgcatttcataccgactcattttcaaggaggtctcttagacacttcgagtatgtgcatacttgattatgcatatccacaatctgagctcttcgctgcaaaacacagatgtttttcaaggaaaaaaaaattcatcaaaacagatcttctaggaaattctgtaaaaattgcttagcaccttgagagataaatggataagatcatggtccaaaactgagaatttctgtggcactgcattattttcaacatcttcatcagaaaaatcctgcaggcaatttacagcataattaacatgtatttatgaaactctgaagtaatttattatcagcatttattagaaaaattgttgtttatacctctgagacatgtgagtagatatggctatccagttgaccagaagctagatagttgtcataatcctcgtgcaaatggatttgcattgcagccctagcatactgaagaaatagatatagtattcatacaaaaatggaagtggccaactggccacagaacaagaaacaccaaaaagtcgttccatctaatagactatggaaatacaaatgtcttactcaatatttaattattagtaatatatgtgtgataataactacggaaatatcatcaaagcgcacacaataagccatgcaacagtggaagtttgacggttacatgtttgatgagagagagaaatggacaatattacaagccttccaacatgaagtctactttcaccaggggcaaaaggtttcatgaagttgattaataaaaaaagacattcggtatccctacagctgtcagcgtcagggatgtattatttaccaaacttctttattagtttgtaatgttttattccttctatcttatagttaaaaatatgagcagcccaagttatgctattccttctatcttatagttaaaaatatgagcagcccaagttatgcattatgtgtaggactatagacaactaagcataataagtgtagcatcaaagatgcatccatttctaacccaagttacttcttacagtatcattctcacttccactaagaatagttagccatgttggtaggtaaataacacttatacgtatgccaaagttgatacaattaattgtgtggagggctctaggcagtgctaagccccaaactgactgaataattaccaaaaagttcatcaaaatgctgttactgacaagaaaaaagtgttataaactcatcatggtagcatgaagtatacttgataaaaaagaacatcattacaacaagcaccacctgattagcatttgtagtacaaaatatgcgcgagaaaaaaagaacagtatatgaacatggtgagtggtatttgtgacagcaactttcacaacaatctaaaaaaaaaactacagaaatggcacccattatatgatttcctagttatgcagctgctacacatgcagacctgcttggacttatgttagtttagtatacttcagttacagttggatcagaaccaaatgttctaagatgaaaaaaaaaagacttgcaaatctgaagtagatactaagccttaaacgaattttctaatctatttttgtgaacaacaaaaagttatactgtgttgtcttgtaagctgagaaattttgtcagtccagtgtttgagccagtgaagccaaaaaaaaaaaaaaaaaaaaaagggaggagtgctcccatggaccacatttgacagacttcaaatctgccaggatgcaaacatgataagcacaagaaaaaagtaaggcaagcacattcagtccattggcatcacagatactgtttattatcagctaaatggtgtggcatgggtggaagaaaggataacaaatatgtgcacgtgtggaggcgaggatcacatgtcatggtgggatttgttcctatttgtgacaaggggct

SEQ ID NO: 58083 - DNA, 11533 bp, Oryza sativa
cctccctcctccctgtcgccgctttggccgcgaccgcggagcgccagctcgcgccttgaccgcccaaagacggtttccaaaccgacattgccgcccttaaagccccgggtgccctcccttcccctttcccccccattcctccccgtttctcgtccgcgccattgccgccgccttccgagctctgtctcgcctccgccgttcttcaccaagcgccgggagagccggtgcgttcgaggacgcggaaggggactccgggcgctcgtcttcctcctcttccccggcccgaggccggagagatcactcccgcgccgtcggcctctcgtcacagcgcccctcctcatctcggtagtgcctccctccgttcttcctcctcgctccatctctcccccttagttttcggtagtagcacaagtagcctccccgtagctagccggcgccgccccgaccgttgccgtcgctcgccgtgtgctcgccgccgtcgccacccgagctctgtagcacccgctcgtcgccggcctcgctcggcgtagctccgcccaatccgacgctagcaacggattcccgtagccgcgtagatgctctcaccgccgggagttggtccctcgtggcctcgtcgccatttccccctttgctctccgccggttgccgccgccgaaatccgccgtagacgggctccctccggcgaatccaagccgttggctcgctccctctccttcttcctcgtcatcccggtgtgctcgctttcgccggtatcgccgtggttcgctccgccgctcgccgctgtcgtccgccgtccgttccggccggcgtcgtcgtctacctcccgccggcccgcatggctgccacgtagacgccacgtcggcgccacctcggccgcgaccggatcatccgacccggccagcagctccctccgtttttcccccgtacgcatggtccgcggtgagccgtgaggctgcgcgtgggcccgccgcatccgttcctccgcgaaccgcgcgcgtgcactgcgtccctcccccgcccgcgcgcgtgagccgcgtgctccctccgcacggtgagccgagccgctgacaagcgggtcccacacgggaccgcgcacggtgagcccggtccaccggctccctctctcctctcctcccgcgcgccctactgggccgaatccttttgggccggccggcccattagctcggccgagccgcgctttttctctcgggccgcgccctagccgcccgagagaagtctacttctcctccctctttcttttctttttcaaaaaggatttaattaaatccttttcctttagacaaaaaatccaataatcttagaaattcaatatcttcccaaccgtaaatccgtttgactccgttcaacttccaaaattcctcaaatctctagatctatctaatggcatgcttagaggtcattaatagggccttattttcgccgtttgttgagttgtcccgtttcgcgtgtagtttcggagcccgaagacccgcagtgcgaggatttcgaggatcaagttccagatctcgagcaaggcaagccacctttgaacatcttgagcctatatttgaaatttaattatattgcttgcaaaatattatgcattgataggaccgcacttaatctgttaagtcccgtctgcaaggcagattggcggacctacctagtttgttgcatttgatccttcctatgttaattgatatatcatgtccccttgtaaccatctagattgcgcctcgatattcgtgcaccctgtgcgagtatcgacggttgccttcaaacttaaaatctgaaaaaaatttcttgggtaaaaattgggttttacaaaagacttggaaaacccgacacctgggtcggtgcttgcgaactaaatggatttccaaaaccgcggaccggggaacgtaccgggtgtacggtttcccgctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggactcctctcgtcggcatatggtaaacctgtgtcggctttggaaatgccttgtcatgaaagcttggaggtctcccgatgtggctgatccccacgggctgggtgatccgggttagtaatgtcgtgtgggtaaagtgtaccccctctgcagaggttaacaaactgttcgaacaaccgtgcccacggtcatgggcggatgtgaggtggttcctagcgtagttttgtttgactactgcttgtgaaattgctgttgtggaaaggggttcgatgattgaaaaatctgcagctgatgggatcagctaggcccgggtggccgtttgaaagttgttggcccgggtggccgtttgaaaagctgttggccgggtgccaaccttgtttcaattctaaagactgatacattgcacatactccgaccggacaagacgcactgtctcatccgtgtcgtttgagaagcactcacttagttgttttcagaaaagggttcaaataaaatcaattgctaaaacaacagcctttctttgaagcctgcattaaacacttatttcccatggcttgctgagtactcccgtactcacccttgctctatataaataatcccccccagttgctgaagaagatgaagcggatcctgctgatgaggaggtcttccaggagcaagccggctacgatgagttttagggtttcggcctagttcccaagtcgcgcctgtgtcgtttggtccaactcctagcttccgtttcccttttgtagtgcagttgtgagctcgggatctgtccgcagcccaacatgactgtacatctactctataataaagagacctttgttgctgtgatattctgtctccctgtgataccagcactgtttcctgggactggtatcgattaacaggttaatttggagcgtcacgggctagttccggtcgggactagttcggggcgtgacactcatcatgaaccgtgtcgggttcgtcctgactagatccagatcccttgggatccaccaagagaggcttgagctcggcagcggcggcgagggggacgggtgaggcgcgggcagcacgaagtcgagcggtgaggtcggctatgaggaggcagcggtgaggtgctcctgccgctcgtggagctcatggcgggtggcgaggaggcggtcggagaggcctagggatgaggagagcggcgcgagcgccgaagcgagagaggaaaggggagagagatgaagagatgggagatggggagagagaggaggaagaagaggggtgaaatgacatgtggggcccagggccccgccattttttattaacttgtgtgtgaaactgacatgtgggtcccacagggtttattaattttccgaattgaattaccacgtaagcgccacgtcagtgccacgtcagatcgagaccgagtcaaattagccacgtaggcgccacgtcagtcaaaactgctatcgaaactgccgagggacctaattcgcaccggttttgatagttgagagactcgttgtatctggttttgtgattgaaggatgaaaatcggattcgttgataagttaagggaccttagatgaacttattcctgccaaatatactcaactggaccacgtacaggcctcaagagtcactgccggtgaagcccatgaagttcgttgctgtcaaaccaaaatacagagatattataattaaggattttccaccgaaccatatatcatataaacacaagggttcagatgttgtagactactagcgataaattcttaattaacacatcttataaatagcaattagttaaataccccaaatatcctagttggggtataactgtacaagtaataacactaggtaatatagtaccgctcaatcaaagagttagaaaatagttaacgtaaattagtgggagataattgtatagtaacaaaggatttcaatactattcaattcacttgctcatacaacgtgccctcagtacacatctttatttgtttatttattccaagctagctgaagctagcatgctaaggatcgatacaaatttatcatattactgaaattaaacgtcaacacaagtacttatttgaggaggtctcacaatgatcttatattcttatcaatgcacggtgaccttagtgtatttggtcatatcgatggtggcgcgaccggcagcagcaagggggaagtagaaggggtagatctcgtaacgcgcccagcagctgctatagtcgatctggcaccctggtccgctaccacaggccttatcaaacttggacactgctgccgacaggcattgcgcgcacgacggcggcgataagtctcgtgtgcactgcgccaatgcgtagacactcacgaatggggtgtattgctccttcgccctacctagcccgctgctgcccaccgcaacggcttgcgctgttgcttttcccattgccttccccgctgctttctggaaagccttggggttgtccatgtccggccattgtctcattgtcacgcttgcatcctccctcgtgtccacctccccaagaaagttatagttgtcgtaccgcatgaagcaatactcatacctacatgtacatatatacatcccgcataagtacataaacaactagaaaattaaacaaccaatgtgaaatctataatttatcacccatgtgtactctctggttccattattttgtcgctttggataataacacggtctcaaaaacatatgtttagctatgatttttattatagcatattatctccatcctaaaatataacaacttttacttataaatctaaacaaaacttatcccaacttatagctaaaaatatttatattttaaaacgaagtcagtacacacaaataagtaaaattttaatattattaaagtattttctaagactaatctatgtgttgcgttctagctagcattctcaaattaaactaaatattttgaaaagaatgacggtcaaagtttaaactgttttcaaatgttaagaattatgtaaccgaagagattacataacatgcagaattaggatccacagagtatacatgtgtaccatagcctggagtctgatgtatagttgcagtaggagaccatctgcttggcggcttgggcgaggcaggcgtcgcagtcgccgccggagacgtcgccgcggcactgcgcgaggccgtagaaggcgtcgtaccccctgccggccttggaggtggcgaatccgccgccggtgcgcgccttggcgacaaggtcggagacgacgaagttgatgctccgccgcctgacgacggcatcgctgccgttgagatcgccgtagttcatccccggctcccagcagaagctgccgatgggatacgtcgtcgtcgtcgccgccatggccagtgggagcaatgcagcggccaagaagactgtaagtagcagctggcttaatgccgccatggatggcgccaattgctctcaattcagcctcttgttgctactggagtagcagtagtagtagctagagatttcagtagaggaggatggctttagcttgtgtttgattgggatcgaatggttggagtttatatagagggaggattggatggggaaggagggattgatcgattgatcaatgtgcttgcagagttgcagtatgttaactgcaggcgaacaggtttcaaaatccttgttctaattgtttgcaaacttgtttttgactactactgttctaaaggtttgcatgcagacatgcagtgattagaactgtgggcgcgaagctatattattgcacgtacggatgacactcttgcagatatcgcggactagctaagctagctggctgagctggctgctggctgcctgcttgcttgctagtaccatttcttgtgggctggctgtcactagttttgacttttgagggatgaggtgatggattggataaacctatcatgtctcttcactcttcttcaaccaaacaaaccatgcatatatttaggattaagtggtcaatttacttatattacattgctcaatcaatccaaaactaaacagcccatatatattgagaaacacaacataaatgtaagcactcacaattagttcgcacgctcacccttataaagatacacacgcacatgctctaaaaaactagctattgttgtcgacgggttaatcgtctatactgaaagaataattagctgtaagtgcgagcacccacgtcaaatcgagaatttgaatccagatagcttagttccagcataagaaatctaaccagttgagttatactctcacttcactgaagagcccatatatatatatatatattagtgatgagtgaagatgaaaaagctgaaaaactattcggttgcagcgttgcaggacactgtatagtttgattgagtttgttttcgctgaatctggttggatgaaaagcaaatacactatccaatgattttgccaatttgcaaatactagttgattcttaggcaaaatccactgtatatagtctcctgtttctgcagccaaacagcccaaaacccagtagcccaccgatcgagaatctaattgcccccgcaaaaaaaaaaagagaatctaattgcgaacacgtgcatcgatccaattccaaacctcgtgcgaatttggcgccataccgtttttgtctaacgctaatgatgatttatctcctaaatgatatacatgcatccgtacactcagcttgcacgaatcctgcgcttgcatattgggcctatttcaattgccaatttaggcccagtaaacagaaagtgcatagaatatttctttttcctttctaacttgttttttcaattcaatgtaaaacatctataaaatgtattataatagaagttttttttcttaaagtcctttgcaaagtttgtaagtagaaagtttctttattattcataaattatctaggtgggaagtttactgcttacacaaagtttttgagtgaaacatttactatctatatacataatgtattctgatcaagtagaaagtctgctatttctgtggaaatttccctggtgtttagatgattatataccaaatattccttttgaaaacgaatgcataattaagcgtgatgggttcaatcgcgtgaaatgctagttgttcaagggagtggattctaactctcgacgagacatcccctcgttgtttacatgtcatccaaataattatgaaaaaaataaaacaagatagattaatatgtgataaatcactccacaaacatagttaaaatttaacttttacaagttgcaacgaaaaaacaaattaaactattgctaacttgtactcaaatttgttttttttttcattgcaacttgtagaagttaaatttaacctctcgctgcagccacatggcaaggggcggcgcttcacgactggattgggccttcacggccggatctggttatgcaatgcggtagtggccggatctagccgaggtcgagtaggaggtgtgtcgcggctggcagctgcaggatgtcggcctcgggcactggctaacggcagcaagaggccgatcacgggcgaggtcgcggtcggcacggccaacagcgataggagggaggccgcgggcatggcgtggagcggtgcgtctggccggtggcggcaggagggcggccgcgggcatggcgtggcgcggttgcgattgtggaggttagtgaggacgacggtgagcgcttaccgcccgcaccgacagctagggatgggcattcggtctaaccgaaaatttcggtctcggtcttcggtcttttggtctttgaaaagtgaagactgaatttcagcgaaaaaatgtcaggaccgacaaattcggtctcagtcttttcggtctcggtctcggtcctgaccgaaattcaacaacattttcatatatgaaaagaaataatagaaattttcaacacaaaaatcacaaaaaaaaaatcgtaagcacttatgagtaaagactcttattaggtttcatgcctagaagaagtagggatgtgaaaattagagtttaatcctattaaacatagtggattgtaggttgtatttagatattttttttgataattcagtctattcggttacccgaggagactaaccgaattaactgaacaaaattcggtctttcactgcctaggaccgaattgatgaccgaatttcttggtctcgatctcggtcttttcggttcggtctttttctgcccacccctaccgacagcgggggctagtagcaatgccgtggcaaatatgtgagcttccggagtcagttcgttcttgctagctagccatttccatctccttctccaggaaacacctccccggctatggtcgactcctttcgattgtggggagctcttttggtgagatgtcggcaatggcgtttggaggacgatgatggtgatggggcttttgtcgtgctggtcagcaatgggagccgcgaggttccccatgacctgctggcgaaccggtggtaatggcggctccatttcttaggggacgatggtggctacaatttaggatagaaggacaacttggcacgatgtggttaaaagtgcttgcttgcacacttgagagcgggcgcaacatcggtggtggaactgtcctcacagcacattggtggaggccaaggcgaaagcatggacgctacgggcatcgtcgtttactcgttggaggcgtcctttttgtctcctcgtcatgccgtgtttggattttgtgggtgtaaacctagcccaagatgatggtggcgtatagcttgacgtcgtgcctcctgaaggcatattaatccttggcaatttcataatcatgctccactttgttatggacggcctttgagaagtcggagctgctgcgtcgaggtggttgatgagtttggcaacaatataaatcggaagttggagctgctgtgcaggtgcgaatttggcaatgatgacccaagtaggacctcgccctttgagttttcgctctagtgtggggtagcaatgcaagcttgttggtcggcaagcctttcctggccttagcgtttcctagcgaagttggagtcgcctgtgatggtgtgatgacaataacgttgcgtatctgcctttgcgaggagccttgtttaatcttccaacttgctacttcattttgcaaggtttgtggtgaatagcatttgttgaacctggcttttctgtttttcatagccttgtagttaagatttgccattttctgtttggtacaatagttgtggttttcacatagtttttcctaattaacaatgtaatataaagtttggtctcgttttcttcttaaaatgagacaaatacttctttatataaatgtcggcaatggcatgacctttttttctaaaaaaaaaactatttgttcacacgcgcgtacatcatacctcagtacacatctttatttattccaaactagcagcatactaattaagaatcaatacagcttataaatatatagcctacaacacatgatttattattgaaataaaacatcattagaaatacttgttccgggacagatctcaggtacgcataacataactatactgctatgcgttacaacgtgtgtatgcttgcatgtatgcaatatcgtattgtactatacacgcagcctatatatatgcgagatttattcaatgcatcgtgaccttggtgtactttgtcaagtcggtgggggcctgcctgttggcctcgagtggaaaatagaacgggtagatctcgtagcgcacccaacagctactatagtcaatctggcacccctgcccactgccgcaggcctcggcaaacttggaaaccgtcgttgacaggcattgtgcgcacagtggtggtgccagatcccgcgtgcattgtgccaacgcatagacgttcacgaatgatgtgcactgctccttcgctctgcccagcccaccgctacccatcgtgacagcatgcgctaccgctttccccgtcgcctttcctactgccttctggaacgccatggggttgtccatatccggccattgcctcagggtcacacttgcgtctgtcctcgtgtccatctccccaaagaagttgaagtcaacgtaccgcatgaagcagtactcatacctgcaagtacatatgtacattgcccgcacaagcacataaacaaaagaacgttaaacaaccagcatgtaaaatctataatttttgccactcaagtttgctctccggttccttcaattttgatgttttggataataacacggtctaaaaaacatatctttcaactataatttattttattataatatacccaaaatataagtaaacttttaattttatttaagcacttcttaaaaaccgatctatacattatgttctagtgttctcaaactaaatattttaaagatcactaatagttaaagtttaaattgtttgaccttaattttatccaaaacgttgaaaattatagaaccgaagagactatatgacatgtagaattatgacacacgcataccatattctggagtctaatgtatagttgcagttggtgaccatctgtttggcggcttgggcgaggcaggcgtcgcagtcgccgccggagacgtcgccgcggcactgcgcgaggccgtagaaggcgtcgatgcccctgccggcggaggaggtggcgaatccgccgccggcgcgcgccttggcggcgaggtcggagacgacggagttgatgctgcgccgcctggcgatggcctcgccgctgctcatctcgttgtagctcggattccagcagaaggtgccaatgggagacatcgatatcgtagtagccatggccattgggagcaacattgcagccaacgagagagcaactagtaccaggcagcaatggtgcgatcttctgcttggtgacgccatggatgctagctccaattacttctcacactctcacttcaccttcttgccagctactggagtagtagctagagatgtgagcagatgtgtgtggctggcttgggttcaatcgggagcagtggttggagcttataaattaagacgatcgatcaagcgcgcgcactggattggatgggaaattaattaagagagatcgatatcatgtgcttgcgatgcagggaatagtacaggacatagtatcataatccttattgcagacttgttttgactattctaatggtttctaatgtcgagtcagccatgagccatgctcgtccatgcactggcagcgtgtgggcacgaatgttactcttgcagacttgcgtcgcggatatcgtggactagctcgctgccgacctgcttttcagggactacttttgccacagggttttgaatagaaatttcggatatttctaacgattattttttaaaaaaattaatacatttttactgaatttgaataaattatgatcaaattctcacaatatttgaaaaaaattgaatatttgccggaccgcggggggggggggggggggggg

SEQ ID NO: 58084 - DNA, 17275 bp, Oryza sativa
attcgtctcgcgatttcccctctaactgtgcaattagttttatttaaatatatatttaatgctcaatgcatgtgtccaaagattcgatgtgatgctcttaggaaaattttttgggggaactaaaccaggccttaggtcgacgccatgtgttactaccataatccctcatgttccgcgtgcacgcttttcaaactgttaaacggtacgttttagcaaaaagtttctataggaaaattgcttaaaaaatcatattgatctattttttgaaaaaaatagcgaatacttaattaatcacgcgctaatggagtgcttcgttttccgtacgcgagatatgtgttgccaacctagctgccgaatacaaccttaggccattcacagttcatcacactattttgaggagccttagagtgccatgtaggctaaagctacgggtccaaaatctggttcatcacagtgcaagtggctctaggagtggctttaattttactccctccatccacaaaagttagacatatttcacatttgagtttttccaaataagttgttcctatttgtagtctttatgcattcaagacttaaagacttaaagaagagataaattaaatgtttgattagaacccaaggagtcatataaatactcattggttgcatggtagcattcgcccaccaatttatcatatgcctctattaatctagtcttagcatatcgatttagctctatcggttgcttcttgctttagggtttctgctagtatcggctaaatcgtcttgctagattagattagcttagacatccaccaccctgaaaatcagtcaagggcttgattgtttagatattgtgtttcttttcatacttagtgctgcatcagttaagtttaatctactaagtcgtacttaaaaccataatctctagcatactttttgattgccaataagggtttcatcagagtttcagccgatgaagtatctagacgtcgcatcggcttgtaaggattacatactgttgatgtgaaaacacgacggcctgggagatctgcttaactccagtgcagttccaaagctaggctcgagtgtgtcaatgccagctgatttgatcctacaatcagcaagaaagaataaaagcagaatcagtcgatcgatagcgtatcagccgacggagttagaccaaatcggctatggactggatatatcaaagaataataaaccctaaacatacccaatcgactgtaatactatctatgagttcaatagattgatttaagacaatattatgaaagtagtcaatgtgcagtctgttgacggtcattatcgatcagttgcgcccgtcaatattaccaaaataaaagataactagttatgctcgcaatgcatatttatgttagaataagttatattccactagcactaggattctaacctcttcaagagaataaatacaaaatggaggagaatcagtagcaaaacatacaatcgatcaatcagacgctatcgagaatcagacttgcggacaagtgggctgagaacaccaaattgacacgtccaaaacagcccaaaattcacaagtatacagaaaggagcaaaagaggaggccaccagccgagacttgcgaacaagtgggctgagaacaccaaattgacacgtccaaaacagcccaaaattcacaagtatacagaaaggagcaaaagaggaggccgctagccaagattgtgctggtttggcctagcccatgaacccgccgtgcaaccgtttgatgcagggctggcgctggacggtctagatttcttccctacagcggttggagggtattaccgcacatttccaactgccataaccatcattactaggctatttaaggccttcacctccttacttcttccacatactcaagcaaggggcttctcatacattctctcaagttcagttagtctctacaatatagtggaatagaaatagaatagagtcttcagtcctcggagttttcggaagaattcgggtatggctctagtagcttttccttcttttgtaagacatgtaatatttatagaattttcttttcaatatatttacgatactttgcttcattctaatcatttgggtaccgacttttcgatatattattcgagatatacttgtctagctagcttactcaggagatgcaattatgtgggtataatgttcatttatatgtttgcttatttcatgaggatgatagtagagtagtatttggtagcataagcgaggtgcttaggctattgaatattattatttggggttatatgctgcagaacagtagaggtgggccgctgatggtgatagctcagtatgggtattcctccatgttagtatataatcctaagttactttcctgtggagggtactcctccatattttgccccatttggatggcaatgaagggttgtcgtaaggaactcggcaaccaggggtggtctctcgaaacgccaggagggcatcgtaaggggggtattggctatataactatatagtagataatattgactaaagttgtatgtatgtatattagaagtataggaaatgattattttcttattcttttccactcagcctagaatcagtatgtatgagaatatcgagtgcttctgctttgtgtcactctacccttgaaatgaattaacccctgcttagattttgattatcacaagtaacatataaatattagcttggttctctctattataatcttcccatgggattaaacaaatacgatacccttggaatacttttaggtaaaatgctacaatggtatatccgtgcgcttgcggatatggtctgtaaccataatataccatgaatatttctgtgctattgctaggaattatatttctagtaatgtcgttaagaaatacaaccacagtccaacttcgaattcagttagattcaacaccaaatccgctttgatcttctttcttcttctccgaatttgctgccaaattccgttgttaacacatacaagttagagttagccgatcgtaacagaggtttcactatttatctaatctcgtggattttatgacatcggacctctagccgatgtatgctataaccttcggatcagtgcttattctatcatatcattattagccgattggtttctactagattatattgttgttttgttacattatcatcagctgattgtctttatatcatttatttactcaagtatcagactctgcattggacatacaaccgattgcttaaaaccctatcggcatcgacatacagccgattgcttaaaaccctatcggcaccggctaatataggcatcggctggaattactccatcggcttgatcagctcattgatctactatttgcatatcttatcagttgcaggatcaaactgactggcacgcccacatctcatcaacttttggacctgcactggagctaagcagatctcctaggctgttgtgttcgtcgacttagttcgtgccaatacatttccggcaccatcaaccgagcgtggatttttcatcaacaccaccccaccgtcggcgcgctctctccctaccaccacaccaccggtgcacctctctccctaccaccccaccgtcggcgccacttttcctcctcatctccgccgggctatccctccaccttccccgtcggggtgtcggcggaaatcgagcgacgagctcggcaccgcgtgcggggagaggcgaccgaagtggcggcgcccgggcggagaggtggtcgaagcggcggtgaccccgggcggagaggcgccggatcccccctctctcctgtgggatgagctcggggatgacgcagcggcttgctggaactccctctctcctgcgggatgaactcgacgacaatgcgggcctactcgcttgtaacgtcccgcctctcccaggccgggaccacttacatctggcagcttttcttggatatagactgccctcacagacgaacacaagtcttttctgcacactttgtcctcactcatgtgcacaggggaagaatttcctggtcagtcacccatcccgaaattgctccaggccaagaaaaagaagttgcaacttgttggtatgagtattctattaatcctattaaaccctgggccaggatgtcacatcgctcactcgtacacacgggacggcaaggacaagcgcaggaacgacgaaacgaggtaacgacctccacaacgtgcgcaagtgctcgctcctcacgccgcttgccctggatttggccgaggaacacgtgaccaaagttggacgcgcggacttcaggtagatgcggcataagctaatgtggcgtggaatattcgttcgggaacgacgaagccgaatgtcaactagactgtcacacccggagtttctcctttttcgtagtttctgattcaccaataaatcgtctatagaaattactttggttaaccaggagaaaacccaaattaacaatgtatttaataattggaaatgtcagggagaatttttttcgaattctctttgctctaaaatcattaataggattttagagcaaagaatgttgttaatttaaattgtaaagatttgacttaataataatctttctctctcacctttggtcatgaatagtgcccaattcactccctcttcgtctgcggtttcgttttgcatgatgagtcgggtccgtttctgtccgcgggtccgtttccgttcttttccaaaaacggcaccgcatttcttttccaatttgggaaagtccctatcctaatccttttcctatttttgtcctcccactccctatcggcagctgctccccctctccccctgccgcgcgccgccctcccctccccgagtccgaatcggcatcctctcccctctcctttgccgactcccctccggccccatctcttttagtttttcccctctcctataagttagaacccctatttttcctattcgattttggtttagccctagccgccggccgcccaccctagcgccaccgcccgccgctgtgccgccgcctcccgtcgtggccgtcatcaccctagcgttgccggtaatccgttttccctctccgtgccatggctatcgccattatctatccagttctaatttatctttgttctaagttttgatctaacatcgccgtcatctctgcgtgttgccgccggaccgtcgtcaccatcatcaccctagcattgccggtaatccgttttccctctctgtgtcatggctatcaccattatctatccggttctaatttttctccgtcctaggttttgatctaacgttgcagtcgtctccgcgtgttgctgccggaccatcgtcgccgtctcctcctcgccgatcatctcggtttggtgaggaatctatccgtaatctcctgttttaggtgttaattcttttagtatcgttgttgaaactctagttttttagccccgcgcaaaaccctagccgccgccgccaccgctgctctcgcgtcgtcgtggtggtttgccgctgtgccgtagcttggtagccgagttgcaaagcgtaggtgcatccctaaattcctaccggcctatcgtttgtcgtaccgagtctttgccgtaaatcgtgtctagttttctgttgtcgttctgagccatcggttccgttcgccggttcggttgaccgtttggatggtcccatgtcatgaagtattggctcgttgagtcattaattcatgaggctcgctgttgatgtgaaaacacgaggcctaggatatatgcttaactccatcgcaggtccaaaatcttgccttttaggttcgtgggcgtgccagttgatttgatcctgcaatcaacaagaaataaagacaaagaaactgtagttaaatccaaaaatgatagccgatcagccagccgccgatgacatatcatttatctccgagccgatgtcatatgtgaatcgatcgatagttataaataagtaaattaaaactaaatctactcgatcggctgtagatgttaacagtgcataatttttatgtcgatatatacttaaatcaagtgattgggatagattggtcgccatgccgagacagtataaatcacttagatcgaaatatatattaacaatgagattatagatgttcacagcataatcgatcagatagatctagcgcgtatcggctaatactccgataccactctatattaagatattaaagcaagtaaaatatatcaaacaaaaagcttaacatatctaaaaagcaataagatctcaatataaagggcagatttagcatatcaattaagcacatgaaatataaggctaaatcaggtaagatcggctgaaaccccgatactactctaatcgacaaccaagaagcaggctagagattatagttctaagcacgacttatgaggtcaaacctaactgatgcagccataagtatgaaaagaaacacaatatctagacaatcaagccattggaagtttcgtagagtggtggatattctatataatctaaatcaacatcggtaattaacctggtcggctgcctcctagtaacagatgttagcctattagaggttaggtaacgatattgccggagattatatagaatatatgataactcgacaacttacatgcacaagattagagtgtcataatgatgcaagcactaatcccgagaacacaagccgccataacaagtcgtacctctagttgaagatcgaaaccgatgcagctcaacccgaaagcaagaactcatcgaaacaaaacgaaagtaaaaggtggcgatgcgccgagattgtatttgaacgtgtgttaattgattacatggggctcgaggtctatttatacccgagattacaaaatatgtccttgtcggacacaactctcatctctaacaaactctaagataccataagtctttgcggcagacttttgcccacacttatctctaaggaaattacataaaatatcctaattaatagatacaattgccttcttaggactcaatccacgtgtggcaatccatatgaagcacattaattcaacccgatgacgtacaccgtgtcatattgttagaatcggctgtatcggctaaccctgttcgactcgaactctgccaatcctgtctgtagccgatttggatcgtagccgattcttgctctgtttccgcaacgatcttcgtcttggattctgctttgatctaatcttcttttccaacactgatattaccaaatttggtcgttaacacatgccccccaagtccgaaatatttggtaatgtttcggatttgccatatgtcgactccgagtgaaaatcgcacttgccgttttccgaccgttactccagcgctttaaatgctaaccgtcaccttcgagaaacttcacgctgtttcctccgttttcactgctgaagcaaacctagttttctctctctccggcgatcccctcggtgcgctcggcgatttcaaggtgatctcctccccggccaagcttccgctcacgatgatgtcgacctctgccggcttgtccgctgcgccatcaaccagcccgtctgttgcgccgtcatccaagtacgcagaggtatgtatccatcggctagatccctttttcccgtgcagtagatcgattttcttcatctcatcttattttcttcttctctatctcttttgcacttgtagcatcttaccaatcttgttgcggttcccagtttgtcgcacgaccatcagtactttctcggcccaattggcaaccttgacccctctgaatttatcattgttgagaccaacagaatcccctttagactggccaacccaaacttaagtcactggaaaaacacctttaaatcatggccatctattgagaaaagtacccccgagaaaagctggcctttgtggttcgaatgggtatcggctagcaaacaagcccactgggatgaaatcggaatcagccaagcgctagcccttactacagcaaatttggctaaggatgagcctctgatggccgctgcaatctacttttggtccaacacccttaatgccttcttgttcaaccaagggccgatgacccctactttgttagatatcatcatgattactggtctggatgtgacctcatcggctaatcccatgagcttgaataccaaaagcacctttgaattcaagaccaaaagcattagggttggtcggggtatattgtagcatacatgggcaaagggccagtcacctctcgagagcatgtagcttttctactgatgtggttggagaaatttctttactgtggatcaagttgtggccctgcaactgtggagattatggataccccatacccacactgcatggttatccgactggttataggggataacttatatctatggaatatataacggatcatgacttgggtattacgtttccttgtatattatgtaacggcctaaagtcctggtttgataagattgtaaagtagatttaggaaatcaataccgtattggttaaggtttctatcttgtaatcctgccccccgtcctatataaggtgggcaggaggccctctagggggcatatgagcacatatgatcgtcagatctaatacacccggcggattcaaatccccaaacaggagtagggtattacctcacattgagagggcctgaacctgtctaaatcctttgtttccgcatccatccacttttaggtctcgtgcgctacccccttttattattgccgaattcatgttttgacagttggcgcgccaggtaggggttgcgtcgaattagccgtcgaaaagtgtgatggattcaactccataagaaacgccaagatcaatctcaccggtttcgacgactcaaatcttctatcgggtttgtcgttccaaataaacttttattagattaattttcaatcattatttgatcttcttacatttattggtttttttcatgccaactgagatcgtgacgaagcagtcggcgacctcgtgaatccaaccgacgtaaatttgatcacgctttgtgctgatctatacgccggcacatggcccggtgacagtcttcatgcatggagcatcgccggttataaggaacacacgtgcttatgttgattcaatcaacaagcacgaccaacttaatcatgccatatatccaatatatatgagtctatatgtttctttgtttaataacagattaatctactaatcgctttcttttgcatgttcgtatatgccgatcaagagcaaccatctgtccatgacagcctttgactgctgccacacgcgcgtcaactagcgattgttctggccgggatccatgtccgcgtgcacccacctgtcatggcgccgtcaatttaatcctccatgccagcatgcaaaagcatgcatctttcgatacatgtacatctgtactttttattactactaatctcagtttgatgtgtggtttattttttgcatgcaccctggtttcccgagtccgattccctatgacttggtttgatctggctggactcggacctgtgacttgtacgtgctcatgacatgcaggagcatgaatcggtttaatgatctgcttgtgtggacgcatctaatgttcatgctacatgagatcaatcggccaaccaaataatatatgcatgcttcatatatgcattgatatatgcagacatacatccacaagattaattttcttgatgctaattagagatttcttttgtctctttacatgtatcgccggccgtctccatcgccgctaactggtgccctcgcctacgcgattggatggtcacaccaccattgttgggcatctacgtcttcaccgaccggccgcctcgtccgccgccgactggtgtctccgcctacacggctggcctattatgccgctgttgttgggcgtctatgacttcaccgtcggcctgcctccgtcgccgccgactggtgtctccgcctgtacggctggcctattatgccaccgctgttaggcgtctacgacttcaccgccggcctgcctccgtcgccgccgactggtgtcctcgcctatacggttggttggtcacaccaccgttcatgggcatccacgtcttcaccgactggcttgccttagccaccgccgactggtgtctctgcctacacggctggcctattatgccgccgttggagggcatcttcgctttcaccgtcgaccgccttcgttgccgctgactggtgtcttcattgttattgatggacgactttgttcccacattggccacctctgccatcaccaaggggaatattacaaagttgagtcatcatttatttcattctttatatgatattttccttttcctctgcctcactatatcaactggttcgccgttgactagtgagtcgggggctacagatgttatatcatattttttaaacaatttttataatatttatcttgattgcttgcgatataatctgagtacaaaagtgcctatcgagttatggagttctatcttcctatgctttttgtttggtttgccgatggatagttgcctttgggccgattcctagcacccgggggctcgttggatggaccgagtaacgcaaggtgctaagtattattcggaataaatcaaaagcatagagataagataaatttattgtttgctcttaacaattgcaaaagtacccgagtagtaaattctgatccgtgaaactttgttccattaatgacgaactcatatcactcatatgcatgtttgggaagtgcctaggccgacacccgatgcttgggggctatgactagtcgggcagagtgtttaaacgtaatgagtcatctgctcggggaaatcaaaattgacaagaggagaaaaacatatttataaacattttaaaatgcttgaattttcctctagtattgtatttacatcagatactactcatcctatatgtttgttctgtaggatccagatccagatatgcacaatagggattcatggctttaagcttatttcctacgcttcaggaataggtcagtcagaacatcaccaccggcttgccttcgccgccgccgactggtgtcttcgcctgcacgattggcctattatgttgccgttgttgggcgtctacgtcttcactgccggcttgccttcgctgccgccgactggtgtctccgcctacacggctggcctattatgccgccgtttgttaggcgtctacgtcttcaccgaacggcttgccttcgccaccgccaactggtgtctccgcttgcatggctggcctattatcccgccgtttgttgggcgtctacgtctttaccgcgggcttgccatcaccgccgccgactggtgtctctgcctgcacggctggcctattatgccgccgttgttgggtgtctacgtcttcaccgaccggccgcctcgtccgccactgactggtgtttttgtctatacggttggttggtcacaccaccgttgttgggcatctacgacttcaccgctggctcgccttcgccaccgccgactggtgtctccgcctgcacggctggtttattatgtcgccgttgttggacgtctacatcttcatcgaccggccgcctcgtatgacgccaactggtgctatcgtcttcacggctggccacgccgccgccaccacaaataggcgtcatcaccttcaacacaagctgtctacgtctgttgccgactggtttcttcacttccatggctgcatgattctgccagtgttgattggccttatagtcttcaccgccggtcatctcgtctgctgctgactagtgccctcgcctctacggctggtttataccactaccactactgatggatatcatcgtcttcattgctggccaccttgtctgatgccgactggcttgttcgcctccacggctgcgcgtcttcgtcatcattgactggcgtcatcatgatcgctggtttgccttcgccgccgcccatggtttcttcactttcatggctgacttattttcgtcgttcaaggacgtcttcattttcgtcatcattctacttcttccgtcgccgactggttatgccgccgccgactggtgtttttatcttcacaactacgcatcttcgctaccggtttgcttctgttgccgccgactcgtgttcacttcatcacgactattcaactttgtcaccatggtggagcgacttcatctttattatcttcggcaccggcagactctattgtctctactttgtaagctttgctacttcaccaactacgacgtcttcaagagcctcgacatcttggtatgcgtcatcaaatatgatgccgtgttattttactacaacaagtggtgttccaatattcaagatttctactcggacatgttcaacacgtatcttcactcaagtgatggctactcgatgacaagaagctacaattcttgactctatgttcagttgtttctcaactaaccaaagagtctagggctacacaaataccagactcaaaattcgacaagctttatgtcaagacaattccccttgggcaaaattctccttagctatcagtaccaaattttgaacaatgcatcagctaagatagccgtcggttcgatggttggagcaggtgggccatggtggtttctacagacttggctgaacttagtagccatgaaagctgtcaatcggccatcagtgatagaagtagagttcccaagactagagccgattacagatgatgatggagaagagcgaacccattgcaggtgcatgtcttatggagaatatgcatccacaccagccgattctggagcaaagctatcggctgaactgctcaaagactggttctgcagtttctatgaaggcttccagagagatgctcgggtttggttcccatatgaggactcaatgaatttcgatctcccagcagatttcagatttgaggatatcaactccgaaaaatttgataagtctagagaagtcttttcagctgctattagtccatgcatccttccagttggcatctatcaaggaagaaacattcaagtttcttatgaattttatcacccaatgagttcagctaggcagttcggaatgggacaattgccgatcggcttgtactttgccgataagatccagtgcaggggtgatatatcttcagccttgatgatggatcggctgctgaatatcccaggacctcaacttggcagtattgagaatatagagtttgcaaggttcaggagcaaagcctttgacaaatggtggggtgaatggaaattgcatctgttccatcaatcggcttccatgtatatgacatacctcttcccagatgccatccctcaagtaagtcttttcattatcaattttgtaaacataactgttagccgattgataccttatctaatttctcttctttcttgcagacaacagaatcctcccctcctcgcaaaagcaacagtggcaaggacatcgagtatgctcctggccttattccaaatggaggtggactatctccccctgtcatcggctaccatgcccccaggacctcaagtctgctctaagggcaactgagagaaccagtcgatgccggcagaaaaaggaaaaccaagacatcggctattgatccatcggttctggctccaaagaagaaggccaaaaagaagaaatccaagctagccgatgacttgcctgccgtagatccatccattgaacaagctttggatgaagaagaacttagagaggatgttgatcaagctgcagccgaaatgagtgacccagaagataaaacaccatcggcttctccaaaacaaactcctccaactcctactgctccagctcattttaggagggtaaattacttgtttcaatcatccctttttagaataatcaaatttgaacagccaattgcttactagtcttgtacttgcagaagaagaaaactgccgtgaagaagaaatcggcaacaatagcatcaaagccagctccaccggtaaggttctttgtatctttaagtacaatcaaagccaacattatttaacacttgtctttttcagcttcctcctccttcgcctgctgtgcagccgatgtctagcgaatggactctatcggctacaggcagccacaacgttgaaggagaagaacaaccaactgttctgttttctttcgcaggtcttaaccgatctgttttcttttgacatcaaggattaccttgatgaagaagaagaagacaccactagcaaagcctcagctactctgtccgatgatgtgaagagaaatcttgaagacatatctcatcagctagggtcatcattaaacagcttggtagctgattgtgcttcaatccgggcaagatttaaggaaattcaacctctaatcccagatgatctagccaacgttattactctagctgcttatcttgagcaacaccaattcaagctgaagaaaggtaagcaaagattagtcgatcgccgagagcgtaaggatatcgaaactactatccaagccaatcgacagcttgtacatgaagtgaaatccaagcttgatcagctatctgaaggcccgatcaagtccaatattgatcggctcgaggctcggaagattgagctcttggcactacttcaagaatgtaacgctgagctgtctttggagcaacaaaaattggctaacctaccaaaggctattgaagagcagaagttgaggctgaaatcggctatcaggaatattgccgatatgactaagtccctcaaagtcatccctggaaccgatgctcaagacgcccaagccatagaagaagtaaagcaaattaggcaaagggctatatcggctattcagtaatatttgtctcaatgactatccatgtaatagggcttagaaaattcttgtaattggctaagatattttggtacttcaccaactaagtaactgctttgataatcctttatgccgattaacataacttctgaatttgcctcaaaaatttcaaaaatatccaactttgtatatatatatgccccccctaattttgtaatgacgaagacattgataaaattataaattagtctgtgggcgatataaccatatcggccatcatacaccggcaaaacacagccgattatgaagataaaacagctaagggcgatattactatatcggccatctcaaggcgatgcaaacacatcggctctacatgcatcggcaaattcagccgatcatgaattaacccatacacttgggtaatatttcttcaagtatttgccattaagggcccgtccataaacttccccatcaagtctttgcaacatataagctcccttggacacaacattgtggatttgaaacagtccttcccaatttggcgaccacttgccgaatttattatcacaagttcctatcggcaagatcaacttccaaacaagctctccttctgaaaaatatttaggcaccaccttcttgttataatgtcgagcaaccctctctttatcctaagtaactttttcaagagcccgcaatcttgattgaaccaggtcctcccgttcatcgaccatgagattgtaatactcatcgactgtcaatccatcctgtaaatctgttcttcttgagccgattctcacttcccatggtaaaacagcttcatgcccataaacaagcttatagggagaaacttgaatcgatccatgacaagccatccgataagaccataatgcttcagccaatcgagtatgccattgccgaggataatcagaaatctttcttttaatcaacttgatcaaacttttgttagatgcttcggcttgcccattggcttgtgcataatatggagaagaaaacttgatacccatgctatcggcaaaccgaacaaactcatcagacacaaatatcgaaccttgatcagttgtaatcgtctgaggaatgccaaatcggtagatgatatgttccttaacaaactgaatagctcccctgaatcaactttcttcaatggaatagcctctacccacttggtgaaataatcggtcgcaacgagtatgaacttatgccccttgcttgaaggtggattgatttggccgatcatatccataccccatcctctaaatggccatggcttaataataggattcatagctgatgctggtgccctctgaattgccctaaacttttgacaatcttgacaccttttataatatctgaaataatcttccaacattgttggccaaaaataccccacacgccgaagtaaccacttcatcttgtgagctgattgatgagttccacagattccttcatgtacttcgccgattgcagccttggcttgatcggcactcaaacacttgagtaacaccccatcaatcatccggtaatacaactcatcatccaacagggtgtatttcaaagctttatttcgtaattttcttgaagccaattgagacggatttcgcaaatactgaaatacatcatatctccaatcatcggctgtaatcgtagcaacctctatctcaacatctctcaacatcggcttatatcccgatgccccttgagccaaatcattagcttcaatgttttgctctcttgacacatgtttcaaagttaccagccgaaatccactcattaattctcggcacttctcattgtaaaccatcaatgtatcattcttggattcatattctcctgccaattgactgattaccaataaggaatcacccatgatttcgatagcgtcggcttcaacttccttaagcaattgcaatcctttgagaacagcttcatactcagcctgattgttagtcgcataaggtttaatagtgcaggcaaactcaaaacttgcccctcgaggagaaattatgaccaagccaataccacaaccatgagtgcataccaatccatcaaagaataaagtccatggcacaatttctaccgagtcgattgagtcatctcgatgatccacaataaaatcggctatagcttgtcccttaatcgcctttggtgactcatatcgaagatcaaattctgtcaaagcaaatatccacttgccaacccttcctttgaaaatcagagccgatagcatgtatttcaccacatcggccttacatatcacaatgcattcatttgacaatagatagtgccttaacttggtacaagagaaatataaacacaagcacaacttttccacaggagaatacctcgtttctgcatccaagagccgtcgacttaaataaaaaacaactctctctttcccttcaaactcctgaatcaaaactgaaccaatctacttatcaccagccaatagatataatctgaaaggcacccccttttgtggaggaataagaactggtggagaactaagatattccttgatactatccaaagctttctgttgttcgggctgcaggaa

SEQ ID NO: 58085 - DNA, 42243 bp, Oryza sativa
  unsure (1)..(42243): unsure at all n locations
aagcgcccacatcagtgccatgttagatcgagaccgagtcaaattagtcacgtagacgccacgttagccaaaaccgccatcgaaacagccgagggacctaatctgcaccggttttgatagttgagggacccgttgtatctggttttgtggttgaaggacgtaaatcggattcgttgacaagttaagggaccttagatgaacttattcctatttggcatggaatatgcggcctgtgatccagcttgttgggccaaatcgctgcgaaggcccagtcgctacgcacctacatttcgatcttatactttggcattttcttttttaaaaaaaaactacatttcgattccccactttgcaactacaggtagtcattgcgtgtttgatcactttgtcatcgtttttaaccctaccaaatttgagtattactaaattttgataagacaacaaaataaacatattcttgtcactactatcataccaaattttgtagaagtcgaaagcttccactcttaaaagctctattggtaacaccaaaacatatcgaaaattgataatgtcaaatattggtaggcttaaaaatgtaaacaaagtgaacatactctgtttctgtttttttcttattagacgaaaccttgacttgacatagagggtccaataaggcttacaaacactatgtaatctaataatctcagaataacacgtgtccaagataagtgacttgtaactagtagcatattgtcggttcgttgccataggattttaattgaaaaaaatatcattgtacatgtcatcttttaatttgtaaatatatttattattgagatgtggaccctttagccccatattatcatttttttcttctcacaaaagtagaaaagtaggtatgtagtggggggtgattgacatatgggcctcacaatttagttttttcttttcaaaaaaatagagttagtggtgagggtgttataacagattcaccaccaccctactcctttctaaaggagtatttgttaaagattcaccgccaccctccttaacattcaacagaaaatgcctctaaaaatttgtcgaatataacggtagtacaattacaatatactacaactaatatgtaatgtaagtaagatgtaagcagtggtgtgtacatcacaattcacaaaaggggtcataggttagtggattggcgtgcgcaagggttccatgtgctgcatccacgttgactatttaccccatccctgctagcacgcatcttcaagcccatctaacgatcagaaatttaacaaatattctcccaaagtttttgttggaagttaaaatagcaaatccgagagatatgtgaaccctttggctctcgtagtgttcttttttcttttcatagaaatagagagttgatggtggaaatcgttgacacatgttgctaactctctgatctcacaatgtcaatgtttttctttaaaaaaaacatatggagtttgtagtgagggtgttggcaaacttaccaccagtaccactgtccaatatccgctcatcacttattactatcttcgtcctataataatatactaacatagtacttactgaatatgacacatcttagtactataaatctaattagtctttctgtctagatttatgtcttattcaatattagattattttattttgggacggagagagtactagattaacaatgccactatctccacacaaagaaaatactctcttcatactcataaaggaagtcgtttaggacaatgtttaagtcaaaccttgagaatataaattatgaataactcttaagttgttgagtttgaaaatgtaaaaattatatgtatagatttgtcttgaaaaatacttttataaaagtatacatatatcacttttcaataaatatttttatagaaataagaagttaaagttgtgttttggagactatgtcgctgtcctaaacaactttctttataagtatgaagggaataatggacacatagggatattgatagtatttcacaatacaagctagggccggaattatgacgcatgcacgcaaggtggttgaccattcatcaataaatctgatattgatcaattgatgtacgtggccagccggaattaattggatgctgcaggagccttagtctctagcatgcattctattgtattgcaacgtctccggcccatcccgtgcatgaccacctgccaatataatggacccaaccaaattttgtgtagagaagatcagcatgcaataaatatttacttcagattttaggtccttcacatcatcttgtacatatagagagctgggtgcaaatgtatatagtccaaattaagcatagcacactgtttttttttttggccaagtctctctgttttccatatttaagcaattcaggataagtgactatttaagctagcaattcaagaatcaagataataagtgactaaagtgtcccattgtttggcctaaaaacggcttattagtaaaagaataatttataggtaaacttttatatctatgcccttagttgtttaattattaaaagccaatataaaaaagaaactacgacaaaaagaacataaaatcaactccaaatcaagttcacttaaattttgacaacggcatataagctatagagcaaataatgagaggttgaattgtattcacttttttgtgctattgatgacgcattttactctgtgaacagatcaattcacagctaggttcatatataaatttttagtgcatgtagctacggaaccaactccaaataaatctacatgtaaaataaaaaatttaacaaataaaccacatagatgtgaaaagtaatactataaacgtaagaaaattgcttgtcctttttttacttcattcaataaatcaccaacctcaaaagtgaacaagaaaataataaggttcttatgacattaaagttttgataatacatgtaactaccggagtagaatatatcctttaatccatccatcataatcagttgttacccagcttgcggccggtgtggaccacagcatttaagatttaagctgaccttcataacacataggccatgtgacttgaaatgtcgcctttcctaccttcatttcaaacaaaagcataatatgtagtgcacggtgcacccatcaaattataaatgatttcaattgaagttagtgtgtatcaaacctgaactctggatattgcatgcatattaagttggagccgatattgatacaataaaactctataataacagtaccctatatatagtaatacgtggaaaaaaccattgttgaacattccttttaaaaaaacccctggtaattaataaatatatgttttagtcacgaccactgtggtgtggtggtggagttgtatatccatagatatccacaaatatagttgtgtcatccttcgatgcagatcaagcgaccaaaatactttttctgaaataagattgattagatatttaaatataagtgactattacaagattaattatattaaatatgagattattgcaaccctactatctacatggtaaatctaaaacttctgaacaatttattggaaaaaaataaactagattccgtcaagcatattccgttttcttgtagtgaattgagattctccatctacaaagatatatgcatgcgcgccatatgtctggtcaaaattagagttacgtactcctacaattaaattatgtatataacgcacttagatatatgcatgccattttgctgttcattatactatttggtcaacactagtttccaaagtgctttatcaatcatttttaaacagtataataaaaagatcatttgaatttattgtcaatttcaaaactataaaatagttaaaattaattagttcatgttgatttggtttgtaattttttaataatacataaatcggccgttgctgcatccgagttggtttatatagaccaataatgattattctagctatatatttttcatatataccgatgcgtgttgtataaacgtagaactgtaaaagtttgcatgttttatacagtatacatataaacaggagtatatacgtacgtatacgtactccatcaatcggtgtagtagagagatcgaaagcaataaattctggacctaaaccacctattaattctttcaccacaagtcatgaacagctcacaaaaacggctctgtgcagtaccggccgctcctgttgctctgcctgctgttgctgataaaaaccaaacacaccacttaccggctgtgtgtttcttctccctctttttttttcaccctgtcttctcctgtatatataatatatacatgtgtccatttacctttaggcccggtttagttcctaaacaaaattttttcaccctatcacatcaaatgtttggacacatgcatatatatagtattaaatataaaaaaattaattacacaaattacgtgtaaattacgagacgaatattttaagtctaattgcgccataatttgacaatgtggtgctatattaaatattttgctaatgacggattaattaggctttataaatttatctcgtagtttacaggcagaatttgtaatattttttgttgttagaatatgtttaatacttttaaatatatatccgtatatctgatgtgacacacaaacatggccttaattagttctgaaagagcttgctactagtgtacgtacacgttcaccctccatctataatctgtttagtctttacagtatgctacgtacgttgacacgtacgtgcagtacgtgtatatacatatggtcgtgtgtttgacatagttctagatttacgaatattttttagagttgtgtatcttttgaatatttttttagagttgagtgtttctgttccacggatttatatatttaatttggagaagtgatcatattgataaacattttcatgaatagttttgttcctattttggagaaaatatagaattttaaattgttataatttaacttgcaaattctaaatttgacataccccaccacctcacctgttcatgccatgcaattgcgaggggttatattgggattattggaaattagtactgtaaatccctaattctatttttatgttcattgaaaaagtatatctctatcttatatatgcaactagatgttacccactactacataaatgatctttgcagataccccttttatttttacaagcagaccaaaagaacatccatatgcaaaatgattttagggtgtcgagaaaagacccgcttggaaaaaatgattttcgtaggtgggctccttaagagccccgcctgcaaaatatagttacttcgcacacggacttttttgatacctgggcaaaaatatagcatcggcttccctctcctttaatttctctcctacgtacctctccgcttctcttccactcctctcccttatcctcatttttctccactccgatctcctcatttctcttagtggcagcgacaagagacggaggcagcgatgacgatcttctggaggcggcgatagcgggtgcggcgctgggtgctcaacgatggaggtttgtgaaggcggcagcgacgatggcgggcgcggatctgggacctcggtggtggtggatctagtgctcgaaacctcagcgacaacggatctagtgcttgggacatcagtggcggcggagctggtgctgccggcttcgggagctgcaggacctctggcaatgatggcgaacgatgctcaggagctctgtgacaacgatgacggaggcaacaatgggctgcggtaaccacgacgactgcacttgtgaatcgaggctatctagggtttcaattttgggattttttgtgagttcttttcttttcgcatgtggacggcttaactgaccgccacgaaaatcgcttttcgtgcatggatgccctacctgactaggaaaataccaatttttacagacatgtatggggaggcggcccacccagctgcttgtgaaaataggttttagccgcttgcgaaaatcatttctgtactagtggtgtcgtttgttatacatgtgaccaatatatttacatattttgttgtagtatggattttcacaccaccaaccttgtatatggtttttcttcttcttccatcgatgtggtaattattatgtctccaaagtaaattatggtttatttgatggaactcacacattcgggtttaagtatccaactcagtatatgtacttgtgttacaactatattttttcagtggtaggtgatacactcatcaacagtgaggtacttagaccctgtttagatgggactaaaacttttaaatccctatcacatcagatgtttggatactaattataaatattaaacgtagattattaataaaacccatccataatcttggactaattcacgagacgaatcattgagcctaattaatccatgattagtctatgtgatgctacagtaaacattctctaattatagattaattaggcttaaaaaatttatcttgcaaattagctttcatttatgtaattagttttgtaagtagtctatatttaatactctaaattagtgtctaaatacagagactaaagttaagtccctgatccaaacaccaccttattgtgactccataaatcttaagttatggagaaaatcccctgtgtacccctgaaagttcacctaatctcttctatacccttgaattttgctcaatcccttggatacccctgaattttagtttggatcccttccatgccctttccgctagttgaccgttagttgaccgttaaattcttatgaaaaagtccattttgccctttggtataaagaagcatataaattaatatagtatattgttggagcatagaaatgtgttatatgagactattatgtttatgagatagttatgcaccatattatttgcgataaatatacttttagatatgacataaaaagttaattcttatttatttttttagcatatgtgttctgatagtaataaacaaatatgttatattactatgaaaacacatatgctacataaaagaacttttaataactaataaataagtattaaatttttatatcatatgtaaaagtaaatttgtcacaaataatatggtgcatcacagactcataaatataatagtctcatccagtaaatttttacattccaacaatgtacttcattaatttattatgtttcttcataggaaagggcaaaatggactttttcaaaagaatttaacggtcaactaactgtcaactagcggaaagggcatggaagagatccaaactaaaatttaggggtatgtaagggattgagcaaaattcagaggtatagaagggattaggtgaactttcatgtgtacgtaggggattttctctaagttatacgttcataaggatcaggtctgacctagtcgattagatcaactatgtgtcaacgtacgcttgtaccgtcaaatgagaactatggtttcttttagtcttactttaatataataatcttttgtacgcagttgcccctaccgctcgagatataaatgcatgtgagttgtatacaactaaattatatttattatatacatttcagtttcgactaaaaactttttaagttattattggctagtctctgtcgttcgtacaagcctcttattttattttagtaacccacttcttttttttcacaactgtactatactagagccatccccaatgcaacaaggtaattttaattgatgactaaaatagctaatatgataacacattgtttcatgtttgtggttttataggcaatacatataaggaaacagcgtatagaaggtttcatctaagatacaaacccatttcatctctcacttcattattattttttacacatcatccaaattactgatatggagtagtacctaatttaatagtagaacgaaacttgtattggaagtgtcctaattggcgactcttcattctgatctaaaccgcatgcacgtaacttaaaaagttatccaattccataaaaatggtccaaactttttttattaagatacaaaggtggtgtttgaatctcctgaaaatgaagatgaagatgaagatgaagattaagtattttacgcaaaatgaggtgataataacgtgtgattaattaacttttaattattacaaacttgaaaaatgaattaatctgatattttagaacaactttcatataaaaagttttcgcacgaaatacaccgtttagtagtttgaaaagcgtgccacgaaaatctaaaatttaatcaactccttgtagtaaaatctaaattttacttatttttttaactgctaaactgtacattttttaacttaaaaaactttatatatagaagttgctttaaaatataaaacaaatccattttaagtttaaaattattaaaacttaatgaccttcttgttttacgtgtccatacttaatcttcatctgtagtgaatccaaacaaactagagaagaaacaaaaaagagatcaaaaaactttgcatggtgtatgataaatactgagctagtatccgtgtagtgtaagagggccggtgtcagacgtcactgatgactttcagcaaaacgtacgataaaaccgcttatccatatatattattacactacgatctaacgactataaccagtatactactatatatcggtagatatacatattacgcaccaacgaaccaattttcccacgcgcgcgccaggccatgcatgacgtacgaactgccgtatacatctacgcgtatgtacgtacacacctactagacacgtagtctacatcgtataccaatctctctctaccactgctagctgcgagtacaggagagaagagagagagtagagagatgcaagaaggggcagtgcgtgtcatgcaataactccacgctacgcccgcaatgaatgcccattgcaccctctccgctactctccccgcaattactccccccctcttcaataccccgcaccctccaccctcctcacctcctccccctcttccttcttcctcctcccgccgccgccaccgccgcactcttcttcctcctcacatcactccactctgatctctctctttcagacagtagcaagagcagcagcagagagagagagatttttatgtgtgttcttgacgactgcgtgatcggctgtgccgccagatatagatagaccgtacaactgcagcgctagctatatatatgtttcgagtggggtgtgtgtttgtatatcgattgttgatttgttggtagatctgagctctgcgagtgttgcttcgtccatggtggatctctagctatttagggttgttggtctagctagatagctatatctttctctctctctagtactggtgtgtgcatatatttgtatatgctctgagggagagggagaggatgatgatccctggccggaacatgtcgccggcgatgatcggccggcccaacggcggcggcggcggcggcggcgtcgcctacgcttcttcttcctcggcgctctccctcggccaggtatagtagtagtgtcagatgtgttggtgaaggattatttgtgttcaaatccgtttgatttgatttgtttggtacttagctcttataatgctttgctttcttgttaatttgtgatgatccttctgaattaatcctttgcatatatgtggtaaatcctagaaattaattactgcctttgctgtgctgatttcctgcacttaagtgttctccaccagtaagtgctaagtacctcttgttatttggtgtgtgcctgtcaggcaggctgtcacactgtcatctatcactaattaactcacttcctatgatgaatgtattcaattgtacataccatttacatatatggagttaggccagagagagtgtttagttttcagaaagcgaatgcatttaagtagggattaataaataccaaaagggggatccattcatatacatgagctacttgagctacatacctgatgagaaaaatgtatacatggagcatgcatattaatattggctttgtgtgtctctctgcacttgctgcacttgtaaaggagtagtgatgatgtgcaaaattaaacagcttcagtagtacatatgcaccctactctcttgtgcatagcattaacttgtgccatcctttatttctcaagctgtgttcctccctaatttaggtgctcctttttctcaatcctattttgcaaaacatttattgctttgctacccctggatgaaccggatttttgcacactgtttcctagtcagactcagcactagtaccgctgttgttaatttctcttggtcctatctcatttcaaatgctcaatttcaaacttccccggttttattttacttcagaagctaaacagtgaaattattaagcaattttccctagataatatatccagaattataactctcccttgcattagcttgtttattttgatgtgtgcaagcgcaggagagataatgtgtgtctccctagttagtttctttttaatctttagaaaataaactttacctatcagatttttagtacaagttaattagaacagcaagaagtcaccaatgtcatactccacaactagatatagatcaaaatcacttgtctgcatctccaatataatacatatataatgtaatccaaattatattcacacctagtcttacttaagctgaattacagatatatatgctcgatcatatcatgaaactgcacacagtgcatattttctagaactctagctatatatgaacaattatttgctactctttctgcaatattatccttgactgttgcacagctcatgaatgttaaatcacaatgcagagcttgttggatggacaccaccatcagctgccatcactgctgcagcagcaccacaatggacaccatctgcttgatcagcaccagcagcatcagcatcagcttcccccacaggcgacgacgacgagcgagagcgacggccgtgcccctcgcgacgagctggagatgagcaagtccggtggcagcgacaacctggagagcggcggtggcggtggcggaggtggctccggtggtgatcaggaccccaaccagcgcccccgcaagaagcgctaccaccgccacacccagcaccagatccaggagctcgaggccttcttcaaggagtgcccccaccctgatgacaagcagcgcaaggagctcagccgcgagctcggcctcgagcccctccaggtcaagttctggttccagaacaagcgcacccagatgaaggtaatatactaatccgtgcatccatcgtatatcttacacgtcatgtgaacgtgcatcggttcataatgttgtgtttataaatgttaatggtatgtgtggttgcacgggtttgtatgttgcagacgcagcatgagagacacgagaacaatgcgctgcgcgcagagaacgagaagctgcgggcagagaacatgaggtacaaggaggcgcttgccaacgcgtcctgccccaactgcggcggtccggccgccatcggcgagatgtccttcgacgagcaccacctccgcctcgagaacgcgcgcctccgcgacgagattgacaggatctccgccatcgccgccaagtacgtcggcaagcccgccgcggccgtctcggccgcgtacccgccgctgccgccgtcgaacaggtcgccgctcgatcatatgggcattcccggcgctggcgccgacgtgttcggcgccgacttcgacaagccgctcgtcatcgagctcgccgtggccgccatggaggagctcgtcaggatggcgcagctcggcgagccgctctgggcgccggcgctcggcggcgaggcgctcggcgaggaggagtacgcgcgcacgttcccgcgcgggctagggcccaagtcgccggagctccggtcggaggcgtcgagggagacggcggtggtgatcatgaaccacgtcagcctcgtggagatgctcatggacgtcgggcagtggacggcgctcttctcgagcatcgtgtcgcgcgcggcgacgctggaggtgctctcgacgggcgtcgccggcaaccacaacggcgcgctgcagctcatgtccgccgagttccagatgccgtcgccgctggtgccgacgagggagacccagttcctgcgctactgcaagcagcaccccgacggcacgtgggccgtcgtcgacgtctccctcgacgggctccgcgccggcgccgggggcggatgccagccggcggcggcgcgcggccaccggcgccgcccctccggctgcctcatccaggagatgccgaacggctactccaaggtgacgtgggtggagcacgtggaggccgacgaccagatggtgcacaacctgtacaagccggtggtgaactccggcatggcgttcggcgctcgccggtgggtggcgacgctggagcggcagtgcgagcgcctggctagcgccatggcgagcaacgtggcgtcctcgggcgacgccggcgtgatcacgacgtcggaggggaggcggagcatgctgaagctggcggagcggatggtggcgagcttctgcggcggcgtgacggcgtcgacgacgcaccagtggacgacgctctccggcagcggcgccgaggacgtccgcgtcatgacgcgcaagagcgtcgacgaccccggccgccctcccggcatcatcctcaacgccgccacctccttctggctccccgtcccgccttcccgcgtcttcgacttcctccgcgacgactccacccgcagcgagtgggacatcctctccaatggcggcgtcgtccaagaaatggctcacatcgccaatggccgcgaccacggcaacgccgtctccctcctccgcgtcaacgtaagatagctcttcttcctataaaatggatgatgaatcgatccatcgccattgctgatgaagagaagaataaaataatttggtgcagaacgcgaactcgaaccagagcaacatgctgatactgcaggagtgctgcacggacgcgacggggtcgtacgtgatatacgcgccggtggacgtggtggcgatgaacgtggtgctcaacggcggcgacccggactacgtggcgctgctgccgtcggggttcgccatcctccccgacgggccggacggcggcggcgggtcgctgctgacggtggcgttccagatactggtcgactccgtgcccaccgccaagctgtcgctcggctccgtcgccaccgtcaacagcctcatcgcctgcaccgtcgagcgcatcaaggccgccatcaccggcgacaacggcgtcgcgccgccatgcccacggtgacctcgccggcgtgcccatctatctgtccatcatgtgcaatggtaagtgagatcccctgatcattacagaacgaaatttctaaaattctctcaatttagtaaaattgttcaaattcagtcaaattttgagccctattcagtgttttttcatctgcaaataccccttttcttatttcagcaagattgaactctgctttaactattcctacaaaattccagcaaaattactaagtgatcaatttcttgaaatggttttctctgacttaatttcataattcgcatttatgatggtttaaatttgatcgaattttgtgcaggggatcaagggagggatcaagagcgaattcggaggtttagcaatgtggggagtcaagaacgcaccgcagactactgtccttgcaaaagtgtagttgctgcttcagttagctagttcatttatcattttttttaatcactatcaccaccaccaaaaaacccccagaaaaattaatcatgagtaaaaaccttaattatccaacacagcagcaacacaacttaggtcctgtgatcatggctgatatatatacactacatatatttatacagtgatatgtcataggctctgagttgtgttgctctcaacaaattcctactcatcatccaaaattaaatttgcttcagagttcagacaaacacattgcatccaatccatgcatatgccccctcttatttgatttcagttaggttagtttcagttaagttattaatgatctgtcacctgcattacatggctcatcaacagttcatcagagttaattagttcggaagcaagcaacactttgcaaggttggttggttggttcgggtattgactcctctttctctctccgggttgccactctctctctagaactcctcttctgatgcaagatttgttaatttcatcatcagctggactaatgcatgcatatgtgtactgcatagtagtacctttaaattcagtttgcaaaaagagtgtgtatcatgtttgtgcttaatttgctctccttgtctattagattgggcttaaactttgcatgcatttggagatttgcagaagtctgtcttgtatcctctctgtgattctcatggacagttcgattaattggactacctttttgcatccatatctaaagtctggctgagttgatgcattttgttttggtgtatatctgcaggtgttcaatgatgtttttgtgtgtgatatgaatgatgcgatattttgatgttgcttcttgcacaaagtcagatatgaaatgatgttttcctagtatatattttccaaagctacatctcaaaaacctacacatgacacatcacccatggttagtcttgcaagaaaaggacattttctcttttttggttcagatgatgctgtcaaagcataggaaaccatgtgtatctcaaaaacccatacattacctattggttagtcttgcaagaaaaggatacgtctcttttattttattcagatcatcggatactgtcaaaacctaggaaatcatgtgttccaaacaaaacagatcaggagaatcaacaaccatggcggcggcagcttagctttaaagacagttaagccatctcaacttaaatgaaggccctaacacccaacaaatttgttggtttagtcagagcaggctgctgtcacagtgtcacctgtcgacatctctcactcctgtacaaggaaagatgttgttcaagcaatgcagcagctgcagacagacagtagcagcggtagtagtaggttgtacattttttttaagatgatgttagtacattttttactactagcaaaagataaaacttttaactaattactagcaaaggtagcgtagtgactcaaccactaaacaaatgtcacaattcacctcctctttgttcctttcatcatgttcttcacaaagtaacaagacaactgaagattcagagagaacacagcatactacggagcaaagctgaaaagatatgctgatagaatggagaaagattggtgtttatttagttatatttaccaactccgccaataacatcattcagatacaaagacaaacaaacaaagatactcttgtagctaatatgaacttccaagcattattggtacttttttatccaaataacaaagctctaatcaattgctgctgttgtattgcaccctttcaaaactgctcatggaaaagctatcattttttagcccctctagagttttttcagacatcaaggtacttgctggctgtgtggacatccttgtctcctcttccactgcagttcaccaccaccctcacgccgtcgggcagcgttgggcagagcttctccaggtaggcgagcgcatgggacgtctccagagcagggatgatgccctccagccgagagacgcgcttgaaagctgcatgtgaagatagcattcgaaaagggaatagttagattttgagcatagcacttaaagagttagatattgcagcattaatcaacgattgggacatcaactagtaaatgtttatcgttatgtcagtgaagatgtgaaagacttccaacataactttacgcaactcggtaatattttagtactcaggattatgttaaaacaagtaaacaacaatcaagatcaaaacatcaactaaatgtttaacataacatgcatatgtgacagactgacggctagcaaactactgagtcagcaactcagcatgttaagaatttgcctggtcttacttatctgtaattcagggtcactttcggataccctactaactcaacagcaaagcttaatttccagtgtaaatctaaagtttttgtctaacatgtgaatcagatagagttgcagacaaccaaagcgtagttgctctgatatcattaagatggtagaggggccaaacaacaaaattggtgccttagccctgcttaaactcgtatcaagaaagttcagaacattcacaatatatgctactaagaataacagtttttaacagttgttggttctattagcctactcttactcattagcagtccccaccatcaaagagatatactattggcatttatagtagatattccaccaatcaagtggaaggaaaatatcagagaagagaaccgtagatagtgacactgaaacacataccatccagtgcctcctgatctgtcacgctgtcatattcagcacgtccaatatccttcaaaaagctatgctcaggcccaacaccagggtagtccagcctaccattcaaaacagcatagatgattagcccaactgctgtaaaaatgaattactgtcaatgccaacaacagaatactcacccagcactaatggagtggggttcaataacttgtccatcatcatcctgcaacacatagctcaatgatccatggagaactcccacttctccctttgtcaaagtggcagcatgtttgtcagtgtctacaccatagccagcagcctccactccaatcattcttatatcttgatcatcaacgaactcatggaagagacccatggcgtttgatccaccaccaacacaagcaaccaagacatcaggcttgccaccccacttctccatggcctgtctacgggtctccttgccaatcaccttatggaactctctcaccatcatcgggtatggatgcggaccagcaactgatcccaaaatgtagtgagtgttctcaacattggtgacccagtcacggatggcctccgaggtggcatccttcaaagttgctgtcccagaatgtactgccctcacctgtttcagcaaaagagatcagcaaaccatgttgaggaacaattgtacattcatatcgaaacgagtgtacacgattgcaagcacaaagatgcacaagtttccgtcatacctctgctccaagaagcttcatcctgaaaacattaagtgcctgcctctccatatcctgagcacccatgtagatgatgcactgcagcccaaacctcgcgcacaccgtggcagtggcaacaccgtgctggccggcgccagtctcggcgatgatacgttccttcccaagccgcttggcaagcaagacttgagcgacagcattgttgatcttgtgggcgccagtgtggttaagatcctccctcttgaggtaaatcatggggcctgtgccatcagcgcgcttgtagtgctcagtcaatcgctccgcaaagtacagcggggtctcccggccgacgtaatccttgagaataccatcaagttctttctgcaaagagcaaggtgttgtcaagcacacaactctcttgttatttcataatctccctagcaatcaaaatgactactactacttctaaacatttcgcatgattcaggaatcatatgaagttgcaggcattgcagtgataaatgaaacaaactattcacactattgaaatgcatttggtctctgaaaggcgatgtagctacagctcaaatacagtgataccggtgcttgaagaataggggctccaaagtactatatgtggctgcagttctcggaaagggacacagacgaaaactgaatcttcgtcgaaaaatcaatcggtctcaaaggaagattgattggttctgcaaattgatgtgacttctcccctctaccacaaaccagagatctcaaacacacacaagtatcacgtattactagcgttaatccacacaaaataaaagaagcaaactataagaatataatcgaagcaatcatcattaatccacaaaagaaacaaaatcgacggactaaaccttgcaaatcaacatctccgaccatcaaccaattcggcgacgaaatgaaatggtggcgttttccaagggggttgaagaaaataaaacccaaacgaaatatacttcgcgaatcaaatcgaaacaagcgagcaccaaatccaataaatcggagtggggggaggggggatccagcaccgcggcggttacctggaaatcttcgtcgccggcgagggcatggaacgcggcctcgagctcggtgagcgcatgcatcagcgtctcgggcacgtacttgcccccgaacttcccgaacctcccgaacgcgtcgggcctcgcgaacccccccgacgccgccccgttcacctccccggccgcctccttcgccggcgacgccaccgccttcgccggccgcattgccgccgccaccacagcccccgctcccctcctccccgccgccaccctcaagccccccgcgcgcaacgcccccgcaccgaccctcgacgccgagatcgacgcagcggcggccgcgttagggttcccgacggcggcggccatggattccgaccacgaagcgagtaattaatggatagggaggagaagaggttgagtgggggagaagcgggtacacgaggcgggtatataaaccggtcgcggtaggaattctcccacgcgggggtaggtggtccatggacccggtgcatgggccggcccactcacagcgaggcgccgggtccgcgagggcgtttcgtggaccgggtgcagggggggtcgcaccgggcccaccggatcggggtaggggtgggggcgggtcattcggcacgtgtggcgggggcgttctcgtcagagcaagttttaacagtatagctaactgctggctctaaatcatctatagctaatctaatagtctattcatacaatagttaagtacaaaaatatactacaccattaataccggtcctatctctcatatacacataacgtcttagagtccgtgttgcaactagctataaatctgtagcccgttttcttctctcttctcttttcttctcgatacgtggttatagaaaaaaattgaaaatatacttctttttttattattttgcatttatatacctatgtgacgaaaatttgcacaaatatacctatcccgcagtgtggttacgcgggaccgaggcggtcccgcactaccattccgcgggaccggtggtcctgcagcacggacgcacggtaccgcgtcggtcccgcggaccggccgtgcggtcacgcaggccggccgcgcgtgaccgagcagccaagctgcacatgcatgcatatagcactgtttgacactgttctgcactgtttcgcactgttttcacactgttcatgagccggttccgcacattggatccgcggtaccgctgtttgaacagtgccaaatagtgtcaaaacagtactgatacagtaaaaattgtggaaccgagccgctccagcacgcccgttccgcgggaccgtgccgctcccaaggtgctcccgcatccctgccgctcccgcatacccgttccacgggctgcatcgcttccgcgcaaccgccgtgcgggaccggctcgatcccgcatccccactacgcgcgaccgtgcctaccgtaccgctcccgctaacccaatatacggacgaggtatattttcgcaaatatatgtcgtgcaagtatatttttgtaaattgaaagaaaaaaaagtatattttcaaatttttttctgtggttatagcggtcttatagtgagatttggatgtgagacgtggagggttctcggccgttcatccgtggggacggtgggtgcatcgaggccgttgattgggggatggatgggtcggattggggtcagggtgggttgatccacgtaggcaggatattggtcacgttgtgttgttttttttagtatttgaaagttgaaactagtggatggaaagagatggaaaatggtttgctgtgatacggctagttgtaaagcttgatcgtgacaaaaaaaaaatgaactagaaaagatatttatggctgtgtttagattctaacttttctcattaaacttccaacttttctgtcacgtcaaatgtttggacacatatatggagcatcaaatgtagacaaaaagaaaaactaattgcacaatctgactgtaaatcacgagacaaatctttttagcctaattacgtcatgattagctataagtgctacagtattccaaatgtactaatgatggattaattatgcttaaaagattcgtctcgcagtttacaggcgtaatttgtaattagttttgttattagtctacgtttaatactttaaatgtgagtccgtatacgtaaaaaagaatttgacgatgaactaaacacggccattatctaaaacaaagatatttataccatccacatccttatctctctccaaaattaaatattaggtaggcaaataatgttttttgtttttaataacatcgacacgaggttttttttttccataggataataaattgttcttggtacctttttttcccagcgtggttgtaattggacttttgcataatttctggtatcgtgcggtaattgggattattattttcctttggcttttcccaaaaattttggtacgacaaaggctgtgttgtttggcttattaagattgagtagaaaaacttttatacatatatttttagcggtccaaagacatagttgagtgaaaaaaatgaaaagaagaaaatttaattttacaatatgtttgtaatagctcataagccaaagtccaaacaaataagctttggttgatttagtttgagtttaaattggactagggtacctgtctggaatctagacagtggtcaaagcacagttacacaaagacaagcattccaaattgaattctctaataagggaccaaaaggagatcaatatagtactaatacagtatactagtagatccaaattgcctctaaaataaacctattaaatattcaccaagaattgaattgtactcacagtccagccatttatctaggcaggttcgcatttccaagcagcagcttcacaaaccacatcaaaacagcagaaagctccacattgacactgatgtgtcccatattctgaccattcattactactgtagtagccaagtcatcaattgaagaacaagcgagatgttcttcagagtcacaggcgagagacgacgtagcaaagcggcagccttcttgtttttactaatgttctttggcctctttgactaatcacatcttcagagatctctcctcaccaaccacaacacaaaacacccttcttgctacgccgctgttaaaactggtcaaggtgttcaaagcaaaatttctttttgtttgtactaagctgtcctcctttctgtggtgattaaataaattattcagacatgagatttggtcaggaccagagaccaacaaccgaatcagtgaaaatttcctggcatcttgcattggatggacgatgaatcacggtggctagctagctagatttttccagtttaattggaagaaatatggtacactgctactactacaacaacttcagaagttcagaagcatcagtgcatcagaaggcaggcaccaggaagctcaaggaagtcatacatgcagctcatgttgtcttgccgactttgtcaagcagacatacgtgcagccatcgtagcctcgcatatggatccagcgaataaaattcaggttaaaaatatgttcctaaccctgagtccctgacatgtgacaaaatagactggtagtagcagctagcttacacttcttgtttgtgctgcacactgaaagggacagcacagattagcacaaacacaaccatcgggtgtatctcagcttatgctcatacagatgatccaaagattgtacaatctcatacagaaagcttcatgactcggatgaatattctacaaaagttacattgaggtaacatttggttcagttgccctaccagcaaaatactctacctgtcaaaccaccatagtgaacattgaaattgggaggggaaaaatatgtttgtgattttaatcaaatccctaaattacaggatcctaaactagctttgaagacaaaagaagaatcctaaacttggggacagctaaggctgcttcaatctttctaatacaatgcaggaagaacaggcaccatgtcttcaatctttcttggcatacttgccaacatatgcctacacacaaacacagcccaattagcctatatgtgtgagtttagtttctcaaatgacaagagatgccaggtggacagcgctgagagtggaagctcattgttacctggacgagtttgtttagcttttctctggagtaggacatgtaaatatcaatcttctcttttgtttgaggagtattttcaactgtggtcgtaactttgtcgacaaccttcttcacaattgttttatgaacctctctgctcatttgaccctctttccaggtgggcttaagtgcatccttcacaaagtcagccagtgcaagcttaaacatcttcaacgccttggaatccttgctcttcttgttctcaccatcttcattagcctcagcatcagtgtcctttggttcttctttcttattttctgcaggtgtagtttcattggtcgccaaggcagcagcaggaacagtcggtgcaaccgaatggggtaaaagcagagggttgccattactactaccagcagccattggtgcctgaaatgtctggggagctggttgttcaggtggaacaatatgtgaaggttggaccattcctgcttgttgtaaccaaggccagtgattaggttgaactgcttgaggtgcagcagacgaattgttcatcaaactcgaatttggatcaggctgagacgactgcagcccagaggtatcagcagtcagagaaggaacaaagtactgggccaaagatgcagtaacacgacggacttcttcctgacttgacactgcattgtgagaaagaggagctccagccatatcaactgagctggaactggccaccactgataacccttgcaaggtttgactctgagtttgctcatttggagcaacaggctggaaattatgtgtgttttgcaagccttgatcaccactatctcggcccaggttgggtgtgtcacttgttgcctgattctgcccagcatgcacgattgttggaagattctgtggaacttgaccaacattgaaaatttgtccattatgcacagagagatctggtaatgattgtgcccccataatgtagccgtgttggctgtgccccatataaggagcaactggctggctctgcatgctaggagcagagttatttgtagttgcatgaggaactgcaaactggtcctgcctatttggatgtaatgaaaagtcactttgctgaacttggctattcaaaggcactgaggatgtagtattctgcaattgggtggcgcccggaagagatggtgcagcagaaatttgagaaattgcatcttggctctctgctttttggcccaagttatgccctcctaaaagattagcagaatgcatcccgatttgcatactcaaattgccaacggttccaggtccactctgaccacccatgtcagataccttgtcaatgtttatgctctctgtgcctgtttggacagaaggtatgaactgtggcagttgtgaagcagctatttcaggtttgttttgccctactgaaccaaaatcatcctgagggaatatctggtactgactacttccagcatctttggaatgccggtttttgttctcatatcgagaatcatttctgccagtaccctgaggaacagggttttctctgtcatctcttgacaaaacatgagaacttgcctgcacagaattattttgttcactccagctcaagtaatctcctcttgttgtaggcccaccagtgtaaccaggctcatcaggtgcacccagtcccatttggctctgggaagcttcctcgtggagatatgggcaattttggccacgacggcatccaccgttagcaaaaaatttgcaggggtttttatttgttctacggtgctcagtcctgttcccatatgatgaatcagggccacttctaccaatagcattatctctaacctcatctctccatccaccatgaggggtggaatcatcatgaacatatcggcaattcgcacccctactgcatcttcctttgacaaaatcatggcatggcatcgtagaccgatactcccttcgaggttcagatctttcccaagttccttcatcataatggccacctcgaggtggcctattccttaaatagtcatcttgttctcgtggatccatgaagtccctattctgatgcccatacttttcccttgaatctacaggataatgctcatcaaactgcctgcgcacaccatcttcatgagggaacctgcaatttgagcctcttctgcatctaccagctacaaaatccctacagggaagagcaggtcctccagatgatctgcttctctcaaccctccattcagatccacggtcactgaaataaggacttctgcttctgcttctgcttctacctctacctcgccctatgctcctgcttctacttctagaacggcttctgttcctgtaaagtgtaaaagaaaacaaatatattaaagaggcagggaaaagaaactagtaaattgaatttttcattagaatttcaaataaatgtattccatagaaattgtaaaaacttcttatgtgagcatcatctttgacatttatagaacaaacaaaccatacaatctatcttggatatttcattcttgataaatttcattttaaaatcatctccaacagctgctacacaatatacaagaaaaaagttaccagttgcacagttaattaaactaattacttgttcaaacacacctgcgtgacctgttccaaccacctcttggagatagtggactgcgacttctcttccacgcatctggaccagatgatgatatcctagaagaataaccacggctaagagttgtaccccacccatcaccacgccttctgtcatctgcatatctgctcataccttggttaccagctgccttttcaaagcctctgttgtgccagtcatttttattatgatcctcatcacccattctaagaggcaacctttcagaggatgccttggatgacctttccttgatatctttgttgagtccatcagctcgatcctgctcatgtccagcgctaccatggtgcatagagacagtagatttgaggttcagagattcaccaatttgcttgtcattaccatgaccaaaatcctgagaagggagcaaatcactgccctttctatgatcatcattgccctttttatgatcatccatattcataggaagagactcatcttcactgatctccactatatcaggaggtccttttgtatcccacttggaccgttctttccttgtttcaccagtcattttaacccttctttattagtccaacaaagaagtagttcctggtgcacaacctcctttcccttatccgaaagtactcttgtcggtctatctgaaataatcaaagatcgtttgcatatattataatcaatggaagaatagaatacttcaacaacaaaagtgactgctgcagtatgcgcaaaagatatagctttctcaaaggacatgattcagaaacatcaacaaagttgagacacttaacaactgactgacagctgtataataagtaggatccaggatcaagtaagacatatctagtaaaagaacgctaaagccaggaggggtatactgaaacagaccttccactatcaaggattcaaggtaaccgcctaagtggctaaccactctcattatatagatacaacataagatatgtcccaaaaaactaagaaaaatttcttattgtacaagttatatgccacctacactttccaaattttagtcatacggtacattgcttggacatttgagtggcaaatcctcataagaatcaattttaggggtggcaaataattgataccctcaccaaaaagctcaggacatacttttctctggtatttttgtttaattgataccctcaccaaaaagctcaggacatacttttctctgtatttttgtttcatttgttctttgtaggcaactacgtataccaacacttgttgaagggaattcacaagcactcaaaccctagtgtgcactatttccatgaattatttttgaggattttcaggaactccctcgtgtcccaacaggaatgtgagtagttatcctctagagcgctttgattaccttccccacatcagactacagtcagcacatctatcttgcttatttctaagatcaaacaacaggacactcaacaatttagcaacttatcaacatgtaccaaactgaacacgtatttttgccagcaattgctgaaacttcagcatcacccatctgcttccttgtacatgtgcgtaagcgggttgggatattaacaccatactgcaacagtataaagtatagtactatagcctgcaatttccatcagtacgtatttcactgtccatttgaatgcccaagaaaggcaataagtataaagtatagcctacagttttgtcctgtggaatattagaatagatgtttttttagtcagtaaagtcgattgcccatcttccaaggatagtcgtgactgtcatttagttgacttcagactgttattactatatataccagttacttctactgctagtctgctactacttgctgtgcccaatggacccgacaatcctctcatcccccttttcactcaatgggctcgataaaccaggcctgccaagcggcaccctgtagctgcccttgctccaatgcgtcctctggtgccaagtcaaagtcgtatccctcaagtcgtgctccctatccgatttatcaactagctgacgattagtcacacggcttcataaaagtagaatggaataattattatagcagatttagcacaactaagcatgcgatttgaataattggccagaactgtggagattggatttggcacagtcaaaaggtggagaaaatgcccaacatcaagattgcacacaatcacacaatggaaaatgaaccttatgcagagataagaagcaataacttttttacagcaggactgtaagagtcatcagacttgtgaagaacttataaattccacacccaggtacaaaccagtgttttttattcatctggcatagttcacaatcaaaaaccatggaatacttcattcaacatatacattataaccactcaaataaacctatacaacttacaggtaaatatatgacaagaatgtttgctttctacacttacaggacggctaaatctacaaacacaacctaccaagaaaacaatgtcaagcagtaattgctgttatctggggcatcaacagattgcaccaaaattctccttcatttactgtgttccagtgttttgccagacttggtcgatacttaaggttcagttgttactgtctctgattgcagagaccttggggcactgatactactcgtattccactgaagtttctccctcgaatgttgtgttccagcgattttgccgacttggtggcaattaacagttcaattttttttctttatataattgctagctatagtcttgaggaatggagactaaaccaaaagggcagacactccaaaaagtggcatttacataatcctgcatgtgagaaagataattctatcagctcgcatgaattcctatgtcccctcacctaccacaatcatctcccaattctagcgctaagcacatcaaaacgctaaccctacattgtctaaagaatccaagaagccaaccatatagagtcgttttacatggaccatatagctagcatgtcatattccatctgatggttatctaagcaaaaaagaacacaacagttcttggtttcaactttcaagattaaacaataggcacaacattggtcagtaaatttgggtgcattaacagtgtatttgcatgcaattctaagaatggaaaagcacatacaagcaagggaaacagccaacaatcaccacaaatgaaggaaacagaaagatgacacaaaagagaaccacaagtccacaacagcaagttaattaggggttcttcacttgggatctacatggtttgctaggagcccttctttcagaaggatggtctacagactgtattacgtcaatgcatggaacatcgagaacttaaggaaacatgacaagcaagcaaggttgacatactctacacatcaagaaacaacaggaacaggatggcactgtagtatagaaaccaacctgagagactcagaatgtgaaaggtgtccaagcctcacaacacagcatcggatcttccagcttaaatcacaggaccataccgcatttgcttttcatctgaaaaaaagaacgaagtttgtcatcattcgccagtacgccacataataaatcgtgtttgattagtattaataataggcacaacccaggtatttatccattaatctcatgaagaaaaaaaaatgtgaaaagaaccctaaacccaacgcggctcccgtatagagaacatacacatcaagacagaaatttccaatccagacacgagaaactgtcctagcaacatgaagatctaactcgtacgcagctatacctaatctaaccagaaagcaactccacatagtcaactcgaagaatggagaatacagacccaacagattgcaatccatccttagacccagccataaaagatctcagctttggggatgcaatcccaaacccctccaaatcccctaatctaacaaaatcaaccggtgctaatctgtcgcagacccacacccgagagtcccaacgcacccaaatcccggccaaagcagccaccaaccaagctcgcgagcgagcaagcagccgcccaaatcacgcccaatcgcaagggttcacctacgggagggaggaaaccctaggcgcgggatccgtacgggaggggaaaggggaagagggtgggaggggctcacctcgacggagcggatgccggagaggccgcctgacttcgccgccgtccgccgccgccgccgccgccgcagccagcgaaaaccctaattgggagaggtggaggagcagcagcgagcagagcacgcttcgaataacggaatagcgcagcgaaagcactggaaaaagggggaaaatattttattattattattaattaattaataaagcgaagcgagtttgggtttgtaattgggttggagttggatccgattgtttgatgggctgggcctccagtactggatggtatggccctccatttcgcagaattttaacagaatgaaattggaattcatgaaattcacaagatcttgccgtaatacggagaactaattgggcgctcctttttttaatcttgcgattataattgtgggttcagagaaaattcaggatgaagtaattacaaatttgacgaattgatcacaatgaattgaatgaattgaatcggggtaattacaaagttggcgaatagactgcacaaaaatcatccatgatgccaattgaagttattagtaactaattacattgttatgtccgccgccactaatgaatcactctatcttcctaatcttgttgctgcggccggcgtcgtcgtcgtcgccggcggcgacgttcgccaccgccgcggcggccttctcctgcagcttgcggaccacggcggccttgagcgccagcagcttccggcggtgcgcctccacctcctccgccgccatccccgacacgtccatcgcgaccaccccccgcagcgccgccgccgccgcctccgcctcgcgcctccgcctagccaccgcccgcgcccgcgccgccgcgatgggcgcgccgcggaacgtgtggtactcggcgcgcgacccgccggggaagaacacgatggcgtggacgtcgccgccgcacgccgccgccatctcgcccgcctccttcagcaactccatgtgcagcgtccggtgcaacaagatgatctgctgcgccgccccgccgccggcgacgacgacggcgccggcgccggacgacgagctcggctgcggctgagcctgacgcttcttctcaccggaggcggaggcggccatggctgcgtccatcgagcgatctgtccatctgctccccgcggcgagcccttatataggctggcgcgcccacccgtgcgctgccagattagactccgaatccgattacaattagcgctaattaatcgggtgaattaataattgttaataatttggttaaatctcggaccgtccgatccgctctgtgtgtatctgatctggacgcgtggtcgttccgcgtgggtcccacccgttccttatattaactagtgaatatgcacgtgcaaggcacgttgtgctcaacataaattgaattgagcatattataagtataagaatctatttatctacgtgtattgtgtaaatatgacctaggtctagaatatacatacatatatatatatatatatatatatatatatatatatatatatatatatatatatatatatatgtaagtcctagtaattcataatctataatgattaagaaaatatctacaacacaaaatacttttgatatattgttttccattgccaagtcgataaggcagtgacaacacagacagtgattgaggaacaatgttgagctggtagcgcggtttgttaatcttgctatcactaatacttgatactaacattcactcatcaacaacgaaaaatgataaatactcaaaattcaaagaaaaaactccatacacaaaattctaattgattttcatcctcggaccaccaaccaaccaaactgggaagaccaattgttttgtggccttaggaggaattattcaaatcatgctgccagcccacaccccttgccattcaaacttaaagtttaatgccataagtggcagtaattctgatcaaccttataacttgctgaactcaccctaaattcatgaaaaaccaatgacaaaaattacagcaaaacttccatgatttgcattgtacaggcaaatgatacaaaattatctaaaggtatggtacatgttgacttaccccttaacacatttccattataaaaatatactactgcaatatatgggtgtgcctcaaccctttagggtgtgtttggataatgggaaatgaggggtgagattgggattgggaaatgaatgaagagttaggattaaatgtatgagggagaatgaatggttaagatttaaagaggggtgagaaattatttcccttagacatttgccaaacactgccttagcatccaagctgcttcatcaataccttatctactgaacaggcagaaatcagattcagtaaatctcctaactcatcagttaatagatgcaacaatgggggtaaatctctaaattgattcgtatgtgggtgattcagaaagagagagagagagagagagagagagagattcaggagagggtcgacggcgtcgaggaagcccgcgtggtcggcggcgcggccgtgctcggaggggatgacgttggggatggttcggaggcggcggcggcggaggaggaggagaggaggccgagccgaactggcgtcccgccgcagtcgccggcttgtggtcgatctgcaggctgtcaatgctggggtaacttgctgctgtcccgaagcaaaaaacaacaattttccagtgttgaaatcaatgtcatccaacaatccaagacatgtaaaacgttaccactggatgaatgatgcaagaacaatggtaaatgtcagattcaattcagggttctcgttcttgtggagtcactcacattcagatgatgcggctgcgacgagggcacaccacccagcttctgctgctgatacttgctcccgttcgcctcctgcaggagatcaccattgaagaggctgcgacaaccctagctcctcctcctcctcagaccatttcctccatgataggctccctccgtggccgcggccgccgcgtccgccctcgcgctcctcctcctcctcctgtcccgctcgccggtagcacgaggagccgcgtccacgtcatcacctaccgctcccccgccgcctctgcggccgcggccgcgctcccgtggatcgactgggcgcgcacggcgtcgatgaaggcggccccgggctgttgtccttcgcctccgatccgggcagcgtgggtcggtcgctggcgctgctcgtggagttcgctcatggtcggcggcggcgaggcccggcatggtcgggtgaggcaaggtgggaagtcacgcgggcggcgggtgaggctcatggtcggcggcggcggcgaggcccggcatggtcgggtgaggcgaggtgggaagtcacattgtcggcggcggcgaggcctggcatggtcgggtgaggcgaggtgggaagtcacgcgggcggcaggtgaggcgggcggcgtggctggcgtgcgttctttttttcgttctttttggcgtgcagtttcttttttcggagcaagacgcggtgttaatccggtgctaattgtaaccgcaggattaatccggcgctaattgcaatcatggtgttaattacactaaacaactcgtgctttttatattagtctagattagagtccaagtccgattcaattagtgttaactaatcgggtgagttaattgttagtaatagtttggtttaatcctgggccgtccgatccatttgtgtgtggatcagatctggacgcgtggtggtgatgtgatgcaattttccgcgtggggtcccttggttccttcgtaatcaagctagccatgggcccacgtgccagtcagagagtggcttgcgcactgtcgatgtgctgggcccaccagttttctttgatgggcctagatgtaattgggccttggtggatagagaggaggaggagagagaaggagagggagaagaggaggaggaggaggtcgccggcggcgaggagggggacgagatcgccggagatggacatcatctcgcagctgcaggagcagctgaacgagatggcgatggtggcggtgaacaccttcgggacgctgcagcgggacgcgccgccggtccgcctctccaacaactacccggacccgctcaaccccgccgccgccgcagcagcaaaccctaaccccgacgaccccgcccagccgcagcctggagcggcggcggcggcggcggcgggagctccggctgcgcaggcacaggctccgccggcgcaggcccagccgcccgcgctcgacctcgccgagcatcccaaggccatgagccacgcgctcgtcctcgccgccaagaaggtacgcgtcttccgtcgcttatcttctctgcttgccacctgctcgatgaaatgcctgagtgcctgctggttcttggggtctgacgctttagggcttggactgtaatttttggtgtgaccagccttagcatttttgtgtgattgcaaccacggtcagggtgcctggttctttgaaaattcttctacttacagaatcatatcttctatagtgagattgttcatgtagtgtggtagagtactttagttgcattgtgctgttttttagccctctcgagataattttgaatggatctgcaaaataggagcttcactcatattattcctcgcaaagaagggttgacgatgatgtggatcacaccaatctttgtactgttcctcgcaaaatgtaggtgggatgatggtatgcagcacaccaacctctgtctccagagggcaaactttgcatctgagagtacacttgaaatgtgctactagctactgtttccaataccgttctcttttttttttggtttttttatgcagtttgatgctcttgtttctgcgttgccactatcatctgaagaggatcagctgaaaagaattaaagagctacaggtatgtctcagttttgccctctgagcagtacattgtgaaagggtgacattaagctagtgtcttgtgaagatggtatctttgtgcatgtttccttctgttttttttttcctacgccttgtggatggagtttcatactaaggttgtcctccttagtcgcttgctttcttctgaatgaaggtttagcagacgctcggcagcatgtcctgccatagtatcagtattcatgatacttgtgtcctgcagctaaaatgcttatgaatttgaaatgcgcaggcagagaatgaagttgtaggcacagagcttcagaaacaactggaagctgctggtatgctttgctattacattcttggaatattttgccttcattatataattcctcaccatgttacaactgattatttacaagtccagtgttttacatgtcttgttgcttttgtagagctggagctgaagcaagttgaggctctttttaatgaagctacagatcattgtataaacttgaagaagccagagtaatagttatcaatgtaagtttggatttctcccttcactatctcaataaatctttagctttttttgtgcttgcaaaaaattatgcttgcgcttatgatatgggattattttgtgaccagctgtataatccgcttgacttcccaaacttggtacactgtattatcaggaagtcaggatactgataacaattttgttcttatggtgctttttgcagtacaatattctacatgcaccatttactagatggctgttggcatcatgtccatgatcaattattggtttatgtagtttatgtacgatgatggcctgaacaaaacataattatggtggatgttgacctgttatattaatccctcgcaagatgctttcataaaaccctctgggggcttgtctttctgttgatcagaaaattccaacacagtgttgttacgtatgatcgtagtatcactaaaatgacttatgtttgctttcctgtcatatcaggtaacggaacccattttggagtcatgaacagatgaaggtggagatgtgaatgccagctgccgatgctacatgtagactcagttttagtatcaagttagctgatgctcaacaatattccagtagtacttgttggattaggaattaaacctagcactgtaatttacagtaacttgaatagtttcaagctggttcgtttaatctgaaataatttgagcataacttcatgtttatttattatagttgggccactgttcgttcacagcagcacaggaccatatagtgctatgcaaatacaattaagacatgcctaggattcatactctttgaactttgaagaactgcactgaagatatggaacaatattatctcggtataaagcattcctctctaaagattacccaaacattgaggctaaacatgacttgaattctagcaactctgacactgaaatatagaacaccatattttctaggggcacttggacaaacaaaacatcccttgaaaactttatttgtcaagctccagagattggctggctaacttggagcaaactctcaactcaggcatacttgcaattgccagaacctgcaaaggttggcaagaaagccatgtaaatttgcaggattcaggtgaaagaaacagcaagtgaagcaagctttgaagaggctaatacttactgggatcagtgatggtgatgaggccagtgccgttgaagaagcaattccatgagttcctccccctggcctggtagtaagcgttcatggtgaccgacgcccgcgtcggcaggctgccatcgtcgtcggggaaggagcatccgccggtgccctggatggcggcgcagtcgctctccgagcaggcgaactccaggttagccctcaaagcatcctcgctggctgctggatttggacacaccatgtcttggatgactgcaggttttgctcagtttcaggcaagaacagttgatgagcatggcaagatcatatgatgctgccattctgggtttgtttgcattgctgcagaattaaggagaactgaaatttcttgatgagaactgagaattgtttgtttgtttgtttgtttacctggctatggtataggctgggtgctgctgctgctgctgctgctgctgcatggaatacagattgtggagcattttgttgagagaatgaggattggaaaacatggagctgattattttgagcagacaaaatctcatctgatttcaaaaacaatagaaaaaatgtttgatgaagaaaagtaggctgtaagtgagagatgtgtaccgttgctgtgcagcatgaagagtgcgagagcaaagaagcatgtgagcaatgaggcagtagctgaagccatctcttttccttctttctgaacctgagaatgcaatgagcttctttctctgtattatgatgcgtcagaagaagcagcagcagcgtaatgatttgggctctttgtttggaattctttgcacgaggaaacgctgaaggtaatatataagggaggaggaagaagcaacagaaagggcgtgctgcagaaacggttggtcttcaaatcaatccaatttatgtcccatttatttgcgagaataatggctcagtgcattgcagcattgctactatttatcatcaggacggttacaagaaatcccagtagataactagcagaatataattggtcaaactccagacaatactcagtagtagtacataactcaaaattcacaatttgatataaacaaatatacacaaaaagaaatctattgttttcatcacagaggcaaatctccccaagcaacataagaaaaaaaaattacggttttcctctcctcaagttatttatttatttatttccccgttgtatcattgtatgtcattcgttctatttcgcagtaactatacaaggagctaagacagaagaaaacttatgcacatggagctagctttaccccacaccacattcttgattcttttgttacaaatcaacatgaacaaaaccaaaaacaaatctaatcattcgtttggtcccctatctcgcagcacaaatccaatgcatgcatttgatttgagtatttctcacaaacgatatgttcatgcattctgtacattaagaacagatttaagctccattccatcagtccataagcatttgatcatcctgagtacagcctcagcttggaccgaatcgtctgtcgacaaattgggcatttggtcaggctctccccacattccctgcagcactgttgttttcacaaagaaagagaatccaatcaaacaaatgttttttctctacaattttgcatgtcagaaacaatccgatcaaacaaatgtttctacatatttgaatagatttcatcatctgttaagaggttaaaaaagaaaactctgaattagtctgaattttcagtttaccatgtggccacacccaaatgccaagtccttggcattggtcaggcagattgggcacacctgcaagaacaagcagcaggtgatgtgtgagtcaaatcttggtcaaacctaaattacaaggaaaaaaagaactcttgatgaaactatggcaatttgctctacttgatcctctcttggtgacggtggggcggcggcagcggtggcggcggcgctgtcttccctcctcagcgatggctgcctccccgccgccgacggcagcggcggcggagcaggcatgatcctcttagccttccccgtcgaccggcttcggagcagcatcacaaaataaatcatcaggtgaagaagagtagaaacagcaatgttgaccagctattggatgtacttcctccatttcataatataagttattctaaaatttcccacatttatattgatgttacatcaatatgaatgtgaaaatactataatgacttacattgtgaaacggaggggtatgaattaagtggtgtttaaaactgatgaagattaagttagcgcgtaaaacgggaaagtcattagcatatgatgaattaagttttaattattacaaatttgacaaatggatatatttgatattttaaagtaacttttatgtataaattttttggacgaaccaacccatttagttgtttgaaaggtgtgctaactgaacccgagataaaaaatgtgaatttgaatattattcgtgccatgcttctaaaagtacgatttctccaaaagccttatgcgtaagtgcttcttagataatttcttatgaactactccctccatccaaaaaaaatctcaatcctgaatttgaatctggacacaacccaatcctaggtttttttttttttgatggagggagtatttgttagctttgtactaacagttaatctatccccagcaccagatgagcaattttcttaagtccataatctatctaatcatccggttagaacacgctctactgatagatatgatccattatattagaaaaaaaaatgaacggtccagattaattctactactagcagagaccattgtaaaacgtctcggcacaaacgttaagacttaccctaggatgccgagctccatggtggccttgtattggatgggcacctccatgagagccgccaaggcgaacgccgactctttctgctgctgcgtcgtgctcctcgacatgatcgacgtgaagttcacaaactgcacaaaacaattaagtaaccattgcattattgcatgtttaatctgcattgcattgtgatcaattcatctccaagattcagtttatggtgatgagattcagaggttaacctgaaagttgtcgaactggcgagccgggatcttgtcgtcgaacttctgcatgtcttcccatgggccatctccaactccaacaagaacaatggatagagggtaggagctgagtagatcaatcaacaattgaaaaagaaaaatatttttttcttaagtaaatttaaccaatgtctttttgcaagtctgaaattaatctgaaactttgcagtttgtgtataccttgccatgacaacggagtccactgtcctcctctcctgggggctcagatcattatcgcttgtatcaacactcctagtcacctgaattttgccacaaatttttttattaccagactgagtgaattctactagagagtgagtcagtgtgactttgcagaagtgttcttcatttcaaggagagaacctgtccatcagcaacgatgacaagaacatgatactgtcctccactcctgtcaacaatgtcgacggccgcctcgacgatcggcgcgaaagaggtaggccctgcaaattgcacacaatttcaccagttgaattgtcagtgacagttcagttttctgcaggtcaatgcacaatgcagaaggtttttcagagatgtgaatagattggatcatcaccagatagcctgaggtgtggcacaatcttcttgtagcatgataggacctcctcgaatccatggcagggtgagttgtcaggatggaagctgaacacattgtagtcatgtgtggttgctgcaatgggaaaaaagaacagcacaattcttcagacaacaaagaagacaatgaacatctatcatatgatcatatgtttttttcctcaaatgtctaagttctgcacaaattttgtttacaattcttgaacatctagcacaaatttgagcctcttaccgtcgccgaagccaaagcatgggatgagattatcatcgtcgaaaggtgccaatgtcttgccgatgatgctgatggcttgctcatatggatttggtgtgctgcctatcttgtgcaggctctgcccactgaacgaacgcttccctgaatacacacagataattcagaactttcagagcaatgcaggcaagaacatgagcagttgaaataatcagatcagatcgagcaaggaccaaggagttcttggtgaagatacagttaggacattattatcgaaaaaatatatttatttctcctaaaaaaaatctacctgtccattcgttgctcttggtgaagtctatgccaagtatcaggttcgacgactcgagcccttgatctcgcagagccgctgtcacctgaagaaaaaaaaatcaatttgttgttcaggcattgattcgatcagcaattcagaagcagaaacatgcaaaaaaaaagaagcttaatcaatcacaatatttggtctatttatcagtgatctcgtcgtgttcatccacctgatcgagagactggtagttgtcaggtatgtacgagtacttcttggtcagcatcgccctccggtggttctcgccgccgccgccgtatcccggctggttcatcggcgctctgtgcatctcacgacggtgaccaccaccgcggaataacgctccgatcacgccgcccatgtgatgcagcagcgatgacgacggtggctaagaacctcagcttcttcttcttgtacatgcgagaagcagctgctgtcaagctacctcctctctgcttctcagaaagttcagagatcaatcgattgatggatgaattaaagccgcaagcaacgaacaagatcgcatagaaggcaagcaatcgatcaacgaggatttattcctctgaaatgagaggagagtttttttgcagcgaagcttcttgagtctttcgctgagctgagcctttattccatcgaccatcgtgtcctactgctttaggtcggcagaaacgctatagctgtttctgtacttgttgagtaatcacatcggtaataacagtttgtggattggattttttcagggtgtaatctctgaaacctctcgttaatcatcagccaaagctgctaaatctgaaaccaggagctgggcattctgaaactttatggttgtttttgctgcaagtgttaaagttgcagattcttgtggctttctctggagcctcatgagaaagcggctcagggattcttgaaaaaaaaatgcagacagatgcatcgtgacagtgaagatatgtttggatcattgcttgtttttggattgctgagtcaatctgatgtgttctcttgatcttttggccttgcaactacagggaaattaaatggatgtaaagccctaaagcatgtgagctgtagtcttgatttagaacatggaacttttccctttcgaaatgaacgtatcaaggccgcctttggaatggaggaattttgcgggaatttcgtgggaattggactgatttctgtggaatttctgcgtttcgaaggagctcgaaattctataactaacgtggagcttacgatgtatgtttgtgataagttccatacgactttctaatgggacaataaaagtagtactgcgctataattttggttcaatatgtgatattaattgatacccttgaaatcgaaattttatggtattgtttgaaatcgacaaaaaattatatactatggttggagtttcctcaaactctatgtgttctaaagttgttatggattatggctgaaactgccgcttaaaacgaataacaacatattattataaattaaagttaaagttttgattttaaaaaataattctaagaaatactaggaaaaatcgtactgtttgcccgtgataatgaatactccctccgtcttaaaagacgtttttgaccgttttaaaagacgttttgactntggtcnaagtcnaactgttttaagcttgactaagtttatagacaaatattgtaatatttataatactaaattagtttcatcaaatcaataattaatatattttcataatcaatttgtcttgggttgcaaattttattatttttttctacaaagtttgttaaacttaaaagcagtttgactttgaccaaagtcaaaacgtcttataacttgaaacgaaaggagtagtccgtaagggtaggggaactaaactttgataccgtattttattccctttgcgaaaacttttcaggtatattttttccgaagtgaatacctgaaaacttttcagttcgatattaatcatggattttataactgagtcaattttgcaagacaattttcttatacccttcaaaagacaagataataacctttcaggtcagctaagaatattggtaaagcaggcaaggagatgatcatgttgtgggcggttttttttaagactatgggcagttgattctcactgggaatattgaaacttacatgtggcgcgcatatgtgcgccaaattgtgtttggaaaatgttctaccttttccagctacaatactagacattctttgcaataataatcccttttcaagattcgtgaatgaataaagtgtactccctctattccgaaaaaacgaatctagtacaggatgtgacatattctaatacaatgaatctaaacaaaagtatatccagattaatagtattagaatgtgatgaggatgtgtcacatccagtactagttttttataggacggagggagtatgtaatatatggtatgggccata

SEQ ID NO: 58086 - DNA, 11274 bp, Oryza sativa
  unsure (1)..(11274): unsure at all n locations
ttcggtcacggaaaattgtgtagtaaatgggaacgaccgttcaacgtcatcgatacctctttgcacggggcaatcacactccgcgacaattcaggtaatatattcaaggtaaacagtcaacgcttaaagattttccttgagccaaatgaaactttagatgaagaagtggatgtcattgaattaattgattatgaactatgatgatttcatctaatgcatgcttaaaaccctgtatagttgtcatttttgtgcttagattaggttttaatgagcctagggaaaaattggcagctagctggacccactagggttcgtccgaacctgctggttcggctgaaccagggcggcgcccgatcagccccaattttgaacctcagtctcccccgctcatctatagtctgttgtgatgcgcattcgggggtagatcagtcgtatcagacccagaaccctgtccttcctcctctctcccacttttgcaaacctcctcttcttctcatctcaattccattgcttcatcaccctcaattcaccagtggctggcaaatctttgatcccattcatcggctcttcctccaactccacatacaaccttgacggagagccgacaccggtgaatcaattgatcctggtggagcattacacgatggaaggggtgaatgcactgtgggcacaaccccttgcaacagtgccaggctcccctgcgattctggagctgatcggcaagctccctggttcggccgaacccttctcggccccgttcggccccccgttcggtagtgcgatccctctcccctcgccatgtcacaaggacaaaaattcggggggattcgcttgcgcgacggccgacaacgggagaactcgtcttgttgaaggcgcgacgccttttccaaaatgatgagaaggccgctccacctcccgccgagcgctatgtaggcaccctgttcaccaaggcaggggatgaggtgttccataagtatgttacacccaccgctactccatccactccgaaggaggagcgtttccacattcaaggagtgcgaactcctggtggcgggtatggcaagggtttactccggccgttaacagcatcagagaaggagggggcagcggaatcccatagccctccacctatgaaggtgaagcataatttgacaccccctccaattgtgagggctcctggccaatatcaagaagatgaggtgaagtcgccggaaccctcgatccataagctcgccgcacaagtgaagaaactccgcaaggagaacatagagcttagggatcgcaacacggagctaggggtagagcttgctgaatttagaattaatttcaatagccttagtcgcggtttgtgcgctgagatcaagcgcgcattcgtagaaatgggaaaggaaaataagtattacgctaattagatgcttcctttccatgaataacatagtagtaggtgcttggttttatttttccaatcatttaagcacttgctacgaataatgtggctcattggtgttaaccccaatgtttgccaaaatttgttttgtttcatgtttaataaaatttaggttttgaataagtgtgggggagatatctcagcttcttacgtgcacataatctgaaaattacttaatgtctgaacacctggaaggcactgaactctgcagaaaattgcagaggtattgggcaccagagtggttcggccgaaccaccaggttcggccggaccagtgttggccgtagtacctcccagttttcacaagtaagcaggtgagcacgtcttttatctgtatatctccaccatgatatagtactagagctaaaaatttagaaaacaattggttcaagcatatgtgaaagataaaatttccaactaatgaaattcttcatgtgattaaacttgtatattcatcattctcagctgaacttgtgcttgtgaaccaccatccatgtttagcgaaccttatgcatctaagtaattgctttatgtgagatgattcaagatgaagggaatccttgcaactcttgttatgactcttgggaatttgttttcaaaaataaaatggtttaaaagctcaatcctccaattgacttcatcttatacctaccaaggtgtcacaccctgaaaattcaaaatatataaattgttgcttaattggaatttttagaaatgattttaaaaaaaccctagaagagaagatctaattttaattaataaattccaatataaaatggggccagataaaatttcattaaatactttgcttaattctataattcctagatttttctgggatttatttgagctaaggaagtatttttaataaatggaattgcatttcatgaataatttaaattgaaaaaggttttttaaaatcctcttttggctttgggccgaaagtcggcccaaaacccttttctccctccccggcccaagtcggcccagaccgcagccgccgcgcgcgcgcgttcggtcgctgacaggtggggcgcacctgtcggacccatcgtctacctccggccgccgccgcccgaaaccctagccgagccgcgccgccgtccccttcaaaatccggccgctcctttccttctccggtgaaatcttttgaggggaaacaatctccgggatctcctccaccttttctcttttggaatcatcggcttaatcgttttggaagttcgtggattcgaggtcgaatcggatcggtctctttcctccgaaccccgaggtttccttcgcgtcgccggtcgccgtggtccttcgccgccgcctcctagcccctttaaaaggatccccaagctctcctctacccgtcgccactctcgccttcgcctctcgtcgtccgtagcgccctagcgtcgtgtaacctagcgccgccgtcgtcgccgccgctcgagccgtgcgccgccgtcgctcctgttgtcgccgtcgccgtcgctgaagaccgccggagcaccgtcgccgtcgtcgagccgaaggtctccgccgtttcaacctcgtcgccgtcgccgtccgctgctcctccgccgttgctttggtcaccggtgagttcgccgcgtcgcccgcttcgtgctggtgtcctccgttcgcgctgcagcgccgtcgttcgccggcgagcatgcgcgcccgagccgcccgagccgccgccggtgatgacgtcaccgctgacgtcatcgggaccgtccgccgtgagccggccgtggaccaatctcggccgtccgttttggatggatcaatctcggccgttcgtttccgtgtgccgccgccgtgcgcccggtccaccgcaaaccctagccgctgacgcaataaatccctttttccttttcaaaaataattcattattgcgtcataattcaattaaaatcaatataagtgttttaatccgattaaatcttcaaaaattcataactaattcatcttagctcggatttagtgggttcaagtctctaaatttttctaaaattgagatctacatgttaaaaatatccacatgtactgttcatgcttgtttatgtgctgttttggtgattttgctctttcctgcttagattctgacgttcccggagagtccgttttcgtaggagaagattttgaagagttccaaggccagcaaggcaagtcacacagatcccaaacaaccctttgagcatattgatcccgtttaaagctattgtttcttttcaactattgcatttattttcaaatgtcattgggtggaattaacctattgtttgttatagcccttttgttctggattactttattccttgatatcttgggttattataacttgactagttgagctctatatgttggttcaactagatgtattagatataattgcttagccctgcttagaaactttagcacactattgggataactttatgactcactattatttaatgatggcttattgatagttcacgatggtcaatcgtgattggttaattaattaatgtgccaactaaaacttgataatggtgggttgtgagcacatggttttgagagtcgtgctcatgacaattaaggaccggttcacgagtttcggttgtgaaacattaaccatgccaaccacaagccaacatgggcaacggctttatcttttgtatagcatggttcattgcggggcaccagactgagaagtggcagagataagcccacgggggtcactggggagtccatgccttgtttataagggggtgattatgatccaggaaaggtgcactgtagtggattgtgttgtgcaaggggtattgtcacaactcctttccgaggtaccgtggtggtattgaggcacatggtgacatgatgtggagttgtgtcttgtgggtacagtggtacacctctgatcagagtaaaactattcgaatagccgtgcccgcggttatgggcgggtctaacaatgtctttcgtgattagtctcacacttctcaccataataaatgatgctttaattgataataatttgattagctcctggtttggaatggtatattcctggtttggagatagatctgtacagccgggtatggttgttcagaatggttgggcctatacaacagggtatgttgtatagcgttggattaatattgtttaattattacttaacagtttcattaaattctgaaatgtttattaaatgctgtttatgcaaataaaaccctactatgccatcctttgttatcctgtgcacttgcatgtttgctgcgtggcttgctgagtatgtcatatactcaccttgcaatcattcatcagaggaagagttctacaatgatgctgatggtgtggaggattaggtgtagccctggtcaagctgcctgtggagtggagtcgtctgcgccgtttatcttattttccgctgcttagatctttattgattgagaggaactatatacctctgtaatgatattttattcgcttattaattagaataataattgtactctattatcaatttgttattgtgtgcctcggctgattcctggacgagggattcacacacatgtaagcgtttggaattttggatagaaattccgggcgtgacaagttggtgtcagagcccccttgaccctaggttatgccaaatggttacccatagaagccctctaaaaattattggaaaagtagaactgttctcctccccttctcttttaattaaaccaaactaatggcacatgcacttcataatctcttttaatggttctcattcaaaatctattccagtgttattagtactgtacatctattactgtactaatggctcattttaccagcaaaagttttacaatattgttttatttaatcttgatgcaaggaaataaatttagcatgttatttaatcttttggaacctgttgttcaaaagtacaaaatttgtaaccctgtttccaactgtttcaacttatcttgcaagcttggtttattttatttacttaccttttactttgattttctaactttattcaaattaatccaaaaacttgtgctattaattggataaatgtcttaactccctcctttcacttgtctttagatgccgcgctacaagcctgagtacttgtttggtgttgagggatttgtccaggagttgcgtacgatgtcctttgccataggatttgggactgctcctttttatgctcagattcctcatgatcgtcatgaagagaagtgccgagtcaaagtcaccttgaacagtaatagtgaagatgtcccctcagtgatgttcgaagctagaggaagaaactacaccatgcatgtcaggaggtggcaaggatcgccataggagagctccgcgatcgctatagtgatcagttggccgacactgagtatcgctaccatcctcgccaaccccagggaagtgaccgtggcagctacctagagactgaaggaattgagaatgatgctaccacaaggcatttggttgagatgctgtgggctgtggatgaaacccgtgcggagactgtattagcagctcaagatcgtgaagaccggaatcgtggaaagatttgcaagctagaggacaaggtggatcgtttggagaaggaattagccgcattgaagggagaagcaccaccgcagaaggccaggattcgtcttaccgcaaggaagagagctctttttgtccctcgctaccaattggcgccaaaggtccgtgtggtggaaaaagaagttaccccagttctagtagatcctccggtcatcaacgtaagtgatgatgaaggagaagaatcgaagcacactcattccaagattgagtggagagcaactcaagatgatgaagacgagccgaacgagccttcaatcaactccgatgcccggaagaactagaatgccatgtcaagccgttgtcttagatcgttgtgttagcttgtttgtttaagtttggttgtgtgggtcttgcgtgtaatttacatcagtggtgggatgtaagtgcatgcgtttgtttgcttctgagtgttaggaagttggtgagtttagtggtgtgagagtcttcagttttgtaataatgaaactcacttaagatcaataaaagttaaagtaattctctgtcctaagtagttttccccggtttctcttcttgtgtcctgcccatgccagatggtgctcactcacagcaatgggaatggcccccaacaacaataacaacaacaacaacaatggagagaatcccacacttgcccaagtcctggctcaacagacacaacttatgaacatgatgatgcagcaactccagaaccagcagaaccaggggaataaccatgcacctccccagaacaagttagcagaatttcttcgtgtgaggccgcctattttctctagtaccactaatcctgttgaagctggtgattggctgcatgccatagagaagaagttggatttgcttcagtgcaccgatcaggagaaggtctcatttgcatcacaccagttgcatggccctgcctctgaatggtgggatcactttcgccttaacaggactattgctgaacctatcacttggcttgaattcaccgctgctttccggaagacgcatatagcatcgggagttgtgtctctcaagaagaaggaattcaggtcgctcactcaggggtctcgctctgttacggagtatctgcacgagttcaatcgtctggctcgttatgctccggaagatgtgcgcaatgatgaagagcgctaggagaagttcttggaaggacttaatgatgagctttcttactcactcatgactggggattatcttgatttccagaagttagtggataaggctattcgtcaggaggacaagtacaatcgcatggaacagaagaaacgccggattgctcaattcaagacacaacaggggaataatcaaagaccgggttttactttaggacccccatccatgccacaaggaggttttttgtctgttgtttgtccgcagggtcagtttttcaacaacaatgctggcaacaacatccggtaatcaagctccacgccctgttgcagcttcgacacagcaacaacctgccaagaaggagcaaggcagcaagcccgtggtgtgtttcaactgtggagacccaggacattacgctgacaagtgtccgaagccccgacgcgtgaaggttgtccctgcccagagcaactctaccgcaccagcgccaaaggcccgtgtcaatcatgttgctgctgcagaagctcaaggtgctccagatgtgattttgggtacgttccttgttaacttagttcctgcaacagtgcttttcgattctggtgctacacattcattcttatctatgagttttgcgggaaatcatgggatggaagtagaagatcttagacgtcctttgatggttagtacccaagtaatcaagcactctctttgcaacgtagcccctctgtcagaatagaaattaaaggagtaccatttctggccaatcttatcctgttagaatccaaagaccttgatgtcatcctaaggatggactggttagccagacataaaggtgtgatagactgtgccaatagaaaagtaactctcaccagcaatgatggtcgagttgtaactgttcatgcattgtcttctgagtttttaaggtcgagactgaaccaaatanctttggaagagattcctatagtccgggagtatcccgatgtgttcccagatgatttacctggtatgccgcctaaaagggatatagagttcagaatagatttggtaaccaggaacaactccgatccataagagaccttatagaatggcagccaatgagttggcagaagtcaagaggcaagtagacgatttgcttcagaaaggatacatcagaccgagttcatctccatggggagctccagttatttttgtggaaaagaaagatcatacccagaggatgtgtgtggactatcgtgcactaaatgatgtgactatcaagaataagtatccgttgcccagaattgatgatttgtttgatcagcttaaaggtgccaccgttttctccaagatagatcttcgatcaggatatcaccagttgagaatcaaagaggaagatatacctaagacagcttttaccactaggtatgggttgttcgaatgtactgttatgtcttttggactcaccaatgcccctgctttcttcatgaacttgatgaataaggtgtttatggaatacctagacaagttcgtggtggtctttattgatgatattcttatctactcccgaaccaaagaagagcatgaagaacatcttcgccttgcactagagaagctacgaggacatcaactgtatgctaagtttagcaagtgtgaattttggttgtctgaagtgaagtttcttggtcacgtcatctcagccggaggagttgccgttgatcccagtaatgtggaatccgtaaccaactggaaacaaccaaagacagtttcagagatccgcagtttcctaggcctcacaggttattatcggaggtttatagagaatttttccaagattgctaagcccatgacacggttgcttcagaaagatgtgaagtacaagtggtcagaagaatgtgagcagagttttcaagagttgaagaatcgcttgatatcagctcctattttgattttacctgatccaaagaagggtttctaagtgtactgcgatgcatccaaacttgggttaggttgtgttctgatgcaagatgggaaggtggttgcctatgcatctcgtcagttacgtccgcatgagaagaactaccctactcatgatcttgagttagctgcagtggttcatgcgttgaagatttggcgtcattatcttttcggtactcgtacagaggtatataccgatcacaagagtttaaagtatatctttactcagccggatctgaacatgagacaacggagatggttggaattaattaaggattatgacatgggaattcattatcatccgggaaaggctaatgttgtagcagacgctcttagtaggaaaggctattgcaaagctacggaaggatgacagttgccattggaattatgccaggaagttgaaagattgaatttgggaattgtccgaaggggtttcgttgcagccttagaagcgaagcccactctaattgatcaagttagagaagcccaaattaatgatcctgatattcaagaaatcaagaagaatatgagaggaggaaaagctattggtttcttggaagatgagcaaggaactgtatggttgggtgagagaatctgcgtccccgacaacaaagatttaaaagatgcaattctgaaagaagctcatgatactttatactccattcaccctggtagtaccaaaatgtaccaggatctcaaggaaagattttggtgggcaagtatgaagcgtgaaatcgcagaatacgtagcagtatgtgatgtttgtcagcgagtcaaggcagaacatcagaaacccgccggtttgttgcagcctttgaagattcctgaatggaaatgggaagaaatcggtatggattttatcactggtttacccagaacgtcaacaggccatgactctatttgggtgatagtcgacagatttatcaaagtggctcatttcattccagtaaagacaacctattccggaagtcagttagcggaattgtatatggcaaggattgtgtgtttgcatggcgtccctaagaaaatagtgtctgatcgaggcagtcagtttacttcaaatttttggaagaagcttcaggaagagatgggttctaagctgaactttagtactgcttatcatccggagacagacggacaaaccgaaagggtgaatcagattttggaagacatgttaagagcttgtgctttagacttcggtggaagttgggataagaatctaccttatgcagaatttttgtacaacaacagttatcaagctagtcttcagatggctccttacgaagcactgtatggtcggaagtgccgcactccgcttttgtgggatcaaacgggagaacgtcaggttttcgggatggatatcctaagggaagcagaagaaaaggtaaagatcattcaagaaggattgcgagtggctcagtctcgtcataagagttatgccgacaatcgccgcagagatttgagttttgaagaaggagattatgtgtatcttcgtgtcacgcctcttcgaggagttcatcgtttccacaccaaaggaaattggcaccgcgttttgtgggaccttataagattgtcagtagaagcggagaggttgcttatcagttggagttacctcaatctttggcaggagtccataatgtgttccatgtgtcgcaattgaaaaagtgtttaagggtacctaccgaagaagctaatcttgaacagatagaagtccaagaggatctgacctatgttgagaaaccaatccgtatcttggaaatagatgagagaagaaccagaaatcgagttatccgcttttgcaaagtccaatggagtaatcactcggaagaagaatcaacttgggaacgagaagatgaattgaagtcagctcatccgcatttgttcgccagttcttccgaatctcgaggacgagattctgtttaaggggggtaggtttgtcacaccctgaaaattcaaaatatataaattggtgcttaattggaatttttagaaatgattttaaaaaaagcctagaaaagaagatctaattttaattaataaattcccatataaaatggggccagataaaatttcattaaaaactttggttaattctataattcctagatttttctgggatttatttgaaccaaagaaggtctttttaataaatggaattgcatttcatgaataatttaaatt

SEQ ID NO: 58087 - DNA, 4356 bp, Oryza sativa
  unsure (1)..(4356): unsure at all n locations
gtataggattagtgcacaatgacagctaataccctgcaatataagccggtcaaagcctgcagttcatcttcagctatcctttttgtaaacgatcatcttcagttaccttcagcgatgactgaaaaatcgctgcctcaatatcgcagagaaagagctgaactgtttatagtttagtcctgttcagattcttatttcacaaataaatccctgagaaaactaattgcaggaatggaccccttggctcttactttttttttccctttccaatatattttattgttgtcttacaaatttgggaacataaattacatactaacatttaactttatatctacaaataaagaggactacatgtaaaaaaacagaacatgtagtatatatcatttcatatgtttcaagttaaaaaatggaacatgtagttttaaaataatattgggagaataatagtcaacataaattatataatacatttaactttatagctataaatagaaagtactccccccatcccaaaatataagcattttgaggttgcttagcaaatactaaggttaatgaaaaagattccctttcagtcacctcaatggtcaaattttgaattgcttagattcccttcccaagcacctgactagctgaaaatgtatggattttcatgcaatgaactcagtgccccagaaatgcttatattgtgtgacaaaattcaatcctagagagcttacaaattgataattttcacatttaggaataaagatgaatttacatataaaatatgtaggttttcacttttcaatgaaaattaggggagtacaaatgtaggattgataggagaaaggtccgtaaaaagatatcgtcagtttgaaccttgctctcttggatgaaaagcaaaacccttaccactttgttggcattgttttgttgtgaggtaatgtcttccacatcatttttgagtggtgcagaggtcagtgccaagcattggcattgacctctgataacatgacaaactcacagaaagagctcaccagcactgaggcattatagctcaatgcctttgaggctggatctgagcaaagggtacattcctgcaattagttttcccaagaaaccagaaagtgctaaattacaaaaagttcaggacaaagagggttggtagctattctgcactgtaatggtgtattgcattgtcataagataagcagatttttttcctaaactgcaaactagctttaaacatactggctttatggtggctacacaaaatattccgtagcatggcataaatatttatttcaaaccctgaagagacagaaccgatcagagaaataggcgctgcaccacctttactcagttatattctctccaattccatgtcaaaaacagaaaaagcagtaaccaaggtttggatctcaattctcaaatattggtatcaacttttcttattgttttcctgttctttccagccaacatcacctcctgctctagctagcatgcactagctagcagccaaggtttcgatcccagtctatgtcacattttatcaaacatttaaccatcaaatgttctgggccatcaaaaagtttggatcatcattaggcccacatattggctgaatgaaatattgttgcctggttttttaagctaaggatcctggttttttcttgttcaaccgatggtccaggccaggaaatagtaacactatttcaatccactcaactggtacctaaaagtattaaacacttctaagtactatccaggaatggtataaaaaataagtatcgaacttctgcacgtaaataaataaataaatggtaaaaactactccctccgtcctaaaatataagaangtttggttggatgggacactaagaatatggacataggatgtgttccatccaaccaaaactcattatattttgggacggagggagtacatggaatataagacccatttgaaaaggaattaactataaagcaactaaccttccgccaccagttcctggagtgctttatcgccctccaccagtttcagtgctattccatcaagcccagttgtatcccacatcctatcagcctccttattcagatgctcatttgatctcatgaaaacagttttacttccttgccattgcccaccaaatttgcttgactcggcctctggtgctggatcaccattctcaacaactgaaatatcttgaactttttcaggtgcaaaagttacagatgctgaagcatcctcgccagtattcttttcagcttctccgaccaactcaaactttggtgttcctaaaagttctaatggctcttctgttctattccagtggcatactatatcaaacttaccatccttcggcagctcaacaacacggttattaccatcttcccatattttatcttttcctcccaccaaaaatataacaaatttaaactccacaagtgtttctccagggagcttaagctggcagacccaaccatttgtagtccattccagttcaacctgctcctcccatgaaccaagctcctttgtggaaccgataatgcctacatgctcaccaaacttaacctggtgctctagacaaacctggagatgcaccaatggctgctttgaagaatctcttctctttttctcctttgttctgtacaatgtacagtcaaattatagcaactgtaaccaattaattgtccagaaaatttaagtttgtaaactggaaagtaaatgtgtgcaataaaactctttaaaatgaaccttttcaggttcacaattttagttaatcacttgaagccagaaaagaaaaggcaaaccaccattgtggaaaaataataataatgacagacagattgtcaaggaatatggagatagtcagttagtatacagaagtctagataatgaaattacgttacattatctctcattcaaaatttaaatagcaatcaagtgtaaccatgtttcattgatcctgaaggaactataataacttaagtaaacaaataacgaatgcagtctatctcagtttattatgcttttattttctcatataccgctacgttggtccaatatttggcatttctttgattgatcccttggttacattaggtagacttgttgtgttgttgcttactagtttccatataaacttgttctattgggctgtatcacaagtttattagtagcaatttccaatcgtacgatgttgacagaactagagttgcaatggataatatccaacacgaaagacatctcggaacaaactatacaatacaactgcccccaacacacagagcttcgctctaccaggtttattgcacgcagcctcatgaaagcataagagagaggaggaaaaaaagaacaagatatcacctctctgccgccgaggccgcggatctcccgcggcacgcgaagccgcgccgcccagggagcgccatcgctccccggcggagcagcacacccgcaccgactccgggcggcgggaggacgagaccacggcgcggcctgccgcctatggagagcgaggtttcgaggggccgcagcgacgtcattgatcctcctcaacggcaatccgccgaacaggtggcggtcgctcccggaaggcgtcgccgcgtcggtttgttcgagaaggcacggagggaggggaggaggaggatctggggctcaaaagcaagcgagcgagtaggcctcggaccgcgtgcgaggaggatgcgctgcgaggaggacgggtggagtggaaacgagaagaggggcgagacgatcggggtggtgccgtcgtggcagactgacaggggaggggaggaacgagtggacgggccgacggggttcccgtgaccgtttgaccggccccatgcgcgaccaccgtacttatcatatattcggacctgtttggagaaagtttaatagtataggtaattattagcttcaatttatctatagctaatcatatcttatttatataatagttaactataaatatatattatatcatcaatatatagtcccacctctcatacacactcaacgtattggagtccgttctgcagtctgctacaaatatgtagcccgttttcgtctctctcttctcttctctcctccacatgtgcttacagttgacttaggagtccattctgccgcctgctataaatctgtagcccgctttcctctctctcttcttttctctactccacatgtgcttacagctgacttatagcatgttattgtactcgctcttagcatgttattgtactcgctcttagttcacgaaaagaaaatttttggttgtcacatcagatgtttgaccggatatcggaaagggttttcagacaccaatgacaaaactaatttcataacttacctagaaaccgcgagacgaa

SEQ ID NO: 58088 - DNA, 35369 bp, Oryza sativa
tcctttgttatggcctgtttgcattgattactttattccttgataccttgggttattataacttgactagttgagctttatatattggttgagctagatattagatatgattgcttagccatgcttagaaacattagcacactattgggataacttatgactcactattatttaaggatggcttaatgatagttcacgatggttaatcgtgattggttaattaattacttgccaactaaaacttgataatggtgggttgtgagcacatggttttgagagtcgtgctcatgacaattaaggaccggttcgcgagctactattgtgaaacattaatcgtgccaaccacaagccagcgtgggcaacggctttacttttcgtatagcatggttcattgcagagcaccagactgagaagtggcggagataagcccacgggggtcgctggggagtccatgcctctggtttttgagggggtgattatgatccaggaaaggtgcattgtggtgggttgtgttatgcgaggggtaatgtcacagctcctttccgaggtaccgtggtggtactgaggcacatggtgacatgttgtggggctgtgtcttgtgggtacagtggtacacctctggccagagtaaaactattcgaatagccgtgcccgcggttatgggcgggttgagcaatgtttttcgtgtttagtctcacacctctcacaataattatggatgttatacctggtaataatttgcttagctcctggtttggagttagatctgtacagcggggtatggttgttcaggatggttgggcctgtacagcatgggtgtgctgttcagtgttgattaaaatttctgattaattactctactgttttactactcttaactctttgctaaatgctgctttcgcaaatgagcctatattatgccatcctttggtatccttgtgcacttgcatatttgctgtgtggcttgctgagtatgtcatatgctaaccttgcaataatcaatcaacctcagttgaagaaaaaggatccagaaggagaagacgtttggcttataccccagttgagctgcctgtgggagtggagccggagcttcgctagattttattttccgctgcagttttcttcatggtgaggactaagtgcctcttaagtaagtatttagcgttttagttaatttgatgaatctgtatattaaattgtcagtttgtgtacctcggctgattcctggacgaggattttatgcacaaataagttcggaaattattagtgaatttccgggcgtgacaccatgtcaagcaccacaaagtctatcgggatgaagaaatcccggatcttcactggtacgtcttcagcaatacccactgggtagcggaccaaagattcagctagttggagacgcatcggtgttggtgccaacaccgcgaagttgagtttttcgaagacctcctttggcaagacgctcaagcttgctccaaggtcacagagggcttggtcgaaatgctgtgtcccaattgagcaggtgattgtgggacaccccggatctttcttcttctctggaagtcggtggagtaaagcgttgctacactccttcgtcagtttcaccacctctgtggttgctacactccttggtcagttcctcctttgtcagtctcttgttgtttagaatgtccttcaggtagcaagcgtgtgtgggtacttgcatcacatccaaaagtggcacgtttatgtggatcttttgaatgacttcaacaaaacgagaggactgctcgtccacggatggctttcgatatcattgaggaaatggcagcagattggtatcacgatattcctgaggtgctatctcctctgtccctgctgtgctagattgagatgtatcctcgctgttcctcctagttcatgcagtgttaagatacggtggatcctaagtcgattttcctcccctcatgatgattgccttaacattttctatggagggttcgggttgccctggaatcctcccagtctcattagcagggactagagtagctagttgcgtcagctgagtttctagcattttattaaatctcagctggttttggaaagcggaagcaaagccatctagcttaacatttatgttttctaagatcttgtcattggcagctagtttcttgcttagagcaccggtagttttagcctgaataaaaacaagatctttcaaggaaggctggttgttgaatgtatcgttattgttgtcgctgcctccttggtagttggagcggagctggttccacccctgacctccttgtggacgagcaaaggttcaagcttgggggggattattgacagtcgttatcgacaagtttcgaccatcaatattatccaatatatgaagactagctatgctcgcaatgcataattcccaaataaaataattacttccactatatgctttgctactaacatttatgcaggagaagcattcataaatgaagagaacgaggtggaaatatatcgatcaatcagtcaaaagtctgccggtgatctacaattacacgagaaggcccaaaagtccaatttaataatcacaaatgggcctagaatgtatgtcactgattcaggggcccacatggaagtctcctgaaggaagctgggggctagaagagccatagggggtcggccgaccccttgttgagcccaatccagtcgcattttggccaggacaaaagggaggccgaggagaaagcagcaggccaaaaaccaggcctgttgggcaattcccctttggcgtggacgctccggatgaactcctgatggcggttgcggggcatttccgacaattcccatgctctacaaccgtcattgggtgctataaaaggacctcacctccttcactttcaatacacactcaagcaaggataaaagctctctacaaagttagtattagtgttagtagagtagagttagaatagttccaagtccgtggaggcttcggggagttcggtaaaggttctatagcttttcctttcttctttgtaagacttccatttatcaatataatattcttctttgtacaagttcggtactttattccaatcatagagtatgagtatcagtcttagtttattcataagtagtataatctgtgtggttaaaccttctgggatttccattgatgctggtataatgtctgattactgggtcataagtctgctctggctaggccgagagctatggctcggggactcagatgctctgcaccgattgcaaggctgtagagtaataagtagtaacttaagcatagggtttaggttatcacttatcattatttggaggtatattctttgggtgatttgcatgccgctgatggtgacagctcagtacgggcgtctcccccgcagtttatattcctacatacaatttcctggggttggatacaccgccgtatcctacttcgattggagggttatgacaggttgtcataagaaactcggcaacccggggtaactttgcgatgcatcgggagggcatagctattcttgggcttagttatgttgcattgttaaaggggttatactacatagtgtatactagttagaatatactaagatgttgtatactagaagtataggaatagaacttatctaaattactaccacttagctataattaggagaatgtaggagttagctaaatccttagctgtgtgtcactcaacccttaagcttaacttacccctgcatagaccttgatgtatacatgtaatatataaactattaacatagtactctcttatcatatcttcccttgggataaaataaatacgataccttggaatactcccgggtgaaatgctacaatggtatatccgtgcgcttgcagatcacatctgtaaccataatatacctaggttatttctagtgctattgctgggaattatatttccagcagtgtcgctaagaaataccaatgagtatttctagcgccgttgccggggaagataaaagattaagagtttactacatgttaataattttatatgttacctccgtatagttattgtcctttgttggcaaaccttgtttgttttctcttttatatgaaaacagggtagtacaggactggttctgatctgccgaccaatttcatatctggagtcactggtgaagtgaagccgaccccgtgtcgttcatcctcaaggttactctatcggcaaccagaccagccaattccgcgccaccagaattgcacgatacggctgagaagtgtggacaccctgagtattataccatccagtgtccaacgcgaccaccacatactattggagaagtgggatccatacatgcataaatagccactcgtcctcaatgtgtccatgatcgcggttgacaaccttctgttataataaccgaaatgtcgagtagtgagtgcaagacataaccgtaagatagcttgccagtccaccacgtcatatgcccgtcaaccactcgaaggtggcgaccaaaagcataccccagtgactcgctatccccaattatttcaagcgatcaaaacccgttactcatgcttagctagtccccaggaatacgactatcctcacactttcatcgcaagcaattaataaacatagcaagtaccataatagggttaaagtgcagcgagatacatgacacataatagggtccgaggtcccaacatacaacacataaatatagcagcggaagtctcaaatagagttcataagcaaaagataaaaccggtggtgccacaaccccactagggcaaactaaccgggcaagagccaagttgcaagagatcactccttgccctcgccgccctcggcagagcaatgaccacacaagaagcataactcaaaactggattccactcctgaaattgcagacaccgggttaagtacaagattgtactcgcaagtcttacccaaaattatatatacataagggagagagaagcatgcaagctttctagcctacagtgggtctctaggttcaacatttgcataatgctaattttattgagcaattaatgagtaaaataagcaaggacaagtaaatctagcatcattttaatttatggacagcaagaacataattctgaaatgtataagcaaatgagcccaaacggcgctctcatcatcaaccatgttccaccaaagtccataccaacatggcacaacatgccaacaccaccatcaaacataatcccatccataaaaatccacattttatgctaacatgagtgagatacacatcaagcaatgtccataaccgaggacgcggctattcgaatagattatactctgaccagaggtgtacaactggtcccacatgaaatgaaaaagatcaaatgctacacaccccgtcgagtgcggtacacaagtgattcaagctcattacatgccctttcttagccccaccacaaccacctataccacgctagggttcccgacgactcagtcacgtgcgtgcgtgacgtgaccaaggcgggcgcgccacgcgggaggcatccctggccaatataggcacccgaggccctccaaagggctacctgccctcaagtctctccaacgtggtataaatgatcacagtagaactagtaaaggacaagccggtcccaaataaggcatgtggtaagtacgaagggtgcttgaatagatgtcaaaatgttcggtccttaacgactcagacggggcttcttgcatcagaggaaaaccaacctcccttcatcgccctatcacccgtccaagtccaacatatttcatcaaccattatttagtgtaagtgctcaagttttatgcccaataatgcaagttgtctatatacaacaattaatagcactgtccatccctacagttctattagcactaagcatggctaagcattaatgaataagacatcccaagtaatcccaaccagtggtaatagggtataaggacagcaatattacaagaactaaatgcataaataggttcttcccatacaccataaaccggcaatattaatatctaggaatgcatgcatatatatacgtatagattgcaaccaaatcatttttagagaaagcataggttctatatgtttaggtgcttgccttgctactgagggtagtcactatccttctcgggatatggctctttactctccggaatctctgaatctatcgaaaagaagcaatatgcgaataagagccaaataaacatgcacatgcaaaatgatcaataaattatgaaataaatacagtgggtagatcatattttaacttgaatttaggtgaaagaatcaccagattatcacttatggtttgggagatatgaaaatgacaagctcttaggtgctgaaaatggcagttctgtaaatattaacgtttcctttagtactttacaagtaaaatgcatttcaaaccaagatttcataataatgattatttttagagtaaagtacatcactcacagctcctaagaaaaattatttcacagctatatgtgttgtcattatttatttatggattttacaagttaaaaacataggaatgataaataaactcctaaacatgatttaagaggtagttttgccaaaaacaacaccacaacagaaaagagtactaaaatataagctcaacaaaattggtttcacaattttagcttttaccaataatttcttacgaatttattaagagctagaccactcaagggatacatatagctatttatatttttactgggaaaaccagtacaaaagttggtcatttttattttacaacatagaagatcacatttttcttaatccacagaaatttggttcactgaattcagagttcatatgaattagttatgaatttttaaaacgcaaacctctttcagctcaaaagctatctcagaaatcgatttctattttcgctccccttttctccaacttccaccggacatccctcacatggcagcaacctggacgtagggtcatgcgaggctaaggcctcgggctgatggcaagagacagagcaaggcctcggctgacggtaagagacgttgcctagggctgcttcaaccgaaatcaaaagagattaacaccggatgagctgcagccacctcctagctgcaataatggagatggatgacctgttgaatgttgctataaatgttcaacatggagagaattcaaaagaggcaccatggatgaaaaggaagctcaccaaatagaggaaaacacaatgctgctgctgcagccctacaggctgaaaccaccactctcttcttccttctcgatctctctcaactctccatgcatgtgcaagatgttgggatggattgaaagcttagatgatggggattgttatggtctaacatgcagagcttgagtttgggttctttgatgggatttgggggaggagaagtgagttgggagctcagcttcagaaggaaaagaaagaaagcaagggaagtgaaaggggaggaagaaggggttttcctttgcccaccttatgtcttgaggtggggagaacacccaagggtgggttttgggctaaaaaggcacccaaggttagtgacaagtgggcccaagtcgtggtggtctaagaggtaagggctggaatagaggtggaacaagaatttgggtagatttccggaattttcagcaattttacacctcttccaatatgacactcagttagttcaagaaataatagtgatataattttatcctttggtgtggagatagacctggacacctagtttccatttttcaaagtttcactcaaaaattcaaaatattttaattctggtgaaaagatgaaattggttaggctgaaatttttaggaggccaaaacagagagtaaaaattccacaaaatttatatttgttggtgataaataaactagtatttgaataaattattatacatgtacatttctgttcaagttattgttcaaatagaagtggtttcaattttaccgattagagttaactttgtcatcgcctatgatcaaattgcaatatagtaaatatgaaatctaaaggacaacaaaagcacttctaaatacctggttatgatcctagggctgttacaagaagtccctttgcaagttcgctgctcgctctgttggtaacatgctagttgcaacccaagtcagcaggggagatggtgactttgatttaaagaccagctaaattaacgatggcgtaggcttgcttgttccgtggcaaggctaaggaggatgcaagtgctcattttcagtaattcgtggaaagtcgtagcacgtataccgtcagaagaatcagactccaattattgccgttctccctcctcgagagagcagaacagcggttctacatcaaccgtgcaacagtgaatacccgaaacaattgctcaacggccttcctctcaagattcttcctgatgggcaaggccaacgctcttcgtggaagaatatccagcttttagcaaacgagggatgaaaccattcttgaagcctgggaaaggctgttggaatgcgtcaccgcccgtcctcatcatgggatggccgagtggctcatccaacagagtttcttgaacgaattaacccccttgtcctgggatcacctggatgctgctgctagagggacattcttctcaagtacagtcagatgccaaccgattgagaagatgctctcaaatatggggtggagcgaggaacgactccaaactcgtcaatgcggcatgtacactatcaagtggatggaaatgctagcagctcagttggatctccttatgaatagagtggacaacaacgagaaggaatccaagcagggtaccgttaatgctctgggctctcacacgacatctgaggtttatggcaatgccggtcactctgggacggatggtccgaaaacccgtaaagacgtcatgctcatgaacaacagcaacgggaaccgtccacaaggagaccaaggatggagcattgctccatggggtagatcaagaacggaccgaagcacaaggaggtcaaagtaaaaccccaaaggacggatagcctcaacaccttcatgatgaacttccgggaacagggagaaacgaggaaccaacaataccttaagctggcatccaagaagtcgggaatacaggctggtcaacctgagttcctagttacgaagaggccgcagcctacgcctaagacaaagaaggtgtggtgggttaaggagaagacacccattcctgtacctccggaactgggtgcctcatcgagctaaaacatcggaggtacggtcgtgctcgtcggacctgaaacgacgtcgcccttgccaacaggtaaattggtagttatctcatatttattttccattgcatcgaaacatgtttgaattttcaaaacgcacattgagatttgaatttgaggaaaattattcaaatgaatttttgtgagcaaaataaaataaattttttggcaaaattctacacaaccaccttcacactagtcgttggaacccaacaggtacttgtggggccgattgggtccaccaggggtcgggccgaactggcctagcaccggctggctgcaaatttttgcagggtagtggctagtggggcccacatgccatgactagccgttatccatgcactatatatgtagctcggctgggagagggaagtcacaccactttaactcattttcactccctctcaaaaccttgctctcaaaattaattcattcaaagttttgcaagtttgcctcaaattcacacaatttactgcatttagtttagacactttgcatgtacaagtttgctttagttcggtgcaaggttaatcggcgggtatttgcttaacccccgtccgagtagtcttgtattctttctctttgttatagctatgaagaaacgactttcgggcatattcaagagacgatcaagctcacggacaagtcgacacaataagccaagtacaccttcttccgtggatgcatccatggaggaggcgtatgttccaccgaggctgtacgacaactccgatctcgacctcgtgggcgaccgggaattgcaaagcctactacatactgaaaaaccgaacgtgtgctcacacctgagcatacgactcgaccttctgaaaatgataggtacggatgctgagtttcatactatttagcgtgctataggttgggataaatttgcatgtgtagacgagctgggttcccgtttgcttaccatgcagtttcatgtgccttgctagaggtgggcgatggtgttactttccggttattccgcaaggaatatcacctttcttggaaagactttagcttgcatctaggctttgacaaaacatgcaaaattaatttcaggatgcatttcctgattttaacaagcgtatgttttggcaatgtatttcgggtctgtcatcctgtaaaaagcctggaactagggacatccataatcctaccttgaggttgttgcataggttgcttggtttcgtgctgtttcctagagctgatatccagatagtacgaacttatccttttgcatgccatggatagaaaaatcaagtttcacccgttcaacccatgatcaagcaatggttagaaaatgtgaagttgtctggtcctgttaagtgtatttctttggtgactcatttagcatgaagagttgggactatgcttgatacgcaagtatcttgtattcctgttacccgctcttatgttgatgaggcctatctgattcaaggtcacatactgaaacatggtctaaatgattgtcacgcccggaatttctatccaaaattccaaacgcttacatgtgtgttaaaccctcgtccaggaatcaaccgaggcacacaataacaaattgataatagagtactattaaatattcgcaaataaaaaaaaattattacagaggtagatagttcctctcaaagaataacattctacgcagcggaaaaaaaaactataacaaactacggaacagctatggcaactccactccacaggcatcttaaccaagaacaagcctaatcctccagatcatcaccttcactgagatactcctcttctgatgaatgaatattgcaagaatgagcatatgacatactcaacaagacacacagcaaatatgcaagtgcacaggataacaaaggatggcataatatagatcatttgcagaaaacaacatttaataaatatttaagagaataataaaaacagttgaataattaatcaacattaaataaacaccatacaacacacccgtgttgcataggcccaaccacatttgaacaaccaaccccagttgaacaaattaaacctccaaaccaggaattatccattccaaaccaggagtcaaattaattatcacattattaacattgatgagtagagtgagactaatcacgaaaaacattgctcaactcacccataaccgcgggtacggctattcgaatagattaaactctgatcagaggtgtaccactgtacccacaagacacaaccccacatcatgtcaccatgtgcctcaataccaccacggtacctcggaaaggagttgtgacaataccccttgcacaacataacccattacagcgcacctttcctggatcataatcacccccttataaacaaggcatggactccccagcgacccccatggacttctcgccacttctcagtctggcgcactataatgaatcacgctatacaaaagataaagccgttgcccacgctggcttgtggctggcacgataaatgtttcacaacagtagctcgcgaaccggtccttaattgtcatgagcacaaccatcaaaaccatatgctcacaacccaccttaaccaggttttaattatcaattaattaacatcgcacgattaaccatcgtgagctaccattgaatataaccttaattaataataataataataatttatatttaacccctttagttagctaatgtttctaagcaaggctaagcaaacttacatatagcatttagccgaaccaatccaatatataaggttcatgctaatcaagttataacccataggaaaacaaagtcatcttcggccattaattaattgggaaaggttcaccacccgattgacattcgaaaacaatgcacagttgaaataaaataatagctttaaacgggatcaacatgctcaaagggttgtttgggatctgtgtgacttgccttgggcttccgcaaacgcttcggaaccttcctcaacggaaacgctctcctccggaacgtcggaaactaaagcaattaaacaaaaaccaacaaaacagtacaacaacaagcataaacagtatatgtggatatttttaacatgtagatcttgattttagaaaaatttagcaacttgaaccactcgaaacggatctacggttatttagttatgattttccgaagttttaatctattagaaaattggaaaaaaaggaaaagaaaaggagatgatgacgtcagcatgacgtcaccccacggtagccggctagggttggcgagctcgccggagattagatggtcggccgcggatttggagggcacctacgcgtagaggacgacgaggcgaacccaacggtactcaccaaagtgccaaacggcgaacgatgacggccggcgactaggaagcggcggcggcggctcgggttggacggcgacggcgagctacggcggtcggcggcgaagggggacgggcggtgtcacgcccagaaattcccgaatagaattccaagcagaatgtgcattaaaatccccgtccaggaccagccggggtacacaaacgacaatgttgacatacagatccacgtcttacaaacatcataaagtcttacataaatgcagcagaaggaaagaaagacaacaggagctaagccttgactaaactgcagcgggaacaccactccacaggcatcctcgacggcacggacgaagcctactcctcggagaaaccttcatctgacccgaactcgaactctggggttgggaaaagtagagcaagactgagtactacccactgtactcagcaagtcataccggaatagaggtatgatgcagggaatcatcaaagaaaagctaaagtggttcatttgcataaagcgggcatttataaacagagattgaaagatttaaacagttgtaaaaattaagcagtattagtcatccactgtccaacgctacaccacgttgcaacaggcccaaccatccacctaaactatccaaattaaaggattacactaaggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggaccctctagccaagcacaccacacctcaggtttcacccccgtccccggcgggcaacgggcagtcccctctcgtgcctaggtgaatccggaagccgcataggccgtcgcagggcccatccaaactccatcacgcccacccttgcctggatgcgtcgactagagaaaagctacactacaagcccagccgttgcccacgctggcttgtggtaagtacgataagttcttccagggcatcccgcgaaccggtccttaattgccatgggcgcgactagcaaaaccatgcacccacagcccaccatgtgatacattttatttaaccaacaccagcgcggtggtactaatccaacattatcatgtaaacctatagtctaggttttaaattgagatttccccattgtgtgctagttgaactaagcatggctaagcaattcctagtccaaagtctaatcaagttatgacccaagctaacaaaggagcatggtatccaaaaggcatggctgtaacaataggtaaccatccccagtaatattataaaacaatgcaatatttgaaagaaaacaatagagcatttgcaatatagggtcaacatgttcaagtgacaagcatgacttgccttgctctgctgctggaggaacctcggcgactatctcaaagtacaccggagcgtcggaagagccggaatctagcgacatacaaggcaaacattgcaaacaggctataagactactgaaacagggaacaaaaccatttttaatggattctacacatttttcctgatttactgagacttgaatggacttaaacggagctcggatgaattagttatgaattttagaagattcactgtgtttattactataaccaaaatccttaaatactttattgcgcaataaattccagggctgacgtcagcacgggtggcgcggcgccgacatgcggggcccaccggtcagcggcacggggaggagagaggaggcgtcggcccgcgggcccaccggtcagcggcacggggagggcggtctaccgtggaccgggaccacgcgggtgatccaccgccgatccacgggaccgacggcccggatcgccctcgggccgatcggacggacggcggcggcggcagcccccgggctcggatcggcatcaaagccgatcggccgacccggggctagcggcggcggtgcgtgcgcgtcgcgtcgccggcgacggcatccggcggcggaggcgacgcgaaagcggcggcagcggacggcggcaacgacccaaagcgacggcgagcgcgggcggcggcgacgcacggggaaatggggaaggagaggagaggagatgcctcaccgagggtggccggcgcggaggaagacgatggcgaacggcgacggcaagccacgggaggcgacggcggccggcggacgagcttcggcgtgccctaaggaaggagaagagagggattagagagagggagatagaccccggcgaccggcattcgaggccgaaagcggcggtaggggttaaacccaccggagcgcgaggagacgggtgttccggcggcgaacctcgacgggggaggggcggccgaggtagatctcgaccccgcgaacccgacggcgacgacggcgcggtgcggcggcgaccctagcggcggctagcggcggccgaagtagcaaaaacggcggcggcgggtggttgcacgacgcgggagcgatggggagctcgggagaggtcggcgcaatggggaaaaagtgagagggagcggcggtgaagcttaaataaggggagagagggccggacgtggccgggagaggcgggaatcgccggccgacgtggggagtggggagggagagagagacgggattcgaaattcgaatcccggccatctcgggcgcgggcgcgagcgggagagagaggggaatgggcgcggagagcgcggcgcacgcgcggacgtggccaacgtggcccggagaaggcggaggcgtgggcgtgacggccgttacgagcgaggcggcgcgagcgggagaggcgggaggtgggagacgggtctgacaggtgggtcccacctgtcggcgaccccgggagggagggaggcgggcggccggctgggcctcggcctgcggccggcccagcagggaggagggggaggaaaggaggagatgggccggcggcccatccgaaagaaaggaggaaagagagaaaaaggaaaagaaaaagaaaaaggaatttttttcctggaattaaaaattgcactttggtgatttttaattggttacaattatttctagggctctgaaaattccactaaaaatcctgttagtgagtttcgacatgtagaactcaagaaaaattccacatgccaaatccaattattatttgcattgattttcaagggtttactcttgctttgcaccggtatttttcttagggtcatttataaattcaatttttggcttaggaggagaactacagggtgtgacaggcggccgagcttcctcacctccgtgcgcacctaacggcgacggcggcaagcggcggcaacggcggaggcgatgcggcggcgcggctggagaaggaagatgagtccgacatgtgggccccacatgtcggtctccacaggagagaggagcgggcggcgtcggctgggccggcttgggccggttcggccgcgcggagagagaagagagttgggccgaaatcggcccaacggcttaaaaggggttttttgaacttttttaaataaaacaatttgtgaaatgttgtttcaattattaaaaatacttcccttgctcaattaattcccagaaaattctagaaaatagaagagcaagcataatatttaataaaattttatctagctcattttcatgttgaaaaatttcctagaaaattagggtttagcttgtaggcttttaaaataatttctaaaaatgatttaaaatatgcatttttaatttagtcgatttttagggcgtaacaaacctaccccccttaaacagaatctcgtcctcgagattcagaagaactgacgaacagatgaggatgagctgacttcaattcatcttctcgctcccaagtggcttcttcttctgaatgattgctccactgaaccttgcaaaaccgtataacgcgattcctggtattcctctcgcttacttccaaaattctgactggcttctcaacataagttaaatcttcctgaagctctatacgatcaggatctgcttcctccgtaggtacacgtaaacatttcttcagctgagacacatggaacacgtcgtgtattcccgccattgacggaggcaactctaactgataagctacttcacctcttcgactcacaatcttaaaaggtcccacaaaacgcggtgccaatttccctttggtttggaaacgatgaacacctcgtaatggcgtaacccgaaggtatacataatctccttcttcgaaagccaaatctctgcgacgattatcggcatagctcttctgacgtgactgagcaacgcgcaacctttcttggataatctttactttttcttctgcctctcgcaatatgtctgtcccaaaaacttgacgttcaccggtttgatcccaaagaatcggcgtacgacattttcgaccatataatgcttcatacggagccatttgcaaactagcttgataactattgttatatgagaattccgcgtacggcaaattcttatcccaacttccaccaaaatctagaacacaggctctcaacatatcttctaaaatttggtttactctttccgtctgaccatctgtttgagggtgataggcggtactgaaattcaaacgggtacccatctctacttgtaatttctgccaaaacttcgaagtaaactggctacctctatctgacactatcttcttaggaacgccatgcaaacataccactctggccatgtataactctgcaagcttattccccgtataggttgttttgacaggtatgaagtgagcgacttttgtcaacctatcaaccactacccaaatagaatcatgtcctgctgacgttctgggtagaccggttataaaatccattcctatttcttcccacttccactctggaatcttcaacggttgtaacagaccggctggcttctgatgttctgccttgacccgctgacatacatcacatagagccacatattctgctatctcacgtcgcatactggcccaccagaattgttgctttaagtcttggtacatcttggtgcttccagggtgaatggaatacaaagtttcatgagcttctttcatgatagtatccttcaactccttattttctgggacgcaaattctttctcccaaccacacagttccttgctcatcttctacataaccgatggctttacctcttctcatgttctttttaatttcttgtatgtcaggatcattcacttgagcttctctaacttgatcaaacagagtaggttgagcttccaaagtagccacaaaacctttgctgactattcccaagttcaacttttcaaattcttggcataacttccaaggtaaacgtcgaccttctgacatattacagtagcttttcctgctaagagcatcggctacaacatttgctttccccgggtgatagtggatttccatatcataatctttaatcaactctaaccatcttcgctgacgcatgttcaaatcaggttgagtgaaaatgtacttcaaacttttatgatccgtatacatctctgtacggttaccgaaaagataatgacgccaaatcttcaatgcatgcaccacagctgccaattctaggtcatgcgttgggtagttattctcatgaggacgtaactgcctagatgcataggcaaccacctttccttcttgcatcaacacacaacccaaaccgtgtcgggatgcatcacaatacacttggaaacctttcctcgaattaggcaaaattaatacaggtgcagtcactagccttttcttcagttcttggaaacttcgttcacaatcctctgtccacttgtacttcacttccttctgaagcagacgagtcattggtctggcgatctttgaaaagttctcaataaacctgcggtaataccttgcaagtccaaggaaactacgaatttctgaaaccgtcttgggttgcttccaacttaacactgactccacattgcttggatctactgccactcctccagacgagatgacatgtccaagaaacttcacttcggacaaccaaaattcacatttactgaacttggcataaagctgatgctcacgtagtttctctaaagctagacgaagatgctcctcatgttcttccttcgtcttggagtaaatgagaatgtcatcaataaacaccacgacaaacttatccagatattccataaacaccttgttcatcagattcatgaaaaaggctggggcattagtgagtccaaatgacataacggtacattcgaacaaaccataccgagttgtgaaggcggtctttggtatatcttcctcacggattcgaagttgatgatatccagaacggagatctatcttggagaaaactgtagcacctttcaattgatcaaagaggtcatcaattctgggtagaggatacttattcttgatagtgacctcattcaacgctcgataatccacgcacattctctgagtatgatctttcttctccacaaagatgactggtgctccccatggcgaagtactgggtctaatgtatcctttctgaagcaaatcatccacctgtctcttcacttcagctaactcattagctgccattctgtatggtctcttatggatagggttggttccaggtaccaagtctatccgaaactctatgtctctcttaggtggcagacctggcaaatcctcgggaaacacgtctgggtagtcttgtactatgggaatctcttgtagagcaacttggtttaagttcacaccatgagatttaggagaggacacaaagaaagaaacggtttccccattgctactagttaaagtcaccttacggttgacacaatctataactcctctgtgacgagataaccagtccatccctaagataacatctagatccttggattctagcaagataagtgaggatgggaaaggaacttcttctatttctatagtagcggaaggacaatactgtgtcgaaaatacttgattgcctggggtgttaactagtaaaggtctcccaagactaacaacttccatcccatgattgctcgcaaaacttttagacaaaaaggaatgtgtagcaccggaatcaaaaagcacagttgcgggtatagagttaacaggaaacgtacccaaaaccacatatggtgcattctgagcttctgctgctaccacatgattgacacgtgcctttggtactggaacattggagttgttcggagctggagcgttcttcacgcgccgaggcttaggacacttatcagcataatgtcctggatcaccacaattgaagcacaccactggtttgcttccctgttccttcctgacaggctggttctgagctggagttgctgcaggacgagcaaccacgttgcggttgtcattgccacgattaccagtattgttgttgtagaactggcgttgggggcggataactgatgaagatcctccttgagggtacgatggagcttgaggtccaataacgagacgtggcctctggttactgccctgttgtgccttgaattgggcagccctgcgcttcttctgctccatccggttatacttgtcttcctgacgaatcgccttgtccaccaattgctggaaatcccggaaatccgtagacatcaaggcataagacaactcatcattcagtccctctaaaaacttctcctgacgttcttcatcagtgcgaacatcctctggagcatagcgagctaaacggttgaaatcatggaggtactcagtgaccgaacgagatccctggttgagtgctctaaattctctcttctttagagctacaacacccgctggtatgtgtgtcttcttgaaagcagccgtgaattcctgccacgtaataggctctccttcagccctgccttggcgaaaatgatcccaccattcggcagcaggtccatgcagttgatgcgaagcaaaagaaactttctcctgctcagtacactggatcaaatccaacttcttttccaccgcatgcagccagtctcctgcttctactggattggtggtgcttgaaaaggtagggggtctcacacgtaagaaatctgccagcttgttttggggaggtgggggtggattctggttctgattgtttgcctgctgattctgtgcctgctgcactaacagattgatcagttgtgtttgttgggccagaatctgagctagcgtgggatctcctccattgttagtagctccactaccacttccacttccacttccagtgcgcgtgttcaccatctggcgataagcagagacaacaggaaagaacgacagagagacacccttagaacggagttatttaattaatttaaattctatattgctcttaactgtgtatgattacatttaagttgcactaacactatctcaccaactatcttacactccgacaagcaaaagagctagactcatgctgttacatcccaccaatgatgtaagcaacaactaaaacccacacactcacaagcaaacttaaacaagcaaactaacacagcgaactacggcaacgatctagctaagcgactaaacccgccttgtgtcggaacgaagcgatggatcttcttcctctggagtagctggctctctttcttcagggtcttcctcttcttcctcatcacttatgatgtcgatgacaggttcagcacgatcgggcacagcttcgcccatcacacgaatcttcgaggctaactggagacgaggtggcggacaggttctctttcttgcgacgaggcgaagcttgggtgttggcggcggcgtttctcctttaagttcagctaattccttctgtagacggtacaccttgctctccaacttgcaaatcttgcctcgattccagttttccctgtcatgagctgctttgtctcgctccacacttactgcatccatagcactaagcatatgcaccacatgcatcagagtggcactctcttcaccatcaggacagatataggttccatagtcttgaccatgaggcttgtgaggatgatactagaaagctgatgaatccaactcttcttcaaagcgttgacgcaactctccaatggccaccaaagctgcttcttgacaagcatggctgtacgatcttcctccagcttcgaacttaatagacggaaggtcttcacgatcactagccaacgtcacacgaacatgacacttctcctcgtcggggtcatgggaaatttggcgatactcgggagcaacttcataacctacctcaaaaaccatcaatcttagctccctgacgaatcctaacacctcgatcaaatttctcggtgaatggggcggcatctaaagaaacatagaagggaagaattaatgcatattttaagttagctgcaccaactagacttaactgattttgaccaaaaaggaagaaagataaaagaaaagaccgtacaaagctattatataaatatatttttagaatttaacttttttggacagagacaaatattttttttttgacaaataactaaaataaaactaaaatacttatgatctattataagcacggtacagtgtcaccacaagaaagatgagtagtactagtgctatcatgattgtatcgataccataatagatgtacagtgccgactaatcaataagatttggtaaagagaaaaagaaacattttgagaagaacaactttttgcttttaaaagaaaagaaattgaattaaataaattttgtgcataaccttgcatgtgctgccaacttatttaatttataagagaatagagaagagcagttctatattttttttcaaaatattttgaaggctacttaaggtttaccatttggcttatcctaaggtcaaggtggctctgataccaacttgtcacgcccggaatttctatccaaaattccaaacgcttacatgtgtgttaaaccctcgtccaggaatcaaccgaggcacacaataacaaattgataatagagtactattaaatattcgcaaataaaaaaaattattacagaggtagatagttcctctcaaagaataacattctacgcagcggaaaaaaaaaactataacaaactacggaacagctatggcaactccactccacaggcatcttaaccaagaacaagcctaatcctccagatcatcaccttcactgagatactcctcttctgatgaatgaatattgcaagaatgagcatatgacatactcaacaagtcacacagcaaatatgcaagtgcacaggataacaaaggatggcataatatagctcatttgcagaaaacagcatttaataaatatttaagagaataataaaaacagttgaataattaatcaacattaaataaacaccatacaacacacccgtgttgcataggcccaaccacatttgaacaaccaaccccagttgaacaaattaaacctccaaaccaggaattatccattccaaaccaggagtcaaattaattatcacattattaacattgatgagtagagtgagactaatcacgaaaaacattgctcaactcacccataaccgcgggtacggctattcgaatagattaaactctgatcagaggtgtaccactgtacccacaagacacaaccccacatcatgtcaccatgtgcctcaataccaccacggtacctcggaaaggagttgtgacaataccccttgcacaacataacccattacagcgcacctttcctggatcataatcacccccttataaacaaggcatggactccccagcgacccccatggacttctcgccacttctcagtctggcgcactataatgaatcacgctatacaaaagataaagccgttgcccacgctggcttgtggctggcacgataaatgtttcacaacagtagctcgcgaaccggtccttaattgtcatgagcacaaccatcaaaaccatatgctcacaacccaccttaaccaggttttaattatcaattaattaacatcgcacgattaaccatcgtgagctaccattgaatataaccttaattaataataataataataatttatatttaacccctttagttagctaatgtttctaagcaaggctaagcaaacttacatatagcatttagccgaaccaatccaatatataaggttcatgctaatcaagttataacccataggaaaacaaagtcatcttcggccattaattaattgggaaaggttcaccacccgattgacattcgaaaacaatgcacagtggaaataaaataatagctttaaacgggatcaacatgctcaaagggttgtttgggatctgtgtgacttgccttgggcttccgcaaacgcttcggaaccttcctcaacggaaacgctctcctccggaacgtcggaaactaaagcaattaaacaaaaatcaacaaaacagtacaacaacaagcataaacagtacatgtggatatttttaacatgtagatcttgattttagaaaaatttagcaacttgaaccactcgaaacggatctacggttatttagttatgattttccaaagttttaatctattagaaaattggaaaaaaaggaaaagaaaaggagatgatgacgtcagcatgacgtcaccccacggcagccggctagggttggcgagctcgccggagattagatggtcggccgcggatttggagggcacctacacgtagaggacgacgaggcgaacccaacggtactcaccaaagtgccaaacggcgaacgatgacggccggcgacgaggaagcggcggcgacggctcgggttggacggcgacggcgagatacggcggtcggcggcgaagggggacgggcggccgagcttcctcacctccgtgcgcacctaacggcgacggcggcaagcggcggcaacggcggaggcgatgcggcggcgcggctggagaaggaagatgagtccgacatgtgggccccacatgtcggtctccacaggagagaggagcgggcggcgtcggctgggccggcttgggccggttcggccgcgcggagagagaagagagttgggccgaaatcggcccaacggcttaaaaggggttttttgaacttttttaaataaaacaatttgtgaaatgttgttttaattattaaaaatacttcccttgctcaattaattcccagaaaattctagaaaatagaagagcaagcataatatttaataaaattttatctagctcattttcatgttgaaaaattttcctagaaaattagggtttagcttgtaggcttttaaaataatttctaaaaatgatttaaaatatgcatttttaatttagtcgatttttagggcgtaacaatgattctcttatgtttttgtttcccggcaatacaaatgagattccgttatctaacccggagtttcatttgtataactgctgagaaaactaaccatttctctccaagcggtgttgcctcgtgaggtcccatgcagggtaacatgacgaatggcgagagaagcacctcaggaggcgtcttcttcttcaccaccagtgcagaagtatggagattgttgggacccgaccgtgcatgcccccggttggacccaattcctgcaacatgatgctggaggttcgtcctggcagagtgctagcgacagccggtggtatgagccgcaggagctgcactggggttattcgcgctccttcagttcaagtggtctacctccatcctcttggatgcattgctcaatctcctctcgaggggatctgggaaaattcatccgggggatggatacacttgaactgcaggcagggaacatgcagcacatgctggaagatcatgtggtacagtcacgggaatggcagcagactgttgatgcacagcttgcaaactttaacactatgatccaacaacaacaagttgactggcaagcgtttcaccgctaccagggatttgatccccgccatgagccatagcaagaagcaagcttggggggccactaaggtaacttgtatcacattgcatatttcccttttcaaattgcatgtttaaatttttgcattgcatttataaacctaaaaataacataaaaatttgcaaaactaaaaataccaaaaagataggttagatttaatatgctaggtaagacatgcttagttcttcatgttgaaatgatgaatagttgctctgttttatatctctcatatatgggttcatggttaagtactccctcaagaattgaataagagtagccaacaattatctgggaacctgaggtaagtgagctgcactttgctgatctgagtctagtgttggtatttgatacggttacagataaaatccgcaagcgcacggatataccgatgtagcacttcccctacggagtattccaagggtatcgaatccaagggaacatgtgtgatcagagcttcctccggttcatccaaggacaccaagcaattgataggccaggatagagaggatttactagtgagaaacagtgtagggaaagcttaattttaatcctcacgcaatacttcaggcactggcaacccgctgttcctagatgtcgctctacttcgtatccggacagggaggacttaagtgctctcgagggctgtcaccacctctacacccatctcaacgtactgtgggatatgcagcaattactggataataattacctaaacaccacgtctaagcaattaatatctactttagtgtttataactcaccaaagcaatcactatattttagttgattatagtgaacaataatcctgtatgctaattaggaactaaccaagaggtaattctcacaagataaatctaaattactcaagaagaatattatattgaattcagagtaataaacagaataaaagaaataggagaagattaccgacaactccggaattcttccgactccttctactctactctcttcctattctagtatacaatatagtacaatagagccttttataatttagctcaagcttggaagtgtgtgtgtgaagtgagggagtgaagcctttatatagaggtaggtataacggttggcgaaggggaaatgtccgaagtgccctccaaccgccatcagggagtgatttggagcgtccaagccaaaccccacatccaacggtggagatagtggttcggccgaacctgggctgggcccatctggcctggcctttggcccaagtcctcccctggtcctcctctatccatttcttggtattttgggctgatttactgatgttttgatgaagttcacaacccaaccttgtatggatacaaaattttcctcactttagtctagatgtcctcccaacttcagggtttattacctgcataaatatacaccaacacttgtggaatgtgtgagattaagcacctatcactatgttggatgttttattatctaaactttatgcagatgttggtggtatagaatcgacatttaacaaccaccaacatctaggttgttgcgagatatgagatagtaaataagagttgctatgtcgcgaccgagaaaatttccttttcccgaacgctagtgtattaatccccatcccaggagaagccggggtacaccaaacaaacatgatacaaaaggcacatctttattatatcgataatatttacattattacaaaggcacttcaggcctgacaaacaaaaataaacagcagcggactagcgggcctacggctccatcttcacaggcgctcaactgaggtataagccaggactccacctaggacttcttctccaaagcttctcttactggaggggggagagatagagcaagaatgagtacaaccaccgtactcagcaagtcacaccgggagatgcatgattaatgcaagggggtacaaggagtaataatataggggttaagtttcgcagtaaacagcatttaaaagtcacttagttgcccaaagctattttataaagactatcctagagctacacagtattattaatcaacgccgtggacccgcacgaacctgccttaacccaaggcctacgatgattcagaccgaactggcaacccgacctgggtcccagctcgtcccaagccaacccaggccaaccattccatattttagttgttaagcaaattttaagaattaaaccactaacttgggtacattgctaggcttgcccatatccgagggcacggctattcgaatagatttactctgatcagaggtgtacatctttacccacaagacacatctttactccacattctatggccttggaacccgtcataaacatgtgacataacccttcacccatcctagccgtgaacaaaagtaccgacccaaccctgcctacggccagtatcccgggacaggcaggccaggattgagcccctagcaacaggatctagaccgggtgcgccacacacataggggtgagaccacccgcgtactagtccagtgccatggcatctcgactaacaggcaccgacccgtgtagccttcatttgcctagacatctcgattaccaagccgcagctcgtgtagccttcatttgcctcagagatatccatcgtcgcaacgacttcatccatctctatccgtgttcttttgttcaggactagactgagcaccgagttaagccttacccattagacatgtggttagtacggtagtgctttgcaacagaggcccgagcttaatccttatattggccggggtgctacttatagagtacccactagttgggggtttatttgcctagggtaagcaaggtgataataacaatagcaataataataaggtcataacaaaggtaaataggcatggctaaataaaacagtgataacgcgggaatttaaataaagcgatgatgcattaatttaaatcaaaataattttataaactgggattcaatatgctcaaggatgatgtgacttgccttgctcagagagaacggccttccgaaccttcggcaacgaccgcaaactacgcttcgagaaccttcggaacgacagaagctacgcgaagcacacaagcaaagctacaagcctataaagaagcaataccaatacataaaaagaaagcaccccggttctttatgttataacaaacattaggagacttgaatgggtcgattcagggttcgtatgaccaagatatgatcatccgaagtttaatgttgttacatggagatttacggattattgtgattaggttttgcaattataaaacatgtgtaagcgctagcctggaaaagacaggaaggctgcgctgttgacatgcagaccccacatgtcaacctaaaggaccccagtagaccgagtacacagagacggtccacgggtcgacggaagcggaccccgtgtgtcaaccgaggcgagtggccgacaaacggactccactagacaccacacgggctgcacacgtggaaaccacgcggctaccgagcgggcacactaacacggtcaccacacgcacaagcgaacgactacagacaccagtacacgggtaccggggtcgacaaccacacaacgggcacgggacgacaccgaaaggacgaggacggggcagcgagaggacggatccttaccatcacgcgacgaggcgtggggacgacgatggcgaacgggcgcggcggagacggtttggagacgacggaggcgaacggtgtcacgcccggaaattcactagtaatttccgaacttatttgtgcataaaatcctcgtccaggaatcagccgaggtacacaaactgacaatttaatatacaaatccatcataataataatgttacacacttacaaaagaaaagaaaacagcagcggaataacggtctagcgatggcttcagctccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatataggctcatttgcaaaagcagcatttagcaaaacatttaagagaagtaaaacagtggagtaattaatcagaaattttaatcaacactgaacaacacacctatgctgcacaggcccaaccatcctgaacagccatacccagctgtacagatctaactccaaaccaggagctaaacaaattattaccagttatagcatcaataattattgtgagaggtgtgagactaatcacgaaaaatattgctcaacccgcccataaccacgggcacggctattcgaatagttttactctggccagaggtgtaccactgtacccacaagacacagcctcaacatcatgtctaccatgcgtcgcgatactggaaagtacccgaacagaggctgtgacaataccctctgcacaacacaactcaccacagtgcaccattcctggatcataatcacccccttataaaacaaggcatggactccccagcgacccccgtgggcttatctccgccacttctcagtctggcgctccgcaatgaaccatgctatacaaaaggtaaagccgttgcccacgctggcttgtggttggcacggttaatgtttcacaacagtagctcgcgaaccggtccttaattgccatgagcacgactctcgaaaccatgtgctcacaacccaccattatcaagttttagttggcaagtaattaattaaccaatcacgattgaccatcgtgaactatcattaagccatcattaaataatagtgagtcataagttatcccaatagtgtgctaatgtttctaagcatggctaagcaattatatctaatatctagctgaaccaatatataaagctcaactagtcaagttataataacccaaggtatcaaggaataaagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgccgtgcaataatcggtcttcaattaatcttcttgaatactttcggcgcactcacgaaccttcgcaacgacggaaacgacaagctaacatgcaaaacgaagaaaaagactaacaaaaaccaaataaacagtacatataaagtaaacaaacatgtagatcatgattttagatgaatttagcaacttgaaccactcaaaaccgagttaggatgatttagttatgaatttccgaagatttaatctattagaaaaacaggaaaaagaaaaacgatgatgacgtcatgatgacctcatcaatggtcggaccaagatggcgacctcgccggagattggatggtcggctgcgactttggaggacatgaacacgtagaggacgacgagacgaacccaacggtactcaccctcgaaccaaacgacgaacgacgacgcccggcgacgaggtctagcggcggcgcggcttcggtcgacggcggcgacggggctccggtgaccggcggcttcggggagagagcggccgagcttgcccacacctcggcgcaccttacggcgatgacggcgaccagcggcaacgacggaggcggcggcgcgacgcggatggaactcggccggcgacgacggcggggtggagcacgtggcggcggcgctacgaggcacgtgagatcacgggagagggggcaaacgaaagaggaggactagggggtcctttttatagccatgggaggccgggatcgagcccacaacgacgggaaaaactcgggaaagtttagatcttcgccggaaaaaggaaaggttgaaccgcgaaattggaaaggatttccatataaacttttggggatttcttggggaaaaggaagaggagattgaggggattccattcccgcaactaatttggagaaaggagcaacgatgtggccggattggtgggaggaggcggcggcactgtgcacgggctggagagctcgggctccgtctggaggtagaagaaggagcactgtagcgacagggacgaaaaacagacttctatgcgggctgagaggaagggagagagaagggggaggcaaattagacttttcgtcttgggttggctgaaaacaaagcaaagaaagaaagagaagggggaagctcggctgggccgacttgggctgcacggccgagcacacaaaagagggagatgggctggaaagggcccaagactaggaagaggattattattacttttccaattaaattaatcaatgaaatgatctttgaattgttaaaaatacttcctatgctcaaataattccaagaaaaatcttgaacatacttggacacccaaagtatttaacaatattaaaaccagaccatttaatgattaatttaatatgtgggtaattactgaaatgctctttgtatgattaaaaattaggaattgagctccgaaaaatccgagaatattccagagagtataattaaccatggagaatttaataaaaaattaaatccatccatgctttaaattaaggaaattttatttcccacatttaacttcacttgtaaattaatgaacatttaatataaattctaataataatttattaaataatttataaatcctgaaacaaaaatcaggatgtgacaaacggcgagggagcgactttggcggcgatctttgcacgaaagcgagacgcgaccggcgcaacgcttggcgacgcggaggcgaggtcgaagacgatgacggggctacggcacttgacggagcgaggacgacgaacgagaacggcttgacggagggacgaacgccacgacgagtgaaaccgggaacgacgagaggacgacgacgacgacgaccggggccggtgaggaggcgacgaggcagttggcagcagctgcacggaggcgaggacggcgcggaacacgccgctgcgaatccgacgacggaggcggcaccgcgagacgatgagccggtgaggaggaacggccgaccggaagaggggatggcgacgtcggacggagacgacgacgatgaacaccggcggggttcgggtggaggggaggcgagaccgagggcgaccttgccgctgcgatgccggcggcggtggtggcgcggccgacggcgcacgggtggagaaagggccgaccggggaaattccggtgaggcggatggagaggccggcgcggcacggcggtgttccggcgaaaccgaggagtggccggggaaggagacgatgccgcggtatcgaaggaggagacggcggcgtcgatcggcgtaccggcgacgaacaggagccggccggagacggtgtagtggcggcgacgccactgaacaccggcgggaacgcgtctccggtgctctccgcgctaaacggaggatggcccgggggagaggaggcggctgcgaggctgctggtggcgacggcgcgaccggacggcgctccggcgaggagggagaggcggctggaggcggccggtggcatgggagaaagaggaggatggtggggagaggtggtgaggccacgggagagtgcgggagggggctaaaatgatagaacggagcgagggggttccattttataggatgggggagggagccgagcatgggagagggcggaacggcgacgggaaacacggtcggcggccatggaaggcggccgggaatggcgcggccgttccgggcgtcagagggcacgaatcaagggggaaattggggggaattgaagaggaaggaaaggggattaattccctctaatcaattttggaattcctgttttgaatcgcgtggatttgggggagcaatggcgctaggtttccgggaaagggaaaggaggccgtgcggaaggagaaagacgacctgggggtgtgacccaccggtcaggcacgtggtcagcgcgcgtgacgggcgcgtgcacgcgaaagggaggggcggctcgggcaggggggcgcggcttgggccgggcggccagcctaggaggagaggagggaaaggcggcccgggggaaaaagggaggaggagggagctgggccgaggggaaggagggagggcggcccaagagagagagagggaaggaaaaagagagggaggaagagaggactttggccgcgggccgagagagagaaagagagaggactttgggccagacttggcccaaaggaggaaggaggattatttttaggtttttctttttaataaactttgataattgtttttgttgcttaataaatatttccggtgctttgaaaattcaagtaaaatttgagggctcattttagaccaaggagaatttaacaaaaattctccgggccacattcgaatttttcttgtacgtattttagtgttaaccaatttctttttgaattttaattaattctattattccttttagagaatgatttttatttcgggatgaatttatcaggacgtgacatgctacgaccctgttctaaatttgacttgaattccggatgttttatttttcaaaatgataaatttggaagttcctcatttgatatgaattcctactagagccaaaaatatatatattgattaagccatatacattatggttacttgtaattccattgaactttgtcaaatccttgtgacttgtgtagatacttttcatgctttatgatcaagatcatacacccacatatgcacacatatgctaagcttctacattggaagatagcattcatatcatccaccatatccatgtcatcattatccacaaataagctctccatccatgctttctttccaaagaaaaatcctttgcaaaaattaaaggaaaaaaatagggaaaggtatggctatgagaaaaataataaattcttgctctcccaaaattggagcatgaaagaaaaaaaaagaaaaaaaaaagagaaaaactagccataccctctctatgaaaattaaaggatattttggaggaaaagcataagcacaaatgagaagcattttctttatccacattttgttttccatcatattttccaccatattattcacacacactttgcacgatcttgatcttgagtatgattagtcatctattttagtccaagttttttgacttagtaataaatgagaatacaagtatgccatgtttgatccctaccaagctccacatatcaaaccttagagtaggaatcataaaggcaaatctagtgaggaattcatattcaaacaatttgagtgatctagagaatcatttttggaacttggctttcttttgcaaaaaatcatttgaaaacctccggaataaaagttgaataaagattgggtaactagcgctctaattgctgttctgtctctcaaccgctcaagacaaggaaaggcagtgtctcgtgggaattaggggtaagggtaagccaccgtgccaaacttatttaatttgagagagagtatccataccttgcatctgtatctttgagatatacaacattgcagcaactcctgatcaacaaccaagtctttgttcctttcgtcctttactcgggacaagcaaaggttcaatctttcccaaataaaataattacttccactatatgctttgctactaacatgtatgcaggagaagcactcataaatgaagaggaggaggtggaaatatatcgatcaatcagtcgaaagtctgccggtgatctacaattacatgagaaggcccaaaagtccaatttaataatcacaaatgggcctagaatgtgtgtcactaatttaggggcccacatggaaatctcctagaggaagttgggggccagaagagcccataaagggtcggccgacccttgttgagcccaatctagtcgcattttggccaggagataaaggaggccgaggatgaagcagcagtacaaaaaccaggcctgttgggtcagtctagggt

SEQ ID NO: 58089 - DNA, 12394 bp, Oryza sativa
caagtggctgccgcgtggggcccggccgtcagccgcccgcgctctcgggtgcggctgacgtgtggggcccacggcgccggccggtgtgagcccgggtgcgcccggtccaccgtggaccgtgaggctgccgcgtgggccccactcccgtggacccggtccgcgcgcctctccccctcggctgacgcaataaaccctttttaaactaaaatttaaatgaagaaattcgcaaatattcatttaaagagcatataaacttcaaatggccataacttggccatttgaactcagaattagaccgttcaagtctctaatttttccttaagaagtcaagaacccatttttgtgctttgttcctgcttgttatatggagtttattagagtaaaagccttttcttttccgttggtcgtgtagacgctgcagcttcggaagatccgctctttgtggaagttgaagccgacgtttgggaaagcgagcaaggcaagtcacatcatccttgaacatattggatcccatttttataaaattattttgatttaaattattgcattatcgctttacttaaactcccgcgttatcactgttttatttagccatgcctatttacctttgttatgaccttattattattgttattgatattattaacttgttcaccctagattaaacaaaaccccaactagtggacactctactcatggtaccactagtatgaatttagttagatgcttcgctggttaattaggcaacattaggtggttttacaactctagactttgggaatattctcatcacctggacactatggaatggatggattattgtggaattggattcacacctccccctctattcaaaatcctcaaaatggttttaggctgggctcggggtgcatggttttgattgtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctagggcaaatgaaggctacacgagctgcggcccggtagtcgagatgtcatggcacagggccggtgtcctgctgctaggggctcagtcctgcctacctgtcccggaggttccggccgtaggtggggttgggtcggtactcttgtctatggctaggatgggttggaaactatgtcacgtcttccgtccgtataccgtggtggtatgtggcacgtggttacacgtgagaaagatgtgtcttgtgggtaaagatgtacacctctgatcagagtataacctattcgaatagccgcgccctcggttatgggcaagcctagcaatgtacccaagttagtgttttaattcttaaaaccttcttaacaactaaaatgtggaatggttggcctgggttggcttgggacgagctgggacccagggtcgggttgccagttcggtctgaatcatcgtaggccttgggttaaggtaggttcgtgtgggttcacggccttgattaataatattgtatagctctaggaccatgtttacaaagtagctttgagcaactaagtgacttttaatgttgtttactgcaaaccctaaccccctatattatggctcccttgtactcccttgcatttattctgcacttgtgggtgtgtcttgttgagtatggtggttgtactcagtcttgctcaatttttcccaaacccagaagaggagttcctggaagatgaaggctttggtgtctagctcgtgcttgccgtcaagcgcctgtggtcgtcgccctagtcttccgctgtttcccgtttgtctttgtgtatgctgggccttcgccgcccatgtaataaattaattatttacgcttccgcttgataaactctgaaatgtatcaacttttaggtgtaccttgcctcctgggacaagaaataatacacgcacgtaaggaacgcccgttgggttatttccggtcatgacattcgggcccctgaattgtcaggtaataaccctacatcctgttggccgaagccggtcgttgctcttattcaccataatcacaccagtataatatttggggtagcctatctaactgttgtcgatatggcggtctgaagttctgactcgtagtcgacaacagggtagtcttcctcctcaagtttgtgctcggcgagatcagagacagcgctagatccctacggccggcctctgaaggtaccggatagggtcgatctagacatatctctgatgtcgatatccggcggcttgtcttgacgtatgttggcttgtattggcttgaggctttgtggcgtctatggtgggtgtcttccatgctgggcgttgattgtcctctcctcctagggggtcttgtatttatacccataggtgttcctttgtccaagttgagctagggaaaccaatatggatacaatccgagtagtccttgtcgtttccatgtagaactctggttatccttccttatccggaactcctatatccgcacgttgtttccgtataagacatggtatgtggtgggtactgccgagatttactcaactactattaggtatgtgctatccataaaccctgatagtagccccccacttttatgcaaatgaacgaattcatattctcaaccgtgcgcagaccttggagtatctgagagaggcggctttttctctcctctgtgagtttagagttaacgttagacttcctttatcagcctcgtgcgggcacctaaagggttttgtctgagtcaatctctgacgtcaaccaagaaagtacagaatatacgactatgtctcccatcttgctgtaatcgagaatttggattgaagtcaagaaatcttatctcggcgagtacaccatctcttcattccgtattccttgttgagatccaccaactgttctcgagtgatcgagaaggcacagagcttgcaacgaaaccttgtcaacatttgttgtgctcgccttagtcgatcttggtgtgtagaaccatagagacatggagtcttcgtcaatgtcgaatagaattttcctgaaatcaatactcagaaaagaatattagatagaaatagcccccgagcgaatgctcaaagggtgacatgttataatatgtatagaaaattgaaaatgaattgaattttacagaccaatgttttgtatatgagcgtctactcttttaccgacttcgatcagtcagtttgttgagttatacactctccctagcccctagccttgtcgtcggagaatcgttctcggaagataaggctcttggacctttgacctgcctcggttgaacaagcactgatcctagcccccagtcgtgaagttggaaaacccaatttctgattatacggcttggttaatacgcacggcgagaactcttacacaaccagctcttacatggtcttttgtctctacaggattcgacaaggccttatcggctctgggcgtccctagccgaagttcccttaggttcctcggaggccttgtcaagacagcgtaaagggacatgaggataggtttgaacgctaggtgtcatcgtggtaagggatctctgggtaaaacacttggcaacattgtgtacttgatatcaactttgttgaggtaaaggtagtggaagatctcgctacccttctggtcgaggaccaggtagtagtcgtactcgactacttgaagtggaaatagtgggagaatcgctacaccactggtcgaggaccagatagtagtcgtaactcgaccactagaagtaaatgtacgagagatcgcgacaattgactggttaagaactagtgagtaggtgtctctcgatcatttggagtcgtggtatgagggccgctacgctgccggtcgaagaccagtcgtagctgttcctcaaccatctgaagtcatggtgcgaggaccgctgcgttattgctgtagtcgtacctcgaccatctgaagttaatgtgcgagagattgctacgttttactagttcgagaaccaacgagcgagtagagttatctctcggacaccaatggaagttgcggtgcgagagattgctacgtgctggttcgagaaccagcgagcaagtagagttatctctcgaacaccaatggaggcgctagagttggtttattacatgtgcatctcatgtggccagcatgactcacacacccaacttgtagcatatccggatgtccgttcgcaatcatgtcgggtgatcaagccgacgacgttcgcgaggaattatccgttaacaaccttttctcgagtagtccagccatggccggtactatgagataggtcgtcggtcttcgttggtaggttgggcacgacgactcagcatttgtcgagatcgttttcgataatgcggtgtactcgaccacaacctactcaggtgctcaattgttcctgaagaatattttctagaaggcaagacatatagtagataatatcgagtatgtactcaaaaaactgcatggatcttctagtattatcaggacataatgagcaaatgtaaatatcaggcattatgcaaaccgtaagcaagcatgattcatataggagagaacagagcgagcccccagcgttagaccgtagtcgatttaacatcggggacacccgcgcaacagatattgtataaaaacatgctctaggtaaacaaaataaatcatggatttgacaatgctgtatgatctgaataggtacgataaattgcagataaactattgcgtacctttgtagatacatgccggatgtatctacgaaattagtagatcaatttaaaaaaccaatctaccaattaccttgttgcgtactcgttcgatatcatgcgatctgacatcttttggtacgccgcggagcttgaggcttggatgatctcgatagaccaagttgttgatgacgatgatggttccgatctggttaggttggatctccccctcagctgaagtcgtcgagtagctcgttgtcggagaatccatctcttaaacacatctcgtcgaaaccttgaagcaccaaaagatcccctacttggcgcgccactgtcgacatttgatgtcgcgattccggtatttgcatagtatggggatcgttggtactaggatatacgcgagaccgaggtaaaagagatggagacgaggatttttatacaggttcgggcccctgaattgtcaggtaataaccctacatcctgttggccgaagccggtcgttgctcttattcaccataatcacaccagtacaatatttggggtagcctatctaactgttgttgatatggcggtctaaagttctgactcgtagtagacaacagggtagtcttcctcgtcgagtttgtgctcggcgagatcagagacagcgctagttccctacggtcggcctctgaaggtaccggatagggtcgatctagacatatctctgatgtcgatatccggcggcttgtcttgacgtatgttggcttgtattggcttgtggctttgtggcgtctatggtaggtgtcttccatgctgggcgttgattgtcctctcctcctagggggtcttgtatttatagtcataggtgtccccttgtccaagtaaaactagggaaaccaatatggatacaatccgagtagtctttgtcatttccatgtagaactctggttgtccttccttatccagaactcctcctatatccgcaggttgtttccgtataggacatggtatgtggtgggtcctaccgagatttagtcaactactattagatatgtggtatccataaccctgacagttatatggtttgaagggcacgggtccccagcctgcctagggacctgggcccacctttgctctggtaggttacacgtccctcccaaagaggagcgtagatgcctacaagatctatattttaagaataaggctgagggaagcctggatcctagcttgctctgggacctaggcccatctttgcccttgtatgttactcatccttccttgagaggagcgtggaaacataaaagatctacatcttaagatcataaaccaaggcggagggaagcctggtcccatcctgctctaggaccaatgcttgcctttgcccttgtattttgcatgttcctccttgagaagagtgtggaagcatacaagatctacattttaagattgaagactgagggaggccagggtcccaccctgtcccgggacccgggccctcatttgcccttgtatgttacacattcctccttggtagaagcgtagaaacgtacaagatctacatcttaagatggaaggctgaggaaggccaggaagcctgtatcaggacctaggccctcccttgcccttatagataacacgtccctccttgagaggagtgttgaaacttacaagatatacatcttaagattaaggctgagggaagcctagatcccggcctgcctgggacccggccccacctttgctcatgtatgtttcacctctttcctcaagaagagtgttgagacgtgcaagatttatgtctcaagcaaacaaaccaaggggagcttgaatcctagtccagcttgggatccggtcccccctatgtccttgtaggttacatgctcatctttgagaggagtgtcgagacatataaaatctatatcttaaaattgtaggcaaaggaaactgggtcacagcttggtctgggacttggtccctcctatacccttgtgagatgcatctctttccttgagaggagagttgagacatataagatatacacatttacaacttttcatcaaagacatcttcaagaagctcgtccaaaaataactaaactaccttttctaggacaaggggcacaaccagaaggctttgttgagtagtgaacgtgcccctctaccagctatgggcaaacgtttactgccataaatgaaataggtttaagagggaaactccaagtggcctggggtaaaagacatggaaaagacactaacgctgagtgattagggacaacgggcgtctgtacatgcgtcgcgcatgcccagcgacacacgacttttccaactggacaaaaaggagctgtggcactattttgggtaggttggggatcggtaggcccaccacgagctacatggagctggcccaaaccaatgcccggagagcctggggcaacttaatcacatatttttggtaggtttttcaagaagattggaaggaaaccaactggcagtggcaagacaaccaagagagaacatagaggaaaagcaaaaatggtaatctgagcccctccttggactataaaaggaaggggatatgccactaagaaagggatgcttgagtttagcttgaaaaagtatagtttgtatttttctagatccagatagcaaacacaaaaaattaggagtagtatattacacctccgggtggcctaaacctgtataattcttggtattggttggattgtggggaactcgtgccccatcctaggtgatttccacacatcgattgtagccaacccctggttgaatcttcatcaggggacacgtctgcacttccctgctgctagagaatcgcctctccgatagtggcggtggagaggagagacgccagtggaggggagaagcggcggcgctgtacgaggagtaggggattgggtaagagggagagtttggtggggaggagaaaacgtataggtcaggtctgacatatgggtccggcaataggctagatatatgtgtactcctttttgttgttatagggtgtaaactataaaagttttaatttattcgacaatagaaaatatcatagggattgacaaagaaatgactagggtctgaaatcctgtaccatgggttatgtgctctaaatgaatcttgtgcttatgtggcatttaagggtgcttaaatgacgatcccgcactgtgaatgtgtcaggtaggatgaagccttggattcagattcggtgatattgcgatagcatggcacggtgtgacattggagtgatctggggcgttgaaaactaatccaatggtccgctgcactggcccacctgcaggactccgttttcaccccacgcgcctacccttcttgccaaacgacgtctcctccaatctcgccccaatctcgcgtgctcgcatcgcggcttccccacgccagtctggagaggcgccaggccaccgcgccgccgcgagtgaggaggggactgggcggccgcctcgtcgcttcgcctccccttgcccgtgtcaggccaccgctgtgagctagctgggagccgccaccgcgccaggccggagaggcgcccgccaccgcgccaccgcgactggggaggggactgggcggccttttcgcctcccctcgcccgccttaggctgccgccgcgagctagctggaggccgccgcgccgccgcgagtagggaagggaccgggcggcggctgcacgaggaccctgatgtatctgaactctgtgttggttttggcatatttttgatgtttggagttccatctcgccaattctactgaacatatgctagctaatccaacagctagcactaatagagcaacagagccaaagcacccaactgaaagggaaacacacagcaaaattgatgaagcacaggggcgcgcaggcacctcttccgcaccgggaggcggttggacctcgttgatgtcaggcccggtggctggctgcctccacacgcggcctgccgcggtagcacggcagggccccagccccggcctcacgtggcagccgccagacccctccacactcgcggcgagctcgtcggcctgtcacctctccggtcacggtggcggcgactctcccagattcagcggtgacactcccgctgactcacggacgcgcacgatgagaaattgggggcatcgtgtcacgccccgaaatagtaccgaccggaaatagcccttgacgctccaaattaacctgttaatcgataccagtcccaggaaacagtgctggtatcacaggaagacggattatcacagcaacagaggtctctttattatagagtagaggtacagtcatgttgggctgcggacagatcccgagctcacaactgcattacaaaaggggaacggaagccaggacttggaccaaacaacacaggcgcgacttgggaactaggccgaaaccctaaaactcatcgtagccggcttgctcctggaagaactcctcatcagcaggatctgcttcatcttcttcagcaactggggggattatttatatagagcaagggtgagtacgggagtgctcagcaaaccatgggaaataagtgtttaatgcaggcttcaaggaaatgctgttgtttttacaattgattttattcaaactcttttctaaaaacaactaagtgagtgcttctcaaacgacacggatgagacagtgcgtctcatccagtcggagtatgtgcaatgtatcagtctttagaattgttcaagattggcacccggccaacaactttcaaacggccacccgggccaacaactttcaaacggccacccgggcctagctgatcccatcagctgcagatttttcaaacatcgaacccctttccaccacagcaatctcacaaggcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcatacttgtcttatgtttggatgaaattccaaggaaacggtccttaagtgcgagagcgggaaaccgtacacccggtacgtcccccggtccgcggctttggaaattcatttagttcgcaagtaccgacccaggtgtcgggttttccaagtcttttgtaaaacccgagttttacccaagaagtttttcagattttaagtttgaaggcgtccgtcgatactcgcacagggtgcaggaatatcgagacgcaactagattggttacaagggaacacgatataccatatcaaggaggtcaatgcaacaaattaggtaggtccgccaatctgccttgcagacgggacaacagtttaagcgcgatcctatcaatgcataatatttttcaagcaacataattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacggcgaaaaaagccctattaatgacctctatgcgtgccattagatagatctcgagatttgaggaattttggaagttgaacggagtcaaacggatttacggttgggaagatattgaatttctaagattattggattttttggtctaaaagaaaaggatttaattaaatcctttatgaaaaagaaaagaaaagaaaaggaaagagggagggaatatagacttttctcgggcggctagggcgcggcccaagagaaatggggcggccggccgagctaaatgggccggccggcccaaggcggcccaagacgcgcgcgcgcgggagggaggagagagagagccggtggaccgggctcaccacgcgcggtcccgggtgggacccgcttgtcggtgacacggctcaccatgcggagcgagcatgcggcgtacgcgcgcggcctggggagggacgcggtgcacgccccccgttcgcggaggaacggttgcggcgggcccacgcgcagcctcgcggctcgtggtggaacgcgcgccgggaggggctgaccggggtcggcccgacccgatcttggccgagctggcgccgacgtggcgtctacgtggcgcctacgtggctgccacgcgggctggcgggaggaagacgaaggcgccggccgtgaatggacggcgggcggcggcggtttctccggggcgccttgcgacgatgaggggcgacggggcgtacaccgggatgacgaggaagaaagagagggagcgagccaacggcttggattcgccggagggagtccgtcggcggcggatttcggcggcggcaaccggcggagagcaaaagggggaaacggcgatgaggtcacgaggggccaattcccggcggtgagagcatctacgcggctacgggaatccgttgctagcgtcggattgggcggagctacgccgagcgaggccggcaacgagcgggtgctacggagcacgggcggcgacggcggcgagcacactgcgagcggcggtaacggtcggggcggcgccggctagctacggggaggctactcgagctactaccgaaaactaaggggggaagatggagcgaggagggagaacggagggaggcactatcgagatgaggaggggcgctgtgacgagaggccgacggcgcgggagtaatctctccggcctcgggccggggaagaggaggaagacgagcgcccggagtccccttccgcgtccacgaatgcaccggctttcccggcgcttggcgatgaacggcggaggcgagacagagctcggaaggcggcaacaatggcgatgggagggagaagagagggagggcgcccggggctttaagggcagcaatgtcggtttggaaccgacttgggcggtcaaggcgcgagctggcgctcggcgctcgcgtccaatcggcgacagggtggagggaggataacgccggcgggaggaaaaaggggaaaaggagggagagaaagggggctcgtccctttcttctttgggaaaaaggaggaggggagcgggggcgtcgcggcagagggaggagggctctgcctccgtcccttggcggcttgcgcgcggagtggcggggccgaggcgatgacgacggcgatgacggcggggcggtttggagcggcgcgacgacacgggcgacaggtgcgggctggcgcggcagagggtgacggcggcggcgaccagacggtcggccactcggcacgcacgcgcggcttgcaacgggggggggggggggcggcggatggagtggcgcggctcgggcacgcgcgctggcggcggggccgagcggctgcaggcgcggcagggcagcggggccgggcggcgcaaacgcgacgcgggcgaggaccacgcgggcgcgcgcgcgaacgacgcgcggggagcggcagcgagggagcggaaaggagg

SEQ ID NO: 58090 - DNA, 9754 bp, Oryza sativa
agttgtgtcgtgggcttaacccaagggggtgtgcaccttagggcaacctaagaaggtccggaatcatatttattcagtagccatcatcgtctagagtcgggttttgcttacattaatctgtcaagaatagtttcgccgcttgatcagtttgtggaaccccaaattcaagtgcttaatcattcatatgcaatttggttgcaatctatcttattcttccttgtgttcttcgtttcgcatgcagggattagccttctcggcgaggtcaaccgcgtttcggcatagttgataaccagaggagatgtggtgctgcaattatgtggctcagtagcgtgttcgttcagaagccagatcgagttctgtcgcgactccacccaaatcaactatttatcaatacctaatggaagatcggaacctaacatccttatcagttggtatcaaagcgcgattacccgttaggtaatttatcttcccacaactagaaaattgccacataaaaaaattttattctttacctaaacaatttgagcaattgcattgttgtattagattttgcttcgttgaattttagattgcatcatcgtgtcaactgctggtttagttctagatttaatttgtagttttgagtattgcgtctgtcatcacattgagtctagggttgatcagtcaagtcggtgtgagttgtacgtcaattttgggtccagttttgcatttcgtcggttgttgccgggaccttgaaaaattgaatctaatcattgtcgggtttccgtttttgggatttggagaaatttttgtacaacggttttggagttgctccattcaagaagttcctttattacagttttagtgcgcgtcccacccaccccccacaattcgtgtaagaagactagtcccaccagcaagtgcttgtgctactccccaagtaatcacgagcatccagatctgtttcactcattttgatacttgtaagctgcaattaattgtttcctaatgaaatacatcagcacttggaacagatatccagaccgtctgtttagctttgattcctgctgcctcccttttccattgagccttattgatcaaatagtgctcgaaacaaattctactggctcttgaactttcaccttcatatgatgcaaatatatgatggattgatgggtcatacctcacaaataaagcgggagggaaggagggggggtggttacacagcacatgggtgataaccatcaaattatatacgtatataaatagagagaaaccattatatgccactgactttatcacgttctataatatgccatcgacttttgcttaacttctacgatttaccatcgccgtctggttagtctccgttagtactgtacaaatttgtcaaactgaccaacatacccctgggacaaaactttcaaaatttggataaaaattctgaaatatcagattttaagtttttgtccaaattttggatgtttacaatattatgtttataatatgatatttttgtccaaattttagaagtttttgtcctaggggtattttggtcatttggaaaacattgtacggtgctaaaggaggctaaccggacggtgatggtaaatcgtagaagttaaacaaaagttgatgacatattatagaatgtgataaagtcaatggcaaattgtagacgtgtgacaaagtcagtgacataatggattctcttatatagtattaatgttcatgtagatgtagctagataagaaaataacatctgttttgagatacaaaagaaggcttccaacctctcataaacaccaaaacaaggcaacatatgtttactgttttgccgtacacaaacaaaaattacatctcagttgacttaaaattagctctacgagtactaataccatagtaatgtcattagaactaatccttgatgccaaatatctttcaatagaacttaccaaatagtccgcaaatagtcgtctcctattttatttcgaagacatgttttcacaattttcagagctaaaaatgctctcagtggttccagttgacacggagagagtcaagactgatcaattgttccttttaaagagaaaatatagccggcaataagcacggtatgtgtgtggtgaatactctagccaaataaatagattaaaccaattgcattagaatctataagagaaaagtatcaactgtattattcgtaatgcagttcaaaagtacgatttcaaaaaaatatattgttcactggtattgcttaaaaaacttctttcagtctatttgttatctctatattatataatatataatttaccaggaattatctagaatttgcatgcttaatcatctttaaaagaagaagataggcttagtttgtttccgaaacaggtttcacaaattaagtgtaaattaaaagtaaagtgttttctttttttataactgattgtttacggattcagttttttaaccaaatctttaaaaacctattgttcaataaatttgctttatttgtacaatcaaactatcgccctctaattagttcatattaatgctatttgttgtatacttatatgtaagcatctaagcactgaaaaatgatgcgattgttatgataactagaaaggtagcccgcgcacatacgcgggcaccttcttatataatgtgagtgaaattttattatgaatatattatgtgcaggtggctttttattaaaatatcttgtattatgttctaaactaaaattaaacttattttgtgtgctttgaaagctagttatatttttataactacccttgcaatatataaattctaaaataaaattaattgagaccatgtggttttgaattgttgagaaaatattgtgtcgaaacaatggaggtggttcctataataaaatttagggtattttaactcaccaaaaaggatatcttacaacctcaaaagaaatccaataatatcatttttttgtttgattgtattttaaaattacatatatatatattttttcattctaaccatccttgtaaaatgtttgaatttttctatcaagtattggttttaaatccagcaacatttgttcaattttaaatttattccatgtccatttttttctttgggatagtttcattctatgattcatccttgaaatgatttgatctttgcaattttgggcaaaaaatataagaacacataacctagtatgggataaagggcatacgttctaaattttctctcctgaaatattgaagtaatggtcataatgtatttagcgaatcaccactaaagtgtattgttttataacaaatacatgtttctagattgttctacgtcaagactttacaatgtattgtagcaagtttaataaaaaaataaaaaagggcatagtcaataattcctatatggaattgacttgatttattgctaaggccactgcaaggttgttccactgttaaaatccttgggtacaacccatatgcttatcggtatgatgttcaaccaaccacacctttattttcaccctattgtctatattgctagatgaatacctactatgattagtgacttcgtagatcatatgtgtaattcagaggctatgatcatctttcttataactacttatttatgtcctaaaaacatcatattaaaagtatcaaggtcaatttgtataggcatgtcaagagaaattaattaagttggcagaaagttgttagatgcccaaaaggatataattaatagatggaggtccatttgtgttttttaaccatatagataattttaattttaattgtcaaggagataaaaaaatatagagaaaagaatggcgcacgttgtacatgggccgagaaggaaggaggtttgggaggtttctctaaatgattaatctaacaaaaaataatgtgtcagatgtttatgttgaaactgatggtcggatgttttgttttcttgtcagaattttattaggattttctttgatttaagagaatgacgtaacatcttaagagcatttataatatctgtaatagacttttaacaccgtatgccgcaaaagaaggagggaagaaggtttagggtgctcttttttaaagaaaaatatatctaatgacctaaaataatgtgtccatcaatttatgtcatatctaatggttgggtgtttttcttttccaaaatttctaagatttttctctaatttaagaatgccatatagcagcttagaggcatttataagatatttaatggattttaacaccgcactgggatggggagggacagagagaggtttgggttttttcttattaaaaaactaacaaatcaatagccaaatgttttattcttttttaatattttctagtattttatttaatttaatagcaccacgtagcagtttagaagcattcgtaggatatttagagtcacagagtgagagctgctagacctaataggtggaggtctctttgtgatctttttaatgtaaaaataattttgattattatttctcatgaacatagctcgttggcacgtatgtgacaggacgttcggaatgtgtgctttttaaaaaaaaaagatctaaccttctaatataaaaataatggatccaccgatttttaaataaaaatcgatggttggattagattggccacttggcaaccctggagcgtttgtaaggtaccacttggcgaattaagagtattcgtagggatgtttaatgaacatttaatatataattgtctttttttgaaatttctaagattttctttaatctaagtatgtcatgtgacatagtagtttagaggtgtttataaaatgtttaatggattttaacactgcacgggagtggggtgggagggagagaggtttggaatatttttattaaaaaatctaacaccctaaattcatcaatttaattagaaatcaatagtccgttgctttgtattttttaaaattttaccacatagcgatttaaaagcagggagagagctgtagttggtctatttgtgtttttttacctgtaaaagtatttttgtttttattttctcattaaatagaaaataacacatgaatgaggacagaagggaagtacgtatacagtacatatgtacgtacgttcgactattacgtaggtttgtacgttggtttcgtatgatggttccggatgttcttttttctttactagaaaaatgctcgtgcgttgctacgggaaaaaacgttttttatcctatacattatattcccttggttttggaccggatgcttctttgtttttggaccggacgttcattccttcctttctttttagctctagtcctagagtagtccgctaactctaagctgctcggtctatctctttttggctcagcccacaagtgaaactgtagtcttagctcgaacatttccgtgcctggcctacctcttttcggctcagcccacatgtgcagctgtaggcctagcttgaacagtctcgtgcccgtaccatgacggagccgatcctcccatcaaatccggtaatctggtcgagctcacatagttcagtgtccgtacgatggcaatcctctccgtcaaatacggtcgaatctttctcgatctccaaaattatcgagagattttgatccactcgatcccctttttcgtttttttaccaaaatcaaagcaatccgcaaaacttggaaaaaaatgacgaactgaaaggaaaattcaagcggaaaatgatgaaagagtagtggagaatcggtttttcaatctattggataaggaaatacataaagatgcaaatcgatatggcggcggcgctagggttcggcccgacgaaaaaaccacacaaaaaaagcgaaaccagaaaaacggtgaaagaaaaaacggcgcaaacaaaataaaacggacgaaaaaacccgaaaaaacggtgaaagaaaaaagcggtaaaaaataaaataaaacggaaaaggaaaaagaaaagggaaacggacaaaaaaatttattttatttttgccgtgacgggcttcctttttatacaatcgttttttcagcacttttttttccgcttttttaagtaaggataggaatcggtcagtttttttttccacactttttttttcgccctgggcttttcttaattacgatcggacttttttttatatttttttatttacggacgaaggaaacatcttgaacgtagtatatatatatatatataggagatagatagataaaatagatctaagtaaatctaaccatccaaaataatgggtccaccaatttaaataaaaatagatggtcagatttctcttaattattatggtgtgccacttggcgacttgatagcgtttatagggtgccacttggcggtttgggagcgtttatagaaagtttaatggacttttagtatataatagatagatagatagatgggtatcctacttaagtgaatgctaagaactttttaatgtaagagttttatattttttttctataattagttcactttgctcccttttgtatttcctattttattttatacaactttattttaacttgagatgataaaatattaatgatagagcgttataccttatgtatcaaccattttctgtgaaaactcaatcaacttttgtgtaaacatctaaggctaaataggttctcattatttatttattgatggatttggggaaggtggggggaggattcgaggttggatcatttcttgcaagtgtgcaaggctccacccagcctagagagaacatgattggaaggctaaatataactgcgaaggcatcattatgtttggaatatgatttttttattgtttccgtgatttaaatttttgtatgaaatttataattaaatattaggaagtatgtactcgataccaatcactctacaaactttttgattagctagattgcactgggcatgaattaagtacaataagattatataaacatttagctgatgcttataatgtctatccacttgacataattaccatgtatttggtcatggatgtcttgaactcaatgttcagtcatgcttctcttgaaggttggttgcagctcctatctattcagcatgctcaacatagatgctctttttatgttgacgatgcggttatatatatgttcctaaggccaacagtgaatgacataactatcatcaagcaactgttagatgtgttcagtcatgcttctgggctagtgactagtggagtaaaagagtttccctgcacctacgtgtggttgcctctcaatattatgaaacctagcaaagctgagctacaattcttggtggataaggtggccaacaccttctatttggaaagcttccctcatgaatagagctgggagactcaccacactgaaagtagttctatgggccatcccgatttatttgatgatcacaatggatatccctaaatgggtgatcaaggtgtgaaatagataaaaggcgaagaggtttttcctatgggtcgggcatgaaagggctaactgtggtaattgtttggttgcatggtagcggatttgtcgacccccttatgtatggtgatttaggaattcacgagctcatgaatcgggaccttcgcattcggtgggtttggttgcaaaagatcaatggtgctcgagcttggtaaggattggaccttcaatttccaagcaatgctcatgctattttcaatatggccgtggaagcaatggttgggaatagtcaatccatcttgttttggtccgatcgatggatacaatacaggaccataacagaggtggcccctaatcttatcaatttggttcatataaaaaggttattaaaaaccgtactgtcgcacaggatttagaaattcatagatatggactacagaaatcgaaggagccctccctgtccaagtcatcgtggagtatcttcagctgtgggacttggtggttaaagtggatttgcatgatattttccaataaagtaaggtctaggtaagatcattaagattggtctactcactctctccatgcttctctctctcatcctagttcgcgcaagaaaatctttaggtttcaaggtataaacaaattcattataaattttgtgtatgtctaatatatgacaatctttagcttttactgtgtttgcaaggtatttagaagtattgagaggtggagtaatgtggactgttgatcgagagaggtgtaaggaacggaataaaatttattgtaaccgatggtagtgaagtaattaaatagtaaaacatgggcattttaagtggatggaatatttggctggactgaaccagtaccaatcagtaggaaaaacataaatcaggcattgatttatgcattgaatagatcttcacgggaaaaagatatcagatccgtcttctttcttcttccacattggttcgttcttgctctaggatttgacctaaattcacccaaaaggaacagagggagaaccgtcggaattgttgaggattcaacatgagacgagattgaccagtcaatggcataggtggagcccatcgggtgagatctccttgatgtcaattgattagttatttagatagtttacaaattccttcgtatgagagattggaatgagatctcctctgttcttctaatagggttcgaacatgtggaccagcaaggagacatgaacaagggagaagctctggcacagtcatgtgttcttttgaacaaaacataaatctatagaagaccacgcaaatgagaatctttacgttagtaatgtgttcttagaacaaaatgtaaatctagagaaaatcacacgaataagaacctcaaagaacacaatgtaaatctacacgaaacgacgcaaaagaaaacatgtacgctagtaccaggcaaatgacttaagtggtacctatgcggtaccgatttaaatttgaggacaattctgcccttttctctttactagcaaatttatattcaaactttgatacctaagtacctacactaatacttaaatactttttacatcatatatatatatatatatgttattgagaagcgttggatgtttactttttttggaatgcaaacatcgtaaaagctctcttttgttaacaatggttttcttgcacctcctagtaatcatgccgcagggttgtaaaatttgtttagatactgacacatggatgtttccatgttgtgcgcagaaaaaatataaatttttgttcatacctggaaggtatagaatagctcttagccccctgcatgtataagtataactacgtatggcatattaccagtccgtaaaatagactctataatatagtcggggcaacggcccgcttgcgaaaatggaagaaacgaacaaaaaaaatcgctggcccacgccgggagccgccgccacccgacccgcgccgccgccccacgccggagccgtcgtcgtcgcacccccgcgccccgccagccacgtgcctcgccgccgcggccctcccccggcctcctcccggccggatctgggaggggaggggagggccgccgccgccgccgcaccggagccgttgtcgtcgctgccctgtgccccgccgaccacatgcctcgccgccgccgccctcccccggcctccctccggccagatctgggaggggaggggagccgccgccgccgccgccgccacgtccgcgccgccagtggagggagggaggggaggggaggggacggcccggcctggccggtggggagaagtgccgttgagggagagagagggaaatgagtggtggggagggggtggaggagaagataaggagttagatttttttggtaggtacaatttttgcagg

SEQ ID NO: 58091 - DNA, 28181 bp, Oryza sativa
aaaaagaaaaacgatgatgacgtcatgatgacctcatcaatggccggaccaagatggcgacctcgccggagattggatggtcggctgcgactttggaggacatgaacacgtagaggacgacgagacgaacccaacggtactcaccctcgaaccaaacgacgaacgacgacggccggcgacgaggtctaacggcggcgcggcttcggtcgacggcgacgacgggactccggtgaccggcgacagcggggagagagcggccgggcttctccacacctcggcgcaccttacggcggtgacggcgaccggcggcgacgacggaggcggcggcgcgacgcggatggagctcggccggcgacgacggcggggtggagcacgtggcggcggcgctacgaggcacgggagatcacgggagagggggcaaacgaaagaggaggactagggggtcctatttatagccttggattaaagagatcggactcctcccgcaagaaatcgatccgggaaatcaaaaactcagttttggagataaactcgaaaacgagttcgatccggataagatactcaacgattagctccgatttttgggggtaaagatagaggaggataagaggaatatttcccctcaactaattttagataaacacaaggggaaaggtcagatttggaggagaaaaaccgagccaaatcggtctcagttcggctgctagaggtagaagataaacagtgtcgagggaggcaaattagacttttcgtcttgggctggctgaaaacaaagaaaagaaagaaagagaagggggaaactcggctgggctgacttgggctgcacggccgtgcacacaaaagagggagatgggctggaaagggcccaagactaggaagaggattattattacttttccaattaaattaatcaatgaaatgatctttgaattgttaaaaatacttcctatgctcaaataattccaagaaaaatcttgaaaatacttggacactcaaagtacttaacaaaattataattagaccatttaatgattaatttaatatgtgggtaattactgaaatgctctttgtatgattaaaattaggaattgagctccgaaaaatccgagaatattccagagagtataattaaccatggagaatttaataaaaattaaatccatccatgctttatatttaggaaattttatttcccacatttaacttcacttgtaaattaatgaacatttaatataaattctaataataatttattaaataatttataaatcctgaaacaaaaatcaggatgtgacacatggactctgacaaggatacgccactcattttggggcgtcaattccttagcactgcggaggctaacatcgatttgggagctaggagtatccggctccgcattaacgggaaggaggaaaagtttgagttttgacctaggacggagtggtgctctatggtgaagatcaagtacgggccaaatccacataatatacaagaggttgaagtgaagccgctaacgacgaacaacctaacagctttcatgaagaacttcctcgagaaggaagcagaaatgagcaagcctcgtccaagaaatacaccagtaaagccaggggcgcaggctagaaagcctgtgaaatcagttgctaagaagccacaagtcacaccaaagatgaagaaggtgtggcgggtgaaacagatgacattcggtccctcacctccggagccgggtgccacatcgtcatgctaaataggatggtggtacagtcttgctcgtcggacctgaaatgacatcgccctcactaatatactatcatcggtttcagtgccgctaatgaggggaagccgatggagccttaggctgaaaagtgttagatgttagaattgatagtattgatcaaaatgaaagatggagagttcaaagagaacttgccaatggaggaggtgtcagtcgaggagttggttgccgatgagtagaagctgatatggtttttgtcttcagaaagataataaagtgttagaagatatgaatgttgtccagatagagtggaaggatgcaatatttactcttgctcggggttggccgacgacgaggaggtagaggaggaggttgctcactggctttgctgcttttgtcctcagggatattgctggcatcttcatcttcattagtaacattggtaggttcatcgcccatatcggcagcaacattttcgatatcttccatggcggcactgaaaccgatgatagtcggagctatttccctatatggtaataaagcttgagcatatactatcggctgattactatcactaattgtggaaggacatcggcggcctacaataaaaatggattaacggtagagaagtttatgaattgcaagggctaattgaaggattgactatggttaagtaaaagttagatcccaagacgtaaagatgtttcatccactcaatccaccattaatcaaacaatcggctgcgcatgggatggatatcgatatcggcaggagagcgtaagataggtccttcaaggtttagcagccgatcaaataagagagttgagatcactattcccctagtttgaatttttcttaagaagtatagaccaattgggagttggccatatcctagttgtcgggctgccaccattaaatgatagaattcgtaagagacctcagagtaacggccggtagatataccagtcgaaaggatgcagggtgagacaactgatataaatatatctctggacttgttgtcactgttgatttcatccaatctcaaatcaattgggagctcataggaactgaaatcagtgttggagtaccaaattctagtgcttctgggaaaccattatagaagtgttcaaaccaaatttgaagtttttcatccaatggtcctaatctagggtagattgatgttgcttctctaaaggacatacattggtgagttatttcatcggcatcgttggaaatacatattcttcgagggttggacatacgattagcaacttgaactgtatagagattgagccaaagttggacaaaccaccgaggccctccacatcctatcggcttgccagttagcaattttcttgttgttttatgcagaagttgatacgtggccccaatagatattttcctaaaggcatctctttaccattaaaaatcattaagagcggcgggctgggcggccgctcggcgtgtccacgtcagcgatttgctacagtactacagtgctcgggtgtattttttgcaaaaaaagcccttagatttgtccataattcggagtaggttcctcatgaaagtcgctctgaggcgattttttatttggaggccctttaaaaaactggatattgcatgtgaaggagggaaaaattgcggattaggagtgcgctgtaaaaagtggaagtataggggctttttcgcaaaatgccacccacttaaccaaaccctagacgccgccgcccccttctcttctccctctcgtctctccctccccatctcccaccgtcgccgccacgcgccgccgcctccgtctccgccttcccctctcgccgacgcgagcgcgtctacctccgccgcaacggccacgtccacctccgccgccgcggcacgcgtcccctcctccctctcgtctcatcctctttctctcccgtcgccgccgcctccgcctgcccctcgcgacgccacctccgcctcgcgccgtcgccatcgtcgtccctgtcgcctcgagccgccgcgtccatatccacctccgccttcccctcgcgtcgccgcctccgccttcccctcgcgtcgccgcctccgccgccgccgccgcgccatgtggttgctcgccgccgttggagaagctggatccgatggccaagccctcaaggccgtcgcatcttatggcggcaagttcatggccggccaatccggtggtttgacggatgatggaggggatggtggtgatggagcagtggggcgaaatccttgcccatgccaccagcatcccttcgccacgtccctctatcttctgctcttgcgatacacgagccgctgccgtcgtcgagcattgcctccctccccaacatcttccggggcgttcgaggtggtaaggtgctcgatccggtgatgatacgatcgacctcaacggggagaagctcggttaactggcgctacgatcgatctagatggcttactcacaaggcaagcctgtcatcacactgtcctagaatcgggtcgccccagtgacgcccttgtctggtgctgcatgcctcctcatcctctccctcacgcgactgcaagatttgaatcactccggtgagtctctggttcgttctcggcttctcaatcctctgccttccttgattttttcccctttttctttgttctttactttgctgatgtgcataggtgaattctttgttctttactttgctgatgtgcataggtgaacgagaaaagcgtccagccaaccacttctcctcgttgactgtctttatcttccctccagccctggcagcaatagagcaagctcatgtcaccatagtcccatgctcttggggaaggagatactagcatcccgcctacggaaattgccatcgccgctgcttcctcaaggtttgcattatttttcacggccgtatttgttgccacatgaaaaaaaatgttagctgatattgttttcctatgttacaacaggtgagaaagatagtacaaggaaaacatgtactttggggaatctgttatggacaatagtaaagggagagtttcttttacaagaataaaccataaaccatttccaatttaccattattattccgcaatatagaacgacaaaagcctgagctcacccgatctgaaattttttcagcttttatcttatttgacagttcaagaactggtgtaatagttgatagaactatacttgcagaaaatagaaaacatgacctctgcgtgcaggcgagattctcagtggtgatgcagacggaggcagtacaacattcacagtggtaacatgacactaaggtttggttgattgggcgaagaaaaatagagtttggtcaggatgcagtgtttcctctgagaaaattgttgcaaaaagcagctgcacaagacaattgtgaggtattataactgcatttatggactaaatttggttctatcgaattcgcttgattcgtactatacatgtttatatatgtttggattgtattacagtgcgatatgaaataaaataaatttcaatagttgagttggattacatggtgaaggattataaacacaagtaacctaattatgtggatatattgtatgggtttcctataataaaagaattgtacaacaaacacaatttgctctatgtagtattcaaattcaagtatttagtacaaataaaaaaggtcatttaaggggattgagtagtgcaatacatagttcttccatagtaccataagttatatatggaaatagtcatgccagagctgtagaagctagaaaggctatactgtaagtacggttacatagagaaatgcacattatgtagatgtacagtttatacaggggtgtaaagcaaaagggctgtataaagtagtattatatacagaggtggcaaagctatataatttaattgagcaatgcaaaaaggtttatatatgaaagtggaatgagatgtcttactatttcatcctgtttattacaaaagggatttaggaagtggaaccatccagttgacctatgaaaacaaaaaaaagtattaatcatacaggttacatcaagtcagtacatgctatttgtaatgtgctgtgttaatgagtaatcgatgtaccttatcatgttgcttttatctaaacgatgtataatacgtgattaggaatcctagagagttcttgcattggtagcagtgtgctttgagcctttgagtcagtatacaggcgtcatgtgcgaagtgttaagattaatttgtaatggatcttccgtgccacgatttgtcgatttcacatgaaagttctactcttcgtgtcctcctcatattaataacaattctcttttatgatgttctacagcgcttctgaaaaatgaatatatatcactggtgacagattatagatttggacttacgtaaattggtatggtatccttgtgagtattcatctacagttcaaggtatgatacatacactgcatatatttataggtccatcatccttgttacagtttctttctgttaaccagataataatgttttcttgtatgtccccaattattatcattccttctcacacaaaaattgtgccttttgtatttctgtaattttgtcataaaatgctaccactttgtatattacaaggaaataaccattatcatggtttcttattagtcaatggcatgtttccgagaacaagaaaggattaatcaatactctttctgagaacaggaaaggattaatcaataccaacttctttttgtaattttatagaaattgttggttttccttagcagtggctggtgatgaatttcactgcatcatattttatttgctttcagacaagatatgatggcaattgttccacatgaaatctgctaacacatgcatatttggtatgtacttctatcctgattatatggctttacctgcccttttcaatgccttctacggagtgtcgcctattaaaatcagtaattgacaagccacatggcatgctcatagtttttttgggttaaataacttgaagcatttcagcgtagaagctgggtaaagtatgggacaagtatgtcgctgatcatctccacttaaggcgagaaacatttttcttcatttgtttcaggaattgtaaatgttcttaggtttagaggtgagatccatgtgcatgctatctaactgatgctctctggtttaccaaatttgtggacttctatgtattgaatgatacccttacaggttgtatttgaaaggtcaaaataattgatgcatcaccatgtttcttgccctattcattctatttgagaacatatttatatattactactgccggcatatacaagttacaatttacaagttgttacctttactggaaggcatatacaagttactatatccctttttttttgaccaaaaacagcaggagaaactccttctgtcctatattaatatatatataaagaacaatatttacatgagagaactacaagattagaatatacaaaaacttatgctagagtttggcatttattctttctactcgttgaatcaagagagtatcttcaagtaatcctagctctgaatacttcaaattatcacttatcattgtagctgagatatattttcttactttagttacttcttgctttaaattatctatacaaacaacaccttcgtgaatatggtttaatgcactccaacgagtttaacacttcctttagctctataattatgtgcagatttttttagtttaaattcaccttttagagactattcttgtgattgaaattttttggatacttattttttcctcaagttcattgagtgtggtctaggcatacatggttgcatcattttgccatggattttatcacttgagaatatgcatgctagaattaggcttcttatctttcaggttttttctagggttaatttaagattagaactggcatgtacctttatatgtaaagaattttgttttttcacctcaaaccctctatggtgtgtacttcctacagagtaatacgtagcatgttttctctgttcaaaatttaaggtcatatatacatattcatttagtcctggtatttaagtaagatccattgcagtgagtgtgtgtatatgaacttttgtatgtaaatatatctaaccaatttactgtggcttatacaaaattagatcctaaattacattgagaaaccttttgtatttccaatcaactatactagagcatatatgtatagctaccagtattgtgcatttgaaaaatagagcattttttccaccaacggtggttgatctgttagtctcaggtcccaattagatgcaatatttcatcttagtgcaatttattttgatcttcagtttgacctaaataattgtaatttgcatatgtcctatttttctgatcaatgacattcttaaatattcctataggatgttagcatctcatacatgagctttgatctatatacaccacacttggtattatctctaaccatgttgaattatcatgacatcgatgcattttaacctgaaggaattataatcgttcagaattttgtaatttacattaagtataccatggctgaataatataatgattcaagtttttagttagttgtatttctcgaaaatgagttggagttgtttggttgaattcctgtaggtacagctgttgctgccatttgtgtacattggggaaattttttaaacataaactaacaagacatatatattttgcagtacattttaaacacccattgccctggatactaagtctaactagacatgttttctatttgtcaaccacctttttgttcggtcaaataataattgatctacactggagttattctccattctccaatgtaaatataataactaatgtagtttaggatctgatgtatttcctttcgatatagatgaggctgacagtgcaaacaacaatgagctgtagtacaagttgtaagcatttcctttttacatactgacaattgtactaacagatatcatgatatactaatgatattgctacatttgacaactgttaaagcctttgctctcatccaggaagctggctttggaacccaacacctctaagcggaaatgtgcacgcatatcagagctggctaatagtaagcatatctctataattaaaggatgctagagaatttaagattaatagctgagctatctattcccataataggagagtaactaaggatcacataaatctcagtcagtaacagtccattgtaggcactatgtcatgctctcctaagcgtgctacattgtaattcatctgtcatcctatgaacagccaatcattatctttattattcttaaggtttttgtttagaactcaacttataaaaatgctgatgtgcctttaaaaaatagcttagttagtcataggatcatgttgttctatataatgaagggaaaaaagagaggtatgccgtttttagtttcctcagtgtgaaaatagtttatttaaccaaaccactttattactgatgtttataactatcccattttattacctttcttcagtgctgcgtgcagtttgtgactttactcagaaacacaaggccgcaaccaagtcgctaaagtgattaattaagtgcatcgctattttggcctggttagtgcattttgtaagtttgccagctaaactgtacatttccagaggtagaatactatcatataggtgcgattattatatacttgtattgtgctatatacgtcctggcatcaatatatatgctatctacctatattatcattgtgctgctaatggacacatctttattttaaggcattcttcttgttacaacctgtttgatcatattgccaataccgtaaatgtgcatatgatgttcttggcaggaaatgccccgtaccttttacaatgcttttgcttgtaacataacaaattatttgatcttatttagaatctatagtcagttatatggaaaaacatgagtgttcgatcattatgtgcactatttgtttcaattttttatcattatgtctcatcagtatctggagattgttcttttcgtttggagaaatcttgagattgttcttaacacctagaatttatttatggttgttctacctgttcactatacaatgggtgcttaactatacttttcagttttctcatagctttgatcatgcatgttaatatctatactgaaagaacatctaatctactatgcttaacatcttaagacaaaattaatatgttcaagttacttgtgagatctgctttcaaccttttattcaaagaaggccttaggcttaagtttatataagatttcctaaatgttgcacttagcttgtcaaagcttaatgacctcgtgttattagttaaaactgcatgaatacctttttgttcatcatgaataaaaatccaatatactaatatcagcacgcattcattcgtaggttgttcttggctacataagattgatccacgatattaatgccagatccattgatctatagcaattgtagatcagttggcagtggcggagggtaaaattaatcagcggtgagcagcttgatgctctcaggtatgatccactatccagttttgttgctgatgctcaccagagcaacgttgccccacttccttttttacagtcctctcatgttagagaggttgaagtgatagattactttttcttttgcattcctcttgaaaaaaagcaatattcagatgaattcgtttgtagtgtggttgtttctatgaagagaggtctaatttgtttggaggattagagggatgcatgaagtttgaagaaattttggaactaatatgagaaagaggacgcaatgctcatttgtggcaattgatgcaaaaagcagctggataatacaactgtgaggtattatacattgcatttatctgctaattttgcttctatcaaatcggcttgattcatttggtacatgtttatatagcaagtttgattcttgcattatgtatgaatagtattatagtgccatgctaaagaaaataaattcgataggtgagtatgaataacatggaaaaaggttttagctgactagcgatcaaatcacgtggaactatgttctgtatgggtttcctatatataaaaattttagagcaactacaatttactctgtagtattcggattggggtatttgctgcaagcagtgcagtacatagttcttacatagaaccctatgtattatatgcatgggaatggccatggtagagttgtacaagcccaaaaggccaaactgtaactaagattgcataagagctgcagattatctagaggcacaataacgatacaggagtataaagaaaaaaaatgtcatactttaagtagtcttatatataaaaaaatgtcatactgtaagtactcttatatacagaggtggacaggtggtagaacatacttcatatatacttcgtgttctcggttgtgtcttaatttggatcaaagttatcaccaattatgcaactaattatgaagttgtatggcaattttaaacaactaatcatatgcttttacatgagaaatgtttgtgtgccatgatcttcaatggcccacataactcatgtagtcaggtattacattcatgcttgctcttacttctcatctcgattcatttcagttttagccacaaagacatttttcaggtattacatttcagttctatccctatagatatttttctacagttttgtctatattatgcatgaatggaaagttcatctagcctgcagctactctcctgcaatatctactatacatgtgttggttatattcatacacttctgctagacccaaaatctcatggaacagtgtgtgatcggtattgcattggtgatcattgagcattgataactcaattcatacgctagctacatgtcagatatttgcaattacttctgctttgatctaatagaggaaatctcagcacatgatgtcttaattgtcaatcctctaatcattatcttcagcaagcatcaatttatatatatttgtttttcttaatgttgaagcaggatcgagagattatcagcattgctccctgatattggtgcaatacaaaagcttatctgacccctttccatcggtgggatcgagaaattatcagaattgctccctgatattggtgcaatacaaaagcttttctgacccctttccatcggtgggagacaatacttagccattgtgttaggctgtgtttagatctaaagtttagatccaaacttcagtccttttccatcacatcaacctatcatacatataacttttcagtcacatcatctccaattttaaccaaaatcaaaactttgcgctgaactaaacagtcttagtctatttcactgctagactgtacatgtgtttgttatgctgaaactatttcgttgaattttatgtacgtatatcggaagcatgcgaggatgttggcagggcagttggaccaaacagtttagtaataaaatctcagaaatccactggattcggtaaccttgttgcgtacggtcaattatcagttatacacattggatcagcaaggtgtggtatagtgtgccggtatttcatacaggcggcgcgcgcaacggcgccccatcctctagtttaccaagggtgtgtttagttggggaaaagaaaatttttggatttcacatcgaacgtttgaccggatgttggaaggggttttcggacacgaatgaaaaaattaattcttgaactggccttaaaaccgcgagacgaatcttttgagactaattaagccgtcattagcacatgtgggttattgtagcacttatggttaattaggtttaaaagattgtctcgcgatttccttcataactgtgcaattagtttttctttttatctatatttaatgctttatgtatgtgttcaaagattcgatgtgatgtttttgggaaaaaaattttggggaactaaacgggccctaaagcaacggcatattagctgttggtccacaacttagttccacagaaaacaaatctgtccagccaaagattcaagaaggctacatgctccttctcaataacagccctagtgttggaatcaagttgttaggatcggatattaggtagtatcgttttgctcaaagtagtattgtatcgtaggatcgtatcatagtatcgggatactatgagattttcttttttgaaaagtttaattaatatttatattaattatatatagccattctatataaaaatatatagtaataatatatattatgcaaatatagacatttatcatgagaaatcacattggttttgatatatttaactgatttctatatatacttgagcatattcgtttacattatttccaaaccatcttattttaaataatattttgtaatatcgtagggatcgtagaatcgagataccacctaagatttcataggatcgtgtagtaatgaatagtaggatcgagaggtgggatcggtatcgtttctgcttggtaggatcgtagtatcgtaagatactagaatacgaatcgggatactgacaaccttggttggaatgtctggtgatataccctgaccaaccacctccacctttggtgtccaacttatagttgcactttgttctcaaacttacgatgttgatgaaagaggttgtatctaggccggtcagcatagagatatcaagtaatgttggagtcatcgacccatggttcaaaagaagcattcaaggtatctgactagaaataggaagctgatggcattaaaggttcatctaagagttcagaactgccctatgggccgaagaagttctcagttgcccatcgagtaacgaacaatgttaagtggatgcggaggtaagttggtacacacttggggccggatcactccgagcaatgacccaagcgtcctttaacttactaggcagaaaaaagagagatgtggagcaatattacaccttgttactttttagcctggtctgctgtgggtatcgtgtgggtaaaaagctaggtagacgttgcagagtcatagagtatttgaatgcgttgtgctcccggttaatggagttgtgtctatgggtggattccagattatgagcacaagttaaactaattggctaataattaatttggttaattttgttattagctcatgttctgtttaagttattagaaacaattactccctccattccaaaatataagaacctaggactggatgagatatttcctaatacaacgtatcaacgttccatttggtcctagtttcttatattttgggacagaggtagtatattttatgcttattaatattgtttaaattaaatgtttaattatgttgcttatattaaatgtgtattaggacagaccctatgaaataactgataaggtttgggtttaaacctttcaacttcttatattgcattttattatgttattataagcatgttttgctgagtaccttttgtactcataaatgggttcagatcatgaggagaaagatgctcgtggagatcccgtgactcgttagagtgggacgattatgatttctaggtcattctatgctcaggcagttcctgtggtggagttggactgtttatttgtttataaggttttatgggtaatatatggaatgatcatatatcaaagtttatgattttatatcatttcatgcgtaactgaacttcctaggaggttatgtattcgtggggcaccttaactttatctggtgtccccacaaaaaccgaaccgattaaattaggaaaaccgaaagcccacccctagggatcaggatcgagatgcataggaggttacgtattcgtgggacacctaattttatcccgtgtccccacaaaaaccgaaccggttaaactaggaaaaccaaacgcctacccctagggatcaggatcgagatgcataggaagaggatatcaatattggggagaaggcacagtctctggaacaggacagaggacgatgcatacgggctagggcgtgggtcggtaacagctaaagcagttcaaaggaaagatattattacaaagtagatatatttacgctgttactgcacacgagttatattgttactatattgatttcatgatggtactacaggtctcaagtaacacataatacaattggcacagtaacgtgtgagtaaaggttagttgtattaaaatcaatcaataacgtggtggtagctcctactcataggaactaaacaatggtgttgtctcatattactacagtaatatataattctaatggtgattttattgtacgcataataatataataatagatttgtgaatatgcagtaagatggtttgaagtgtacagtaacaaacatcgcattgtagttattacatgttatgccaaattctacatcaattacaacggattttccaacaagccgtacgagatctagttgtttgaatactagttacatttccatacgatttgtgctaatattagcattctcaggccatggcatgaaagatttgaattagttaggccttaaacttctatttcctttagaatttaggcattattttttccccttgcttccaaaaaaaatagtaaagaaacactaatgacaacccttcgagttttgcgtgaaggctattcgcattacaacagtcgatccatgcggcaaactttatttacctaaccatactgatattggcgcacatccatgctatggctgtggcctgctttgcactataaaaatatctttcccaaccaggcaaccttccacatcctgtgcactcccgaacttctgctccagatactggccaatcgcagccagtcgctgaccaaactgcttcctaaaggttgtatcaaccgacaatggcttcttgctgtaatcaacagtaagacgaattacttctccattggcaggaccagagttgtgcaccaccatctcctcactgaaatttgaaaaggcaagagtggcaacttttccatcgaatttgttacatgacagcctccacggggtgccacgggttcctgaagcaagcgtttcacccagcccaggggcgacctcagcctggacaaccttggggtcatggtcagcggggcaaacagtatgaagcacgaaggagagatctggctgcagtatttcttggacaagaacagccattgtcgcgtctctctgataaacaccagcggctcgacggcttaggatggctctccttgtgtataaagaagcccaaaccttcccaaccgcagctccaaaggcacatgggtccatgagactgacattgggaattgaatcatagagaccagcagctgacataccagccaaatcctccacattagcactagatctaacaatcaaccggacatcctgtgggaagattcttttgagaaatataatagtctcctccggtggggaaagatgtgaaattattgcttgtagctccaacgccaggctatcaacttcaccattttcgactttggctgtttcaatcttttctagaaggcttgtaaaggattccagtgatccacttttcttgagcgcatcctccattgatccaaatggtatcacagcaccagaagggactctaaaggctgctggaactccttgatcactatagactacacagcagtaaaaaaaatatcagaaaataataattagaagtcttctcttatgaatttatcacctagaagttttccattcaacaaacattagcagtaaacaactctataatatcaaccctgtactagagtcactacaattgttttcctgtgaaccatatgtacactttccatcagttaccaacttaccatggatagcactacattttaactgtcttggcaaactgttttttttaataaagaaaatacaatgatacgtgcacttggatgatccaccaaattatgcacagaattgtttaccttatactttgattacatacaaaatcgtgcagtgtaatatatcctagtattttctgttcaaaactttcgacttccccattgataataattggagcttatttaaatacttgtttaaacttaaagtccctcgatatcttgcaaaccttgtaaagttccatttgcaaaagaacttagacaaaaaaaaatttaaatgaaaacttgatacctttattagacaatgaagcaagaacagaaagagttctgcatgcagcagcttttgcaccagctgattccactgaagcttctgaaagctcaagagcagcaaaactaccattcactcctgatttgcttttttgctgtggcaatgcccacggaatgaaaaataagtaagagcaactgcaacaagaatgcaggatgcatctttctggatgatccctatcaaagataagaaatgaagcatcaccttagacatttgcagtggcatctcgatatccgatggtagagagaattcattttggagtttctgttgaaatggattccctgtactatttggttctgtagagacagcattgtcatttttttctgaaactattgagagattgacattgatggatgatgcttctaatctgtaagaaactaagttaatttcagtccaccaaaagggaaaagagaagtcctagagatatactgttgagagaacaaggccaattaattctcattaaggacgagaaagcatctatggaatttgctaacccaaatacacaagtgaattttaaatcgcaagtctgttacaatggtagatgaaaattcagagttcaaagttcaatctgatttaaataaaaactgaggccatttttggaagtgatatttctcttagatttagtttatgcttattatccaagaataaagcctaattcatggcgtgtgctggaatattcttctacactttattcctgcaccttttctatccccattcgttccttttggcacaactcagtaagttggagagtcatgacatcttatgtagttagcagggagggaagcaccattggcccacaatgaaatggatatgcgcatccctagttggagaggctgcaagttatccttctttggaggaagcaccaacgttgcagtggtgcagtccttcacccactaggctcgcagttggcacagtaaccagaaattatacttctattatctacaaaacctgtagatcgtacaactcatgattccctactgtcatatttttctataaagattactagcaaaatgcccatgcattgccatcggagaaaacaatttcaaaagaagtgaaaaaaaatgaagtatcaataatgcatgtacatggtagtcgtcatcacaagacatgtgtgcttggttgatgaattacaatgaaaaattgttatcatttgtgaatggtatttagttttgaagttacgaagtgcaatgctttgatgtagtggtgcggtggtgcctgtgttgactaacatgggtcagcttgtgaagaatctattcccaatatggttgtttggactattgatacgtaggaggcttggagttaaccttgctaccggtattacgctaagagaagagccaaaacacattggcaaacaaacaccttacatcacgattgatgtgatgggtgtaagtcgatttttataagtggcaaaaaacgagaagaaaatatctagagaaatggaaagagaataggagaagaaatcaaattttcaaatcacaagggacatcatatgtgctttgtctgcttaggctactgttcctgtggaactattcaccacatcatgcatgggagaggtgatgagatcttggcttacggaagtaggctcatcggccttggtgggtcatggccagctgaggagccagccatgtgggggcagggaggagtgaggctccctcacacagtgtaagggcatctcccagcgattgagttgtgtttgagaccagcacagctacggaggtgacggaccaaaatttctggcagaaatgctatcaatttttataatagtggagataaagatatggattacatcatgatataaagcatttatgagttagctggtttaaatagcacaactagatattcgaaacttttaacaagatactgaaaacattcaaccacacaagtcgagattaaaatttcagcctgttattcaatcaacgattcaaaatttctagcagagcaattttaaagtgtacaccacatacaaatctaaagtcgcaaacaaggtcatagttgtcacttaatcgtctctcatattaatatttgcacaacacacaggaagaatcatgggcatatttgtcacttgaacaaataaaacagaaacttcaaaagatcaaagcaaaagaaataacatttccgatgagaacaaatcattagaacagaacatgacctgatatattttccctcaagcaaatacacatctgtaactgtgtcatcatattcacaagttacaaatacaacattctcctgtaaatatatcaaaagtagctttcagaaacggcaccatcataagtaaaaggaaatgagtgtagtaagactaacttgacgagctctaacaccaagatgtgaaaggtgaggtagttcctgaagaagaataacaccaactatattatccccagcagctttgacctatcaaataatgagcaaaaccatggtttatcagttatgggggtgataagatcagcaaataagaacttggcgctcccaaagtacctcttcatctccatcagccttatctacaattagaaccacaggttctttgacagatgaaggtaatgatccaggaagaattctttccacctgaataaagaaatcgtttccacaaaacatagacaatcagaccagataataactcaggcccaggaaaaacttctagttggactgaggatattataaccattccttatttagtaacctgaaggaaatgtctcttgcaaggcactggcccaagctgatctaatttaattagaaatgaagcatacaataatttacatgcatgtttatgaaacaaataaacatgtactatctccaacagaaaacaagaacctagagagtagaaaaatggaaacagtagaaatttctatatgtcactaatgaaaattgaaggcaccaaaaacctagatctagttacttgcctgtcacaggaaaataaaattctactcagaatgccactctgacaaggataaagatcttggttaatgctaaatgagtcttatactcctcccaaaacatgtgacgtccacccaaaattccaaatgtgtaataaaacttcagagaataatgcacagaggaagggtggactgtgatagatggagtggaaaggactaggagactataagctaggatgatgaatatttgggagaagaaaacatatatacaaacatgtctttgtccataaaaccacacatttatggtcatgatattgcacttcctgtctgaagtgccctaagctaaggttcccttgctctattgtaagtaatcaggttggtgcaacagaagatgtcaaggagtgtttcctactgcagcaacactacaaggaaaaaaaaattgaggtctctctctctctcccccttgaccagagagaactgagggcaaagcaacctaccttgccaaattaccccaatcagtactcgccctccctccctccctcctccccccccctccttcctctctctctctctctctctaccagagagaactgagggcaaagccacctaccttgccaaattaccccaatcagtccctgggctgtgtcaatggatatgcacaaaatttcatattaggattatggtggcaactcaggaaacaaggcaatgcaaacagaaggaagttcaatgcaagaaagtctgctgcttagttacagaaaatacccgcatcagagttccatgggccactccaggaacaagaacatcccagccagttgatccaagtacttctcgaattgctttctgaagtactgtgcatagtttagatacctgaaaaacaatgctagacatatataaaaagttaggttcagaataattagattgattacagctccagaaaaccacaatttccagactctgtacagaaaaggattacccagcacgaatttctgcctctgtgtaagttctcacactgttatctggtattccaagggctttcccaataacctattaacaagacagccacacagaatctaagtttgaaacataaccaaacaagacaaaaagtctgagtgcaaaacttgtatggtcaaatatcacaaaaaaaatgtaaatctttaggaacgaccatctgagtaaagttgtccatgaaccaattttccatgcttacatgccactgaaaatgtctgatcccagatatgcccctgaaattttggttcttccagttttaccactgctttttaattcatgcctgaaattgcaatcattgtcaatgttgcgggatcagctcagctgacgtgccaacaattgttccgacatggcagtcctacccttgctttactcaacatgtgaaaatggattgacaataaccctaggcatccattcaccatgttattccatcttagcttctatccttctcaggtgatggacaacacaaccagtagaaaggagaagggcagaggtggtgggcagtatccaggatttagctcacacaacacaggtgtttgagctgagtgggtttggggtggcggatgtgtgttgccataatggcagtcaaccacaccaacaggttgtactcagcagcttattatactatgcgtttaagtttgttggataataatattgacaacattgtatcttcatatttgtttcatttaactgcatgcatacagttgtgcatgctgatcaggatatatgcatacttgcagcagaacatgaagaagtaagatgtgattttcatgagtgcaaacagagcacaaacttgtcttaaactcttattttctatgtgatatttttaacaaatttctgcaacatgtgttagttttaatacaatggcgtaaatgcgagtaataaacctaacatggtgacagaacaggaatacgagacttccctcacttgcaaagcaagggtaaatttggcatttcccacctctcacaccaagatttaacaccagttggtcaacagtcacattttcaggcaaggattaaaacctcttgtaggctaccgattttatcttgttagactaaagcagtgacaaataaataatcgaaatttcagtggcatatctaggacaggaaaatttatatggcattaaggaattttccatacgaaggtttggtttgagtctgaagcaggttgtgataatctcgttcagtttagcagttaaaatgctattaatttcccgtgtccatctagctactctttttcttaatcaagttgcgaatgggtttatttttttcagaccatttaagatgaaatgtgacaagaaatggggaaaaaaatgatttatctaactataacctgacttaccaagcagtaatattacacaatggtttctgttttgaaaagagcaaaccataccatgataacagcaaactaagcctacgtcaaacaatatgaacatagttgtataccattgaacattttttttcattaatggagttaaggtcctctagcttcgtttaatacactcaccattactttttcagggaatatagaaagaagtgcttcagagtactcttccgttaatctccgtgctctgtccagtgtagctttaagtcttagtgaccaaatatatttcccatcttcacaaccttcacacatgacaagaaacagtcagggtatttctgagtcttgactacaataaaggtatttaggcatgggcatataaaatagatagatattaaagaagaaacagcaccttcactttcagatagacctttttgcttccaggaaagaatctcattccctatggcaatacattcatctgttttccaacctgaaaagctaacttgattgatgccaatgacaagggcatcaagagtagtatcccatagagtagtatttctagctacatcctttgcaagtgaagctgatccacctaaggcttcaagagtattgatgaatctgttatagtaccagagcaaagtacataagctcactgataccgccaagagtaatataagtttgcctagctacgattttattttgaagctataaatgataacatagagtcatggagtgaattaacctataaatcataacaaataagtcagcaaaaattgataccattttaatcaatgcaatgcattagcattatttggaaaaacagactgcaaagtctatcttttcactaaagcacaaaggaaattagttcactgttgcaaaagtcgaacaagtgaaatacactgttcttctcacttcacacacacacacacacaagtaggtgatggactgaaggtgttttcagtttgctacaatagctacttctgctagcttgcattactaccaattatagagaacatgtttcagtcgattctgctccaaaaccaacatatactacagctgcttgcaatctctgcaggtctctgattactactgatcctagagcaggaaaactctatcctgacttctatcttgtcaaaggaaacttattagcccagcagcctacaaacatttctagtgttcagacatcagttgttatgggttagggttcataggggtaaacaccgccgggaggatggtgacggctgctagggatgagagagggacttaggttgggagagactgattcatcgcttaatccaaaattccaaatgacgatacaatccatccttatatagatggataagatggagggaaagacccagtctaatcctatccaaccaactctatccaactgagctaccataggatgatggaactgatccctagggcctcaacccatcggctcactaggacctccacctctcggcccactacctatgacaacagttgcctacaatctattgtttgtacacatgagtaagctgctggttttatttaacaaatttgatgcctaagcattagattcacctaacaattatgactctgcatgccctcgaatagatcaatatccactctatatatgcacatagataatatggcttcactaaagatgactacatcacatgagagtgcaacctctacattcactttttatccatattcgtcagtattttcctttaatatttgtattcaacaagactccacaccacatgatatagataagcttgaaacaggggtcaaaaagaggtagggcactcgtccacatctatccaatgactttttcctatcatgatagagaggcttcaagcaattcttggtttctcattgcagaattctagtggtaaattagttgatcttattgggataactcaaactaatacagtaaccatacaacgtttctatcaaacccctagcaatttgtttacttaatccaatatggtccttctggatcaaaaagagaaatctagtatgcaatcaaatttatgttctgacataatcaagaaaaaattgcaattcatgcagccatcagttttcaccagagcagcccccacttcatatatacccaaagtaaatactttatttaaagattgattatggcatgttagtgtcaataaattttcgattgcccactagtttggaaaggtatgtgcttttttagagagcactgatgcattttacaagtgcatacaaactaatcaacaaagaacataaaatctcaaaaagtgacgactattgactagtaagacaaatgaagggcgaaactaacatttcagaatggaaagaaaaggcaattcaaaagtacaatttcataaggtttgtgagaaagcaccaattaaaatcacttagttgaaactaggacagttacctgcttaacagaacaaatgaataatcctcaagactaatttcacaaaggcgccactgcaaaacgtaatcaagtatcgcttgtgatatatgcagccaatttcaaccacttatcaattatgttagacaagataaccttttgtcgcattgctatagcattatcaggcgcatcatttctaaggccactttcaaggcccttcattagaaccgatcttagagaagataatgattgcaaggtagtcatcaaaatttgaatggtatcatttttatccaaatcttctgcatgatccacttggtccaaactctgaaaaggaagataaacacgaaaggaatatgagttaggcatgacaatgataagcaatgatgccagaccagtactacttgttcctctattgaaataccagaaagtaacaaatgtcggtatcaactgtcaaaacatagaaataacaaggacatagtgcaatgcaaggtgacataaattcgtatttataagtttatttgattatgttatgttaggtaaccagagcacagaagtgtctgattgagagtgatccctggtagagcattatccgcaactccaatgcaaaggaaataaggagataattaattgatgatcatacatataaagaaaaattaactggtttcagcaaagtttacccttttggtttccacaaaggatgagagaacttctaagcctgactcgttcagagattccttgatggactccagttgctcaaataggctgtgaaatcggtaatcaggttagacaatttatatttacatggacactatatgaccaacaggcatttgaatatctaacacactaaacatctgctttttttcaattttgttttataaatttattttgtagtaatctgttattacttcttaaggtttgattgcaggttagcagtacatggcaactttttttttttattctagtgtacatctaaaagggcagccacataggcattaggcagcacacggcctcctaagcatgtctgttgcctgactagaacttagaagttctaaccctggtgaacaattacatgaaacccagaattgacaatataaattgaaagtttaattccttatttcattccatgtcactgcgttgaagttgaatgcattataaggctcgttcagaactacaaattcccatcttctactcccttgttttacgagtgcacgcttcccgaactactaaacggtgcatttttttccagaaaatttctataggaaagttgttttaaaaaaatcatattaattcattcttcaagtttttttagctaatacttaattaaccatgcactaatgagctacctcgttttccatgcgggatgaatgagttacaaatcctcaggttcgaacacagcctaagggtgtgttcttttatcccctttctcaacttctactccctcgttttacgcacgcttccaaattactaaatggtgtgttttctacaaaaaaaattctatataaaagttgctttaaaaaatcacattaatctatttttcaatttttttagctaatacttaattaataatgtgctaatccaccgctctgttttgtgtgccagaggggaaggccggaagggttcccaacccttccaaaagaacacagccttaccttcactggtgccctgaataaatatattaaattcttaataccagcattattgcaagaaatatgtgcatatactagcagcaccagtctggtgtttttcacaagttaagaccttgatttatctttctttgtgtgaattcatgggtcgatgggggactaccatctgtctatctctatcaccgtaaaattaccactgcttctagttataagtagtcatgaattggaaagctataactggcataaggatgttttagtacacagtaggatagataagttcaaaaagagagtgacaattttgttagctttttcagcaaacagaaaacttatatctatggaagtaggaaaatggaaaattgtaaattagataacctgccagcattgaagaaatcttttagttcgctataaaatatcgtgaattgttcaacaaatgtttcactgtattctccaggggtcttagtaatcctagcaagcatgacttctgtagcaataagatcctcaggtccagcattacgatgaagtttgttttgtatagtatgcttgatttcttgctgtcgacatgaaaagatcaaactaagtaaagtaatccaatgaagagattgttcaaaactgcagaaagggatcaccaccttgagatcatgtgggatgtcattccggtgagcaatatcacgaattcgtgttagagggacagaggctgtaaactctgacttaaatgaaggtaaaaagggatgaattttgcgaatcacgagaacatcctgcacaaacataattggaagttggcaaataatagatataccttttcccaaatgttagtctggcagagccagaatgtgctcgagagtagggctgaactagtataatctacataaatttgtcttttgtcttccatttttcaaattttaaagtataatttcaatgaatatttgggcataggagtagggctctagccctagctgccctactcctatatccacctgaagatttaactaacagtcaagcattacatagttagcagagcaatcatttaatagcaattatataaaagttggaccattttcatgtgcttagcctcagttaattgggataactaccatacgaatgggaccaaggacagcacagagaaatataagggatcttaggtcaaggaggctatcaattgggacgaagaacatgattacatgagagactagattaattatttcatattgcttgcttaatcaaaggatatccttatatagatatgattgggtggagcattaaggggaaaaaataatagctctcactaaaataaagcagcagagtcctgctacaatacgtcgtggacactattcactctactttttaagggaacaaaattgtagtagttcatcttgattaaaggcattgtgatctgactataatcacaatacttgaaaatgctgatgctgatgtaacattttgttactacgatgaaaggggcaattaaccttggctgatgtggttttcccataatacatcatttcaagttcacggaatatttgcctcgatatctcagcatgtttgttaggccgatggtggccaccatcttcaaagcacgatatctgacctgtataaatccactgaaataaaatataaaaaaaatcaaagaaagctatgaataaactgttatacggtcttattaactccaaattatataatcctagagaggaaaattagatttataggaccattgacataaaacaattgtaaggagaaaccttcagataaatagctgagtatacaagggcccccagacgactctggtcatcaaaagattctgacaatatcccgcgaacaacctctaactgcgaaaaggaaaatatgaattaaattaatataaataattaggtagacagggttataatatacctccctacaaaacaactacctacaccggccctaactctcaatgcacaagggggactcccctctgtccgctcgcatttgttcattagattcaaacccataatctccacacatatgtttgctaacataaccaactagaccaacacggaagcactaaagtagagagcaagctaatttacattactaggatattacatttttcatgaaatagccagaacttttgaaaagatttcagtaaccactgacaatcatgggggtacaa

SEQ ID NO: 58092 - DNA, 18437 bp, Oryza sativa
gcaacggctagtgggcccccatatcagttttgaccattgtgggtgcactactttagccaaccagccgggagagggaactccaccccatttcaacacattttcattccctctccaaagtttgctctcaagttcattcaagctttgatagtttccctcaaattcaaacacttagttgcatatacacaagttgctttggtgaaactaaccggcgggtgaaattcttgttattcctaaccccggccgagctagtccgttcttgctccattgtgcagaatgaggaggcgactgtctcgtctgttcaaggggtatgggtcttcatcaagtcgccatgatgggtctagtagtcattcatcagcagacgtctcgatggaagatgccgaagctctgcgacgactcctgaacgacaccgacctcaaccttgtcagtgatcgggagagacaagcctactacatgctgagcgaccgggagtatactcacacgcgagaatactcaccagagcttcccaaaacgataggtatggttgttgaatttcgttctatttggaaagctgttggttggcagagatttgctgtagtagatgagcctggttctcgtctgcttactttcaaagaaatagaagatggtatttcctttcgctttttccatgaggagttcacacttacatggaaaggcttaagtacacttcttggttttcacgattcctgtaaaatcgatctccagaaaggaattcctggattcgagaaaaataggttttggaaagacatttttggtgctccaatttgcaagaaacctaggacaaatgatatccatagtcctacacttaggctcatgcacaaatggattcttatgactttgtttcctagaggtgatcttagacccatcaggggagatgaattgattatcatgtttgccatgcttagaaagatcaaaattgctcctgtgaaatgtatgataaggcaatggttagaaagtgtaaagttctctgctcttgttaagtgcacttctctgattacctggatagcaaaaggggtaggggtcgttagcgaccaaattgctttttgctcagctgctcgtccatgtattgatgaggcttatctagtgcaagggcatattttgaaacatggagcagatgaatctttgatttactttttcctcgattgtgcaaatgaaatcccgttgccaaatgcggggtatcatttgtacaactgccatgaactaaccattcccctgcagactatagaagaatctcgtgcaggtggaacatacagggagacgcgcaacatgacaaggaacgaatgagaaagttcatcatcctcaacacccgtgcagatgtatgaggcaggttgggcaccgactggggatgcacccggatggacccaagctccacgccacagcatcggagtctcaacctgggcgagtgccagtgaggacctgtggtgtgcgtctcatgacatccaatggggggacaaccaacctctcagatcaagtggtgtgcctccagctccaagtgaatggcgctcaagttcctctcgttgggacttaggtgaaatcactaggagaatggacacccttgatgtgcagacgggggagatccagtacaagctcacagaacacatagctcaaatgcaagaatggcaacaatctgctgatgctcagttcacgtagctcaaatgtatgtatactatgtatattagaagtataggaatatattttggttctcttttctttccacttagcctagataatatattatgggaatgagtagtaatgcttgtgtgtcactctacccttacccttagattatcttaacccctacttagaatttgattatcacaagtaatatataaattattagttaatgttctctctacatgatattcccacgggataaaataaatacgatacccttggaatactctcgggtgaaatgctacaatggtatatccgtgcgcttgcggacaaactctgtaaccataatataccagaagtatttctgcgtcattgctgggaattatatttctagtaatgtcgttaagaaatacaaacacttgaggtgtgtgagtgaagtgagaaggtgaggggtttatatagcctcccaatgacggttgtgatggttggaatggttggaaataccctgcaaccgtcattgggagccaatctaaaccatccagaagaagccctgcatccaacggcggcgaggaaggttcggctgaacccactggttcggccgaaccaggggccggcccatctagcccataatttggctggtggcctcctgggcttctccactccatagacttgtgaattttggcccaattcatcgtgtcaattctgagttcttggcccattcatgcataagtctgattctcgacatcgtccgattgatttatcgtctgagttgatatcgattctccttcactttatagttattctctgcaaaaggttagtaaacctaatactaatggaatattattattctaacatatttatgcattgtaagaatcactagtgatgggcggagcagtttttatttttctctgggccgaaatggacagtgatgggcttccctttgtgggcttatcactgtgcctacccttgtgacacgtggcggcttacgattgggtggggaggcgaaccggcgcctgggtgtgctatatattcccctttttcaccgccttacactcgtcattttcaccacgagtgctctctctttctccgtcctttcctttcacggcacactttttgccatggctcctcgcaagctgaacccagcctccacgacgggccccgatcccggtcggatcgacgatgacaccaccggctttttaggggcttcgcttgtggatgatgacgagctggcgaagttggtcacctccagcgcggtggtggaggggcaggaatttgccccggggaaggccgtggtgccgaaacccggcgacaaccggaaggtggtattcgccgtgttctttgaggcggggcttcgatttccgtgcagcatgttgttgccggaaatccttcgccttttccaggtggagctcccccagctgagcccatcggcactcgtccggatcgccatcttcgactgggcgtgccggaccaccgggttcgaaccgagcgccgagcttttcggcaccgtgttctacgccactgtaaactcaaagacggtggtcactccggccgggacttagaagacggcattcgggagtgtgaactttaacgttcgccccgagtgttccgatctctagacagtgaacgccgccatgttgaagtgggatcgccattggatggcgatgtggttctactactccatccccttcgaggctgggtccgatgcggcgaaagccctccggtggcggcgcagggcgatttcactgaacaggaagcccaagatcgccgtcgatggagccatggaggcccggttcgccctgctgcgaaaggtctgctcccgccttagctgccgcgacttggtggaggagttctgtatgcttcgcattttccccctctcccagtcgtggcaagtcgaggtcgatcaagataaggaggtcgacggtttgccaaagctcgtcatgcctgtgggggcgaacggtgagtctatgcttttcctatgtgcatccgtgtttcgctcgtcatgcctgcgggggcgaaaggttgcagtcgaaagtgatgaggaggaggaggaagaagaagatgtggaggctggttctgaggatgatggctctcatggctatacccccagtcctactactgtgaaatccgcggcgggctctcatgtttcgcctacgcggtcgcaagatatcgtcgtggcgaacaccctcctggcgatttccagcacagtcgcgaaaccggtgatgaccgctaggaggaagaagaagaaagggaaggttgcgcaggtcggccgtggctttttggacagcgatgggtccgacgggactcttacttcaccggttttacgacgcgcatcttcccgtggtaggcgcatgtctctgccacctgctagcgataccgaagcggcgacgggtggaagtgcctcagccccagccgctaaggcgaatgttgctgaggatgaacgggttgaggcagttccttcgcctgttcgtcaacgagagggaaaggctccggcggttgaagcgagcgtttcggacgtgacgcttaccgccccacatttcgtccctgctgatttcgccacatgtccagagatcactccgttcgtggacggggtgtgctaggtcatagcaccgaccgatggccttgggctcttcaccgagctaaatgagttcgccgaaagctacgtggccgtggaaagcctatttgtgcaggtatgagttttctgtgcgccaaactttgccctttcgctagttccctgtcgtaatgtttttttttaccagggccttgccgcgcatctaagtgccaagaagtctgccttagagcgactagatgggtatggccttcgcctccgcatgatcgaagaagatcttcaccacaaggaaaacgaaagacgtgttttggcggagactttgaagaaggcgaatgctgaaaataggtctctctgctctgaccttgaaacagcactcaaacgggatgccgaacgagaccgacaacttgcttcggccgaggagaagattaaatccctcgaagcccgtcttgtgtcagccgaagctgtcgccacgaccgtggtaccagccacagagtctgccaagcaggcctattacactctccggctggcccttaacgaccttggggcatgggcggaaggtgctccgggtgaaggcgggacaacattcaatttttccgattggatgcaggaggcggccggctcagttgtcgaagtggcaggtgcctacggggactgctgcactcgtgtttcggcgggattcgtccttagcctcatgcacgcgcacggctgcgaccacatcgggagttttcccgatttcgtgaaggatgaatggcctagcaatacgcagtgctctggggctgcgttaagggcctttcgaaaggggttttgggaggatggcggccgggactgtgcgaagacttgactccgcgagaaccatgaaagattcgcgaggaacgaggaggccgctgctgtcaacgccgaaagggatcccgggccgtcggaacgagcccccgggcacgagggcgaaggcgacggaggccaagaccaccctgaggtgtgaggcccttcgccctcgtgttttttattttatttttttcctttggtcctttcgggctttctggtagcctaagttttgtatataggctttttgcatgttcggctttaagccgctttcgccttgtaatcaacatgatctttgttctactggcgaagtataatccttttgcttatctaattgttctgtttgaaagtggaactgatcttcgtctatatttccctcgttttttgcacccccctttttttgtgctttgctagcaggcttgtggccgaaatatatgcgttcgacctcccgctaaaaaatggcggaacaaaaacgaaaagttcatggcgataaaaagcctgtcgaagatcaagtgtcattttcggcccatttaccgcgagatgttgattaatggcaacagctataaggttgtaagtgttgctgaacggatgcgcgtgcatccaggccgaaccttagaggactacgatcgctatcgtgtatcgcgtcgcgaagatagttcgagcttttggtgaaactttaggagatcggctcgccaagaagcgatcgcccatcgccgttatagtttagcttgtgtttgtcctccatcccctttgagggttgtttatgatattagtagtgacgatgaacttgattcgtagagccatcccctaaagggtgaggacctttgtgttggcgaagatgtaatttatctttaagcttggctgtaaagccgttgcttcgttcgtctgtatcatatttgtaggacgtgtattctttgattattcttctttaagttaataaagatgtgttttacttcttttttgctatttctcgcattgtcacttttcgtgcttttgttaggtcgaaacatgtcggcccctttgtgtatattagcgaaataggcttgctgacttttcagctttcggcttccgttttcgacctgttgtgttccgcgtttgaaaggagcgcttatgttttcactttggtcgaatataacggtgttcggttaattgtttcccgaaacaagctgttgcggtttcaacgttcagcgagcgatgcttcggctaattcgtttcgcccccctgatttttttgctgatcaggcgtttgccttggggtttttccacaaattatcaatcacacacataaatgggcgaaagacaccaagattttatactggttcgggcctctgggatggataatagacctacatctggttttttttgtcttttttcattttcctctttttttttgcatttttgtgccgaagggcttacataatgccaaaggcttacataatagtatgtacatttttacaagttggcgatttgggtgccacccgttctacacatagaaacgcttgagggaggcagcgttctaggaatggacgagctcttcgccctctagtgtcgctaagcgaaaggagcctgtcctggacttgtgcttgatgaggtacggcccttcccacttcgattcaagcttgccgaccgccaccgagtttgctttcttccttaggacaagatggccgggcaacagcttcgttggtcggacttttttcttgtaagttgccgaagtgcctgtagcgtacttgcgcatgtgttccagtgctttgactctcaccccctccaggagttcgagcgacacctcgcacccttcttcgcccccagagaacatcacctttggtgaattagcccctagctctgttggggtcattgcttcgtcgccatagagaagcatgaacgggctgaacttggttggccttgtggggtgtaacatcctgaaaattcccaataataaaaatcactaaaatttcaaactttttaaaactttttgatcatgctggttgttacgatcgctattgcttgccaaaccataaataatcacaaagaaagtaaaggaaagatctacatttaagcaatagatataatttacgagaatatgttatttattattaaccctagaaatattagtacacatgaaataatgatcacagcaatggccccatctataatagagtatctcactagaatatataattaatatgtgaaacaccttatcaagctcctcataacatgaaaatcactcatataaaataatggtcatataaataaattaagctttatatataaataagattatgtgagttttaattaaacaattagattaatatcgtaccgagtctcaatttactctttacagaataaatggattaagtctatccgtttaaactatattgctatacaaataaattcgaccaatctaccattgtattattaagaacacatcgctatattaaattgaatattaccccaaaagtcttcaaagatatataagttcactttagggccaataatttaaattaatctaaaaagaatttatttgtgtgataaataaataaatatgggtggtaataatttttgataaattttcatgaggatttagtgcttaaatttagttaacatttatctaagtaaaattagagcttataggattaaaattgtacaggagataggctaagagatgattaataggaaaggacactgttcattgcacatgaggtgtttgatggagttcctagccaccctagccctctttcctccccgctgccacgtgccaactcgcgcccggcgccgccgcgtcatgtcacgtcgccatcgccgcaccatctccaacccgccccgtgctgtcgccgtcgccgtcggatgcgccgcgccgagccccgcgccgctcgtgtcaccgtgggcgtcacccgtgccgcgccgagccccgcgccactcgtgtcgccatcgccgtcacatcagtgcctcgcgccccgtgagccgatgcagccgtcgcgtcgcgcatgcgtccccgtcgttgccgcgccatcgcgtcgccgcgtatcgccatggccgccttgagtcccatgacgcagtgcgccatcacgtcgctctcgagccccgtgcgccgccatcatgttgtcctcgagccccgtgcgccgtccgtcgcgttgaccattaagccacccttcccacaccctataaataccccctcccatctcccttcctcccccacacaccatgttggctgccatatcacaaggccccaagagcccccacgagctcgtccacccctctctgcctcttctactccctcaaaaacatttcgtcgaacaccttgtgggcgtgcttcaccttcttctccgctccaccaccgtgacaccgatcttcatcgttcctccatccctcggtaagtcctcgctcctctagcctcccctagttccatagaaactagagccccctttaatttcgccaattagcaaccgaagccgtgcctgttcgggcaccgttttgccgccggtgagctcgccgtggacaagccatcccggagctcctcctctccttctagtgagtaaaatggaacccccatgcgccgtagatgctcatgcccccatcaaattggtcggaaaccctctctcttgacctagccacttgcagcctgagcttggccatggcgttgccatgccgcaacgctcgcccctgctctcgcttgcgccgccgccgaaattggagggtcgcggaagcctcgcgcaccttccccggccgctacagtgccggtctcgcgccgtctcgggtgcgcccagccacgccatgcgcgttggctctgcccgggttgaagaagatgacgccggtaaaagaaagaatgagagagagagagagcagccgggcccacctgtcaatggttcataggatttgctttagaaaaataatccggtaggaaagcaaatacaatcctaaaccccacatgtcagtcacttggagttttggataaagtttaggaataaaaataatgaattaggaacagtaccatttcgcaattattagaattaattcaaatttgaatctttacactagcataacttattcattttaactcggatttgagtgaaacttgaacctaaattcatctaaattcataagctttccaatgatatataattcactatttaataaaatatatttataaatattaaataattaatatcaagatgatgcataatagttaacttaaaaatgtgctaataaataaaattgatattgtactgtaaagtagatgtcaaataattgtccttaacacgctttctcactgtaaaacctatgtaaactaattaggagcattgtttcaaattaattaaagcataggaaatactagtgccatttattaatatatgtcaatatataattatactcatgacgtccaaattgtataaataatgtttagccgcatactttgtgactaaaagtggaacacacgtagatgagtctttaacttgtttatgagagataataacagagctactgtgactaaaatcacctgcacgaaattaattaacggcatttcctatacagtagtatatgtttaggttggaaatcgacccttaagttgtatagacggtaactcactcataaatccacttaaaatcacatgtactgtgtagctcgtagtaaatagcaactattcaaataaatgattcaatattaagatattgtgcacacacctatactgtacatcccattataactgtacggtatagtattaatttgcttgttgcatatattaaattagagggactatatgacaaacatgtatattagataaatactagttataaatcttgacctcatataattataattatagttcaactgtaaattaggattattcattgtaaaattatgtgatgggataatctgtaaccataatatgattaacctaaacaactctaacatacaaagcatggataattattaaccttttataatttattgtgacaagtaaaatatgttcataattaaagtaaagcctccatcaattaaataataatacaaatgattcattatttgattgatcctaaatccatctaacaatagaacctctggtatgtatccgtgctatttagatagatgcatatatagccataatccttccataaccatttgatagactaaaccaccgattagccaaatatatatgtataccataaatgctatgttggttaactcctaaatagaccacaatgacaacagaaagattaagaaactttagcccttagcatgattggaatccattagcaaacacgaatagtacattttgttgtgcatatttgattgttgttgaatactggtttttctcgcgtattatagaccttgtgtatcggttagtcgtgagacaacgtctgcaacttccaagaggtgaaggttgatcaagaattatatcaagaataaggattatcctgagcaggcaagtcatcactattccttgaacatgttgatcccaattgcgaaattgttttgtttacaaataaaattgcatgcaatgatgaacatcctacttgtgattatgccatgccttgattattgtttacccttaaatctttgtaaccatgattacgtatgagtccctagtcaactatgaccattgcttagaaatgctattttagaatcatgcatactcatatttatcaaatgctatatgcttgggcaattacctttgagaaagtaattgagatgcggcatgtggaggcatgagcgccacattgccatgatattgatgacatgatttgtgaaaggaaaataaagtgaaacaactattttcgactggggcggctggacgatttgggtggtgtccggaaaaggctagtgccgtccctggtcagttaaggaccgagccatgaagttaagcatgaaacgacccccgtacaaccgcacttctcgtatgggtattgacctagcggagtagatagctgagcggaggcagtatccatgcgtagtggtcttcttttaggtgtgtgatgcggcaagcagtctgctggcggatgtccggttcggatggccaggtggatggcggatgcccgttccggatggtcagaggctggcttggcaatactacatgaggatacccataagagaacaatcatgatggactgggttcaacgacaagaagcaacgtaggaatgtgtgtgtttttcccttcccgggagcgccagaactcctcttactgctagaaacgtatgacgcctagagtgcatgagggataaagttcatggagcgggtactgccaatgcgaggttatcgaaaggctttgccgtgacgcgtcttatgtgttgggacgaggctcatgtgttgggcagtcgcggagtgcgggtaaagtgtacatccactgcagtgtgagtaaaccaaatctattcgaatagccgtgctcacggttattgaacaccgggacgtgtattacacttggctagactctaaattcttaacttgtgtgggatgggttattgcatgacgatttttatgctgatggagccacttcctgagaggagggaaggtggacgtcctcagaaaaccatgacgactcaatggcgggaagctatccttgggatcacaatggatggtggacagaaccgtcgttgtttaatgtgaatactggtactaaaatttgatcagtctatgctaggtcttaggcttgtgaaaagaattacaaaacttgctttgcgcaaaagaaccatagccatcctttgaatacccctatcatgtgcattgttgctgtggtggcttgctgagtacggttggtactcacccttgctatttatatatcttttaggagagtgttgaagagaagcccttgtcggtacgcttgcgtatccaacaagatgatcagagtgcggtcttgttctaggtctcgttccccagtcgactgcctgtggcatgttaaccgggcccttatattattttgttttccgctgttgttctcggatagttgttggcctacctggccctaatgtaagtatttaactcttttagcctgaattcattcatgatacgttgtgatccaactatgtatgtgtgtaccaactactgatccagggattggtacggataaacacagaagatttccgatttccaaaatcgggggtctacatgggggttgttcaaagggcccagagaacagatagcatttcatctcgccatttacccttcgccgccccctcaagcctttttttgagcgcctcaagaatcttgtcgttcatgactgaagcgaacctaatttccaggtttagcccttcgcgcatttctctgaatctgtcagagtcgaactggttgccgttgtcagtgatgaattcttttggtattccgaaacgacaaacgatgttcttccatacgaacttctatactgctgccgaagtgatcgtcctgagtggttcggtttcgatccatcgggagaagtattcgatgactacgattgcgaacttgtaaccgtttcgcgccactgggaataggccgatgatgtccagcccccacctggcgaatggccagattggtgcgataggctgcaactcgtattggggcgcggtttggcttctgccatggcgctgacagctttcgcatttcctgacttgctcgacacagactctcagcacggtgggccagtatacaccttgtcgaaacactttggaggcgactgttctcgcggcctggtgtgcaccacaaagcccctggtgtatttctttcgccacttcttcgccttcggctaaggagatacagcgaagcaagggttggagcaccccggagcgatatagctgtcctgagaccagcttgtactttgccgctctgagcttgaggcgttttgcttctgcatcatcctctgggagccagccgttcttgaggtactttacaaacggggtccggcaatcctctgggtcttcgcccagcttcgcctggtcgattgccatgatgtccaggctctctatgggcacacttggtgtgtacaagacctcaaaaaagatgccaggcgactgcgggcccccacaagcagcagatttcaccaaggcgtccgcttcctcattctggcctctaggtaagtgttcgaccgttatgccggcgaagcactttttccatagatcgaacagcctccagatacctctgcattccttcttcctttgcctcaaaggacttgtcaatatgacttgccaccaacttagaatcagttcggatgagcaagcgtcgaacccccaatgctttcgccatttttaggcctagcagaatagcttcgtattctgccgcgttgttggttgtgtcgaactgcagccttgcggtgtaccgaatcggcacgccccctggcgaagtaagcactgccgcagcgcctgcccccttgtgcgaccatgagccgtcggagtacatcacccagggttgttcgacaggctcgggttcaggggcgaatgccggtgtccattcggctatgaagtcagccaggacttgggacttcatagcaatgcgggcaacaaaatgcaagtcgaagggagatagctccgccgcccacttgctgagcctgccggtaacttccttaccccggaggacttcacccaaggggtactgtgatggcaccgtgactttctgggcctagaagtagtgtttaagcctgcgcgaagccatcactagggcgtaagcaagcttctccatttcgatgtatcttatcttcgctccttgcaaggctttggagatgaaataaactggtttctggcccgactctgtttcctggacaagggctgcactgcccgccactggcgaagctgccaggtagagtagcagtttgcttcttggtgttgggctgatcaaagcgggcgggctttgcagatattgcttcagctcgtcgaacgctgcttggcattcgggtgtccaggtaaactttcccgctcgccgaagggtcttgaagaagggcaagcctctttaagctgcctttgaagcgaatcgactgagtgccgtaattcggcctgcgagcttttgtacttcgcgtacgctcgacgggggcttcatttgctgaatggcatcgattttctctgggttcgcctcgatacccctttcagaaataaggaaacccaacaacttgcctgcgcgaacaccgaaaacacacttctaaggatttagtttcatacccgccgcgcgtaagttgtcgaaggtctcctgtaggtgggacgcatggtcgaaagccttgcggctttttacgatgatatcgtcgacataagcctccacatttcgccccaactgcttgtaaaggaccttgtacaccagcctggcgaaggttgccccggcattcctcaggccgaaaggcatcctgaggtggtagaaggtgtcgaatggtgtgatgaaggctgtcttggggatgtcggacaggttcatgtggatctggtgctagccggaatacgcatccaaaaagctcatgagttcgcagccagctgtcgaatccatgagttggtcaatccgtggcaaagggaaatcatccttcggacatgccctgtttaggtctgtgaaatcgacacacatgcgccatttgccgttcgatttccgcaccagtactggatttgccagccactcggggtggtcgatctcttgaatgaccccagccttgagcaatgtttggacttcgccttttgctgcttcttggcgatcagcagacatcttgcgtagcttctgtttccttagcttggcatccggcttgaccgctaggtgatgcatgatgagatctgtcgattcccccagcctctggagaatgccgagtaaatgctgctgcgtcttcggctcctcgtaggtgcctcgaaagttaaggacaaagacatcacgcaattgctcccatgagtaattgttgttagctagtaaattgaagtaccaagaacgggcgatgccgtctagagcgagatgtattaccttcgccttggtattttcgtctccatgagcagcttcgatcgcggactcgtagatggagtggaactcctttgggtcagtttcgcctgaatagcatgggatgggtgcgaacttgaactggggtgggattggacggatcttgattcccccgctcagtggtacccccttttcgccccctgccctgttcacggcaccttgatgcggatacggcatggcgaaaggtgaagtcatggcttgcgcgtgaggctgggccacggtgttcggctgcccggctccgattggtgatgcatggtgagccacaatggatgggtcgaacatcggctggggccatgccatggcgacctggtttggtgcttggtttgctcaaagcctggcgttggggcttgcggccgaacttggtgcctgagcagcattgatgaagtcgaactgcggtccttgactccaaggcgacgcccccagacccaggtgattcgacggcaaccaactaggcacaccttggcttgtattcctctccggctggccgaaggggttctacctgaaatgatgtggggttggctgagttgttgaaggaaagcttggagcagcgcctgtagagtcgaagccccttttgccattgtttgtgacacttggccaggcggttgagggtgtacttgggtagcgaccggctgagcttgcagctgcacgtgaggggccagatgcatagctgcggtcgaaggctgcccgatgaagtatactggcgcttgcgtggcttgtggctgaaggggctggatcggtgcttgtggacagacttggggtgggacatagcctgccgaatactggaggattggggccgaagcggccttggcccgcctcaccgcctcgtacgcctgctgttgttcttgcatctggcgaagcatgtcttggagtcgtgtcatgttctgtcgcatggccttcatgtcagcttcggcttgtgttccgaggtcagggttgacttgtgcggcggcgagcacagtcgaaaccgttgccggctgtgacgaagtggcttggggcaacagcagttggcttgtcgaaaggatctccgccctggtttggagtgcccttgccgccgcgtcagccgtgttcggcacctgccccatcgaggtggcaggagccgaaggcggtagtggtggcgcgggtgctgaagccgatggcgctcccccatcttcggcgatgggcgccgagggttctgctccctctttggcggccatctcccctccgacttcgctttcctttcgccttgtaaacttctccttcatgaccctcttcggtggcatttgctctcagtggtttcgctcggaggtccctacggtcggcgcaagctgttgttgaaacgacaactgcatacgtcgaaagacgtggttactcaacagtggttggaaaagaagtaaagtgtattaaattgaggatttttcttcggatccccctattacatggccctagggggctatttatagccccattacacgttcccactactagggttcaggttatacaggggaatttacatagttacccttatgatagggacattatgaagggcacattgtgtcctttacccacacacgagcccccactgggcctaaatagctcggcccaccggcggacgaaatcccccgtgggcgtagcggcccgccgattctcccgtcaacagggtttggtgccatggcgaaacccgtgctcgtgtgccgaggctttcgccacatcatcttcgcctgttctgccttctgccaggaactccacttgacgaaggtggtgttacccaccgtcacggctttcgcccgtatggcttcgctcttgtctctcggtgtgagcctgatacttgtacttttcggtttcggcaggttcggccgaaggccttccatggcaagcctccaacacatacatatacatatacatagatatacatatacatatacatatatatgtatatatatatatacacacacacatatacatatacatatatatacatatacatatacatacatatacatatacatatacatataagacactcatatggggcaccattgtgcccgggcaccattgtatgaaatacacaaattcacccaattttttaaaaatttttaaattgtgagtatatacctagttataagtattcaattcatacctatacctagcaacaaaacaactcaattttaactttatttcacaatccaatattacatacctaattaattatatgtttggatgctatatacctagaatcaaattctaataaaaacatgtttaaattcagtgcaaacttgttttgaactagtaaagttgttaatgttaatacctaaacagttaaaaaaattttatactcatttcgaattgagtatatattcgatttaaatcatggagcctgggcatcatggagcaccaaacaaatctactatatacgctcggatggggctccatggagtatgggctccatggttgtgagacgtcggattgctgatgatcagagttaccatttcagtatattagcttaatgggtatacacccgtttagaatttattagtggaaagtgaatgaatgggagaatgccatataatccacgatacttatgaacagtaaatagtacgtttctatgcatgcatgcaatgcgcatgaaagactttccatatattatgtgcgtgtaaaggtcagaatggaaacattgaatgtccatgtaattggaaataatatcatggaaatatggaaactcactttaaatatgatgtttgaataaatggtaatatatctatgaaatcatgggtactgcatattttggaacatggaaactaagtatatggaaaacaaaagcatttttttaaaactaaatattgaaccgcggtatttgcgcgctttgatatatgagttgcttacgtataccatatattacggctgggtatatggtaatgtacccgtatctctttttgccatttacggtgttattaatttcgctattgctgcactacggctcactttccaattttagacacaaaatatacatgtatggtgtttggattatgagatgagatttgcacaaatttcgggcgcatatagtatgacattacttttatattttttagggtatatctgtacgtacatataatttttactagtgttcaaggaaattttaggaaaattgaatatttagatctaatagagaatagctatatacatgatgagtttggtctgcattacgtaggtacctacagtgtggtcgatgggtatatggggccatagtgaattctcagaaaaaaaaatagtgaatttgggtatgaacccaatttgcatgtaaatacatgaaaaatttaggtatgtgcccaatttatgtgtaaacgtattcatgaacatatacccaaatattgggtatgaacgccaaaaaaccctgcttattttccatactcgtttaagctaagtatatacccatttaaattgttatgctcgtttatattggacatatgcctaatttaattttttatggcccaaaattaggtacatacaattttttaaaacctgtttaaattgagtatgtgtct

SEQ ID NO: 58093 - DNA, 11341 bp, Oryza sativa
ccaggttatatataaaagtccactaaactttttataaacccccttaaagccgttacatgactcctacaaacgctactaacccgtcacgtggcgctctaataaattagagaaatctaaaaaattctgagaaaaaaagaaaaacatcatatcattgttacatcacctgctcactattttatccaaattttctagctagcagctcagcacataaataataagaaatgctatattaactatctattatatagtaaatatcaaataaactccctacaaacgctctcaacctatcactatgttgtgtgctatagtggcactctaataaattagagaaaatcctataaattctgagaaaaaagtaaaacatatagcccttaatttttacttaaattagtgagtccgatatttcaggccattaaattaaatctattaaaatcattccttctaatatggatctgatgcgaatggatggagagaaaggtacgatgtactgttcataaatagaaaaaaaaacaaaaaagatccttcctatcctatgcatatggatggagaggaatgtacgtatatatgtactacctaaaaaaaattattacatgttacgtttatatgaacgtaacgtacgatcgtatgaacagaaattaaaaaggataaagctgaaaaaaccaggttatatataaaagttcattaaacttgatagaaactctcttaagcggtcacgtgactcctacaaacattactaagccgtcacgtggcgctctaataaattagagaaatctaaaaatttctgagaaaaaaaggaaaacatcgtatcattgattttcacttaatatggtggacccatcattttatctcctattatctcacctgctcacttttttatccaaattttctagctagcagctcagtacataaacaataatataagaaatgttgtattaactactccctctgtttcataatgtaagtcattctaacatttcccacattcatattgatgttaatgaatctagacatatatatctatgtagattcattaacatcaacatcactatgaatgtggaaaatgctaaaatgacttacattgtgaaacggaggaaatatctattatatagtaaaaatcaaataaactccctgcaaacgctctcaacctgtcgcatgcgtggtgtgctacaaacactcttaagatgtcatatggcgctcaaataaattaaaaatcctaaaaattatgataaaaaacaaaccattcattttcttttaaataggtgaacccaataattataactactacaataaatattttttaaaagattttttctatctatattgattcacatgcataactaattgtacatatatgagaaataattaaagagagggctagcatgatggtaaaaaaaccaacgaaagttgttgagatttcttcacgaaagagagatataaagaacactcaattcaaaatagaaactcaattcaaaatagaaaatacgttactttaattttaatttattttgttagaactattttcgaaacaaactaatgggtatgcccgtgcaaatgcgcagagttgtagaaaaatatttcatgaggtaatttggttgtcttttagctttttatataattgaaacattttcgatttactaaaaatatgttcgatctactcggtgaaacttgatattttttcccgattcgggaatgttttcatgccgcggggtctgaagttcctgaattttcggaaatacgggaagtttcgaaccgaaatttcagggctgacggaaccaagctgccgcctgttcaattcctatttcagcgccaccttccctcccatcctcggcgtctcctcgaccatcatcgccgccgccgccgccgccgccggcggctcgcctcatcctttctccggccagccggtcgacctctccgtcagtttctccgcgccctgtcctactcgctggggtaaccaccgccatcgtcttgctactcctcttcgttccctacaaaatcctacgagccatttttcgttttggggttttggggttgggcaagggggaatttgagggctgtgatgataatgatgctttttcgttggtgatgccgctgatccagttttgcaatgggggatcgatcgacgccgttttctggatgaatccgtccttgaaatcggccattttacttttccttttttgggatcaaagaggtaaaggggttcttaatcttgtagaagaaatggccttggcaaagcagttgttaagtgttgtcgattaggtttccagcaatctgcggaggtggaatgatttggggactaatgtggttttgttatttgaggcctcaaagtctttagattggtgggtgaacataacggaaatttgtgtgattgataaatcaggtattgggatttgtggattggaggaactgggtgtgataggttatttttatcaacgtccgcaagggatttatggttcttttaggtatggtggcactggcaccagttaattaagggttcttgttgaggttgatcatttcttgtgctccttgttgaactgattcccgatttataatggaaatataggagaaaaaaatgtggaagagtggtgaaaattggtcttgttgcttttagtgaatggtaggagcacatgctttgcatctttcatataatcatattgcttcaaggaaataattgtgccctacccgtgagaaggaattggttgcatgttttagttgtattggcatatatctctgatgtctatgttgtaatagttcagagcatgagtgcatgacagcattgtgttttctttgcggatgtgcctgttgtagtggtagtggtagatgattcttttcctctttagaaacatgcagtccgtatatcttttaggaagtcatataacagtggaaattcatcatattgttctctagcccatttttcacttcgattcttcactaaactttcaatagttccagtgtgttttattgtttaaagcacaaaaacttgatgtttgattcttctgatgtagaagtaacaatctaatgttagttagtttgatgatattgggtgccttgaaattgtcgattccgttggattaatatattaatcaaagtatggtgagtgtgtggattacatacagcagccagactcttatatttctggaaactccgatccagcgttaagactagcgaattactctgttgtagaaaccagactgtaatttttaccgagtcaagtatttttttttggcgtaaactgggaagcttctttctaattacttaaacaagttttttgatccagccatttgaatatccatgtattggatgtgtattctgttacatattcagttagatccttgattttccatcctgcagatctgttcctttcatataatcccctcaatttcaaattcttgttccaaactttatcttttattatggagttttatcatataataatagtaattttgataggtttgtggtgacaactttgttcttattaaggtttgcagcatgtgtacgctctgacatgatgtagggtctgaataggaagagctagcacctgtgtggaactgcataataattttgtaatctgaaaaatgttacttacatgctaaattgtaattttctacttctcttgtgctttctatttccaccttatattaactgaaatctcattcttgttaccaaaagcgagctaacctatctcatgccatatctgaacatgcttgatcaggtccatccaagcttcaagatgacaacatgcaaattcatcacttccttcgcaccgggaaggcgcagcatcggaacgcagcctcccatggctgcgccacgaagcctttccacccgcgtgatcagctaccccgaccgccgttccgcgaccccgaccccgaaagccggcctgaggaagctctgagtccctgcggtggatctctacaaggtgaagctcgtctcgccgaaaggggtggagcacgagttcgacgccccgggtgacgcctgcatcctggactccgctgagacggcggggctggagctgccctactcgtgccgcgccggggattgctccacctgcgccggcaggatcgaggatggcgtcgtcgatcagcccaacgggtcgtacctcgacgatgcgcagcgggctgatggctatgtcctcacttgtgtttcctacccgaggtccaactgcgtcatccacactcacaagggaagagaagtgtagtggccggccgcgaacgagtcatatcacgttcgtgtccagatctcagatgttgagagacggtcttacaaactatagcttctgttagatagttgtccggaattaatgcagtatttgccctttttgccgttgatgatagattagcttgagttggggatgttggtgcattgaactgaattatttacatgctgatattactgggttttatggagggaaataatactacctccgtttcaggttataagactttctagcatttcccacattcgtacagatattaatgaatctagacatacatatattcattaacatatatatgaatgtggacaatgcaagaggaagtagaatacagtaaatgaactgaaaaatgctgagcggctgaatgcaatgcatagttttggaactcagctatatataattttattttttaactaatttctgggatcgtttcatcaggatatttgtaatttcccttgggtattttatccttatgcactactcactaaggccctgtactttggttcctgcttaagccatacatggaaaactatgtttttctataaatttggtcaaatttaaacaaaattaactattaaaaatttaaaatgctttataacataaaatggaggaagtagctaaactgtttcccccttcgatgttgattggtaaaaatcctgtcgaatatttttcttgtcagaattgctgctgcttcgaaggaggcatgcccggctgcctttttttcttttcagtttatggaccttgcattattagcaggagtttttcgaaaaatattctttattagcatttcttagaaaagattttaaggacaacttttcaactttctcaaataattgtcataacactactatgaaaacatttgtacatgtcttaggcttttattttcacatccggcctaaaatgaaaagcacccgttaaattggggcttagaagcgtcagagggtgataaaccaacctatttttatagacaattttttttaaaaaaaatctgatcatgaaaatagatctttcacgagtggtttccctaagtaactacatgtgaaaatcaggacatttatataaatagagtgattttatagactgttcttataaggaaagatgtctattaaaatacaaattttttttgttattttcatcatgactacaaaaagaaaaatgggaaaatcattttcatgggtggtagtggaatttgaacacgcaaaatcttgatgtctataggcccttagttgtacacggtttgataaataggtgtatgggttaccgaccacttgcaaaaatgtgttatgtattattataaacataatttcttccgttagctgctaactgctcctataatctctttaaggagattccatttgttattattctgtacattatgcagctttaatgtaaatttaggtatgtgaagaagctgaaaagtgtaaatttaggttacattcttttcggcttcttcatatactacatgcatctaaaaacataatttctcaaaaactttcttccgttgtcattgatttgagcacttattttggtttatttttaaaaatatttaatttatgcctataattaaatagataatctgtggctatatatatatatctatctatctattatctattctatacttaaaaatccgttatacttcatataaacgcttccagaccgctaagtggtacgctacgaacgctcttaagtcgccaagtcttaaattaatggacccatttgttttagatggttagatagaaaagaacatccggaaccaacgtcgtacaaacgtacgtatgaactgtacgtacttccctactgtccttccatattttcattcatgtgttattttctatttacaggcaaaaaaaaatcacaaatagactaactactaggtctagcacctctcgctgtttctaaatcactacgtggtactattaaattagagaaagtactagaaaatcttaaaaaatacaaagcaaccgaccatcaataccagctataattagtgacttcatagatcatatgtgtaattcggacgttatgagaaaaagatcattttaaaagtatcacggtcgattcgtataggaaagtagccctcaactgcatgttaaaagaaataaattaagttggtagaaagtcattagatgtctaatgggatataagtaatagatggaggtccatttgtatttttttcctatatagataattttaattttaattgtcaaggagataaaaaacagagagaagaatggcgcacactgtacacgagcagggagggagggaggtttgggatgtttttctaaatcattcatctaacaacctaagataatgtgccagatgtttatgtcaaaacctaagagaatgacgttacatcttagggcatttataagatgtgtacctaatggacttttaacaccacttgccacaaaggagggagggaagaaggtttagggtattctttaaaaaaaagatccaatgacctaaaataatgtgtcaattaatccatgaaaataatgtgtccatcgatttatgtcaaatatgatggttggattttttttccaaagtttctaagaattttcctctaatttaagaatgtcatatagttgcctagatgcatttataagatatataatggattttaataccgcatggggatagggagggacggagagaggtttggattttttcttattaaaaaactaacaaatagatagccaaatgttttatcctttttaaagattttctagtattttctttaatttaatagcaccacgtagcagtttagaagcattcataggatatttagagtgacgtagcgagagctgctagacctaataggtggaggtttctttgtgggttttttaatgtaaaaataattttgattttaatttatcatgaagatagctcattggtatgcacgtgacgggaggttccgaatgtgtgctttttctaaaagaaaagatctaatatataaaaataatggatcacctatttaagtaaacaatcaatggttagattagtgtgccacttgacgacctaggagcatttgtaaggtacaagttggcggcttaagagtatttgtaggatgtttaatgaacttttagtatataattgtctgttttaaaaaaaattcaaagattttctttaatttaagtatgtcatatagtaggttgggggtgttaataaaatggttaatggattttaacagtgcatgggtttggaaggaaggagaaaggtttgaatttttttattaaaaaatctaccaacctaaatccatcattttaaatagaaatcgatcgacggtggcgccgatggcgtggccacgcgggtgacggagagcgccgcggcgaggttcctgctggtggcggcgcggccgcacggtgagtccgcctcctctcatctcgcgtgccgccgcctcgcctcgtgtcgcctccgtttctcacgccagcgccgatcaccccagctcgggccccgtaacgttcagcctcggcgcagcggcgtcctccactgccgacaccatcatcgacgacgaggccgtctttggggaaggtgatgcgtccgacgaggccacggcgggtgcgcagacctgcgtcgtcttcgttggcgacgacggtggtgccgacggcgtggccgcgcgggcgacggagcgcgccatggtgaggttcctgttggtggcggcgcagccacacggcgaggctgcctcctcctcatctcgtgccaccgcctcgatttcccgcgccggcgccgaccgccccagctcggcctccacggcgtgcagcctccgtgcggcggtgccttccaccgctggcagatgccggtgctgcgtcttctccagcccactgtccatccccatgtcgccgcgcacctcctcgcccctgcgcgctgcccaataagagagaaagaagacataggagagatgaagagtatgacaggtgggacccacatgttttaaataaataaaatgctgactgaattgccatgcatacgtcatgtaggataaaaccgctctggattggaccgaggggggtaattcatcgggtattgaaagttcagggtaagtaatgtctggtttttgggttcatggtgtaattcggtcgaccacgatagtttaggggggtaattcgtattttttccatgtattaattaactcgtggatgaatttgtgaatgtataaatttattgaggttctatgatgtgaacttatcaatgaatatttgattttgtgatccttgaacatctataaacttataaacttattggttctctgattttctgattccttgatatgaacttgtttcatttttcattagatttccgatttatcgtttgtggttttgaggcatcggctcgtatttagccaaaccaagcctttttttttttacaaaccatactccctcactactagaaaactgatctttgctcggtcgccccaaaaccacaatagtcctggttaaaaaagaaccgggactaaagaggatctttagtcctggtttaaaaccccagagccattctatgatctttagtcccggttggttcatctttagtcccggttcatcccctgtcaccttgtcagaggggcggggatctttagtcccagttggtgtcacaaaccgggactaaagatcactttactaaagatctcctagatctttactcccagttggtaaaatcacgtgtagtatataatccctattccctatcctctcaccaacaaccggcctctcctctcatcagatccatctccctctcctcttcctcctcccatcccggcactctccttccccctcccttcccatctgatctctcctcagatccatctccctctcctcctcctcctccccttcctcctcccatcccggccctctcctccccctcctcccttcccatccgacgcccagcaagggccgcctcctccccctcctcccttcccgtgcccagcgggaccacacttggcaggcggccggcggggccgcgcccagcggggccgcacgcagcaggcgccgcgcatgggccgagtagcgagcggctacaggcagcgctaccgacatccatttttttcttttttttttacaatttgtgattctctgatatgtataattttgtgatttgttgtatggatctgagatgtataatatgtgatgtatttggtttgtgtgtaatttttttaaagatttgtgatgtatttgatttgtgtgtacaagtaacttaagatttgtgatgtgaatgttttggatattactttgatttggggtttgatttaggactatgcatcccactcgattggggagaaaatatagggtttaatctctggctaagaaacaatgaaaaaaaagaaaatgagacctaatgggactgctgctaccctatctttagtccgggactaaagataccaaccgggactaaagatctatttttagtcccgattatttcaaccgggactaaagatgggcatctttagtcccggattgctagtcccggttggaaaacgggactaaaggggttaccaaccgggagtataaatggtttctccaccagtgcctccggtttcattttaattgacgttttggacaatgacacggtctacaagatacatctttgaccttattttttctattataatatatataataaataaatgcatgtttacttttattatagtactttaaaagacaaatctatatatgttgttctagttcctttatactaaatatttttaaagttattgataatctaagttataaaagtttgacctcaactttatcccaaacgtcaattaatatagaattggagggagtatataccttagaggaaccgacaccattaacataactcctcgttagcacctgctcgatcgatgccggttaccaaatccgacaccatgtgaagttgataaccagcacataaaggcttttcgtaagtagtgcgtgcgtgcagttacagagctaatccgtgaccgtgatcgtctccacttcgatcgaccgtttcgtcgcggccacgaaatcgccatcaaaactgctgcatccgactgggaaaaggacacccccgtacacgagcccgactcgtacaccacactaccccgccccacgctataaataccagctctcgtcgtcctcctcgatcgtatcccaccaccaccaccaccagagctagcgcagcaaccgcgagttcagttcagttcagtttttgttacgtcgtcgttcgagtcgtcgtcggctagcttcgattcgaagaagggcaacaatgaggttcgtggcggcgtacctgatggccaccattggcggcaacgcgagcccgaccaaggacgacgtgcgcgccatcctcggcgccgtcggcgccgacgtcgacgaggacaagctcggctacctcttcgaccaggtcgccggcaaggacctctccgagatcttggccgccgggagcgagatgctcgccttcggcggtgtcggcgccgctccggcagccgccgccactgccggtggtggcgccgcggcagctggtgagaaggagaaggaggaggagaaggttgaggaggaggaggaggacgacatcgtgttcagcctcttcgacgacgaatgagctatcgaccttcgtcttcagccctgcatctacgtgccgtagtccacatgtcgtccgtctaagtttagtcgtagtagtatatatatctatttaatttgtttatttagtgtatctgcgcgtctagatatataatggatgattttataagtacgctaattaataccttcatcttatctgggtttgatgttgctgtgatctccatcgtatgacttccttctataaatgcaccagtatatatatgcacagtgccttgtatgaaaatatggcgcgtacgcgtgtatattttatatacatgtacatacaaatagtatagaattaaaaaaaaggaacttctatggataattagacgacgttaacccatttatcattctataaaagggagtagtggtggtggttctgctattatcctcactaccaattcctaacttatggggctacagagggatcacatgtcaatactcacacaaactcagtatggaactaacaaggtctacgtgtgagcacaaatatgtaaacaattaagagatattaataatatgttaatgataatactaccttcgttttttaatagatgac

SEQ ID NO: 58094 - DNA, 9019 bp, Oryza sativa
aaacactcacacccatcacatcttattagtatgttgctccccttcaacaactaaaagtctatctttgattgtcaattattcggaggtaataaacaatatctacgaagtcaatctcaaggaccataggccacacttgttccacttagaatgaactttctgagtaactatgacgaaagcattttcctcaaaaactgctctgaacatcaatagatcgtgaattttctatgaaactcaaacattccaaagtaaaggaattaaatccactcaataaaaaacaatttgttgggtgcatgtaattgaaaagaaataatcaaacatggaaggtcaagcaacaaaacaaacaacataaaaaatgaatatttagtcgcaaacacggttttcttaagaaatctgagatcatgaaaatgactatttgtactaaattcaagaatcacacgtaaagacaatggaaatatttagaacatggaccgagtataaaaccactttttgaagaaaatgcgtagaaggaagcatcctcttcgacttgatttttttaaaaaaaaagataacaaaaaggaaatatatcttttaccataaactcatgaaccaaaaatcaaagatttggagtttgtttgtcacctcaaactgcgaatccggaagctattctataaaaaaattcaaataaagattaataatcaaataagtgtgaacttcaatccaagaatatcaatactgcacacagttctgtgccatgtaatgaaaataaatcactaggtaaagaaaatcagatttgatacaagttgtccataacaagatttaaattagtattttcaaatagcattgtgcatatcaataatttataatttatcagtgcaaagcaatcacgcaacacttatgtttgaactaaaaagcgaatgaaagccacaaaagtgaaactaaaataaatatttagtgttaattcttttctgaaatctggagaatatttgtcacaaagtaataaatgcaaagtcaaatgttttccatttggaattatttcagaacatgtaccacaagtgagaaagttatttttttcatttcctcaaccatagtcacataatagaactcacaaaaagaaactaataagccatatcgcccttgaatctgaagactgaaaaatggaacttcctcttttttttttttgcctttcgggtgaagacatcactacgttggtgcgtcaggcataacacatagacaaatcacaccactgtaagaaaagaatagaatgagtagatggcatgggggccaatccatcccatacccaaactattaactcggtacgttgatagatgtatcctgacctaacactcacactcgggcaacctcacttggcattggggaaaaaaataaagagtaaaagtcccctcctctaaccacattacactgcctatatggaagaaaagttacctattcttaaaggatcattaagtcttataggatacaacattaattacttctataaaagagattaacacaagttagagccatgatcaaaatagtttaattaaggtctagggaaactaaaaccttatcatgtacactcacatacctcaagtataactcattattgcaaccccatgttgttctccctaatagctttccgaatatagttattcgcaaacgttaatctccacactatacaccgcaccaatgtatcaaaactgaataatttttttatacctcctagctttacttaatatacaattagatcttattcgtaaaagagtatatatatcgagtaacagcataactccagaaatcactaatacaatgagatagagatcagtaatcaataaaataaatcaaaagtgtgatgcaaagaatgacccaatcccatcctattgtgcaccagtgtgtcagattttattagtttaaatctaactcaaattttacttttattttccccatcctaaggaaaacatgatcaatattttaagttgtcatacttacttcccatggacctaccgcccgctctgataccaactgtaacaccccaggtaaccacgtacctagagtgccacaccaaacatactctcaaaccactaactcccaaaattattagaaatttcggtagagtctcccctgtaaatacggacatccatgacaggcaattataagttaaactaataacaataacattcccataatacgatccatccttataatccatggggaagaaactattagaaatctaaaagattattacaagaccaaaccatgatatagtttaagtatcattatggacctaggcaatatagtttgatagtgtgcagataaatgtgtatataagagtgctacttcccgcccatgcatgtcggtctcaatatgtacctaaaaccaaataaaacacaagagtgagtataaaaatactcagcaagtacaatatggaactagaaaacacatatacacatcattggcaataaagcatgaacaaaaggctttcttcctttgataggaaacacattttcaaacaccaatagttgaatataaataatagctttaaacaggatcatcatgctcaaagggttgtttgggatctgtgtgacttgccttgctggccttggaactcttcaaaatcttctcctgcaaaatcggactctccgggaacgtcggaatctaaacataaaagagcaaaatcaccaaaacagtacataaacaatcataaacagcatatgtggatatttttaacatgtagatctcagttttagaaaaatttagagacttgaaccaactaaatctgacctaagatgaatttgttatgaatttttaaagattaaaccggattgaatcatttatatagaattatttttgaaaaggaaaaaggatttattgcgttagcgggctcaggttcacggtggaccgggtgcacgcaaatggtctacgaaacaaacggctgagatctaatccaaaccgaacgaacggtcgagatcgatctaatctaccacgggtctacggctgacgtggcgctgacgtcgatgatgacgtcatcaccggcggcggctcgacacctcgtgctcgccggcgaacgacggcgcagcggcgcaaatagaccacacctatgggtagagggcgacgcggcgaactcagcgagggctcggacgacgacggacggcaactgacggcgacggcggagaggtcgaggcggcggaggcgttcaggtcgacgatgacggcgatgctccggcggtcttcggcggaaatggaggacgggacggggatggtgacgacatggcgaacccgacggcggccttcccgagcgacggcgacgacaagagcggcggcggcgcacgactggacatgcggcggtgacggcgatgcacgggctgacgcggaggcggtgctacaagcgacggcggcctaaggcgaaggtggtggcgaaccgaggaggtctcgggggtccttatataggggctagggggcggcggctagacccacggcgtccggcggcggcgatggaaggtttagggttagaggagagaaatcaaatccgaatcgagctcaaatctgatgatttccaaacaaaattagatgaagtttctataggggaaaagatagaggagatcaaggggatcatttcccctctaccaatttgatcagatcgggaaagatgcaaccgaatttggaaggggcggcggcggcttgcgcgcggctagggcgcggctggcggcggaaggaggaagacgaccctggcggcggcggcggctaaagttttgcacggaaattcccggatgcacttataatgggatggagggagtagttgcgaacaacccatttagaaggggagtgcttcttatacttgctctcccatagtacgtactcgacgataccccgcgctttgctgcgggatatatgttagatattggagaaatgataaaatgatttggattgaaatattatgaaaatgatttgagaaagataatttagcatgtgtatgtttagttttagaataaaataaattgtagacatgattactatatacttgcattgtggagctttgtgtgcatgcttaatgggttgacgtggtatgcttgcatgtaggttttaggagtgctaataaatactatgcttgcatgttgagctttagatgtttagtgggtattagctttatagaaacaagagatacctgtttctggatgaaaataatgtgcaccttaagatacattcagttctctattttgtgtccatgtttctataagtttctctattttgtaaccaaatctgtttctctatgtactcaacatgttaacatgtattccagcgaactttcagcgtattctgtagaggctttcagttgcatgatttggttaccatgaaatatgtctttattttttactaaaaccaagattaaggctgtgtttagataggcccaaagtgccaaataaatcggtgaaaggggtgtactcgggactttggatctaaacagggtgggaggtggaattcggccatttcgcacattaatggcccaaacagtaccctaggggatgtgtggcccgttatacctctgggaggaggcgtcggcaccgctcctatccattccccatcgcgtcgtcacacgcgcgacccctagcttgctctcccccacctccgctcactgtccaacgcgtcgccgccgcacaaatccaagccttcccccggcgaatcggagggtaggtcgtccatatccatcagctccgcggcggtttgtgggccaggatcaaccggagtgtgcgatggattcttacaacggtgacggcgacaacgggggcggctacggcgacggccatgacggaggcgggtacggcaacggtgacaacggaggagggttcgccgacggcagccacgtgagcgggtacggcgacggcaacgccgtgcgcgtattcggcgatggcagccacctcggcggatacgtgccggacagccgcttaggtgcgtacggcggcgggaccaccggcccgctatacggggctgagcatcgattcggcgccggcatccctactcgcgacttcctcggtcagcctctccatgcgtcccgagatggcggccacccgtcgttcagctcgggtggattcggcgaggggtcttcgagcagccaaaacccctctcgtctcgagttcggggcactcgacctcaactccggcgacgactggtcgtccgtgcacgcctacgaagaccttcttcgaggcggcggtggggagggaactcaatgccctcccggcgtacgcgttcctgcccgtacaggaaatcgcacgctcaggctgcgcgactggccaagtgctcaaggggcttctggatctggggcgtgacgtgcccttccgatgtcggctggaggactcggcggatcgcattccgttgctgctgggttcgaagcgccaatggctccgcattccgttgctgctgggttcaaagcgccaatggctccgccatttggaggtacaggcgaaggaggcgtcttcgtgcctccgatccggccgccagctccggctgcttctcagggtagaggccgaggtaggggtcgcggttcacggcctcggtagacacaggtacgtccgttttaagttcttgcaatgtgtggattggcaattgaacatattcttgtgaactgcttcgtttcattagttgctatgtattatagttgttgaaccatgtgaattaaagctactgcaatacttgcgaaatgtgttagagctacggttagtccgtatggttactgactttgactttgttgctcacagttcttttgttaagggttagttttacagcaatgacatacattgcagcacatattttagcattaacatgacatagtgagatgagagttcattgttataaagttgtttaatttgcattgattgataagtgcgaaggtcattgcttcgttcggtttacttgtgcatctaggatgtcaacgacagggcaaattggacaaatgagaacaccaagcttttttgcgagctttactgcaagcaaatagatagggggaactgcttaaggggaaccatgaataaaactgggtggaaggagatcatgaatacaggggtttgaaaaatatgtggacctttatacagaaattgcgtacagacactaggttaggccgcaggcctaacggtaccgtcgttgcttctgagaagtggtgggatgacaacacgaaggtacaaaaacttcaatattaagttctgcactttcattcttgctctttcccatgcatctgactgctgccttcgttttttccaaggccatcctgaattgaggaagctgaagaacgggatgcccgaccatctcgatgagctggaccgcatgttcatgggggtggctgtcgacggatcgacttcatttgttcctacgcaccgcgcatcccagccggccaaccccattgtcgatgttgaggacagcgacgatgacgaagagtccgacaaagactacttcgaccccctaagccctagcagcgttgggacgaagaggtcgcacagcatgaggagcacaccaagcactaggagcatggcaactagtccgagcaagaagttgaagagcccagccgtccgcgccgtggtgaaagaaatgcaggtgcgcaacaatcttcagaaggacaaagcgacatcaattgacaccctatttggccgtttagaccagaggagggatgatgatgacgctcgcgcgcggcaaaaggccgagcgcatcatggcactctgtagggagtgcagggtcacagaggcgacaccgcccttgtgggttgccatgttcaagctgctgaaggatcgagatgcaatcaatgtctttgagctgtccaatcctgaaggaagaaagaccctccttgagcacctcgcacgggtcgacaactagaccttctcatgcttgctttacatgttaatgtatcagccttagttgtgtcttttgggctgtgaggtgctttctgtgttagtggtgctatgtccgttagcattgtccttcaagtaatgtgggctactgttgtgtttcgaactatgtcatgcgtaatgttggcaattaaatgtaagttgtagtatgtctgtcgttccaaattcatttcttacttatgactatgtatgaaagttaccgttgttgttgtaaatttttacaggaggacgtgcggcctgatcctgcggatacaagcgaagaagtttccgacaaagatttggaaataattctggtggaatacttcatggacgattctgcggacaccacgttcctgtacggtgcgtattttatcgctactcacattgacaagtactgcaaccgctctgattatagagatcatagcacaactatgagtggtttggaatgggtagagcataagcttgcagataggaagcggtgttacaacatgtttagaatgacccctgatatgttctatagtcttcatgatctgttggtcgacaaatatgaactcaagtctagcacaaaatctacaagtattgaggtgttaggaatgttcctttggatgtgtggggctccacagttggttaggcaagctgaggacagatttgagtgctctctaggaacagtgcacaacatgtttcacaaagttttggcaagccttttgaagctagctgctgacataattaaaccacgcgacccacagttcacaactttgcatggaagactaaggaaccctaggttctatccttatttcaacgactgcattggggcaatagatggaacccacattcctgttcaggtttcgaaagatctgttggttcagcacatgtgccgacaccacattacaactcagaatgtgatggcatgttgtgactttgacatgatattcacttttttgcttgttgggtggccgggttcagtgcatgacatgagggtgttccacaatgcaatgagtacatacagtcatgttttccctcatccacctccaggtacacagctacctgttgtaattttgcaatgtctaacttccataacgtgtaacttacaggtgattaccgctgcagggaagtactatctagtggactcgggatacgcaaaccggattgggtacctggcgccgtacaagggcacgaagtaccatatcaccgagtttcaaaacgcgccagaaccagaaggtaaagaggaggtatttaactacgcacattcctcccttagaaatgtcattgagcgatcatttggagtactcaagcagaaatggcgcatattgaaatatgtgccttgttatccccgtgaaattcaaacacatatcatagttgcttgcatggctctccataattacataaggcttgctggtttaagggataaacactttggtcgttgcgaccgagatgagaattatgttcctcctgaggcctatgaagatcagccaccggaggacgaggctcctagttacttacaatgtgaacatatgaatgcatttcgtgatacacttgccctcgagttgttgcatcgagcatgagccatttcaaccctaggttccataaacttgttctctcatttatttgtatttgcacttgtcttgccatgtgcttcatgtcaccacatggaagtgttgttgtaatttgtgaggcttgtaatcttctcctgtaatatgtgaggacttctgtctgttacttgtgatgttagagaacattttttcgcgacggcatagtcatggatgtctagtgtttgtggagtactttctgacaattttcagctgagctagcaacatgtgagctccaaccgttgcaatgtaatttttcacagttttatctacggactgttgtaatttaaacttgtatgacaattatttgtaaggattgtttttgttcctattttttttgcatatgtgcatggcgtggatgtcagctcttcaattgtcatgtgcaaggtgcatgcaatttgacagtttgaatgtgtgtgcatgaaatttgaacgtatgaatgtgtgtgaatgcaagttttgtgtcatatgttttattcatggagctgcattaaatagggttacttttgtctcttttcaaatttcttcattccatccttcaaatttgggctgccaactaaacaccccttgcaaagtttgcaatttgatatgtc

SEQ ID NO: 58095 - DNA, 26651 bp, Oryza sativa
agatacgcagtttgcatatatcagtttttctgacagatattctggtagtgtgccctgcattgggttaaaaaaaatatagttcatggaatcaattcctactgatctagaactgaatataccaccaacagttctcatgcatccacattccattagtactgaatataccaattccatttaattacaaatgccatgtacataggttagttgtacaaaaagagattctcctatacaatctacaaaatgagacaaaacgatggcaaatctacaacaggcaaggcatttcccttgtagagaaatgccactccaaaatatcttgtgaccgccatgataagttgagcatctaaaaacttgaatcagattatcagaaagacaaaagtattaagggtcagatatatagattataataatactccattcaatgttaagtaatctatgcaacacctactatttcaatacagaattgaagatcagtgtcaaatgtgcaggataagtgtcaataacataactgatgtagttccatttaattcaatctgtagcatagcttcgatattctcacaatccaccaatattaaattaccagttccattttatgagaaatttatgttgaagcagtataattgcaatcgtaacagattcaattacaatttacaagcagcaaggattgcaatttatctcacaaactatgggaacaaactgattttagcttacatgatgtatgagcctttaagttagtgttgatcttctgttccttcaggtacccttctctgacacttcagcaagaagttgattgctcacccacaggtcgcaaatcatagctagtaaataaataaaaagaagataagtgctgaagtacagtttaattggctcccacttgcaaatgttaacttatattagaattgagatgtatgtaggtgacattttcataattaatgtagatggaaaatctgaagcccgaagactgtttcaaatttgtactacgacaactcactgcaaggacagctagccacctaatttgcagagatcaactaagggagttttatttaaaataattatactaggatggtacattctacaagtaaaaactcagtaaacacacaatgtacatgcatatttctaataaatggattgatataagttggaaatggcttcactagtaaatagaacttggcttgagtagttgctgtactatgtggtgcatgcaaagttctcaattagcatttcaattattccaactggtcctgatagctgatgcatgtctgtgtgaaatcaataatagatcaaatcttaaaaaaaaatgttcaccactctttctagtacatatataataatgtctgccatgaaatgaaaaggaaatggagcaaacataatctccaatttattgaatagtgcatcatatagaagattagcacttaattgttaataccattgaagttcttgtaatggaaaagtaagcggaaatctaaaaatatgaacaattatccgtttttcaatttgatacattagatcagacagaaaatgtccataatgtggtacactacatgagaaatagtgcattttcttagtactaccacatttctgtaaacattacagctaacttcatgagaaatataaagcagaactggagcattagctaagattcatggggaaaagagacaagtaggttcaccctaaactcttttgcaccagtattaagcatggttgcaatgcaagtttccatcccatggctatgaatgacagccccagctctcatcaaataagcctgcaaaataccaatgaaaattagacagtttagaacacactagccgaatgtgcgctctttctcttttggcaaccatgattggacaatcaataaatgagaattctataaaagctcctaatcaacaccactcccgaatacggtatgctcgatcctaacagaagacacgagagtagccactgctcgattaaccgctcgtgagggggaatcgagtgcccctcgcaggcaattcgtcgaacaggagccgtgcaggctgtgatgagagagagagaggggggggaccttgggtgcccagaggcggtcgtcggcggcgacccagcgccaggtgctgcgtgcgtccaggagctccatcacccgccccatcacctcctccccgagcacatccacggggtcctctcgtctctgccgcctcctcctcctccccctcttccgcctctcccactcctccgcctcccgcttccgccgccgccgccgcccgcgccttggttgccgatgacgtcgcctgcaccttgctcgccgccgccgccgtcgcccgcaccttgctcgccgccgccgcccgcgccttggccgccgatgccgtcgccttgccgccgccggaggaagcgtgagtgcgtgacggctgggtagggaagaaaaggataaggttgtggggaaattagggtttggtttatatatgataggctagatgggctttttgggcttgcaatatagtattattaatagtctaatatacacccactaagttttgctgacatataattagctcgtactcttacaattactgacagatattttgaccaaaaatatatttagaattactgacatataccatgtctcattatgcactattgctgacatatagtttgccaaaaacctttaccgacagatatgttatcactaattgtttatttttgccaacagatgtctgttggtaattccatgtcatggtgtagtgccaaatttatgtgtaaacgtattcacgaacatatacccaaatattgggtatgaacgccaaaaaaccctgtttatttcccatactcgtttaagctaagtgtatacccatttaaattgttatgctcgtttatattggacatgtgcctaatttaactttttatggcccaaaattaggtatataaaatctttttgaacctgtttaaattgggtatgtgtctatttaattctaaaaaaatagtgaatttgggtgtgaacccaatttgcacgtaaatacatgaaaattttgggtatgtgctgttccttttgacttaatcagcaattatgctagagatttagagaaaacgatccaatgacacattgactaatcaacattttttaactaatttctgggtatcccatcggtaatacactcataaatatacattattcggattggatacggaaataacaaaaatggggcactaattaaagtatagtaaacactgtttcaagctaaatgccactaattattacactgtaacacgtaaatatcaaactctacaagtgatgcttagttctctgatggcttgcatttcttgtgtaccctccgagatgcggctttcggctgttagtgggttgctctggtttgtttacacttaatatagcggctatgtgcagtagacatgctctcatgattttgatgatgaattttgccataattgtgtgatcttcaaattggttggtaggaggatgaacaagcaacttattaggacgatccactcccatcttgaggtcttcaccatcaagggaaattgtttacacttaacctggaaaacggtagaactcgtacgcgtacgtaaggaaggatataagaatagattgaaacaaattacccatgaaccatgccggcgaccgccggtggtgcaacggacgtacctgacggacaaccggcagcggtgaccacgaacctcatggacggcggatgatgacatcgtggtgacgaagcttgcggatggcttgcgacgggcgacgaattgaagctcacagatgcacaaccagcagcagccgcagcgactaacctcgtggacgaccggcggcgtaacgacatcgcgacggagctcgcagcatcacggctgcgacggatgtacgtatatacctgggcatctaatctgaattctaaaatttagaataccctcggatggtatatatatacatatataaaaggaaacgtctaaattcatatacacggagcaatcaatccaatgtaattaacatgcttgattttctgaacgtatttatatgtaatcatattcaaaattcataattcatttggaaatgcatgcatgcaaaataaaaaatggaaaggtacaagataccctgatgcaaatatacatggaaagcaatcaatccaacgtaattaacaagcttgattttctaaatgtgattatatataatcacattcaaaatccgtaattcatttggaaatgcatgcatgcaagataaaaaatggaaaggtacaagataccctgatgcaaatctttcttattgggttaaacccgctaatttcattaatacccagtttttggtttgcacgaatcctaaagcagttgcacggtggatgacgttggagcatgggctccatggagcaccagttaatttacctatacatatacatatacatacatacatacatacatacatacatacatatgggctccaatgttgggagcctttggatggttgctgatcggttgatcatttgagtgtatgagcttaatgggtataaacccgtttagagtgcatgatttaatagtgaacggattccatatatttgaatacattaaaaaaggaattggatgagagaattatcataattgcatgtacattttaaaaatagaaacattaaatgagcgtgaaattggaaataatatcttgtaaatatggaaacttacgtgattgcatggtgaggtttgaataatgataatataatggtgaaaaatggaaactgactatatggaaaaacgaacttttttttttgcaaactaggtatgtaatattaaatactgatccttctcatatttggaaacatgaaaactaattatttgaaaacatgcatactatatatcgcagcacatttttatggcaatgtatctgtaccaaattattccattcatgatgccattaatttagctatttaagtcacaaagtatgcattgcggatcactttccaagttttaggtgcaaagcttgacatatactcaaaaattgggtatgaaagggaaaaaaatcccatgtaggtatatacattgtaccgatgtacatatgtaatatagtttgatgcgcgtgtggcattcgtgtaggtatatactaaaaaattgggtatgaaagggaaataaatcccttgtaggtatatacatagtaccgatgtacatatatacgtaatatagtttgatacgcgggtgacattcatgtaggtatatacatagtactgatttatatatgtaatatatacactccttattagtttgcatgagcttggaagaaattaaagtttgcatgaccatcgaataaactatcacctttttttttctggctatgtaccattatgtatctaagtataatatacctactgtgtctgggtatagaaaaatagtggtttatagaaaaatatagcaatattttcaagtacctattatgcgtactgtaattatatatattcgagttatatagcaacattattagggtattcgtactatatttatatttttaagtctaatgtaccatatatatacctattagtacctacccaaaattacggggtgcttacccaaaaatttgaagttatgggtatgtggatatgcatagtgttttagttaggcacttatataccttgtttattaatttaaactgaactcaaaactatagatgtccctttttttaattattttttatcatagatacatgccattgggtatatacctgattttaagtagggtgtatatccgtttaaattgggtatatgcctgacttttatattcttttaaattaggtatatatctaatttaaaatacggtatttagctgggtatatagcattgggtatgtgccattgggtatgaggcgaaagcagtaaagcactaattagcgggtactgtctccatttggaatatacacagcagtcacaatattgattcaatgaattcatgataaagaacctcttgtcacaatatatttttgatgaaaaatacaccaaaagttattcagatataaaataaaagaataaactagttctgaattaatctatacactgttctcggaggataacagcaaagcttgcgaacgatttcgccacgaggcaacgacgaaaggacatatacagcaagaataaaaaaaatgataacctgtagctggtcgatcctaacgtacatggaaactgcaaaagtcatattccctcccttcttccttttttatatgaatcaaataattcaaattgaaagtaacggagtgaacgacgaacatcatatcatggacgaccggcgccgacagtggtgacgaacctcaccgacgactggtgatggcggtgcatggcgacgaagcacacaatgacacggctgcgcgatcgtggatgaccgatgccggcggccgtgacgacgaatctcaaagacgacctgtgcggcggcgagcagcgcgtggcgacgaagctacgtacaacatggaagcgcgacagaacatgtgttacgctcccagatcagtaaaatacttttgaaaacgaaaaatcatcgatacatatataaggtaccttaaaaaatttccatggcgaggaacgagcttgagagtcatggacgatcgacggcgcaaaaaaaagcaactgattggcgtcggagacctggttgtgcgttgacgaatctcgcgaacgaccagtagcccactacgaattaagaagctctctcccacgtccggccggtggcgcaatagcttggcgatgaataagctcgccgacgtccggccatcggtgtatgtagcattgagtcgagagtggagtgtgtcatctctatcattttacatgtacacaaagaatggaaagtattaattggtatgatggaaataattaaatcaattacaacgtaattagtggatttacatcgaaatttgtggatccaattcaatgtcatctcaaatatgaaaataaattatcacacaatcatatggaaataaattatcatgcaatcaccagaaaattagtacatgcatgtttgctctatggaaagggaatcgcatcatgtcgtgcacacgctgcatgcaaatcatgaggatacaacaaaaatagaaaggtctaatcgggtttaacccgttactatatgtctaacactctggttttaagtagcacggatctcaaagcatagtacacggtggattctcttggagcccatactccatgtagcaccagctaatttacctctatatatatacacatgcatacatacatgcatgcatacatatacatatacatatacatatacatatacatatacatatacatatatatatatatatatatatatatatatatatatatatatatatatatatatatatatagatatatatatatatatatattgatgtgtgattccttttagcattctttttttaataacaaataaaatgcccgtgcatctgtgtgaaattcttttccgaattatattctagaattgtactccagtttatatcatgtcattatagcatttgaaacacaaactataatacatacccatgtgaatgtgcgggctatctttcttaaaaaaagcctggtgtacaactggggccactgcttttctcaaaaaaatgtgtattccaaatacatattgttatatcaaatagtaaccatgatacagaccaataaccatatacgataaggaagagcttgtcagtaaatccactcaagaagaccaccttccaacttcccaatgtttactggtgtgtagtcccagcagaggcacaaaatcatatgattttagccttttgagcagcagaggcgagagatgtggcagatgcctttcctcctctacttgtaccacctaaagggcacaaaacaaccccaaataaatattagcacagggtttgcattaatacaggaaacaaaaatcattgaagcatcacctaagctaaaaattgaatctgacatataattacattgtcagaaatatctatagtaaattgagaatcaaatacacgtgatcatattgacatgccatcaccaaagtaatttatcctcaccacttaatttattgtacataccagtatttgcaatgttctgctgcacacatatcgtgttggttgtgcaatggacatgatgatgaaatcaacactgcctaacaaacatagaatcatttctcagagtttagttcatcaagcaaaatcaattttagagtttgtttagttcaggatagcaaaatgatttcagatttactttcacatctttgttatccatatttttatatacaaatacaagtaaattgttgctctgatcttgaggtcacaccgtcacagactcatatcctgagaggatttacaaggaatcaacagacttacaacataaatgcatgagcatatggtttacgagcaaccagctatgatcacaaacatctgcttcttttctgtttttttagtagataagctccacccatttaaaacccatcctttgtaccttcagaggagcagctacccattccttttaccacaaactgaaaaaattgtttagtcatctcagaaatccaggtagcaaataagattcattcgggcatgtcatatgctgatggcctcctagcacttacaaatagaaaatgtccataaccaactaattcggggagagaccaattataattactagttgcccacccatgcattgcacgggttgaaaaaattagtaaaaatctaattaattagtttgagaacttaaaaactcaacaattcatcatcaatgtaaatcataaaaaaagtatcaccatgagcattgtgcgaaatcttaaataataaaacatcatttttttcttattgtattgaagagtttttttttttacatttgcaccatatgtccataatttgtctgatttaagggtcagcatctcaaaatccaaatttatgataagtgatgatgttagtactggagactggaaagctcccgtgtgacaaaaacacacggtaactagccaaaaacgccccggaacagcgttaccgtgtgccatcacacggtaacgaacacacggcggcttcaccactttaccgtgcgcagttcccatggggatatgcaaaaagcgcacggtaacactagggaccataccgggtgtccagaaactcacgggaacacctgtccctaccacgtggcaaattttaacgtaacggagttcaccgtcaaatgaacggtaggttcccgggtgaaccaaaaacacggtaacataccgtgcgctgacggaaactctcggtatgctccggtgtgttaccgtgcgttatagtataataaacacacgggaagcaatcgttactgggtttgtacagtggatataattattttttatttctgattttcatttagtttcttttttattgtcacttattgcatcaaaaaagaaacaccacatgctacatgcaccacagctcacatccatataaggtgaaaccacataattcaccaaataaatttaggtttcaacatacacatgttaattaaagaaatatcaaagctttaagacaagctagcttgcctactctacaaattcagacagtcatgtgacatctcaacagatgaagcagctgcatatatttcatcttaatatatctatcagccgaccaaagcaacaaattcttccatagatcaataattcaatatcgaatcagtcaagatgatgggtggctgctgtttgtcaccttgagttgatacatgagtgtagatccttgcaattgttagatactggtaaggagacaagatagcaacacatgtgtaaaaccactgtgcgattggtagaaacagaatggatatgaaattctagatttgacatatgtttccaataattggtaaataagaaagcttactgagcagtgctgaaagaaaaataatctagcacaagataaagttccatgggcataccgtttactttaactaaaaacaatttaaaatgatagaaaggcaaggaaatgtaaacttgtttatcgacatgaatcctattaataaactattagaatgtgataatgataaattaatctacagttgctcactgaagtctaaaattacttactcagcttattgcaggaaacacccgagtggaatactagaatccgcacatgaaaagaaaaacagccagcatgaacagtagatgtcatggacaggatatgagaagtgagtattgtttcagtcagttaccaataccaatttacactacctattagtaccaaagcaattactgcaattcattcagttacaaatttacagttgcactatgggagtgaatttctgggcttcagtatttaattcatactaccctgtttttacaacaaggcaacatacatgttgagtgaatgactacgatacaaaatcaaaagcagtactcatactattgtgtttcaaaaatgagatatatagtgcgatagtcagcatagcattttattgggaaaaaatgttgatcacaaattggtgaggcactttggagaactactgagagattgtataaagagcataccacatcatgagataacatgagctttaaatttttgcatcatatagtgagataatataataatcagggaaaataactgcacaaatctaccaactggtgatgagcacgagctagcatgcatagaacacgaccttttatagttataaatgcaaaggacatgctgtgaagtgtcaacttgcagccattaagacaaacaccttgtaagcataattcactgtatcttgtggactgcagttttgctgatttcttcactgacccaaccaacccaacccctgaatcatgtactgagaaaggaatgcagtatcatttgcaatcacatggatctactacttccccattgcccagttgccgaagagacgattataccgttcgaaaaaaaaaagtttcctacttgacacacaccaaaccaaagaataataaacattaactgacgattgatccaatgtcgaaccctaaccatcgccgcaaacaagtagcagcaatacagcattgcatatgcgatttcagaaaatatatataatggattggtaaatgccacgctcaagaacaaaatcaagaatttgccaaaaatgccttgatgctcttttcattcccttctggatggatgcaatctcgtggacaggacaggtgtaacaatccgatgcaaaacctacttttgaggtttcgaataaacatgattacagacattgatgtaactgcaaagggaagcaaagcatgatgatatatatagtgtgtcatggtttacctgatatatgaacgtaagaaagaagatacacaaaggtaaaacatatgagtttggttgatttaaattaactgatatgttttattacccttgaaaactacaagcatacgaaataaaattattttgattttattgtctgatttgttgaacaaataaaccaatattcggacggctaagcctgcccgatcgagtggttaaatcacctatcgacttttttaattgataacatatatagcatttgtcttttccttccagcatacaatcaggtgatgctcaactctgccaatgattactcactgagacactggttcttgcaatatcgtctaaagaaatctgtagctgtttggcactagacaccactcatgaagatgcagtacaggtttatatatattttttcttacagaccgaaaactgcactatgcatgcataatcctttttgctacacaagctaaatcacatgaaaccttattatgctcaggtgttacagagacgccagtttattacgtctatcagaaagatctgaagaaaaaatactaaaagatgtggtgcattcagttcagcttctggaactgaagcaatttttttccctggataaagattcagacatggagatgtttggttctatcaagaagctgaagaaaccagactaaatgaaaagcaaaagaaggggctagaagtgatgaatggatttgatactgagaagttggaatcatgccaatgctcttgatttgcacctaacgaaatggattttcctcctcgagttgaactcctgtttttttaacttgaattcctgatgcttctccttcttattgtgccatttgctaagatttgttattgaatctttcatcaggctagatatggaattttcattgttatcgccctgaacttccctacagttcttctcaaagcagagaactgccttatttggttctgaaggttcatgctatatatcacttgtgtgtagtgtgatgatttttgttgcatgtaaataagctgcatgctctttacttaggctgaggcagttaaactgtgtgcagtcgtgcagagatgcctatcatttatgattgagattacgacgtataaatttagacaaactttacaacataaatattttttcaacattctggagactgaagtaatcaagattaattaacacggatttaccatcacaactttgttgcaagataggaggatggccctagttgtcattgatgactcaaccaagctatcaaagatatttcctggcaataaaatcaaccaaatcatctaattaatactattaatgtttgctttcatctaaatacataatatttcctagcaaacaaatcaacccaatcatctaaaaagtgctctgctaatatcttcagctcagaacgaacagtcttgaaaacggctatatatgccaggcgttgctcagagggttgtcacaacatcaggctagcttctgtcacttaggtatgtagtgaatacgtaagaccacaaaaaccagagggggggtgaatggttgtagtaccaaaaaccaaaacttttagcggaattaaaagttaccctcaattcgatgtcacacggtcagaccggagtagatgcgctggtctaaccgcatggaaaccaccggtctaaccgctgtagtcgctccggtctgaccgccgaaatctgctactgtcgtctgtagccgccgccagtctgactctgactgccgttagtccgtcggtcagaccaatccgatgtcgtcggtctaaccggtggtgtcttgccggttggaccgccgaacccgagcaaatacaaatcgaagaactctcaaagtatatgacaactttattacttctctttgtgtttataaagtgcaacaacagcacttctcacgaaaatctcgagtactaaacttgaaaccctaactattctcccaactcaatgctctctaaaacgataccgggaggccacacccttcttctctatatatacccgaggtaggcagcctaaagccacgaaccaaacttgtacaagaagtcctaatcccctaggaaacctttctgtataagaaactaactttacaaataacaattgtaccaaatttggactccctccaaattcgactccgcaccccatacgcacacaataccttcatcgtatgccatatagaatcttcaccaaccatgtgcattgatctttagcctaagtatctgtcacgcccagaatttctatccaaaactccaaacgcttacatacgtgtaaaccctcgtccaggaatcagctgagacacacaataacaaattgataatagagtgcaattattattctatttaataggcgaatataaagtcattacagaggtagatagttcctctcaaacaataaagatctaagcagcggaaaataaaataaaaagcgtaggcgactccatcccacaagtagctagaccagggctacgcctaatcctccacaccttcagcatcactgtagaactcctcctatgatgaatgattgcaaggtgagtatatgacatactcaacaagccacgcagcaaatatgcaagtgcaggggataacaaaggattgcataatatagtcttatttgcataaatggcattcaataaatacttaagaatatagaaaaaacagtaaagtatttaattaaacaatattaatccaacgctatacaacatacccgttgtataggtccaaccattctgaacaaccattcccggctgcacagttctatctccaaaccaggaatataccattccaaaccaggagctaaacaagttattaccaattacagcatcatttattatggtgagaggtatgagactaatcacgaaagacattgttagacccgcccataacagcggtgtggagattatggataccccatatctacatggcatgtatagtacgactaggtacagggtgccatatatagatagaatatctttatgaggactcgggttaagtttaaacttgtatgtcaaagaaatatacgagatcctagtcggtgacgattgtattttatctgtaattgcatattccgttagggatatggactgtattttgtaatactgaccccttcccctatataaggaggggtccgggtccctctagggacacgattttctcccagatcatacgatcaataatacactcggcggatcaatccctggacaggagtagggtattacttcttgattaagcaggcctgaacctgtataaaattatttgtctccaaacccatccacttttctagcttggtagccacccccttttagtattgccgaaatcttgtttcgacagttggcgcgccaggtaggggtagcgtcaagttcttcgccgattaagtgcgatgggttccgtctccggcatcgacgacttcgtcttccctcccgggcaagcgttctggttcagcagcctcgacttcatcaccaacgacttcggcaagatttctctcctcgactcggattcaaatcagtcagggagagaccaggtcccagccccgttcggtattccgaactcggccgagatctaccccaagcttatctcgatcaagtcggctccaaaccacttggacgagatcccatctacttcaacaccaccagatcaagatgatggggcctacccgccaatcctgatgaaactccccgacgatctggctgtcgtcttcactacaaggacgtcttctccccgtaggcctaagcgggatccggctttagcatggatccggcctagctccagggaagtcggcgtcatactccagccactcggcacgatttcgacggatcaattggaaggctacttcagctcccccggcgtcgactcacgaccaacagagatcgtagagtatgattaattcggctacctctatgacaaccgtgacctcgacgacttcaacgaaagctttgaagataactacacccctctctatttcggcgtcttcatggccgataacgagacggaagaacaacgccaagcccgagaagcagaagcacgacgcgtacaataggaggccgagcgacgccgactggaagaggagcgccaagcacaagagcaagaacagctgcagcgtgagcaacaggaacgtgaacgggttgcaaaggaggctgaggaccgatgacaacgagccttggatgtagggcgacgagcgcgagatcttatcaggcagcaaggcgttgaggggacagcggtcttctgcacccctcaacagaacgcggttgcggcgatcactctcctcgacaccctcctcaaggaagacgcactcaaccaagctgatcacgttatcaacatcttgaaccagaccaagaccatgattgccgcctcggtcccggttaactccgcaagcgtccgcacgccgactggtagccgagttccccatcttcggtctcaagattatcaccagccaagcctcagcattgctggcgcgggatacaattgcaggagcaggggccacaacgagcgatctgtccactcgcctcccgaacgacacagggagcgccgagttgaacggcctcgctccccacctcgtaggcgccccgtcaatcttcgtgatacaatcaatcagcgccgcgtagcacgaggctacgcgcaccgccattctccggatcgctatgacgacgacgtggatggagttgctgcctttactaacgacctgcgtcgagtggattggccagccggcttcaagccgactagaatcgagaagtatgacggcaccactaatccggagtcttggctcaccgtctatggtctcgcaatccgtgcagcaggaggagacagcaaagccatggcaaactacttgcctgtggccctagcggattctgctcggtcctggcttcatgggttaccccgtggcacgattggatcatgggcggagcttcgcgaccacttcatcgccaacttccagggcacctttgaacgcccttccacacagtttgatctctacaacgtcattcagaagtctggagaatcccttcgagattatatccggcgcttttctgaacaacgcaacaagatctccgacattaccgatgacgtcatcactgccgctttcaccaaggggattcgtcacgaagatctagtcggcaagttcgggcgcaagcctcccaggacggtcaagcagatgttcgagaaagccaacgagtatgccaaagccgaagatgccatcatcgcgtccaagcagtcgggtcccacttggaagccaaagaaagatacgccgactatgggagggggtggaagtaccaatcacaaggaccgtaagcgtaagcccgaggaacttgttgcaactacttttgacaatcacattcctcccgacaacgttcgcgcgtcaatacttttgacaaggtcatgaactcccaatgtccgcatcatcctaactccaatcacgcagccaaagattgcttcgtctacaagcagtttgcagaacaatacgccaagaatgcatggaaggcctccgacggagatcaaagcacgtcaaaaaagaaggacgatgacgacgatgccccgacaggttttcaagaccatcgcaaggagctcaaccacatctttggcagacctctagcttatgaatctaaaagaaaacaaaagctgaccgaacgggagattaacgctgttcaacccgacatgccccaatatcttcggtggtcagagacaacaatcaagttcaaccgctcggatcatccagaccgagtggtccacccggggcggtaccccctagtactagacccagtggttcgcagtgtcaagcttcggagatccctcatcgatggcggcattgcactcaacatccgcttcgccaagaccctggacgacatgcagatacctcgcacataattgaaaccgagtaatgcgcccttccacggagtcattccagggctatccgctacaccactcggccagatcactcttccagtcaccttcggtactcgggagaacttctgcacagaaaacgtctgcttcgaagttactgatttcgagacagcgtatcacgccatactggggtgcccggcgttagccaaatttatggctgtcccgcactatacctacatgatgatgaagatgcctggtcctcgaggagtcatatccctgcggagcgacatcaaacaaaccgtcacatgcgacaaggaaagctacgagatggcccaaacccgagagatcgcgatcgcccgagaagacatccgactggctgcaaccacggtaagcgaaggagaagtgcctgcaaccaagatctcaaagagtggagaaagcgaagccaagaccaagaaaattcttttagatccttctgatcctactaagactgctgtaataggcgctgagttagattgtaaataggaaagcgcactcaccacctttcttcaaaataataaagatatctttgcgtggaaaccatccgatatgcctgatattcctagagaggtgattgagcactctttacatgataaggaagacgctaaacccatcaaacaacgactccaccgctttgcacaagataggaaggacacgatcaaggaggaattgaccaagctgttagcagcgggcttcattaaagaagtccttcatcccgactggctggctaacccagtcttggttcagaagaagaccgggcaatggcgcatgtgcgtcgattacaccgacctcaacaagtcttgccccaaagaaccttttgggttgcctcgcattgaccaggtagttgactcgaccgccgactgcgagctactcagttttctagattgctactcaggatatcaccagatccgactgaaggaatccgactgcttgaagacttcattcatcacgccctttggggcctactgctatatcaccatgccttttggattgaagaatgcaggagcaacttaccaacgcatgatccagagatatttttcgactcagatcggccgcaacgtcgaagcttatgtggatgacgtagtcgtcaagaccaagcagaaggatgatttgattacagatctagaagaaacctttgcgagcatccgcgctttcaggatgaaactaaaccctgaaaagtgcatcttcggagtaccgtcagggaagctgcttagatttgtggtgtcccatagaggcatacaggccaacccggagaaaatcaacgccatcctcaacatgaaaccgccgagctcccagaaagatgtccaaaagctgactggttgcatggcggcgctcagctggttcgtttcacgactcggcgagcgggggatgccattcttcaagctgttaaagaaagcagacaatttccagtagggacccgaagtacataaagcctttgaagacttgaagaaacttctcacctctccaccagttttggcctcaccacatccgcaagagccgctattgttatacgtgtcggcaacttcccaggttgtgagcacggtcctggttgttgagcgtgaagaagaatgccatgttcaaaaagtccaacaaccaatttacttcgttagcgaggttttggtcgactccaagacaagatatcctcaggtccagaagctattatatggtgttttaattaccgtcaggaaattatctcactacttccaaggtcactcggtcacggtggttacatcgtttccactcggggatatacttcataatcgtgaagcaaatggacgaatctcaaagtgggccttagaattgatgtccttggatatatccttcaagccgcgaacttcgatcaagtcctaagctttggccgactttgtcgccgagtggaccgagtgccaagaagacatacccgaggagaagatggagtattggaccatgcattttgacgggtcgaagaggctttcaggcactagagccggggttgttttgatctccctgactggagaaagattgagctacatattgtggatacatttttctgcatctcaaaacgtggcagaatacgaggcgcttcttcacgaactaaggattgcaatctctttgggaattcggcatctgatagttcgtggagattctcagttggtcgttaatcgagttatgaaagagtggtcctgccttgataataacatgaccgcttatcggcaagaggtacgcaagttgaaagacaagttcgatgggctcgaactcacccacgttcttcggcacaataacgaagcagactcactaacttcggttcaaaatgagaagcaggtccttccaaagtgtttgttaaacatctttatgaaccaaccgtaccaaggaaaaacaatcgaggccatggacactcaagacgtaggtatgatcgaagccgactggagagagccccttataagatttctgaccaaacaagaactcccccaagataaggatgaagccaagcggatctccaggcgtagcaggctctatatcattcacgaggccgagctgtacaagaaaagtccatcaggaattctgcaacactgtgtgtctttggaggaagggagacaattgttaaaggatatacattctggtatctgtggcaatcacgctgctgcatggaccattgtcggcaaggcttaccggcaaggttttttctggcctacagctgtgtccgacgctgataagattgtgcggacatgtgaaggttgtcaatttttcgccagacaaactcatctacaagcccaagagttgcaaaccatcccgttgtcctggccgtttgcggtttgggggcttgacatggtcggcccattcaaaaaggcagtcggtggttatactcatctctttgtggctgtcgacaaattctccaagtggattgaagctaaacgggtcatcacaatcacagcagacaaggctagagatttcttcatcaatattgtgcaccggtttggggtacctaatcggatcatcactgataatggcactcaattcactggtggagtatttaaagacttctgtgaagacttcgacattaaatctgttatgcctccgtatcgtaccctatgagcaatggacaagtcgaacgagccaatggcatggtactccaaggaataaaggcacgagttttcgaccgactgaatccctatgccggcaagtgggtagaacagctgcaatctgtactttggtccttgcgcaccactcccagtcgagccacgggccagtcgccgttcttcctagtttatggagcagaagcaatgttgcctagtgaggtggaatttgaatctttacgttttcgcaactttcgcgatgagcgctacggagaaaaccgagtagatgatctaaaccgactggaagaggcccgggaagcagccttaattcagtcagctcgatatttgcaagggttgcggccgttatcataatcgcaacgttcgatcacgagccttcttagtcggcgacctggttctgagaaaaattcaaactacacgagatcggcacaagttatcccccttatgggaagggccatttatagtctccgaagtcacttggccaggttcctaccgactcaagcatgaagacggtactcctatcgacaactcctggaatatcgagcatcttcgtcgtttttatgcttaagcattacttttgtatttccctattttgaccgctaacatcaagctttcccttgaagttatcagtcggggggcaactataataataatggagtgtgatttttatcaattcaatttgcttacttgatttatcattgccttgcttgatcttttggcttagtcaatgaggactgaaacttttttaatagcttttgcgggttttaggctcaataaggtttcacaaaagcttttaagaaatcagaagttaagtttgaaatattgagcacagcataaattcatcggtattgtacaaattgtgcctccatcataatcatcatcatcagaatcattgttatgatataacatcaatcggtatcagttttttcattatcagagttatcagatccagtcggctgaaggtcgttgtcctggaatctctcaactacataaactgctatcttattggcggctttctgcgcatcgttgatgaggtcaagagcagcttcttcgctcgtcccgtctgcaaagccatcaatggcgtcaatgtcggtcctcgggtatagagacttggtcattgccaacgccaggcttgctcccatacttctagcctctttgatattcttaaaatatgtatcgggagcaactctcagcttgtcgaagatttcggaagcatcgaatgtactcggaccattgttattgaagaacatggcttggacgagtggggtagtagcgttagcgacttcatccctggccccttcaagcctcttgattttgttgactaagacatcaaattgagcctgcgacttgattttgcggtctgcatcaacagattcacatcaatgagtaagcataaagaagataatggcttttgaagtattgattgctagtaccttcaacgtctttcaaagccgagtccctctgtcttgccaattcagccttgtcgttttccagagtctgaatctgcttttccagttgagatatcttggcggcttgcactatattgcccctggttaattgatattacaaagatgacagcacaaataagttggacagagtttgtgtgtaccttttgatgagccacttagttcaaagttggattcctggagctcgacaatccgatccctcagatcatgctcagtttttctggcaagttctttgacttcgtgcagctggtctctggtggcctgaagggttccgagatgaggaactaatttttccagggtcgcggttttcgcttcattcctgagatagattctctgcaaaacagttttaccggcatttgagctaaatggcaaacaagatggttgatgccgtgcacgaagaaacttacgtttacaatgcgggtagcctggctgagtgcctttttcagcaggcatacttcctcatcttctttttgcttattgatcacaattccttgaggttgcatatcgtcgtcccaccacttgactaaaatgggtggacggtaatcctcagctgactgtatctggaggacttcttctttgtcgctgactatcgggccttaggcatttatgaaaagcgatgaaacaattggagaaagtttgtcagaccaaaatgattttggataatatgcttacctgtgatgatttccggtcggagacgagtgggctcttatgcttttacagaagagctggatcctggatcattatcggcatcctttccgagagggttgtttgcttgagtttcaacttcagggatctcttggtttggttctgtccccgactggtttccagtcgggggctcctggttaactccaattccagcttcggccgactggtttccagtcgggggcatgttgctgggttctacattatcggttgccggttgattatcactcaggtgatcttttgcagtcggcctagtttcttttgaagaacccgtctccatgttagtcagatcagagtcctttccagaaggatctatgtcagatggcttcctacgagtttgagttgtgctatcagtattattttaataatgagtgagcatcaatacaaggaggatcgtcaaacgatttatacctggaagacttcctgattttcagcatgggacgactagatgttttcttcttcggattggcttgtctcggttgatttccggtcgcctctttatttccaaattttccagcatcatcgccttcatcatcactcagaaccaatttgtcgcgaccgggaaaatttcattttcccgaacgctagtgtattaatccccgtcctaggaaaagcaggggtacagcatacaaacatgatataaaagacatatctttattatatcgataatatttacattattacaaaggcacttaaggcctgacaatcaaaaataaacagcagcggactagcgggcctacggctccatcttcacaggcgctcaactggggtataagccaagactccacctaagacttcttctccaaagcttctcttactgaaggggggagaaagatagagcaagaatgagtacaaccacagtactcagcaagccacaccggcagatgcacgactaatgcaagggggtacaaggggtaatgatataggggttaagttttgcagaaaacagcatttaaaagtcacttagttgcccaaagccattttaaaaagacgatcctagagctacacagtattattaatcaaggtcgtgaacccgcacgaacctgccttaacccaaggcctacgatgattcagaccgaactggcaacccgaccctgggtcccagctcgtcccaagccaacccaggccaaccattccacatttagttgttgagcaaattttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacctccgggacaggtaggcaggattgagcccctagcagcaggacaccagccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggcggtgtgaatcccattccacaataaaccaacaattccaaagtgtccaggtgatatgaatatcccaaagtctagagttgtaaaaccgcctaattttacctaattaatcagcgaagcatctacctaaaattatactagtggtactatgggtagagtgtccactagttggggttttgtttattctagggtgaacaaggaaataataacaataacaataataaggtcataacaaaggtaaataggcatggctaaataaaacagtgataacgcgggaatttaaataaagcgataatgcaataatttaaatcaacataattttataaactgggattcaatatgttcaaagatgatgtgacttgccttgctcgctttcccaaacgtcggcttcaacttccacgaagagtggatcttccgaagctgcagcgtctacacgacgagcggaaaagaaaaggcttttactctaataaactccatataacaagcagaaacaaagcacaaaaatgggttcttaacttcttaaggaaaaattagagacttgaacggtccaattccgagttcaaatggccaagttatggccatttgaaggttatatgctctttaaatgaatatttgcgaatttcttcatttaaattttaattcaaaattggatttattgcgtcagccgaggggaggggcgcgcggaccgggtccatgggagtggggcccacgcggcagtctcacggtccacggtggaccgggtgcacccggctcacaccggccagcgccgtgggtccaatgcgtcagccgcacccgagggtgcgggcggctgacggccgggccccacatggcagccgcgggacgcgcccgaaggcggccacgccggcacagccgacgggaggcggcgcgcccgcgccccgatggtcgccgccggcgaccaccggcgcggcggagcggcgcccgagagaggggagggaagggggaaacgaatcggcggtccacggctcaccccgggtcgacggcgacgacgggaacggcgactggagcggagaggggcggctgcgtggctcgggttgaccgggacggcggcgttccggcggtcggcgaccgaaacggagaggtggacgaggtcggcgaggttgcggcgaagccgaaggaggcggcgccgaggcgggagatggtccggggcgaggacagcggcggaccggagctcggcggcgacggcggagagagagagcgacggcgcgagctcgattccggcggagagagagtgcggcgagtggcggaaacggcggagggaggcacggggagtgtttatatagggttgggagggggagagagcggccggatgagggggaaacgggcgcggaagatccggccgccattgatgcgccggcgaggttaggggaggagtttccaaacgaatccgagggagagagggagggaaaaatggggggggggggaaagagggagggaatcacggggaatatttcccccctcttgattgcacgcgggacggacgtaagcggcgggattcgcggcggcggcggcgctagggcacgggcgaggcggcgggagcggcgggaggtaggggatgacgggtgggccccacccgtcagcgagggcggcgggcgggcccgcccgtcagtggcgcgcgcgcggggagaggccaagtgggtcgcggggagaggagggagaggggagggagatgggccgagccggcccaagggggagagggggagggaaagggaactttttagagtttttctttttataaaatcattttaactttgtttatttcttaataattattatttgtgctctgaaaattccactaaaatttgagggctccttttagaccaaggagaatttaacaaaaattctccgggccacatttgaatttttcttgtacgtattttagtgtttgccaatttcttttcgaattttaattaattctattattccttttagaaaataatttttatttcgggatgaatttatcaggacgtgacaaatccaccccccttacaagaatctcgtccccgagattcgaggaggctagcaagaagataggttgggcggtcttctcttcttgtctgacttcttccgctccgtcttcacaaactttcagcaaaacttcaccactcggaactgcttggcttgacctcctgttgcgggtggaatcttctcttcacctgacttgaaccagggtgcaccttttagctgactcagactaggttgcggtagtttaatgatgcttccgttccagaacttctcatgattcatatcttcggagtcaacctcatacaagttaccacttcatgtcatgcgtcgacactagcttgtcattactaggataccatgtttgtcatcataagaatatcatgcttgtcattcacttctaacttgccaccaactgcctcatattagctttcccggtctccgggtaatagctacttctgctatttgatgcaagggtcgataactttgcctttgaattatgcttcccaagagaaccaacttatcccacttgacatactttgacgtcttcccaaatggctttattgctggatttgttattgtctaatcattatcctgccaaatctgaggcttcgttgttagatgtgcttttaatctgacctctgtagattatcttcgaacatatcacttgattcataactgggaatagctctcacgaacaagcaactcggattcactttcttt

SEQ ID NO: 58096 - DNA, 21830 bp, Oryza sativa
  unsure (1)..(21830): unsure at all n locations
gtgtttccgggtgccccccaggttgacgacatcccgccggagcagcacgcgctggtgccatcctacatggggggcggcggcggcggcgggaagaggatccacccgctccccttcgcagatccgagcgttcctggtgggtgatctggtttctggttggaatctggttagcttctgctgctggtggtgtgagttgctgatcgatgtgcttggtgtttggttgcagtgcaaccgagatccatggacccgtccaaggatctcgccgcctacgggtacgggagtgtggcatggaaggagaggatggagggctggaagcagaagcaggagcggatgcagcagctcaggagtgagggcggcggcgactgggatggcgacggcgatgcagatctgccactgtatgtgaccacctaactttgcttgctcaccaaatgttagttagaacatgtggttacagtgattaaatgaccgtagctgcttcccatggcctgccgttgtctaatgcttagactatctttagaattgctactaattgctatattaacagtacatgaacaaacatatatggaaagtcttgtttgatggaatgctaaaaagaatcttactgtaaaaatgctgacatactactattttttttgccaataacttaatgttttgttacttcgtagaggatactcgtaagcctataattggacagatcccagagaaggaatgcaactatttgtgctagattaacataattgccttacatggtttttacccgcagtacattatttttgttttatcttggctacttcactgtttgaccatgatttgcatttgggcttggttagtttaatattcatggaaaatattatgatgtaatgaaatactaatttttgcatgtcatatgcttggagtttcatcgtcaattctgtatgatgcatagacacaataggttataatttaattattatgtaaggatttgtcttttccttgcaaatattgttactagactctggttgtaaagtgtctctttaatctgttgaccagaatggatgaagctcgacaaccactatctcgcaaagttccaatttcttcaagccgaattaatccctataggatgattataattatccggttggtggttttggggttcttcttccactaccgagtgatgcatcctgtgaatgatgcatttgctttgtggctcatctctgtaatatgtgaaatctggtttgctatgtcttggattcttgatcaatttccaaagtggcttcccatagagagggagacgtacctggaccgcttgtcactgaggttagttaaatccccaaaccaagaaatacttgccctatccttttgctgaaggtttgaaggtaacaaactttttgcttgtctgatcaggtttgacaaggaaggtcagccatctcaacttgctccagtcgacttctttgtcagtacagttgatccatcgaaggaacctcccttagtcacagcaaacaccgtcctttccatcctttctgtggattacccagttgaaaaggtttcctgctatgtttctgatgatggtgctgcaatgctcacatttgaagcactgtcagaaacatctgaatttgcaaagaaatgggtccctttctgcaaaaagttcaatatcgagcctcgtgctccagagtggtacttccagcagaagatagactacctgaaagataaggtagcagcgtcctttgttagggagaggagagcaatgaaggtagatgtcctcatttgttcgtgcttttctactcgattattctttttatattatagctagttacacaagtttaattttcatccagagagattatgaggaattcaaggtgaggatcaacgccttggttgccaaagcccaaaaggttccagaggaaggatggacaatgcaggacggaagcccttggccaggcaacaatgtgcgcgatcatcctggaatgattcaggtaatgcttttgcaattttggtgttttactacacacgtgcgattcttctttctgtgttactttagttcaaagtgttcaattttttgtgtcaataggtcttccttggccaaagtggtggccgtgatgtggaaggaaatgagcttcctcgcttggtttatgtctcaagagaaaagaggccaggctataatcatcataagaaggctggtgctatgaatgcattggtaaaagatccttcacataatgtctcgtatcaatttccatgtagatttacagccttagcaccgtttgacatggttttctctctctttgttgtttgacaggtccgcgtctctgctgttctttcgaatgctccatacctattgaacttggattgtgatcactacatcaacaatagcaaggccataagggaagcgatgtgtttcatgatggatcctttggtggggaagaaagtgtgctatgtgcagttccctcagaggtttgatggtattgaccgacatgatcgatatgctaaccggaacgttgtctttttcgatgtaagattcagcctctctggtactaagaccttgtggtctatattatgcttgttactattatggttcctaatatttgcattgtacagatcaacatgaaaggtctggatggaattcaaggccccatctatgttggtactggatgtgtcttcagacggcaagctctctatggttatgatgcgccaaaaacaaagaagcccccatccagaacttgcaattgctggcctaaatggtgctgctgctgctgttgtggtaacaggcatactaagaagaagacaacaaaacctaagccggagaaaaagaaaagactgtttttcaagaaagcagaaaatcagtctcctgcatatgctcttggtgaaattgaggaaggtgctccaggtattgtcagcttgtctaacaattgtcaaataacataaggtaacataagaaaaacatcacagtaaaactcaaatgtttctttactgcaggagctgagacagacaaagctggaattgtgaatcaacagaagctagaaaagaaatttgggcagtcttctgtttttgttgcatcaactttgcttgaaaatggtggaaccctgaagagtgcaagtccagcttctctactgaaggaagctatacatgttattagctgtggttacgaagacaagacagactgggggaaggaggtaagaaacctagacctgattataaactgatggttaatcaattgaagacgttcctctcacctgtaaatcatgtattcttgcagattggctggatctatggttcaattacagaagatatcttgactgggtttaagatgcactgccatggttggcggtctatttactgcattccaaagcggccagcattcaaaggttctgcacctcttaatctttcggatcgtcttcaccaggtccttcgttgggctcttggatctgttgaaattttcttcagcaaacattgcccactttggtatgggtatggtggtggcctgaaatttttggaaagattttcttatattaactctatcgtatatccctggacatccattccacttctggcttactgtaccttgcctgccatatgcttgctcactgggaagtttatcactccagaggtaagcattattgtgctacataattttgtgatcttctgagtttctgtctgaatcttacatcatttttatttcaaactgcagctcaccaatgttgctagtctatggttcatgtcgcttttcatctgtatttttgtcactggcatccttgaaatgagatggagtggtgtggccatcgatgactggtggaggaatgagcagttttgggtcattggaggtgtttcttcacatctcttcgctgtattccaaggacttctgaaagtccttgctggtgttgataccagcttcactgtgacatcaaaggccggagatgatgaagagttctcagagctatacacgttcaaatggaccaccttgttgatacctccaactacactgctgctgttgaacttcattggggttgtagctggagtttctaatgctatcaacaatggatatgaatcatggggacctctgttcgggaagctcttctttgcattctgggtgattgtccatctatatccgttcctcaagggtttggttggaaggcaaaacaggacaccaacgattgttatcgtctggtccattctactggcttcaatcttctcacttctatgggtccggatcgatcctttccttgcgaagaataatggccctcttctggaggaatgtggtctggattgtaactaagcagcctacactccatatatgcggcgatacgagcttgaagaaattattttgcaggcggcgaatcaagcccaagtttttaaattctttcctgtagatagaaatacagatctccggcatttcttttgttccacagtggtagggcagcttcatctgtgtgtattagggcaaaccagaagctatgtcaattcttgtgcagtgctaccagagaagtcaaatctactcctgtggttgatccaagattatttatttatttggaggggatttccatcatcgctgagcttacttggtggaagctgcagcatgtgtaagctaagttacaaaggcgttgccttgccatttggacagaaggaaggaagatgccaattgtttattttagtaaattaaaattgaattgaattatgcacattccggagttcatttgttccactcaataccatacacagctggctggtggtacatttagcatgaacagatttgtaggtgtttagcaaatgtacctaagttggattcatccggtgtgtggtgttgtacaagtggccatacagtagcgcaagtggtggtgggcacttcactcctgtttgttttgtgtaaccatacagcatacagatgataaaactcttgttcacattttacagagagggaaacttggtgtttattttctccttctaatgcctgatggtttgccagcagtagtagtatctgttgctgtgtatgctgtttttattttcgtttgcaaaatctgttactgcctggatggaagtagaacagacacgtcggcggtgtttgaaaattgaaactgatgatgacgaagatgaagattaaattggtgcactaaaacaataaaacaagaaagctattagcatatgattaattaatttttaattattataaacttgataaatatatttatttgatattttaaaacaatttttggaatatacttttttagtagtttgaaaagcgtggtaacaaaaatcaaatcaagataaaatctgtatctcaacgacgagaaaagaacaccgatgtgtgccagcgtaatggcaaattgtcaatgcagatcattctccgtaatggcaaattgtcaaagctgatcattcccagagatgagcagatatttgcgcagaaatcgtgtgtggccggcctgaaaaagtgtagcctgaatgcgtgtctgatggaaaagtggccagcagctgtgtttacggggaccatgaccatacatgccacggacaccggcagggcaaggcagctagggttggggtcagtcagtacgagacgaaagaaggcactggcaccgaccaaggtgccatggggcctgcggggtgttaaagccgccgtgctgggaagacgagagcagagcagagcagtcgtgcgtgcagaagcagagagagagagagtgtgtgtctcacgcggtggcagcgggcgggttggcaggcagcgttggagctggagggagtgaaagcggaggacggcgcggcgcggcgcggcttttggttttggaccggacgtgtcgtggtgaccgtgacccgtcctgctggactcacgggcgcctcgtcctccggctccgcgttttggctccttgctggtcgtccccgtccctctgccggaattaatggatcatatggaccagacgcgcttcatttttctgtgagtaactgcaactgtatcacatataggcatggtttagttttcaacttttttctttaaactttcaacttttttatcacatcaaaacttttttacacacgtaattctaacttttccatcccatcgttctaatttcaatcaaacttttaattttggcgtgaactaaacatacccataagaatataagatgagaacatatagcctttgtataagatgcaacggcatgtatggggcgtattgttttcttttgttaatcctatctaagtaatttttataaaaccttatccattatggtccaaagttatacaaatcatagatattttaatacatgccacgtaactacaaatatcataaaggttcacaaaacaacggaatactcctatattaaaattttaaaaagtttagtaacatttatatgacggataaataactcataaaattgaaatgtgattgtaaaactcaaaagtgtggtggttcaaaatcaaaatgatcagtagtatggttttgtgaaactctataggtttatctatcatgtgtcaaaacccctgtggttttatacaacttagaccataatacctagggttaggtgaaatttactcatccttttatttcaacttcatgctagtttttggtttggtgccctttcttgacgaggacatcctccactatttcccgctggcaaagacgcaaaagtcaggcggcgactgtgtgagcctctgaataatcccactttgcttagcttgggaggtgaaaaccaccttaaaggggagagccacccttcccccattggactagtcttttagggagattgggcctttccccgagtgggtgtgcctaagaactgttggggtctggacaatcttaagttattgggcctcggccgaccccacctgagccggattgctatcatttggtatcagagctgggcccttgtttaagggggtgggattgatgaggacatcctccactattacccgctggcaaagacacaaaagtcaggcggtgaccgtgtgagcctttgaataatcccaccttgcttagcttgggaggaggaagccaccttaaaggggagaactacccttcccctattggactagtcttttagggagattgggcctttccccgagtgggtgtgactaagaactgttggggtccgggcaaccttaagttattgggcctcggccaaccccacctgggccggattgttatcatttctccctcagtcccaaatgtaccaaattttaaaggatgacatatgtattaaagcatgagcattgcaagctcctctttggccattcataatgctcttgcgtgatgtgtggactcgtctagccacgtagggcactggctgctgtggaggagagagtaggtgaggtccatggctctagtttggttctttgtgtcttgtttgagctacgagagccttgtcctgcaaagcgtcaggcgcagggcccactcagtgagtagacgaggaagagaggagaagcgacggagttgtacaagggagaaggggaagcggctgcgctatgcattgtggttgtcgccattgagggccgtcggggttgccatcgctgagggccaccaggagcagatcaactgccaagtcccctgcccatgaagatacaacgatgatgctacctctgcaagcatttcagtcgctgtagtcgttcaactatgctcgaagttgccattgaactcgttgcattggcacaagcagatctgaagcagcagcaagttcggatcgccacgaccaccgatgtagccaaggccacctcgaccatcggtgcggcctcctagaggagtgctacacatctgtaggcaccgtggttcctcttcttgttggtggtagcatcggcggtggccggtgagaggatgacgatgccggtgtccttgtggagcatgagcccttgggccacaccgtcgatgtcgcggccgtggacaaagaggagcacgagctcggtctgtgccatcggagctcgatttggccccgtcaaagctcggttcgtggaaagggagaggagagggaggttgttgccatcatggcctcctgtcgcccttgctgccttcgtctgctgagccgccgccgctaggttctagggaggagatgcaccgggggaaggggagaagggaacaatggctgttggtgaaatggtaactagggtacccctttccctatggatctagcactcttttcatattaattaagatgaaaaagcttacttagaccatcataaagctaaggcgcataataacggggcttgggacccactgtaagggtgagtcctagggcccctatctcgcgttacaagatggttattgtcgacatttgatgtcgcgattccggtatttgcatagtatggggatcgttggtactaggatatacgcgagaccgaggtaaaagagatggagacgaggatttttatacaggttcggtgtcatgtccgaaaacgactctaaaatatatcctttaaattatgcctagaataattaaaatccgtatgtgaaagcctccaaaaattaaaatgtgcaaagtaaaagtcaaaaagggcttagaggatttttgtatatttcctaaaagcctaaaatgtgtaaataaattttagtggaattttcagagcacaaataataattaagaagaaataaacaaagttgaaaaagttttaaaaaaaagaaaaaccctaaaagtcccccttccctcccttgggccggctcggcccatctctcctcccccctctctctctcctctccccgcggcccactcggcccctccccgcgcgcgcgccgctgacgggcgggcccgcctgccaccctcgctgacgggtggggcccacccgtcatccccgacctcccgccgctcccgccgcctcgcccgcaccctagcgccgccgccgccgcgaatccgccgcatcccgccgtccccgcgtgcaataaagtgggggggggaatactccccgtgattccctctccctttccccccatttttccgtctctctctcgcattcaaacgggcggatttgcccccgcaaatctcgccggcgccattgatggtggccgacctcccgcgccggtttccttcctccccggccgctctctcccccttccaaccctatttaaaccctccccatgcatccctcctccgtttccaacccttgccgctttctctccccgtcggaatcgagctcgcgccggtgtcctctctctccgccgtcgccgcgagctttggttcgccgccgtcgtcgccccgacctcctcccgcttcggcatcgcctccttatggttcgccgcgtcctcgtcgacctcgtccaccccttcgtttcgcccgccgaccgccggaacgccgccgtcctcgtcgacccgagccgcgccgccgcctctctccgcttcggtcgccgttcccgtcgtcgccgtcgacccagggtgagccgaggaccgccatctcgcttcccccttccctccctctctcgggcgccgctccgtcgcgccggaggtcgccgccggcgaccatcggggcgcgggcgcgccgcctcccgtcgaccgtgccggcgaggccgcttcgggcgcgcccagtggctgccacgtggggcccggccgtcagccgcccgcgccctcgggtgcggctgacgtgtgggacccacggcgccggccggtgtgagcccgggtgcgcccggtccaccgtggaccgtgaggctgccgcgtgggccccactcccgtggacccggtccgcgcgcctctccccctcggctgacgcaataaaccctttttaaactaaaatttaaatgaagaaattcgcaaatattcatttaaagagcatataaacttcaaatggccataacttggccatttgaactcagaattagaccgttcaagtctctaatttttccttaagaagtcaagaacccatttttgtgctttgttcctgcttgttatatggagtttattagagtaaaagccttttcttttccgttggtcgtgtagacgctgcagcttcggaagatccgctctttgtggaagttgaagccgacgtttgggaaagcgagcaaggcaagtcacatcatccttgaacatattggatcccatttttataaaattattttgatttaaattattgcattatcgctttacttaaactcccgcgttatcactgttttatttagccatgcctatttacctttgttatgaccttattattattgttattgatattattaacttgttcaccctagattaaacaaaaccccaactagtggacactctactcatggtaccactagtatgaatttagttagatgcttcgctggttaattaggcaacattaggtggttttacaactctagactttgggaatattctcatcacctggacactatggaatggatggattattgtggaattggattcacacctccccctctattcaaaatcctcaaaatggttttaggctgggctcggggtgcatggttttgattgtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctagggcaaatgaaggctacacgagctgcggcccggtagtcgagatgtcatggcacagggccggtgtcctgctgctaggggctcagtcctgcctacctgtcccggaggttccggccgtaggtggggttgggtcggtactcttgtctatggctaggatgggttggaaactatgtcacgtcttccgtccgtataccgtggtggtatgtggcacgtggttacacgtgagaaagatgtgtcttgtgggtaaagatgtacacctctgatcagagtataacctattcgaatagccgcgccctcggttatgggcaagcctagcaatgtacccaagttagtgttttaattcttaaaaccttcttaacaactaaaatgtggaatggttggcctgggttggcttgggacgagctgggacccagggtcgggttgccagttcggtctgaatcatcgtaggccttgggttaaggtaggttcgtgtgggttcacggccttgattaataatattgtatagctctaggaccatgtttacaaagtagctttgagcaactaagtgacttttaatgttgtttactgcaaaccctaaccccctatattatggctcccttgtactcccttgcatttattctgcacttgtgggtgtgtcttgttgagtatggtggttgtactcagtcttgctcaatttttcccaaacccagaagaggagttcctggaagatgaaggctttggtgtctagctcgtgcttgccgtcaagcgcctgtggtcgtcgccctagtcttccgctgtttcccgtttgtctttgtgtatgctgggccttcgccgcccatgtaataaattaattatttacgcttccgcttgataaactctgaaatgtatcaacttttaggtgtaccttgcctcctgggacaagaaataatacacgcacgtaaggaacgcccgttgggttatttccggtcatgacattcgggcccctgaattgtcaggtaataaccctacatcctgttggccgaagccggtcgttgctcttattcaccataatcacaccagtataatatttggggtagcctatctaactgttgtcgatatggcggtctgaagttctgactcgtagtcgacaacagggtagtcttcctcctcaagtttgtgctcggcgagatcagagacagcgctagatccctacggccggcctctgaaggtaccggatagggtcgatctagacatatctctgatgtcgatatccggcggcttgtcttgacgtatgttggcttgtattggcttgtggctttgtggcgtctatggtgggtgtcttccatgctgggcgttgattgtcctctcctcctagggggtcttgtatttatacccataggtgtccctttgtccaagtagagctagggaaaccaatatggatacaatccgagtagtccttgtcgtttccatgtagaactctggttatccttccttatccggaactcctatatccgcaggttgtttccgtataggacatggtatgtggtgggtcctgccgagatttagtcaactactattaggtatgtgctatccataaccctgatagtagcccccgacttcgatgcaaatgaacgaattcatattctcaaccgtgcgcagaccttggagtaactgttatcgtgctaacgtgaccgttctcggtgagtttagagttaacgttagacttcctttatcagcctcgtgcgggcacctaaagggttttgtctgagtcaatctctgacgtcaaccaagaaagtacagaatatacgactatgtctcccatcttgctgtaatcgagaatttggattgaagtcaagaaatcttatctcggcgagtacaccatctcttcattccgtattccttgttgagatccaccaactgttctcgagtgatcgagaaggcacagagcttgcaacgaaaccttgtcaacatttgttgtgctcgccttagtcgatcttggtgtgtagaaccatagagacatggagtcttcgtcaatgtcgaatagaattttcctgaaatcaatactcagaaaagaatattagatagaaatagcccccgagcgaatgctcaaagggtgacatgttataatatgtatagaaaattgaaaatgaattgaattttacagaccaatgttttgtatatgagcgtctactcttttaccgacttcgatcagtcagtttgttgagttatacactctccctagcccctagccttgtcgtcggagaatcgttctcggaagataaggctcttggacctttgacctgcctcggttgaacaagcactgatcctagcccccagtcgtgaagttggaaaacccaatttctgattatacggcttggttaatacgcacggcgagaactcttacacaaccagctcttacatggtcttttgtctctacaggattcgacaaggccttatcggctctgggcgtccctagccgaagttcccttaggttcctcggaggccttgtcaagacagcgtaaagggacatgaggataggtttgaacgctaggtgtcatcgtggtaagggatctctgggtaaaacacttggcaacattgtgtacctgatatcaactttgttgaggtagaggtagtgggagaatcgctacacctctggtcgaggaccaggtagtagtcgtactcgactacttgaagtggaaatagtgggagaatcgctacaccactggtcgaggaccagatagtagtcgtaactcgaccactagaagtaaatgtacgagagatcgcgacaattgactggttaagaactagtgagtaggtgtctctcgatcatttggagtcgtggtatgagggccgctacgctgccggtcgaagaccagtcgtagctgttcctcaaccatctgaagtcatggtgcgaggaccgctgcgttattgctgtagtcgtacctcgaccatctgaagttaatgtgcgagagattgctacgttttactagttcgagaaccaacgagcgagtagaattatctctcgaacaccaatggaagttgcggtgcgagagactgctacgtactagttcgagaaccagcgagcgagtagaattatctctcgaacactaatggaagttgcggtgcgagagattgctatgtactggtttgagagccaacgagcgagtagagttatctctcgaacaccaatggaagttgcgttgcgagagattgctacgtactggttcgagaaccagcgagcgagtagagttacctctcgaacaccaatggaagttgcggtgcgagagattgctacatactggttcgagaaccagcgagcgagtagagttacctctcgaacaccaatggaggttacagtgcgagagattgctacgtattggtttgagaaccagcgagcgagtagagttatctctcggacaccaatggaagttgcggtgcgagagattgctacgtgctggttcgagaaccagcgagcaagtagagttatctctcgaacaccaatggaggcgctagagttggtttattacatgtgcatctcatgtggccagcatgactcacacacccaacttgtagcatatccggatgtccgttcgcaatcatgtcgggtgatcaagccgacgacgttcgcgaggaattatccgttaacaaccttttctcgagtagtccagccatggccggtactatgagataggtcgtcggtcttcgttggtaggttgggcacgacgactcagcatttgtcgagatcgttttcgataatgcggtgtactcgaccacaacctactcaggtgctcaattgttcctgaagaatattttctagaaggcaagacatatagtagataatatcgagtatgtactcaaaaaactgcatggatcttctagtattatcaggacataatgagcaaatgtaaatatcaggcattatgcaaaccgtaagcaagcatgattcatataggagagaacagagcgagcccccagcgttagaccgtagtcgatttaacatcggggacacccgcgcaacagatattgtataaaaacatgctctaggtaaacaaaataaatcatggatttgacaatgctgtatgatctgaataggtacgataaattgcagataaactattgcgtacctttgtagatacatgccggatgtatctacgaaattagtagatcaatttaaaaaaccaatctaccaattaccttgttgcgtactcgttcgatatcatgcgatctgacatcttttggtacgccgcggagcttgaggcttggatgatctcgatagaccaagttgttgatgacgatgatggttccgatctggttaggttggatctccccctcagctgaagtcgtcgagtagctcgttgtcggagaatccatctcttaaacacatctcgtcgaaaccttgaagcaccaaaagatcccctacttggcgcgccactgtcgacatttgatgtcgcgattccggtatttgcatagtatggggatcgttggtactaggatatacgcgagaccgaggtaaaagagatggagacgaggatttttatacaggttcgggcccctgaattgtcaggtaataaccctacatcctgttggccgaagccggtcgttgctcttattcaccataatcacaccagtacaatatttggggtagcctatctaactgttgttgatatggcggtctaaagttctgactcgtagtagacaacagggtagtcttcctcgtcgagtttgtgctcggcgagatcagagacagcgctagttccctacggtcggcctctgaaggtaccggatagggtcgatctagacatatctctgatgtcgatatccggcggcttgtcttgacgtatgttggcttgtattggcttgtggctttgtggcgtctatggtaggtgtcttccatgctgggcgttgattgtcctctcctcctagggggtcttgtatttatagtcataggtgtccccttgtccaagtaaaactagggaaaccaatatggatacaatccgagtagtctttgtcatttccatgtagaactctggttgtccttccttatccagaactcctcctatatccgcaggttgtttccgtataggacatggtatgtggtgggtcctaccgagatttagtcaactactattagatatgtggtatccataaccctgacagttatatggtttgaagggcacgggtccccagcctgcctagggacctgggcccacctttgctctggtaggttacacgtccctcccaaagaggagcgtagatgcctacaagatctatattttaagaataaggctgagggaagcctggatcctagcttgctctgggacctaggcccatctttgcccttgtatgttactcatccttccttgagaggagcgtggaaacataaaagatctacatcttaagatcataaaccaaggcggagggaagcctggtcccatcctgctctaggaccaatgcttgcctttgcccttgtattttgcatgttcctccttgagaggagtgtggaagcatacaagatctacatcttaagattgaaggctgagggaggccagggtcccagcctgtcccgggacccgggccctcatttgcccttgtatgttacacattcctccttggtagaagcgtagaaacgtacaagatctacatcttaagatggaaggctgaggaaggccaggaagcctgtatcaggacctaggccctcccttgcccttatagataacacgtccctccttgagaggagtgttgaaacttacaagatatacatcttaagattaaggctgagggaagcctagatcccggcctgcctgggacccggccccacctttgctcatgtatgtttcacctctttcctcaagaagagtgttgagacgtgcaagatttatgtctcaagcaaacaaaccaaggggagcttgaatcctagtccagcttgggatccggtcccccctatgtccttgtaggttacatgctcatctttgagaggagtgtcgagacatataaaatctatatcttaaaattgtaggcaaaggaaactgggtcacagcttggtctgggacttggtccctcctatacccttgtgagatgcatctctttccttgagaggagagttgagacatataagatatacacatttacaacttttcatcaaagacatcttcaagaagctcgtccaaaaataactaaactaccttttctaggacaaggggcacaaccagaaggctttgttgagtagtgaacgtgcccctctaccagctatgggcaaacgtttactgccataaatgaaataggtttaagagggaaactccaagtggcctggggtaaaagacatggaaaagacactaacgctgagtgattagggacaacgggcgtctgtacatgcgtcgcgcatgcccagcgacacacgacttttccaactggacaaaaaggagctgtggcactattttgggtaggttggggatcggtaggcccaccacgagctacatggagctggcccaaaccaatgcccggagagcctggggcaacttaatcacatatttttggtaggtttttcaagaagattggaaggaaaccaactggcagtggcaagacaaccaagagagaacatagaggaaaagcaaaaatggtaatctgagcccctccttggactataaaaggaaggggatatgccactaagaaagggatgcttgagtttagcttgaaaaagtatagtttgtatttttctagatccagatagcaaacacaaaaaattaggagtagtatattacacctccgggtggcctaaacctgtataattcttggtattggttggattgtggggaactcgtgccccatcctaggtgatttccacacatcgattgtagccaacccctggttgaatcttcatcaggggacacgtctgcacttccctgctgctagagaatcgcctctccgatagtggcggtggagaggagagacgccagtggaggggagaagcggcggcgctgtacgaggagtaggggattgggtaagagggagagtttggtggggaggagaaaacgtataggtcaggtctgacatatgggtccggcaataggctagatatatgtgtactcctttttgttgttatagggtgtaaactataaaagttttaatttattcgacaatagaaaatatcatagggattgacaaagaaatgactagggtctgaaatcctgtaccatgggttatgtgctctaaatgaatcttgtgcttatgtggcatttaagggtgcttaaatgacgatcccgcactgtgaatgtgtcaggtaggatgaagccttggattcagattcggtgatattgcgatagcatggcacggtgtgacattggagtgatctggggcgttgaaaactaatccaatggtccgctgcactggcccacctgcaggactccgttttcaccccacgcgcctacccttcttgccaaacgacgtctcctccaatctcgccccaatctcgcgtgctcgcatcgcggcttccccacgccagtctggagaggcgccaggccaccgcgccgccgcgagtgaggaggggactgggcggccgcctcgtcgcttcgcctccccttgcccgtgtcaggccaccgctgtgagctagctgggagccgccaccgcgccaggccggagaggcgcccgccaccgcgccaccgcgactggggaggggactgggcggccttttcgcctcccctcgcccgccttaggctgccgccgcgagctagctggaggccgccgcgccgccgcgagtagggaagggaccgggcggcggctgcacgaggaccctgatgtatctgaactctgtgttggttttggcatatttttgatgtttggagttccatctcgccaattctactgaacatatgctagctaatccaacagctagcactaatagagcaacagagccaaagcacccaactgaaagggaaacacacagcaaaattgatgaagcacaggggcgcgcaggcacctcttccgcaccgggaggcggttggacctcgttgatgtcaggcccggtggctggctgcctccacacgcggcctgccgcggtagcacggcagggccccagccccggcctcacgtggcagccgccagaccccctccacactcgcggcgagctagtcggcctgtcacctttccggtcacggtggcggcgactctcccagattcagcggtgacactccccgctgactcacggacgcgcacgatgagaaattgggggcatcgtgtcacgccccgaactagtaccgaccggaactagcccttgacgctccaaattaacctgttaatcgataccagtcccaggaaacagtgctggtatcacaggaagacggattatcacagcaacagaggtctctttattatagagtagaggtacagtcatgttgggctgcggacagatcccgagctcacaactgcattacaaaaggggaacggaagccaggacttggaccaaacaacacaggcgcgacttgggaattaggccgaaaccctaaaactcatcgtacccggcttgctcctggaagaactcctcatcagcaggatctgcttcatcttcttcagcaactggggggattatttatatagagcaagggtgagtacgggagtgctcagcaaaccatgggaaataagtgtttaatgcaggcttcaaggaaatgctgttgtttttacaattgattttattcaaactcttttctaaaaacaactaagtgagtgcttctcaaacgacacggatgagacagtgcgtctcatccagtcggagtatgtgcaatgtatcagtctttagaattgttcaagattggcacccggccaacaactttcaaacggccacccgggccaacaactttcaaacggccacccgggcctagctgatcccatcagctgcagatttttcaaacatcgaacccctttccaccacagcaatctcacaaggcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcatacttgtcttatgtttggatgaaattccaaggaaacggtccttaagtgcgagagcgggaaaccgtacacccggtacgtcccccggtccgcggctttggaaattcatttagttcgcaagtaccgacccaggtgtcgggttttccaagtcttttgtaaaacccgagttttacccaagaagtttttcagattttaagtttgaaggcgtccgtcgatactcgcacagggtgcacgaatatcgagacgcaactagatggttacaaggggacacgatataacaattatcaaaggaaggatcaaatgcaacaaattaggtaggtccgccaatctgccttgcagacgggacaacagtttaagcgcgatcctatcaatgcataatatttttcaagcaacataattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacggcgaaaaaagccctattaatgacctctatgcgtgccattagatagatctcgagatttgaggaattttggaagttgaacggagtcaaacggatttacggttgggaagatattgaatttctaagattattggattttttggtctaaaagaaaaggatttaattaaatcctttatgaaaaagaaaagaaaagaaaaggaaagagggagggaatatagacttttctcgggcggcttagggcgccggcccaagagaaatggggcggccggccgagctaaatgggccggccggcccaaggcggcccaagacgcgcgcgcgcgggagggaggagaagagagccggtggaccgggctcaccacgcgcggtcccgggtgggacccgcttgtcggtgacacggctcaccatgcggagcgagcatgcggcgtacgcgcgcggcctgnggagggacgcggtgcacgcgcgcggttcgcggaggaacggttgcggcgggcccacgcgcagcctcgcggctcgtggtggaacgcgcgcacggaagggctgaccggggtcggcccgacccgatcttggccgagctggcgccgacgtggcgtctacgtggcgcctacgtggctgccacgcgggctggcgggaggaagacgaaggcgccgcccgtgaatggacggcgggcggcggcggtttctccggggcgccttgcgacgatgaggggcgacggggcgtacaccgggatgacgaggaagaaagagagggagcgagccaacggcttggattcgccggagggagtccgtcggcggcggatttcggcggcggcaaccggcggagagcaaaagggggaaacggcgatgaggtcacgaggggccaattcccggcggtgagagcatctacgcggctacgggaatccgttgctagcgtcggattgggcggagctacgccgagcgaggccggcaacaaccgggtgctacggagcacggccggcgacggcggcgagcacactgcaaccggcggtaacggtcggggcggccccggctagctacggggaggctactcgagctactaccgaaaactaaggggggaagatggagcgaggagggagaacggagggaggcactatcgagatgaggaggggcgctgtgacgagaggccgacggcgcgggagtaatctctccggcctcgggccggggaagaggaggaagacgagcgcccggagtccccttccgcgtccacgaatgcaccggctttcccggcgcttggcgatgaacggcggaggcgaaacaaaacttcgaaaggcggcaacaatggcaatggaaggaaaaaaaaaggaaggccccccgggccttttaagggcacaatgtcggtttggaaccacttgggcggtcaagcgcgagctggcgctcggcgctcgcgtccaatcggcgacagggtggagggaggataacgcccggcgggaggaaaaaggggaaaaggagggagagaaagggggctcgtccctttcttctttgggaaaaag

SEQ ID NO: 58097 - DNA, 8849 bp, Oryza sativa
tgtgtatgatagatgagaccagatattaatagtgtagtatgtaactattgtatagctattagattggttataaatgaattagagttagtagttggctatactatttaacttgcccttatggacacatctgacacaagaagtctcatgcagattgttgctctctatgcagcctggactcctcgaaatcttcgaccagcataacttaggttcgcgaaccctgaacccgttctcgacttgggtcatcgttccgtaatttcttggttcatgacccaactaatgatttttcttattgaggaggcatactcaaggtcgtaccacatttctttcaggtcgcgtcccatgaagcacgacaaagtatttcgtagggatgcaagcggagtgggcaagtcggcttttttatcccgcttgtgccacttctagtttattttttcttctaaattttatactatcatgtgaaaaatagactagcaagcgggtttttatgtgggtagcgggactacccacttgcatccctagtatttcgacccattcgactcgagttgttggtgaccctgacactactacacaaaaaattctctgtacgatgacccttataagttgtagatgaactataattgatcgcacctgtaaagattgttttccaagggaaggttcacggcgcatgcggtccttaagagatccgtcaatgaaaatagacttatattttaggtggacctcttaagagaccgcatacaatttttgcatgtgggcaaaggggtgagtaagtgggccccacgtaatatcccgctccttttattctcctactcattctctctaccgcacctttcctctcctactcttgttatacactcctacttcctctcatcccttcctctcccccatcccactctagcagctaaggcggatgcggtgggagcgggcaggcggcgtcgacggcgaccactactacgatgaccgacgacaacttccgcgacgaccggcggcattggtggagggctggatctgctagtgccaggccttgggtgagcgggatccgctgccaccaggccttgggacgcacggatctatcgttgccgggcctcggcaacttggaccatgtcggtagtgatggtggcggcctcgagcgacaaccacgacggtggatcctggcacgacgacggcaacggatcctacgtgacacgaccgcggattagggtttctgtgttatatagatctagggtttttgttttcggaattgttttgtcgccaaaattatttttacatgcagacggcttaagcatctgcttgcgaaaatcggattttcgcatgccgttttgctagtgggccacccgtctgcatgcaaaaatcacttttggccgcatcggaaaacgatttccctatcaactacgagcacaagagccacgccgccgcaccaccttggtctccccatccagcgctgcttagcgcccccatctgaagatgcgtcctcctggatccagacgccaccacttctgctgccaccaccaactggagccggcccgcgtcaagctcctccatggcctgtactgctgctcgtcgaagccgtagcccgctgcccaagttcatgtcgacaaaccacgctgcccacgaaattcttgcccttgccttgtgatttgctcgatcgattgctttggttgtagcaatccgatggaatccatgctgattttattgggtttgagttcaactcatgactatctcagaatcctcgttcttcccaatacgtgtacggctaggtttcctccttgattgtttggtatgcgtgtctaagggtctgtatgggaaagcttctaactgctgcagtttctttcagaatcagaagctcctccaaacagttcagattttgatccagattctaagaaactgtagttgtagaatctagtaaatgaactagaagccaaaagctaaacccagcttttccagattctcagaagctggctcaaccagttgcttctcagaatcttatgctccccaaacagaccctgagtgtagctccacgtccaagtaatctccatcgcaactgggcacacagaatacgaatcccacacgatctaggcttctctgaagcctgccacgaccgacatcgtccctggtcactttctcggctcagcctcgacatagatcgcacacaccgccttaaattgggtgaccacctgagcctcatgtacatcctgcagccttgagcaccttcacaagtaccttccgtcaactccgccatcgacgaagccatcgatctgtagaattctgtgcatgtcgcatgctgctggtacactgtcttcatagcaatccatcgtttaaaaaacttagtcgacaacacctccatcagcactctagggtccatctgttccgacgtccgattgaatgccatcaatctagtcacgagccgagacagacaaatcacatgtcatccttccagccaccgaacgacccaagcgctacatctagcgatctttctgtagaacatggctcatagaaaggcctgggccaccctgcccatagtgttcgattccatttactgagaacactgatcgcctgcaactttcaactcgagcatggggccccatatctccctgttgagagtagctaagaggaaagtccgggccacccgctcaaagtgtctgacccaccgaatggatcgccaatcgctttcgccgccatcaacccgagcactacgtctagtcatctttctgtcgattgcagctatcgaacggttcagaccgccgcatgaaatgttcgatccaccgattaaatcgttgctcaccgacatgctccaccttgctcacatgtcccttgctagatataaaccgcaagcggcgggatgtcaagcatctccatcgcgcctctaccatggatctcctgtaggctctaatactacttattatagagcaagcccgaaattaccatcgaaaaccaaacgtggcagaaacgccataggagatccaaaacagatgacgttaccgaggcacgatatgtgataacgaatttcagctgaagtctacatcttctgggtactgattacaggtgctcctctctcatccagcatattatagcttatcagagttacaatgaccctcgaccagataccgatggtagtcgctacctctcgcttatgtgaagttgccattgtcgtcatgcagttacaacaggtctgctctctatttaagagtgatcctcgggtagagtctgactcttaccctatttcgatatccagtacaactccaaattctaaactgtaatcaattttatacacatatttgaacaaacactaacaaaatgttagagtttactactgtggagataccttgtccggccaatacagaagttgagactttactaccgtggagcggctttttctaaaagatgagagggaaactagtgtcaatggtctatatctgcagtaataaaaggggtagtgtataaggtctaaaagtggatagattgtagggacaaatgatttagacaggtttaggccttataccaagtgtactgctcccgctagaaaatcatctcctgatgcctccccatgcatcgcagatctgcaccaactcgatttccttcctttccatttccaacttattaacctaagcaacatggaagacttgcgtattattcgcgtcttgttgcccaggaaagctagctgctatacacaatgctaaacagccttcgatcgagtaaaaagactaaacggtgcactaattcacatggaaggctgtgttcttccccctattttcccaactcagctctctcgttttccgcaagcacgcttttcgaactgctaaatggtgtgatttataaaaaaatttctactccctccatctacttttgatagtcatatttcatcttaacacacagaccaaggataagtaattctacttatcatccatttaaacatgctactagtcattcctcgtaaagaagcaattcattaatatttatatttctcaatacccatgtagccaatcatgtgtggaagaatggagagtcacacattaaattcgagaaaatcattaagaggataagttattggattaaaatatgcctattaaaaataaaattttcagatttggaaatatgactatcaaaaatagatggagcgagtatatgaaagttattttaaaaaatcatattaatccatgttttttttaaaaaagttaacacttaattaatcatgcaaatacgagcttcgttttacatgctagggaggagcctaaaaactggcctgccctttgctcccacatttattctgaactcattaccttctttttctgatgaacacactaatatatatctacaaagacttgggaaagtacaagatgaaattaaagaaaagttaatgccatatgctgggagcctgggacgttacattacgttggcgtacctgaatatatacgaaaatgaatatctggctataaatagtacttcaaagtggagttctttcatgaacacgtacatcacatgaatgagatactttctcagttaaatctgttctaatatccactgtagactaattcacatgaatggagtcatggttgcaccgggtgctctgagatacacctacaaagctaggtataaacttaatttcctcatgttattatgccatccatcaacgacgtcacatacgcataggagtgagaggcatcaggagtattttgcaaagcactgcacaatggatcagcatgggtgtttcagcgcatttatagtaccagtttatattagcaaaggagcaagtcgcttcaaattaaattacctgcaccaacgtctgaagcactagtcgccgcaggattgtcttatctggctacgtcttgttacacgatgatcactatgtcagccgaaaaatgactggagaaaccattatacatatatttctctatatatatcagtcagcaaaattggccaactgacaagtcagtatgtcttctgttagtgagcgtgccctttgttcgacgacagtgagaaaattaaccagtaactaatcctgttttccccagccaaaacattgctaggtggaaggggaaaacagatccaacagtaattgtgtcgaaggaaatgttgaggattaatagtaagtttgttcactgggtactggaaagaatcatatcatcggatatccgtctctagaaacaatcaaccttattattattattttagatgtttaattttactaaggtttacattggatatctatctatctattatatacaaaaagtccattaaacttcctacaaacgctcttaagccgccacgtggcactcctacaaacgctcctaagtcgccatatggcacaatttaatctcaccgtcgattttcacttaaattggtggacccgttattgtagaccattagatcagatctattattaaaaaataataacttttgtattgtttataacataggagcgctgtccgtatgtatgattttgtacgatacaaatactactgctgttcttcccgtatgtatacaaacgtacatgattgtgaaaacaaaacgataaaatttcctaatcttcgctggaagaaaacaaatacacatgtatacataaaaaagacagagaatttatatatgcattcataaaaatcaacggtctttttaaaatatgattttctacaatataaagataaaatatattacttcacaaatatcagtatgtttagttaaactaagatctataataaatatttaatcaatgttcctttaaaccatcttctaaatcaatctattatatactaaaagtatattatacgaatgcttttacatcgctgtatattatacgaatgcttttacatcgctatgtggctctcaaataaattagagaaatcattgaaatcttttatatactaaaaatctattatatacctgcaaatgctcttacattgtcacgtggcgctctaataaaattaaaattaaagaaatccaaaatatttagagtaaaaaaagaaaagcatccaaccttatatttttcacttaaattagtagacccattattttaaacattggattagagctcttaaaattcccatgccgctaatctctatcccggaaagaaaatataaagtgcttgtgtcgtacgatcgtctccctcccaaaaaaaaacaaaacttaaatacctgcaccatatacgatcgaaaaaacagttaaagccaaaaaaaataaaaaaagaaaacatgcactagaatcagaaagaaatactaataaggaaaaatcataagtgccggcactgatttgttgtcaacagcctttaatctacgattttaataaaataatactacacagttaaaattaatcataaacttattgtagtgataaatatatcatcacaaatgacaccagcatgtaatagcaaatgtgataataatgtttcaaataatttcatatcatattttatggtgtcaaatatcacaaatataaagcgttatcttgaatctacatatgtaataattaaaataacaaaacctagcatttttttaagtacatctatttaggtttatttaattttggagagattgagattctcaaagtatttggaattttttcaaaacttttcttatttgagctgtgagaagcataattaatagattgatgagaaacattaaattaaattttagccagtgataataaaacaacataatttagatgtgatttttaagtggatctttttaagtttattttgggtgagattgagattctaaaagtatctgaaatttttcaaaacttttttattgctctttgagagtgagaagcatacatgatagatagttaatttgctacaatacaacccttaattcatcacaagaattatgtattttctttgccaagtagtattggaaaaacatgaataatccaataaaatacgcataaaactacttatgttatattttttatagttgatagagattcttatataccgggtataattgatggacaaatgttatacaccactaaacccaactgtaagtgcactctagcgaattagttattgtaaataagtttgtgaaaataagtacattcttagtattagtaaatgagtctcgtattcttagtattagtaaatgagtctcgtatggttgcttacaacatatggtggaaacaaatttggtgctaaagtataaatctttatcaaaatataaataatgatatggtgttttgcatattctcatggtggtatgtctttttagctatagtttttattaagtattgtcaaatgattaaccccactcatttgaaatacataatattgtatgtattccattaaaatttgagaagtacttattactaacttcatatgaaaaaaatgcattttcatcaactcctcctttctgtccctctgtccttgaatgcagggtgcagtacttgctatgccatcgtaaatattgcatgggtatgtacatggtttagttaaaggtagtgtccgtgaaaggtcaccataggcagtgccgccacagtgtaactaaagtgacatacttaccatataatcatttgtgagtgtactgatagtaaactaagtgttaaaattgcactctaggatggtttttaggggtatggctacatcgacgtggaacctatatgtttcaaggcattacatacaaaagccttctttcgcagatacagtcgacttcatccattagagaggcatttatgtttattttaaacagtgttatcgtattattcggtagatatagtatatttagactatttatatatagatgcgaaaataagtgatgaacaccgggctatgcaggtagatgaattttttagtgtattaataatgtattatttgttttagtggtactaatacagtttcatttattaaaagttgacctaactcttaaaacaatgatagtaagtagtgatgacaaacgaccagtttatatatgaccaggacaaaggtatttttgtttaaatctaagaaacattcttatcatgttagaagtattttaaaatataccatctattttatggtaaatatatttctttttttttcttattgtagggtaatctaacttctcttacagtgtgtgtctctagcatatgattccttttagcattatatgattattaagatatatgattccttttagcattatttttttaataacaaataagatgcctgtgcatctgtgtgaatttcctttccgatttatattccacaaatcaaatgttctccggttcatatcctgtcgttatagcgtttgaaacacaaactataatacatgcccacgcgaatgcgcgggctaccttcctagttggtattataattagtctaaatcgcgcgtgcattttttctactcccttcgctccaaaatataacaacttttagcctttagaatttgtcccaaaatataacaacttatttaccaacattttcttctcaaccaatcacaacccttcaccattcaatttccccacctacctccacttctcaaccaaatacaatctttcaccatttaattctacctattttcttaataattgtgtccaactctagaactttcttatattatgggacggaggtaataatgcttttcccgggggagtatcttgccgacgatgcacagcattacaaggatttcctgagttgccagacacctcccaggcatatgaattgcacgcgcccaccactatggagtagaatgccatagctgctagttaaaaagttgtataagagcaccccagcagcttatccaaatttgatccttcatgtcctcatatatagatggtcataaaaaaaaatttcctacttcatgtcccttctgactaaaaaaacatccatattatatactccatatcaaaccctcatatattgagtaatacttccaactaactatacatttgtatta

SEQ ID NO: 58098 - DNA, 22213 bp, Oryza sativa
ctaggatcacctagggttagatctagtggggtggttctatttggaattgatgttttaactaaaaagattgaaaacggagagggtttaatatagaccgaccggttaaggtgttggagaataaaaaagtaccggcaatcgtcgtcgttggcgctcggttgtcgtgaatgcggcaccggtaaggtctacgccgatgacgcctgcgggagtgagggtcgtagatgtcctgccgataaggtgtggcgggcggtggcgcttcccgtcactgactgcgccccctctcgatcgaattagggtttgtagggtggagttggcggcggcggtgaatctcgtacctcgtgccgtgccggcctccacccctgttttatatggcgcagtgtgacggggcccaccagccattgggctggacgccccagatcagggcgcggtcaaggcccccttgagccgttgggctcaaggggagggagatcaatccaccaatacatacatatatacccatatatatatatatatatatatatatatatatatatatatatgcaatgtcaatatatgcatatgtgttaccaaccgggactaaagttctttagctcccagacaggggtctgacgtgccctgtcagggggcgaaccgggactaaagatcccttagtaccgttgtagttataaaccgggactaataaaccattttagtcccggctattgtggaaatcgtccgaccttttaaagatcacttctccagtagtgataagtacgtaccaaaaaaagtatacacacatatcgatcacactgcacagtaacacacgctatgctatttgcttgttgaaaaaaaattaaaagtatatactttttttctacctgattttacgagaatatatatacatgttcgaaaagaattgacaagaatataccatcgtcgtagagcaaatgtgcgaacttgcgcgccgctttgctgcgcctagcgaactgggcttctgatgagatgctaatgattcaattaattaattattaatttctaactaggaagataacccgcgcatttgcacgggcatacgcattagtttgtttcgaaaatagttctaacaaaataaattaaaattaaagtaacgtattttctattttgaattgagtgttctttatatctctctttcgtgaagaaatctcaacaactttcattggttttttttaccatcctgctagccctctctttaattacatgcaattagttatgcatgtgaatcaatatagatagaaaaaatcatttaaaaaatatttattgtagtagttataattattgggttcacctatttaaaggaaaatcaatggtttgttttttatcataatttttaggatttttaatttatttgagcgccatatgacatcttaagagtgtttctagcacaccacgcatgcgataggttgagcccgtttgtagggagtttatttgatttttactatataatagatacttcctccgttttataatgtaagtcattttagtatttcctacatttatattgatgttgatgttaatgaatctacatagatatatatgtctagattcattaacatcaatatgaatgtggaaaatgttagaatgacttacgttgtgaaacggagggaatagttaatatagcatttcttatattattgtttatgtactgagctgctagctagaaaatttggataaaaaagtgagcaggtgagataacaggagataaaatgatgggtctactatattaaatattaagtgaaaatcaatgatatgatgtttttctttttttctcagaactttttagatttctctaatttactagagcgccaagtgacggcttagtagtatttgtaggagtcacgtgacggattaagagagtttctataaagtttagttagtggacttttatatataacctggttttttcagctttatcctttttaatttcggttcatacgatcgtacgttacgttgatataaacgtaacatgtaattattttttttaggtagtacatttatacgtacattcctctccatccacatatgcataggataggaaggatgttttttgtttttttttctatttatgaatagtacatcgtacctttatctccatccatttgcatcagatccatattagaaggaatgattttaatatatttaatctaatggcctgaaatatcggacccactaatttaagtgaaaattaagggccatatgttttactttttttctcagaatttgtaggattttctctaatttattagagtgccactgtagcacaccacacaatgataggttgagagtgtttgtagagagtttatttgatatttactatataatagatagttaatatagcatttcttattatttatgtactgagctgctagctagaaaatttgggtaaaatagtgagcaggtgatgtaataggagataaaatgatgggtccaccatattaagtgaaaattaattatatgatgtttttctttttttctcggaattttttagatttctctaatttattagagcgccatgtgatggcttagtagtgtttgtaggagtcatgtagcggtttaagagcgtttataaaaagtttagtgacttttatatataacctggtttttttggctttatctttataatttccgatcttacgatcgtacgtgaagttcatacgaacgtaacatgtaatttgttttttttttgtgttttaggtagtacatacgtacattcctctccatccatatgcatcggataggaaggatcttttttggttttttctctgtttacgaatagtacatcgtaccttcctctccatccatttgcattagatccatattagaatgaatgattttaatagatttaatctaatgacccgaaatatcgggtcctctaatttaagttaaaattaagggctagatgttttgttttttttctcagaatttgtaggattttctctaatttattagagtgccacgtggcggcttgagagcatttttagaaagccacgtgggtgcttcatagcgtttttagtaagattaatggatttttagtatataatagatagatagatagatgatgttgcgagagatgccaatatgagagctgcaaaattttgcgagatctttagggatattgttggagctagtcttttacttgtaaaaatggtaaattttgatgtggggaatgattttgcaacacttgctaagccaagctacgactcaaagcacaacttgaatccctcaactagtcatgtttgtttcggcttaagattaattactataatctagattattaagtcagattactattaactgaattataataagccgacatagaataagttgttagctgtttgtttctgtggattattagttgtttgttagttgttagccacctaataattaaaaaagcacttttaaagtggattaccatattatagtaagctgtctgtttgtttcagcttactccgaataatttggattataataatcctaagctgaatcaaacagggccttaagttagtcacatagataaccagacacagactatgtgttcttgcagttcctttttccacattcctacttggggaaaaaaatcaggatttttgaaatttaaataccattaggccaaaagtaaatatttttggaccaatttgttaaaacaaaattccgaggctgaaagtttcgaaaatgctcaaaatcgggcgcccgaacagtgcaaaaaatcgggcgcctcccactcgtgcctctgcctcgcctcccacacgtgcgtgtcgcccccaccatatgtccccaccactcgcgctccgttgcaacaaccacccgatataacggaaacgcactatcaaggggatttgttttatttttttccaccaacaatatttcaggtagtgtactcgtgatgtttcactatgtatggatgaaatgttgcagtggattttggtactatttcataatttcatcttaatggacatgtgatttgttgatgtatacgtggtttaagtgttgcaatggctttaaattgtttgctgcatacgttgaaccaaattattttatctagtgatcttaatgtttttcatattttttaagaattgaaacattctttcgctatttgctgaaacattgtttttatatagggtgaaacaacgcccaattttttttggaaaccgttgtttcatacatcttctattatatactaaaagtccatttgtcagggttacgggttaggtatatcctttacccttcgatatacgtcgcatatcggtatggcatacctacgcgtatatggatactctctgcatacactaaggaaatcctttacggagtttatagaaggaaagaatcctactcggacaagactgggtcgtcagtgtatcatgtagggtctgatgtctccgagttctacttggaaaccgcctgacctgcgatataaaagggaccccccggggaggacctaaggcatcgaatctcagagccagcacaacccccacagcctacgaagtcggagcctgcaggagccaaaccgccggagatctagtcgaaccaactcgattacgatcttgccggatccatcgagttccatcgttccttttgtaacctgtgttttccatcatataatcccacatcaactggatttgggctattacttattaaggggcctgaaccagtataatcttcgtcttctgtttgcttgatgtcgtattacgtagacccttgtaccaacgtaccccaataccctctatatccggtctacgggtatcacccgtcgacagtggcgcgccaggtaggggaacatggtgctcaaggttctactactatgtcatccagcttcgccgacaaccgcgtcaacaccaacctccaccggggatttcctgcttcaataatgctggtgtggactcaagtcgacgaaatcgtcttcccggtttacaccacgatcccgatctcagccgacccatcaatgatcagaaacgagaacgcaatggctacaacccaggacgactccatgtcgaaggatcctcccgccgaagcggagaacggaacatcgacgacatccgagctcgagaaggattctaatgcgaccaaaccttgtcgtttagacaagagccacgagccaacgagaatgacttccgaagcgacaaggtcctggtgtcctatccacaaaaccatgaaacacactttgcaagcctgctgggtttttctcaacgtccgcgctgaaattcgcgcctgcaaagagcgtggaattcagcgtatttctccaactcgtgatgtctattgtcctattcacaagacaaagaatcacgacctctcaagctgcaaggtcttcctcagcgccacgaagacgtcatctcctaaggtccagcagtcaggcatatcccttagagatgaagacaaggaacaaggaacgacgctggtttcagatcgattcgtaggcgtaatcgacatcagctcacccgaaccatcagtcctgcatctactcgaggactatggctcatcgccagcaagtacgccgcgcgaggtattagctatcgacggaaccagcacgtcagcacacgctaatgcggaaacacaaaatcaaatggctacaccggcccagcacatcaggaccatcaacgcaatactgagggagaccccttacgatcccgttctaaacgatgatctcgcacaatggacagaacggctacgggaatcaagaaccaacctcaactacgcgttcgaagaagccgctgctgcggcgcacccggaacagccactaactggcggtgccaatggcgaaaatcccaaacagcaggagtcaccgcatcgagctaccccccacctcgcggcaccggcgatctccgcaaccacctcaatggccgccgagaggcacgacgcacatgagacaacggggatcgctcccgataccgcgtctcttcacgatgtcgcgataatgaaagacaggaaggccgctcgaacgaagaccgagactgtgttaatcgccacgatcgtgagaggcggacgcagggcgacgctggtcgaggacaccgccataatgacgaggacgacagagatcggcgccagaacaagaccggagggcggcgacaagattctcgagaacctagccgacgtcctcgtaatcctacactggaaccaagtgatccatcgtcatcgtcgtcttcttcttcatcctcatcattagacagacatccacgaaggacacacgatcgccgacaacccaccgcccctagcgctgggtgtagagctttcagtcgttccttgcgtgatgtccgatggcctgagagattccgacccagagcaatagagaagtacgatgggagcaccgacccagaagagttccttcaagtttactccacagtactctacgctgccggagcagacaacaacgcattggtgaattatttgccaactgcgttaaaaggctctgcacgttcatggctgatgcatctcccgccctactcaatcacttcgtgggcagacctgtggtagcagttcgtcaccaacttccaaggaacttacaagcgccacgcgatcgaagacgacctacatgcgttgacacagaactcgggtgaatccttgagggaatatgttcggcgcttcaacgagtgcagaaatacaatccccgaaatcaccgatgcttctgtaattcgcgccttcaagtccggtgtcagagatcgctatactacccaggagttggcgacaagacgcatcacaactactcggagattgttcgagatcgttgagcgatgcacccacgcaaatgatgcgctgagacgcaagaacgataagccgaagaccgggggagagaagaaaccagccatggacgcacctgagtcaagcaagaagaaaaatcgcaaaaatgggaaaagaaaagctcaagcggaagttctcgcagcagaatacgcgaaccctcccaagcgcccagatccacaaggtagcgacgtgaagaaagcatggtgccccatacacaagacggacatacattctttggaagattgtcttgttttcaaaaagtcgctcgagaagcacatggcatttgaaaaaggcaagcgagtacgcgtggtcgagaaggatgcggaggcggctcctcaggaatcggactcaacatatccagactctgacatccacgtttcacacattttcggaggttccacagcgtactcctcaaagcgagaatacaagaaagtggaacgtgaagtctgtttgacatggcagggggctgcacccaagatgaagtggtctgaacagaagatagaattttcggaagaagaccatcccaagactgccatcatcccaggatgctatccgatcatggtcgaatccactattcggaacatcaaggtcgcgcgggttctcatcgacggtggcagctcaatcaaccttctcttcgccagcacttaagacgtgatgggaattccacgaagcgagttgacacccaccgatcaacccttccatggaattactccctagtcctcgtccaaaccattgggcaaaattacattgcctgtgacttttggccaagcaaacaacttccgaatagagcagatcacctttgatgtcgctgaattcgatacagcgtataacgccatcatcgggagaactgcacttgcgaagttcatggccgcatctcactacgcgtatcaagtgctcaagatgccaggaccgaagggaacaatcactattcaaaggaacgcaaagctggcggtacaatgcgacaagcttagcctcgacaaggttaagcaaacgcctagcccacccgccacaactgagccacccaagaaagtgagaaggacaaacaagacgccaaaaccggacggcgcgatcaagatcgttccactctctagtgccaaccccgataagaacgtcaagatcggggcatcactaagcgagaaataggaattcacgctcatcaccttcctccgcgacaatgctgacgtgttcgcttggcagccgtccgacatgccgggggtccccagggaggtgattgagcacaaactcatggtgcgacccgatgccaagccagtaaagcaaaaactgcggagatttgcaccagaccgaaaacaagccatacaagaagagctcgagaaacttctcaaagctggcttcatcagagaagtacttcatccagagtggctagccaatccagtcatggtgcggaaggccaacgggaaatggagaatgtgcgtcgatttcaccgacctcaacaaggcgtgtcccaaggatcaatgccctcttcctcgaatagatcaattggtggactcaacagccggctgtgagctgttgagcttcctcgacgcttactctggctgccaccaaatcagcatggcgaaagaggacgaagagaagacagcattcatcacgccattcggggtattttgctttgttaagatgccattcggactgataaccacagggaatactttccagcgcacggtacagggcgcacttagcgaccaactcggcaacaatgttgaggcatacgtcgacgacattgttgtcaaaaccaagacaagtgactcattgattgaggacctgcgggaaacgttcgacaacctccgacgatatcgcctcatgctcaatccaaagaagtgcacgttcggagtaccgtcgggcaagctgctcggtttccttgtctctggcagaggaatagaagcaaatcccgagaagatcaaggcaatcgagaacatgaagtcacccacaagactcaaggaagtacaaaagctaaccggatgcatggcagcactaagcaggttcgtcgctaggatgggagaacgaggacaacccttcttcgctctgcggaagaagcaagacaaatttgtatggacacaggaagctgaagaggcattcgttgcactcaaggactacctatcaaacccccctgtacttgttgctccccaacctaatgaagaattattcctctatattgccgccatgccatattccgttagcaccgtcattgttgtcgagagagagaaagtacaacgaccagtctactacatcagcgaagctctccatgacgcaaagacaagatatccacagatccaaaagctgctttacgcggtaatcatgacatcaagaaagctacgccactactttcaagcccacagagtcacagttgtctcctccttccctctcggtgaagttgtgagaaacaaagactttgtcggctgcattgcgaaatgggtagtcgagctgagccagtttgatgtccactttgtgccacgaacagccatcaaagtcccaggtactcgccgacttcgtagccgattggactatgcctgataacaaatcagacaaccaaatcgataacgaaacatggacaatggcgttcgatggtgcactcaacagccaaggagcaggggcaggattcatcttgacatctccttccggagaccaattcaagcacgcaatccacctcaacttcagggcgaccaataacacagccgaatacaaaggactactcgccgggataagagctgcagccgcacttggggtcaagcgactgatcgtgaaaggggactccgagctagtcgcgaaccaggtgcacaaagattataaatgctctaaccccgagttatccaagtatctcgcagaagtcaggaagctggagaaaaggttcgatgggatcgaggttcgacacgtataccgcaaggacaacatcgagccagatgacctagcacgacatgcgtccagacgagaaccgctcgagcccggcacttttctggacatcctgacaaagccatcagtgaaagaggttatcgacgaagttagcccagccgcccccgacattagctcggaggccacagaggcagaacgcgccgttgtcgatatcgagaccacagacgactggcgcaccccactgatcaaattcatcaactgcgaagagttgcccgaggacgatgcagaggccgagaaaataacccgtaaagcaaaaatctactgcatgatcgggaacgatctatacaagaaagcaccaaacgggatacttctcaaatgcgtctcgtccgacgacggcagacaccttctccttgatatacatgaaggcatctgtgggtcacacgccgccggacggacattggtcgggaaagctcttcggcaagggtttctctggccaaccgccctcaaagatacatgcgacatggtccagcgatgtgaatcctgtcaattccatagtaaacacacaaagctacccgcgcaagcgctccagactatccctcttacttggccgttctcgtgctgagtgctagacatactcgggccattcccacgaggacagggcggctacaggttcctattcatgacgatcgacaaattcactaaatagatcgaagcaatacccacgggggaaatcaaggccgacaacgccatctaattcatcaagggggtattttgcagatacggactaccgcaccgcatcataaccgacaacggctcccagttcatcagcgccgatttccaggattactgcatcggactgggagtcaagatatgcttcgcctcggtctctcaccctcaaagcaacggacaagtcgagagggcaaacagcatagtactacaagggatcaagacccgcgtctacgatagactcatgtcacatgacaaaaaatgggtcgaagaactcccatcagtactatgggccgtacgcaccacaacgacaacgtctaacaaggaaacacccttcttcctcgtgtacagctccgaggccatgctccctagtgagctacgacatcatagtacacgagtacagaagtattccgacgaggaccaggaggagcagcgaaacgtcgatgtgaatctactcgaggaacatcgcgaacgagttgccgtcagtgcagccagttaccaacaagccctccgccgctaccacgagaagcgcatccgagcacgcatactttcgatcggtgactacgtcctctgacgggttcaaagccaagcagggcgaaacaagctctcacccaaatgggaaggaccttacacgatcacacaagttttgcggccaggcgcattcaaaatagcagacggtgatggttgcgagttggcaaactcttggaatattgaccaactacgtaaattctatgtatgagtcaatatcatccacacctgtaagacgccttacaacatcaatggagcctatttttaggtgcatattacaatcaaagtgttcctgcccgatgatcccttacccagatgacacctagcgttgaaacctatcctcatgtccctttacgccgtcttaacaaggccttcgaggaacctaagggatcttcggctggggacgcccagagccgataaggccttgtcagatcctatagggacgaaagaccatgtaagacctggtcgtgtaagagttctcgccgtgcgtattaaccaagctgcgtaatcggaaattcactttccaacttcacggctgggggctaggatcagtgcttattcaaccaaggcaggtcaaaggtccaagagccttaccctccgagaagaatcctccgacgacaaggctgggggctggggagagtgtatgactcaaacgattaactaaagttgtgaattgagaacacactcttacacacggtacccagaacatccatcatagggtacaaagactaccaagaaggccaacgccagttcatagactggaagaccttctccgccaacggcgccatcgacttcgctaggtggtctatctccgtcggagtcctcctagaacgagcgaaaccttcatggagaaactcaaggtccagtcgcggacgatgatttcgtaggcaagccaacacgtgccctccggcatatcggctcgatcgacgacattcctgcttcaagggttcgtcaatgcgtttgccgacgccttcgagctgagtacacgccccattcagccacgagatgtatccggccgccgactcttcgggatccccacggggtactcggagctctctacaaaccttggccatggacgtgcagcaactcttcaagtacgagttgaaccacacctcacgacctcagagcgtttccacagcttgctctttctttacttccagcatagttctctcgagttccgctacttcaaatttcgtcttccaatattggatacgacgatcttggccagcaagagcactctcgagatctgttcaatatggaaacaactaagtcaagctgcacccttctttcgggaacacggctgatcaagtcggaggagcaaaaagggatgaagggaccactaacctaaggaagtcgtcgccatcttcgtcctcgcggctaaaatctgatctacatcgtccggcgacgcgtgtggctcaaacgcaagagccggaatgatcgccggcgacttaggctgcccacgctgctggacatcctcgtcatcaacatctctacaaaggacaaaaaagtactcgagatcaaaatgctaaagaaaactaaggtgatgactgcatgcacaaaggcggttggaacccattggagttttacacagcatgtctaaggaatacaagagagtcaaaatcctactctttaaaaagggggagaacatattcccccaggtcaccgacttcttccatcacctccttacgcgtgtcgctagccgccccctgatccaagatctcgcgcagatcgagttcagggtgcgtcagcctcaaacacgcaaggacgtggcacgccccggtgtagatcccgttggatgtctcctctccgatgctggccgcatgcttggagggaatctcctccatcaccgccgccagctccgcaagagaagatgtcagcaagaactcatcgggattcgccgggatagtagacttgataccgcattccccagcgagttggtgcagaccagtataggtgacccgcaacgagccacggatttccgacaagttgttcccgagctccgacatgcggtgctcaagcccctgccgttgtcgctcattgccagccaccaactcccttatcttcttgaggtcctcacgagcctccgccaagtcgtgcgccagccggtcggcgcgctcgttcgccgatgccgccgccgacctcgcctccataatctcgtgaccaatgccgcgagcactagcctcgaggaggcgccccatttcaacctggagctcctcccaggtgaggacggcagccggtggaccacgaccagccgcgagatcgctggctgggccgcttggtgtcgcctcgcggcttccgggcacgaccacgacatccgtcgaggttacagaaggaggcgcgccggaagtccctccagactcgtcttgcgccgccttcgcccgcgccgccctacgagaaggctgtggtttagacaaagttcgacgaaatcacgaaaactcaaattcattcacttacttctcgccgagtgtcacaagccgctgccgtcgtggaggcgggggagacgcgtccgaggcctggagtataatcgatatgaagtcaggtggaagtattctgactacgtgatcaaatgacaggagaacttaccgagggggtaggtgcctttcgacgatgtccgattacagaggagaatttcctcccctttgttggaacgtcgccaccacttgttgtggcagcaacagcagcagcatcggacacctccttggcgactttctctttcagtgacgccgccacctgatggtccgcgagcggctcgatgatatcagtcagaggaacaacctacgctttattaagtcgtaaggcgatctcggaagaaaaacgcagaaggcccactgagtacacttacattgatggcagcgttgcgtttggccgcccccttctcgcaaaggggaacggggacattgctcgccgtcgtcgggccactgatcatcacctggccgacacgatgtctcacggcttcgccgctcagacctgtgaatcgagaaccaaagttcgataatgtcacgaccggaaataacccaacgggcattccttacgtgcgtgcattaatccttgtcccaggaggcaaggtacaccaaaagttgatacaattcagagtttaacaagcggaagcgtaaatagataacttattacatgggcaacgaaggcccagcacacacagagacaaacgagaaacagcggaagactagggcgacgaccacaggcgcttgacggcaggcacgagctagacaccgaagccttcatcctcctggaactcctcttctggggttgggaaaaattgagcaagactgagtacaaccaccgtactcaacaagacacacccacaagtgcagaataaatgcaagggagtacaaaggggttataccataaaggggttagggttgcagtaaacagcatttaaagatatttagttgctcagggctattttgtaaacacgattctagaactaaacaatattctttatcaaggccgtgaacccacacgaacctgccttaacccaaggcctacgatgattcagaccgaactggcaacccgaccctgggtcccagctcgtcccaagccaacccagaccaaccattccacattttagttgttaagcaggttttaagaattaaaacactaacttgggtacattgctcggcttgcccataaccgagggcgcggctattcgaatagattttactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccacctacggccggaacccccgggacaggcaggcaggactgagcccctagcagcaggacaccggccctgtgccatgacatctcgactaccgggccgcagctcgtgtagccttcatttgccctggagaatgtccatcgacccccgacttcatccacctccatccgtgtacttttgtttataactagactgagccacaaactaagccttacccactagacatgtggaagtacggtagtgctttgcaacagaggcccgaagaccggtccttatatggccgaggtgctactatcaaaaccatgcaccccgggcccagcctaaaaccatttttggggattttgaatagagggggcggtgtgaatccaattccacaatactccaacaattccacagtgtccaggtgatatgaacattcccaaagtctagagttgtaaaaccgcctaatgttacctaattaaaagcgaagcatctacctataatcatactagtggtaccatgagtagagtgtccactagttggggttttgtttaatctagggtgaacaaagaaataataacaataacaataataaggtcataacaaaggtaaataggcatggctaaataaaacagtgataacgcgggaatttaaataaagcgataatgcaataatttaaatcaacataattttacaaactgggattcaatatgttcaaagatgatgtgacttgccttgctcgctttcccaaacgccggcttcaacttccacgaagagcggatcttccgaagctgcagcgtctacacgaccaacggaaaagaaaaggcttttactctactaaactccatataacaagcagaaacaaagcacaaaaatgggttcttgacttcttaaggaaaaattagagacttgaacggtccaattccgagttcaaatggccaagatatggccatttgaagtttatatgctctttaaatggatatttgcgaatttcttcatttaaattttaatttaaaatcggatttattgcgtcagccgaggggaggggcgcgcggaccgggtccacgggagtggggcccacgcggcagcctcacggtccacggtggaccgggtgcacgcggcttgcgccggccggcgccgtgggtcccacgcgttagccgcactcgagggcgcgggcggctgacggccgggccccacatggcagccgcggggcgcgcccgaaggcggcctcgccggcacggccgacgggaggcggcgcgcccgcgccccgatggtcgccggcggcgacctccggcgcgacggagcggcgcccgagagaggggagggaagggggaagcgagatggcggtcctcggctcaccctgggtcgacggcgacgacgggaacggcgaccgaagcggagagaggcggcggcgcggctcgggtcgacgaggacggcggcgttccggcggtcggcgggcgaaacgaaggggtggacgaggtcgacgaggacgcggcgaagccgaaggaggcgatgccgaagcgggaggaggtccggggcgacgacggcggcgaaccgaagctcggcggcgacggcggagagagaggacgacggcgcgagctcgattccgacggggagagaaagcggcaagggtcggaaacggaggagggaggcatggggagtgcttaaatagtgttgggagtgagagagggcggccggaggggaaggaaaccggcgcggcgatctcggctccatcaatgacgccggcgaagtttgcgggaggatttccaaacgaatccgagagagagagagagggaaaagtggggggaaagggggagggaatcacggggagtgatttccccctctttattgcgcgcgggggcggcgggatgcggcggaatccgcggcggcggcggcgctagggcacgggcgaggcggcgggcgcggcgcgaggtaggggatgacgggtgggccccacccgtcagcgagggtggcgggcgggcccgcccgtcagcgacgcgcgcgcgggggaaggccgatgggccgcgggggagaggagagagagggagggagctgggccgagccggcccaagagaggaaaggggggggaaaaggacttttagggatttttctttttataaaaccactttaactttgtttatttcttcttaattattatttgtgctctgaaaattccactaaaatttatttacgcattttaggcttttaggaaatatacaaaaatcctccaagccttatttgacttttagctttgcacattttaattgttggaggctttcacatggattttacttattctttgcataatttcgaggatgtattttagagtcaatttgggacgcgacagataagtcaggagaaacgcgcacacaagtaagtcagggtaaatgcaagaaagataccccgaggagaaacccgggtcgtgtcctccggtccagaatagtcaaaggctggatgggctcgagcctggagcggctggatccgtctaccaatgaagtcagcagcgacttcataccccgacaaacctcgtactcggagatcgtcgacaacatcgatgaaggactaaagggaaggggtcaaggtgggctttgcggtccaagacgaaatcttgtctggttgttcctcaggaacaacgaagataggatccgaattttctatctgaagatagaaccacctcctccgccatttgctgcgagaggaagggcactggaaggggatataacgcgacttcaggccatcccgaagtcggaatccaacgcatccagacaccctgttggattctatccaacgcaactcgtagtagaagcgaaagagatcaagaaagggctctacgccaatgtaggcctcacaaagatgtgaaaaaatactaaggaaggcaatagagttggggttcagatagagcaaagaaaggccgtagaagttcaaaaccaagagaagaaattcagaaggcggagggagaaaaccgcagagaatgtagtcctcgatcgcaaccatgtgacctaggacaggttggggttcagtacctcctgcttctctttccatggtcccgcgaccaggaagggcgccatcctcctaaagcttcttcagtgacgcgctggtggaggaagatttgccgagatccatcgctgactggagatcgccggaggaaggactgagattgacgagctagggttttgcgggagcggagaagacgagaaacgcttggaggctggaggttttcttcacaacaggcggacttcaaaatggatccccaaaattcccttaaatagacgcacttccgacggtgcgaattccaaggaaaggagagagatagccgccggaaatttctgggtccgttacgcgtggaaatctttcggacttcagtttaaattcactcatgaccgttgggcttcacatggtgttctcgactatgtcctgtctctacggttttcacaccgggaatgacaacagcctcgacactagaagtcgcgaatggttacacgagttcatttaagcagaagtcgggggctactatcagggttacgggttagttacaccctttacccttcgatatatgtcgaatatcggtatggcatacctacgtgtatacggatactctctgcatacactaaggaaatcctttacggagtttatagaaggaaagaatcctactcgaacaagactgggtcgtcagtgtatcgtgtagggtctgatgtttccgagttctacttggaaaccgcctgacctgcgatataaaaaggaccccccggggaggacctaaggcatcgaatctcagagtcaacacaacccccacagcctacgaagtcggagcctgcaggagccaaaccgccagagatctagtcgaaccaactcgattacgatctcgccggatccatcgagttccatcgttccctttgtaacctgtgttttccatcatataatcccacatcaactggattagggctattacctatcaaggggcctgaaccagtataatcttcgtcttctgtttgcttgatgtcgtattacgtagacccttgtacaaacgtaccccaataccctctatatccggtctacgggtatcacccgtcgacaccattaatcttactaaaaacgctctcaagcagccacgtggcttcctaaaaacgctcttaagccgccacgtggcactctaataaattagagaaaatcctacaaattttgagaaaaaaaatcaaaacatctagccttaattttcacttaaattagaggacccgatatttcatgccattagattaaatctattaaaatcattcattctaatatggatctaatgcaaatggatggagaggaaggtacgatgtactattcgtaaacagagaaaaaaccaaaaaagatccttcctatccgatgcatatggatggagaggaatgtacgtatgtactacctaaaacacagaaaaaaaacaaattacatgttacgttcgtaagaacttaacgtacgatcgtaagatcggaaattataaagataaagccgaaaaaaccaggttatatataaaagtccactaaactttatataaacgctcttaagccgctacatgactcctacaaacgctactaagccgtcacgtggcgctctaataaattagagaaatctaaaaaattctgagaaaaaaaggaaaacatcgtatcattgattttcacttaatatggtggacccatcattttatctcctattatctcacctgctcacttttttatccaaattttctagctagcagctcagtacataaacaataatataagaaatgttgtattaactactccctctgtttcataatgtaagtcattctaacatttcccacattcatattgatgttaatgaatctagacatatatatctatgtagattcattaacatcaacatcactatgaatgtggaaaatgctaaaatgacttacattgtgaaacggaggaaatatctattatatagtaaaaatcaaataaactccctgcaaacgctctcaacctgtcgcatgcgtggtgtgctacaaacactcttaagatgtcatatggcgctcaaataaattaaaaatcctaaaaattatgataaaaaacaaaccattcattttcttttaaataggtgaacccaataattataactactacaataaatattttttaaaagattttttctatctatattgattcacatgcataactaattgtacatatatgagaaataattaaagagagggctagcatgatggtaaaaaaaccaacgaaagttgttgagatttcttcacgaaagagagatataaagaacactcaattcaaaatagaaactcaattcaaaatagaaaatacgttactttaattttaatttattttgttagaactattttcgaaacaaactaatgggtatgcccgtgcaaatgcgcagagttgtagaaaaatatttcatgaggtaatttggttgtcttttagctttttatataattgaaacattttcgatttactaaaaatatgttcgatctactcggtgaaacttgatattttttcccgattcgggaatgttttcatgccgcggggtctgaagttcctgaattttcggaaatacgggaagtttcgaaccgaaatttcagggctgacggaaccaagctgccgcctgttcaattcctatttcagcgccaccttccctcccatcctcggcgtctcctcgaccatcatcgccgccgccgccgccgccgccggcggctcgcctcatcctttctccggccagccggtcgacctctccgtcagtttctccgcgccctgtcctactcgctggggtaaccaccgccatcgtcttgctactcctcttcgttccctacaaaatcctacgagccatttttcgttttggggttttggggttgggcaagggggaatttgagggctgtgatgataatgatgctttttcgttggtgatgccgctgatccagttttgcaatgggggatcgatcgacgccgttttctggatgaatccgtccttgaaatcggccattttacttttccttttttgggatcaaagaggtaaaggggttcttaatcttgtagaagaaatggccttggcaaagcagttgttaagtgttgtcgattaggtttccagcaatctgcggaggtggaatgatttggggactaatgtggttttgttatttgaggcctcaaagtctttagattggtgggtgaacataacggaaatttgtgtgattgataaatcaggtattgggatttgtggattggaggaactgggtgtgataggttatttttatcaacgtccgcaagggatttatggttcttttaggtatggtggcactggcaccagttaattaagggttcttgttgaggttgatcatttcttgtgctccttgttgaactgattcccgatttataatggaaatataggagaaaaaaatgtggaagagtggtgaaaattggtcttgttgcttttagtgaatggtaggagcacatgctttgcatctttcatataatcatattgcttcaaggaaataattgtgccctacccgtgagaaggaattggttgcatgttttagttgtattggcatatatctctgatgtctatgttgtaatagttcagagcatgagtgcatgacagcattgtgttttctttgcggatgtgcctgttgtagtggtagtggtagatgattcttttcctctttagaaacatgcagtccgtatatcttttaggaagtcatataacagtggaaattcatcatattgttctctagcccatttttcacttcgattcttcactaaactttcaatagttccagtgtgttttattgtttaaagcacaaaaacttgatgtttgattcttctgatgtagaagtaacaatctaatgttagttagtttgatgatattgggtgccttgaaattgtcgattccgttggattaatatattaatcaaagtatggtgagtgtgtggattacatacagcagccagactcttatatttctggaaactccgatccagcgttaagactagcgaattactctgttgtagaaaccagactgtaatttttaccgagtcaagtatttttttttggcgtaaactgggaagcttctttctaattacttaaacaagttttttgatccagccatttgaatatccatgtattggatgtgtattctgttacatattcagttagatccttgattttccatcctgcagatctgttcctttcatataatcccctcaatttcaaattcttgttccaaactttatcttttattatggagttttatcatataataatagtaattttgataggtttgtggtgacaactttgttcttattaaggtttgcagcatgtgtacgctctgacatgatgtagggtctgaataggaagagctagcacctgtgtggaactgcataataattttgtaatctgaaaaatgttacttacatgctaaattgtaattttctacttctcttgtgctttctatttccaccttatattaactgaaatctcattcttgttaccaaaagcgagctaacctatctcatgccatatctgaacatgcttgatcaggtccatc

SEQ ID NO: 58099 - DNA, 38219 bp, Oryza sativa
ggcgccgccatctccgtcgtcgccgttctctctctcacttcacgcgggtggagggcgagagacggtggggggagaagagaagagaaaaggcgctggccatggcgcggcgggcgcgaaggtcgccggcgatggtgacgccatccacgcggtcgcgcgagagagagaagagaagagaagctagggttttcggcggccggctgggagaggggggtttttgatcctccgatctcggcgcccggccgtccgatcgaaaccctagctgatcggacggtcgacgccggccgggccgaaatcggcccaagagggcgcgcgcgggggggcggctttcctggcccaggcccaggttgcggcttggggaagggggcgcccgcccgtgccaaaaggccacgggccgaccggaaaaagtctgtttgaggtccctcggggccgaaaacaaagaaaagagaacagtagcattttttccaatttattttgtcgatttttcatgcaaatttcaatagaattttgaatagatttttgcatgttttacctctgtttaaatttgaaccaacgggagaattttcacagagagagaattacagagattttgctactgttcatatgatttttatatagttttccgctgcaaatagatgtaattgatgaaaattagtgtttctaaaattaaatttcgaaccaacgggagaatttaattttaggaacattaattatgtgctatgatgttgtaattttctgaccaacgttgttaattgcattattatagttatggttataagtgttatgtctaatttctgcccaacggtgatgtaggcttaatgcataatattttaatgttaattttgttctcaccgcacatgattatttcaggtggctactccttgatgggttgcattaaagatattccgaccctaaaaggagataactacgcagaatggaaaagaaaactcgaccttgcttttatcttgggagaggtggactgggtgttgactaccccatgtcctatagaacctgctgaacttgtcagaggtgaaaatgagtcagatgctgactggcaaaagagacagagggacaatgctcctctcgtcatgtcgtatgacattgaacaaaagaaatggtccttagccaacaagaaatgtttggctgtggtaaagaatacgattgagcctaccatattgggctcgatcccagagtgtgacgctgtctcagagtaccttgaaagaataaagagtcagtttactggctcttcaaagacttatgctacacagctgatcaagcagcttgtgacagaaaggtaccatggaggtggtgttagagaccacatacttagaatgagcaacatggcttccaagttgaagccaatggatttgggcataacagatgactttctggtccatctggttatggcctcattgccaaagcagtttgacaattttattgtcaactacaacataagtccagagaaatggaactttgagaagctcattgctaattgtgtgcaagaggaggagagaatcaaagaatcaaatggtggttcaataaactatgttaaagataagaaaaagaaccacaagtctcccacctcaaaaggtaaacagtctcagcatctgcctcagcaacaacagttcgctgttgagaaagatcaatgtctccactgcaagaagacaggacactacaagaaagattgtcctgactttctgaaaatgatcatggcaaagaaaggtgagaacattattacatttgtaaatgaatctcattatgttggttactctagatccacatggtggattgattctggagcaactattcatgcttgtaattgtttaaaggcattccgttcgacgaggactacgcaaggaagagaaagctccattagagttgccaatggagttgaagaaaaagttgaagctgttggagatcttccgctagagctcgcgaatggcttcacacttttacttcgagatgtcttttatgttccttctttgcaaagaaacttaataagtgtatcaaagttggattttgatggatatgattgccgctttggaagtggcaaatgtgaactatggcataataatgcatgtattggtcttgctgtgttgcgagacgagctttatttgttatctctttctgagaatgtgaatgttgtgtcctcgttgacaaaagaaaacaagaaaagaaagcgaacttccaatgtctcatcgaaattatggcactgtcgtttgggccatatttcgagggggagaattgagagactagttaagaatgaaattctttccccattggagttctcagacttagaacaatgcatagaatgcattaaaggaaaatttgtaaagagcatcaaaaagggtgcaaaacgaagcgcaggaattttagagatcattcatacagatatttgtggtccatttcctgtgaaaagtatggatggctatgactcgttcataacattcacagatgattactcccgctatggttatatttatccaattaaagagcgatcagaagcactggataaatttaagatattcaaagctgaagttgaaaatcagcatgatataaagattaaagtagtaagatctgaccgtggggggagtactatggtcgacatacgccttatgggcaagtccctggaccttttgcaaggttcttgctagagaatggaatagtagcccagtattcaacaccgggcgaacctcaacagaatggggtagctgaaaggcgcaaccgtacccttatggatatggtgcgcagcatgatgagctactccacactaccactcggtttatggatggaggcgttaaaaaccgccattcatattctcaacagagttccaagcaaatcggtgcccaaaacaccgtatgagctatggacaggaagagtaccctcgctaactcacctccgtgtgtgggggagtcctacagaggccaaagtatttaacccaaatattgggaagttggaccccaaaacagtcagctgccattttattggctatcctgaaagatcaaaaggctatcgtttctactgtccaaacagttatacaaagtttgtagaaacgagacacgccgtcttcttggaagacgaaatgattagggggagctcggtagttcgagaaattgatcttgaggagaggcgggtgtctgtacccgctccgtcgactcaggaacctttcttctctctacctgctgatgttgtgcctgcaatgcctgtcattgaggtaccagcacctgttgttacccctcctgtggcaacaatgaatgagagtgaggaacctgttatacaggattcaacagaaatggttgccacaccagaggaggagctacaacagcctcaaatagataatgtgccagtacaggagactcatcaagagcctcaggtacaggatgtggcaaatgtgcaggcccctagaaggtctgaaagagtcagaagatcggctatccgtgatgactataaagtttataatatagaagagtcgcatatggaggatgatcccacctcatatgaagaggccatgagaagcgctcgctcatctgaatggttggaagccatgaaagatgaaatgaaatcaatgaaactaaacgatgtttgggatttagaagaaattcctaaaggagccaaaacagtaggctgtaaatgggtctacaaaaccaaatatgactccagagggaatatagaaaagtttaaagcgcgacttgtggcaaaaggcttcacgcaacgagaagggattgattacaatgagacattttctccagtctcttgtaaagattccttcaggattataatggcactagtggcacattatgatttggaattacatcagatggatgtaaaaacggcatttctaaatggagatttggaggaaaaagtatacatggcgcaaccgaaaggttttttcatgaaaggaaacgaaaatatgggatgtcgtctaaagagatccatttatggattaaagcaagcttcgagacagtggtacttgaagtttgatgggacaataaaaaaatttgggtttcaagagaatgtcgaggacaactgtatttattcaaagtttaagaatgggagatttattttcctaattctgtatgtggatgacattctactggctagtagtgatgtcagtctactgcaggaaacaaagaaattcttgtccacaaactttgacatgaaagacctcggtgaggcttcatatgttttgggcatagagattcaccgagatagaacaaagtatgcattgggactttctcaaaagacatatatagaaaaggtgttgaagaaattcaacatgtacagatgcagtgctacacctgctcctataatgaaaggcgaaaagtatggggcatcgcaatgtcccataaatcagtatgagctcaatgaaatgaaaacaaagccatatgtgtcagctgtaggaagcctacagtacgcgcaagtgtgcacacgacctgacttggcatttgttaccgggttacttggcagatttcagagtaatccaggcctagagcactggaaattggtaaagaaagtcttgcgttatttgcaaggaacaaaaggcctcatgctgacttacagaagatcagaatcactccagatagtggggtactcagattctgactttgcaaaagataatacaaagtcaacatcgggatacgtgtttaccctggcaggaggagctatttcatggaaaagctcaaaacagactatcactgcagggtctactatgtatgccgagtttatagcatgctatgaggcaacggggcaggtgaactggctaaagaagttcatacccggtttaaaggtggttgacagtattgagaaaccactaaagttatactgcgacaacgaacccgcagtaatgtacgctcacaacaatcagtcaagtggtgctgccaaacacattgacataaagtactatgttgtgaaggacaaagtccgggatcaaacaatcagtctcgagcacattaaaacagaaaggatgctcgcggatccgctcacgaaaggcctaccacccaacgtgttcaaggaacatgtagccggcatgggtttaagggaagccttatgaatcctggactacagggcccaaaagtaaagtatctgtttctgaatagagatgtgtatagtggctgtcgaatccatcggtgattgaccgtgacgatgaaacatgctctatttacaaatctgtgatggaatagaaaaagctaaaagaaaaagtgagatcaagggggagaatgttagattgatctccctccccttgagcccaacggctcaagagggccttgaccgcgccctgatcgggggcgtccagcttaatggctggtgggccccgtcacactgcgccatataaaagaggggtggaggccggcacggcacgaggtacgagattcaccgccgccgccaactccaccctacaaaccctaatccgatcgagagggggcgcagccagtgacgggaagcgccaccgccgcgccacacctcatcgccaggacatctacgaccgtcactcccgcagccgtcatcgccgtcgacctcaccggcgccgcatccacgacaaccgagcgccaacgacgacgatggccggcacttcttcatcctccaacacctcaaccggtcggtctatctaaaccctctcccgttttcaatctctatagttcaaacatcaatcccaaatagaaccacccgactagatctaacctaggtgatcctagtgcaaagtccaacatgtatatatatatgtatgtatgtatgtatgtatgtatgtaccataaatatctctatatatatgtgtgtgtgaagcaggcagcacaaccaaattaaaaataaataaataaaatctttagtcctgattcctggttggtgttaccaactgagattaaagatggagctttacttccgggtatttgaatcgggactaaagactgtcatctttagtcccggattcttcctcccggttcgctacacgggagtaaaggggttacgacctgggagagatgagcacttctccggtagtgtgcatcgatcgtttggtcgtccctccgacaagttgcgtcgggtgaagctagatggagacaaatgagaattgactcaggactccattctgatcgatacctatagctagctagctaatgagcagtgacgatcgcgaattcgggatcaacatggcagcaaaagaattgacactcgatgggatgcctttgactgatcgaagtgctgaaatcaatgggctcgatctgctagcatatcatgactggaagatggcttatcgattattggtcatcccttcgcacctatgaattgccgcgttggtccagcccgtgatgtatggtgaatgatatagtatcctccctccgtcccacgatataagggattttaagtttttgattgcaatgtttgatcacgtgtctcattcaaaaatttttttgcaaatataaaaaacaaaaagttgtgcttaaaatactgtagataataaagtaagtcacaaataaaataaataataattttaaaaaaatttgaataaaacgagtggtcaaacgttgcaagaaaaactcaaaatcccttatattataggacggaggaagtaattatcggagggtcgaaacgaataaattgaatattagtaagttgataaggtgatacagaaattaaagttctctaagagaaaaaactgataaattaaaagtgccaatttgcaaagtatgcctacgataatccatactattattatgatcgaccaataagctgaaaagaacgggacgtacgtaagcgttgcgacactgtcatgtgaagtagcgccttgagtcatcatcgtcaacgctacggatcggagctccttcaccaattatgtgcatattcttagatgacgtaaagagctccggaattcttcacttccctaacttgaaaaaaaaaataatacctccatattttaatatatgataccgttaattttttatccaacgtttaaccattcgtcttattaaaaaattatataattatcatttattttattatgacttgattcatcatcaaatgttttttaagcatgatataaatattttcatatttacataaaaaattttaaataaaatgaatgatcaaacattgttcaaaagtcgacgacgtcatacatatacgaagtgagtaatagttaccgcgtactccctatacaaggggcgacgatgctgtctgttttccaaaagaccgacgaagctagctagagtcaagtcaacatgcaagtggtacatcgtgtattcacatttaagctggccccgactaatcatcgattcattgcatgcatttaccagccgtgcctataaattaaggtaaccatacctgcaaacacactgcaaactcgcatatgtgcacatatcaatatatcatactagtaccattctgccggcatcaagttcgggcttcgagtgcccagctaccgcgagctgtaagcttctcttctgtagtctactttcacttgttatcatgggaagtaggaacatgtcatgttattcttaagttaagcattcgcatcttttctaaatatccaaatgttgatggctgtatgaattatctacagctagttcattacaaaatataagccgtatatatatatatggttttaacgtggtcttcattattatattttgacaatttatttgtttcaaaggacatcattaacaaccagaatcatcatcgtataaaaatattttaaaatttgaatccaaaacactatcacttgtgtagttctacaagccatgcacctcatatgtatggttctacctcgatcaaaagctagtcaaaacgatcccatctcaaaccgtgttcatcagacgcatttagattgctaagcacacgtatataaaagtttatttttcagcctttgcatttagattgctaagcacacgtatataaaagttttatttacaaattacaaatatgttgtttcgcttattccacaaataaacgaaacgatgggtccgtacgttgatcaaacaagctcactacgaaggttactactgtgagtcttgtgtacgttcttggcctcgtccttccatatctagttagtttttttaaaaaaaaaaagataatgtaaatcgtttacatatctagtttttgccatagggtatatagactatagacataaaagagcattgctaaattagaaaaaaacagaatagggcgacgggacagatctcgacactccactcaaataaacgagaattcgattggaagtcatatggtccgttgattgcttataatcgaacagtctataatggattgggcggtatatatctataggaggggattaaaatgtgagccatgtattaatttaaacatggaaggaaaacactgcatgcaataaacacattgcatagaattgtaatttgaggcttagtaatccacaattttttaaacctagcaaatccctttaaatttattttcttgcacatggaaagcagcgtttacaattttggttcgaaatttcgataattttggtccccaccggcaaatcaatataccgatagaaattttcagattttctcttttttttgtggaatttggtcaaatttactcaaattcgatcaaaatctttcaaaatttcaaaaaaataatggtccgaaaagtgccgaaaatcatgaaatttggtaaaatttcggtcctaccgaaatcaaaattgtaaaccctggtggaaagtcgaaaggatctctgcaacaaaaagaaaaggggaagtcaaaagtaatatcactggtcatggactagccataggaactgccactggtgtctcatgtaagcatggactaaattatgcaatacaacgttcggtaaccaggaaggagcctataattagtcaactaatgttttcatgtatgcgtcgagtagtgaatagtttaattagaaaaggcacactactaaaaaatagttttcgctgacagtcaaaatggattttcgctagcggctagatgtgccgccagtgactaaaggcaagtgaaaataatgctggccgccagtgaaaattgagtttcgcaagcagctatgctaagacaaccgctagcaaaaataccattttggctagtggcaaaattagaccaccagtgaagacaattttggggataaaaaaaattcaaaatggtgctgccaactgccacagccgcaaacaccgccggctgctgccacaacacctcaccgtggccgccgcctgccaaagcccaagccatggtcgccaagtggtagatgggggggaggggttggagtagcctagccatcatcgtcgttgtggcagcccccatcgtcgtcgtcgtcgtggcagccgccgccggatccacctccttcaccgccgtggaggaccgcctgagcaccaccgccggcggatccgcgcccaccctcctaccaccatcgcttcccactccgttggcctcccccgttgctgtggcggcggatccttggtagccgctagcgaaaatcctattttagttgtcggtaacctataaaaagatctctatttttgcaagcagacctcttaagtgaccgccagcgaaaatcaaatttttgcaagcggttgataaccggaatccctccaattattttcacaatcgtattttcatcaaacccgacagtaaaaataaaagggtaatgctataaaaaataatttttctagtagtggcagcttgaattgggtgtaatgtatccttgagctgaaagagatgatgactagtagctttcttgtgtgcaggatttttatgaagaaaactctcaactctgtacagcgctgaaaggaagctagttttcagataatcttagcctaattaagctaaaccattcttcaggtatttcaactactaccaactgagtgtccgaacattttatacaacattgaaaatttaaactttccgatccgtttcaatgtatgaacacaaccaagatcgatcgaaattcgagcaaacaagctcgccatgaccatgaaggttaccactgcaactgcacatttcctcttggtgttcttggcgtccaccatctcccattcagtcatctgctcagctctcggaaacgaaaccgatcagctgtcttcgctgcttgaattcaagaacgcgatcagtctcgatccagagcaatccctcatctcatggaacagcagcaaccacctgtgcagctgggagggcgtctcgtgcagctccaagaacccaccacgcgtcaccgccattgatctagtaggtctagtaggtcgcatctctccttcgctcgggaacctaacattcctcaggaacctctccctggcgacgaacagattcaccggccagattccggcgtccctcggccgcctccgccgcctccggtcactctacctcagcaataacacgctgcaagggaccataccgagcttcgcgaactgctccgagctcagggcgctgttcctcgacggcaatgagctcgccggaggactccccggcgccggcgacctgcccgtcggcatcgaggcgctggtgctctcgtcgaaccgtctcgccgggacgatccctccctcgctcggcaacgtcacgacgctgaggaagcttgcctgcatgaacaacggcgtcggcggcggcatccccggcgagctcgccgcgctgcgcgggatggaggtgctggccgtcgacggaaaccggctgtcgggtgggtttccggtggcagtcatgaacatgtcggggctcgccgtgctcggcctcagcaccaacggcttcaccggcgagctgccgtccggcatcggcggcttcctgcccaagctccggcagctcaccatcggcggcaacttcttccaagggaatatcccttcttccttagcaaatgcttcgaatcttttcaagcttggtatgtctgacaataacttcaccggtgtggtgcctgcctccattggcaagcttgccaagcttacattattgaaccttgagatgaatcagctccatgctcgtagcaagcaagaatgggagttcatggataacctagctaattgcaccgagctacaagtactctctcttgagaagaatcaaatggaaggacaggtaccaagttcactaggcaatttttcagttcaacttcagtatctttacctggggctcaatagattgtcagggagttttccttctggcattgcaaaccttccaaacctgataattctggcactggatgacaactggtttacaggttctgtaccacaatggcttggaggtctcaaaacattgcagagcctaacagtgtcctacaacaattttacagggtatgtcccctcctccctttccaatctatcacatttgatggagctttttctagagtcaaatcagttcattgggaacatacctccaagccttggaaaccttcagttccttacaacaatcgacatttccaataacaatcttcatggtagtgtgccagagtaaatcttcagaattccaacaatagagcaagtttggttaagattcaataatctcagtggggaacttcctgcagaagtagggaatgccaagcagctcatgtatttgcagctttcatccaatatgttgtctggagatcttcctaatactttgggcagctgcgaaaatttgcaacatattgagctggatcataataatttaagtggaggtattcccccttcgtttggcaaattaattagcctaaagtttctcaacctatcacacaacaagttaactggatcaataccaatgttacttggtgatcttcagcttcttgaacagatagatttgtcattcaaccatcttagaggtgaggtcccaactaaaggtatcttcaagaattcaagtgccatacaaattgatggaaatctagggctttgtggaggtgcactagagttacacctacctgaatgtcctattacgccatcaaatacgactaaacgcaagccatctgtactagccatagtgattccattagctagtatggtgacacttgcattggtgatattggtcttgtttatctgtaagggaaaacaaaagaaaaactcaatgtctttgccctcatttggtagtgaatttcccaaagtttcttatagggatcttgccagagcaacaaatgggttttcaacatccaatttgattggcgaaggaagatacagttctgtataccaaggacagtcatttcagggcataaccgtagttgctatcaaggttttcagtctagagacaaggggagcacaaaaaagcttcattgcatagtgtaatgctttaagaaatgtgcggcatcgtaatctagttcctatcttaacggcgtgctcaagcattgattcaagtgggaatgacttcaaagcattggtatataaattcatgccacggggagatttgcataaattactgtactcaactccacatgatgatagatcttcaaatttgtgctctatttcactagctcaaaggttaaacattgtggttgatgtatctgatgcattggcatatctacaccacaaccatcaagggccaattattcattgtgatctcaagcctagcaacattcttttggatgatagtatgacagctcatgttggagactttggacttgcaaggttcaaaattgattctaaaacatctttgggtaactcagtttcaacttcttcattcacaataaatggaaccataggatatgttgctccaggtatatatgatccatttcacacagtattttcttaacaattaattgaagacaacagtttcataatttgtttatatgacatctaaaatgaactctcttcctgcatacgatatgtagaatgtgccataggtggtcaagtttcaactgctgcagatgtatacagcttcggagttgttctcttagagatattcataaggaagaggccaacagatgacatgtttaaggatggattgagcattgcaaaatatgcagatatcaacatccctgacaggttgctgcagattgttgatcctcagctggtacaagagttgagcctcaaccaagaagatccagttgctaccgatgaaaatgcagcacactgccttctttctgtactgaacattggactttgctgcaccaagtcatcccccaatgagcgcatcagtatgcaggaggtggctgccaagctgcacgcaattagggattccatatctcagaggttactgaatcaacatcaacactgttagttgttctgttttgtctgaaactccgaataattttcagaagacatgctgtacgccaagcaccacctctagactgagccggcgccaattcagttatatcgatggcgaccaccacaacacgtagggatctgtgctcttggacatggagcagagggtcctcatggaggagatcgtcacactactccccgtcgagagggccgtcgccacgacgaggttcgtgctcggacttctccgcaccgacatgatcctgcacactggcgtggcgtgccgagacgcgttggagatgagagccagcaaacagctcaaggaggcaacgcatgaggacctcctgatccccaacactggcaactttgtggagacgctctatgacgtggactgcatggagcggatgctggagcagttcatcgtcacagttcacgaactcgtcggtgtacgttcaccggtccgtctcgccacagatataggacgaaggctaggtggttgacgcatcctccggcgagctcatgccacggattagaacagtggccaagctcgtcgacagctactccctcattccctaaatattttacgccgttgactttttaaacatgtttgatcgttcgtcttattcaaaaatttaagtaattattaattcttttcctatcatttgatttattgttaaactaggaaggtagcccgcgcagatgcgcgggcaatttattttatgtttatataaaaaaatctgaaaaaaagtcatatatcatcatattaactataagaacagtagattacctcgtaaccttaccataaaagaaggaaatatttataccgtgaatttgataaggtaaatgatagtgtctatcatattcaaacaaaaaatcactttgtttcggttatatgtaaacttacctatcatcattctttgcaaacataatatgagttttgatgttttttttcttttattatacatgtaattcacttacgcatgttcatgggtaatgtacaaagaaatactctatattgtcaaaattatttgtactaattgttaacacaatttatatgagaacgacataattaaaagggataaaatatgattccatatgacattttttattgtacgtatgtacgtaagttttttttctcgaatggtagtctctcgtatgttcgttctttttcatgtttttttgacaaatatttctctctcataggaggtagggtgtgcgtatgtgtattcatagggtgggtgcacacacgtttaaatgaccacctatgattgcgttttacattgttagtcaaaaaaaatattttcaagaaaattggcgagggtgacatgaagcggcgccatggcagcgtggcttctttgacaacatcgcaaagagtggtcgctacatatatgtataatttgggagaaccttagggctacaaagaaagaaattgaaaactaccagatggggtgaaccatatacacacacttcttttttatttttgacattgcgtatatgtacgtgcatatatatacacacacttctttttttatttttgtcatctcttatatatgtacgtgcatagagagggattagctagtttatagaagcaagggcttacctgaataaatctaatttaatggttgaaaataatggattcatcggttgaagtgcaaatcgatgggtagatgttttgttttctccttatattttttcttaaatttcctcctatttattagagcatcacatgacatctcacaagtgtttgtagaagtataggaacgctattgcttaaactcacagtctacttgtagtcaactactgtttgttgtgattttgtgtcatcctctacttatatatcattttttttattaatgggttcccactaagtatcatcatatatcttcggtgcttgatgacgcacgtgcttattggatgtcaactaattattaagtgcattgtgcatggatgtatcataaacaatataactcgacgattgttgacactggtttgtatatagaacttattacatagaatttatcggggacatacgattgatatattatactatcctagattcacaaagtatattatacactacatattaagttttagtgcatatgtaataaatttatggttaagttctaaagtgcttatcagagtggctacttcattatttatcatgaccatgtttaccgaattgttaaacggtgcatattttacaaaatattttttattatagaagttttctaaaaatacaaataaatccattttcaagctttcaatatttaatactcgattaatcttgtgctaatgacttgtgacttttcgtgtgccctggatacgctaagtcaatgagctagatcgaacgaaggctaagtaggagaaaaagatattgacgtggtgtcaaatgaatatatttgatcttcaattttctaataatatatgaatagagtaaacacataatacataaaaaatatttatgataaatttataacatcatttttccatatcagtattttttacaagagagagtgagtaatttttgaaattctacacacacttgaagttgttttattttggaaaatgtaagtctaatttaactatcacataatctatactttcaatttatttatattttttatgggtgtttcaatgacatgcgcctaatttgaatacaactcgaaatagcatatatttttacaacgcaaagcatagttgatattagtttaaattattagtttggttttccatctaatccaaatgatgagaagaaaaaaaaataaggatgtgggacgcggtgtgtatacgcactgtttataggaatagctgtgtacatactctacgtaggtacgtacttttcttaagaaggaatacctacatacctacgtgcatgtatattggccggtcgtgccaatacgacatgggcctttttacaagtaaatctattttgtagttttaagatagatctaatagttgaaaataatgggtccaccaaattaaatgaaaaccgattggtcgggattttttttattttatacaatttctatgatttattagagtgccacatggtggtctatgagcatttatagggtactatgttcggattagaagcgtttgtaggaagtttatcctcttgattacattttctccctttttctctttatgaaaatatttgcaacaataatttttaaataaccacaaccttctgaattatatatttatttgtaacaatatattttaactcattataatttttaacttttaaatcatacctttatttttttatctatttggaccattgtgttatttatgataaaaatcacaattagaattcatacgtaagttatctacttcactcataaaatgtttattcttccatgttccatttactatcctatgcatgtcattcaaacgtatatgaaaaattataaaaagaaagtgactatatattgtttcttccagtaccacttcacttgcacgcataaataaagtcagtcactgtatatactgttagatcaactttttaaagaatgcccgtgtagctgaaaacatatattttcaaatcatatattttttattgtacgttttttaccatatttgtgaagtaataagttttgtttttctactatagaaaatactattttaaaaaaccatctgtttttttgtctacgcatacgtacatttttttcttggttttgtctacgcatatgtacgttcgtttctaaagtttctgtttttttaattgtgcgtacgtatgtagatttttcggtctaagcggtttcactcgtatggacatgattttccggtatatacggcttcaatatacaatgtagtactttttttggctttatagctgcacgtatattagtttttttttaagcgagcagtacgtatgggtttatatccgatcggaatatactttaatttttctcgtaaaactttctcatgtataaagcttatacgttaagggagtagcaatgacttttcaagtagatctaatctaatggtgtaaaataatggggctaccaatttaagtgaaactcgacggttagattgaaaatagccatgtggcgatttaggagcgtttgtaggaacgtcacatgatggcttaggagcgtttgtagggagattaatggacttttagtatataatagatagatatgcttttatgtatacatatagttttgtatattttaaaaaaaattgaataagacgaacggttaaacgtgtttaaaaaagtcaacaacgtcgaatatttatggacagagagagtacctcgcagaggtcgcgaccaacaccatcctcaagttctccaagtagcatcactaataagctcatcccagactaagcgggccattgtgatgttgctacaggtgcggttaattgaagcgggttgttgtttgtttgctgctgatatactttgaggtgtacgttgaatgttgctgaaatgctagagctaaatggtgttgttgctgttgatatgaatgatagctgatctgatatgctgctagataattcaaaggctgtttgcttgtggcaagggagggagggagaggtcggtgggtgcgtgcaggaggaatcgacttttgggcgaggggagcacgtgtgggaggaggaaaacatattttctgttggtagttttatggaggtcacactttttagtttgtacaatcaatttagccttgatttatggagggcacgatagttttagccttaatttaggttaaagaacggagatagtaaaaatattagccccagaacctaaattttttacctactccgtatttaacagaaggaaggtaaacattatgtcacccacaaacactcggccactagaatcctcgaggtccctacggccatcacgtgacatcacgatgatcaaggtcatcgaggtccctacggccatcacgtgacatcacgatgatcaaggtcatcatgtcaccatactcatcgaatttcctcacgctcgtcttctttcctcgctctacacccaaatcccaaccaccctcacaacacctcccgcttcatgctggctaaagtccccaaaaagatgagaacaacatgcatcgcgcccacgattaatcctagtgtcactagtagcgatcttgccaagattgcgctctcgtaggtgtcgttttggtgagagacccatggcactgttggcaacaacacccatcaaggccgcctccattgagcattgcaacctctagtagatgagagggttagccctgatttcactttcggtcgttccattttttaaagaataatgattatagctaaatcaaagggagttgagacatgcatacctttaaatataggaccaaaagggtatgaattgaaatggactatgttaggctcaacatttgcatcgcctcgcatcggtgccgctctcgcattgaagtaatcattttagcaaaatgatgtgtgtacgtctcgtaggactgaattttccaagacatgcgggactagagagggaatgattatttccgtcactagatttgatgaagtggtatgagatgaaatcttggactaaggatggggtttgctaatttgtttatagacgtagagaggaaaagttcacaaaagaggaagaaaagggaaatacattgcactacaagtggaatgacatttaaaggcatttttgtaaacgctcctcaaatcatccccttttaaggcgattttgataaaaatgcttagtaaaatattactaattggatgaccaattggcggccatccgacggttgggggaatcgcccttcctcaaaaccaacggtttggatccgtcctcccgagcacctatagcctatcaccgtcacgctcgcacacgtgcccaccacgcgcggttgactcctccccctacctctcacctcccccacctcgccgtcgccggccgccgccgcctcccacctcacctcctcttcgccctctcccctcccaccccaccaccactccggcgagccatcgcggccctccgccaaaaaccctagggcaacagcgatcgccggtgcgcgggggcggcggagtcggagtcggagtcgggggccatggccatggacggcggcgcggcggcggtgctgcgcgaggcccaccgcctgacggggcacaccgaccgcgtgtggtccctcgcgtggaacccttcccccggcgccggcgccggccccgtcctcgcctcctgcggcggcgacaaggccgtccggatctggaagcgcgccgccgacggcgcatggcagtgctcggtaactatcacgcccgatcccctcctcgttcgagctgatgctgctgcagctgcaacgcgtgttgattgacttggggttcggtttgggtaggatgtgctggaggacacgcacaaccgcacggtgaggtcgtgcgcatggtcccccgacgggaagctgctggccaccgcgagcttcgactccaccaccgcgatatgggagtactccggcggcgacttcgagtgcgtcgccaccttggaggttgaaaatggctctcgggagtttcagatatggggttaagactgtttgttgttgtggtgcattgtgatcgtttggttgtgcgtgttgaatttactacttctgttgtgggggtgtgtgcagggccatgagaatgaggtgaagagcgtgtcgtggagcgcgtccgggtcgctgctcgcgacgtgcagccgggacaagtcggtgtggatatgggagatgcagccaggaaacgaatacgagtgtgtctcggtgcagcaaggccacacacaagacgtgaagatggtgcagtggcaccctatccttgatgtcctggtttctgtcagctacgacaattcaatcagagtatgaacgctgttaatttcaaacaaatgcctagatcgcacacaagcatttcttgctgttcccctatgctttgtagctgtgatgcgtttgcttatttcatttggtagtgttcaagtgtaataatggctgatttcaaattttctgtggcgaaggtctgggctgatgacggtgatgatgagtggcactgtgtacagacattaactgaagctaataactggtaactagccttggtatccctgtggcctttttttcatcccatgtttcatagagctggtactaggttgtggtataatctgtttgacttatttagcatgtaacatgcatcactgtataatgttaccaaatcatcaaatttcagctggcatgatgctctttattataattaaaataatgtaacttctgctccatggccattagttatttgactttccctactttcctttctccattagacattagttatttgatattttgtgctgtttctactttgctacagcaatattttggcttctatgtcacaataatgtgtttgtgttatcttacaatagacaattagggatcttcttcaactttcctcgataataactaataagatcactttgctgccatcctgctttgtaattagttaaacatacgtttttttttctccttttcaatgttcacttcaattgttgatgaactcatttttctctgtttggcatgttaatacttatatgttcttcctactttcagtgctcgactaattgttgtatcttttccttgtctaattgatctcgttctttttaattccagtggtcactcgtcaacagtatgggcattatcttttaaccagaaaggtgataggatggtcacatgcaggtctgttttgtaatagctactctctgttttaaatgatattcaaggcctcttatggaatgtggggtttccccggcttcttgtcgattgtgaaattcctgcgttccaaacaggtcacccgaaaagttactaatgtcatacagctgttattcagtgatgaccatacattgaaaatatgggacacaagtgctgatttgtctcaaccaaaaactagtgacaaccaggaatcatggtaagagcgtgctattaatacctattttctctacttggcttattcttgaatttattgactcatatttgctgtataaagtttgatagctttgaaatatcgtagctctgcctaaaagctaagctaaaacttagttataattccctggaaacagctatgccactactatagcaaatctattaatgccaatattgcttttatacaatcttatttttgtaatttatatttttgtattctctagtgtagttctgtgaggctgtgatcaacgtacaccaataaatgaggataggcatgtccttcagagagtagaattgtttggtctccggctagcataaattcttttctattgcagaacatgctaatttagctgtactatattttagtgctataacggaaagatctaatttaccagtaagatcaatatcgattaaacttctgctgccctgctttatactggggtgaactaacatgtatggtggctatttccttttggataagacatacttgttactccctccatttcatattataagtcgcttttacttttttcctagtcaaacttctttagggtggacaaagtttatagaaaaatttagcaacatctacaaaaccaagtaagttttctagaaaatatcttgaatcttgataatatgtttgttttgtgttgaaaatattgttatatttttctataaacttggtcaaattttaaaaagtttgactagaaaaagaagtcaacgtgactcacaatatgaaacagaggtagttccgtgcatcactgaataataatgacttcagtgtaattgccctagttcaattgatactgctgttacatcacagcagtgaagtgtcaaaaatatctcttttccataccatgtctccttaacaggatggttgttatttgatttcaggcgacatctttctactctcacgggatatcataaccggaccattttttcagcccattggtcaaggtgaggtgatctctaagcaccaagatatccttgatacacatgatttttatcatagagaactaacaagttaactctgttcctcagctaaactgtgagcatgatttatcaacaagtatatttcataaacccaaggttttcggggcactagtaacaccagttttcacaaaactacgagttctcatgctgttacaagccctgttgtatttggagtccaccaaactgtcaaagcaactcaattctcaccatagggttccagttttatatcctaaaattttcaatataaggaaattcatgaacatatggattttttttttactgcagaacatatggaattttataaacatttattttgttcatagcatgctggatttttacccatctagtttcatgccaaataataatatgccaaaaataacaacaataaccctcaacggtgtcagtggcaaagtgatcgaatgaataatagaaagcaggaagttagacttgctcaagtccacattatgcttggaggttagtagataaattcaagccaactaacaagacctatggtttgcttctactagtgtcacgaaaccacaaattcgtgaaactatggttgtgtttactaatgcctcaataccttgctttttaaaaaattttaagttcgctctattaattcagtacgtcaatatgaattttataattattagtttattgattctatttgagagcgctatatgttctttaaaaggatgcacttgttgtgtttatgattttatgctgataaactttatatacatcaagatacctattcaagcaaaacagggctgtttaaagtactaaccttgcagtccattctttctttctttttcctattcttgttatttatttatctgtgtctcttagtaccattgctgcattcttaaatgttggatgcccattttaaggaagaaattttactaccagaaattctgtgggcactgatggtggtttatctgatgtaatttcttctcttttaatcattattgtagttttccaatattacctcagcccatatgaatcaagatgttaaaatgaatagaatagtgtatttactattctttgacattttcctgttcattcttggcatgacagcgaggatattatagccagtggcgcaggtgatgatgcaatctgcttatttgctgaggacaagagtagtatggtatcatacccttcctagcacattcatattctcaagatttttggtctttgcattctgtgcttagcctgcctgtttgtcaaagttatatcttggtaaatatttaataataaataatggagtgcaatgttctgatagggattccataatttcctggttgtcaaaattttcctaggagtaaaatgtgaacatgaccaatcgataaactgttgtatcattttttggtaaccagtgctgtgccatttgttttgattattggcaaattatgtatgactattttctccaaaaaactgtacaattattattccctctaccataatgccattttattttgcgaaagctgaagaaggatgctaattccttaccttcattgctgcaggttgagggaccttcatacagattaattttaaagaaagagaaggcacatgacatggatataaactgtgtccgctggtgtcctcaggtaatatcagggaattaacaaaaatataagtattgttatattaagttagtgcaatggaatacttatgtcctcaggtaatatcagggaattaacaaaaatataagtattgttatattaagttagtgcaatggaatacttatgtttctaccaattaccacccatttcgtggttctgtttatcttttaaacttcagataaatgtactaatcttctcaaatatgttttaggacccgaggatgttggcatcagcaagtgatgatggcacagtgaaattgtgggagctgagggggaatgcactggattgaattttgttctgtttactgtattataattatagttctaggtttgtgaacgaaatgaggcgtctcctttgggtttttgttttgcttaacaatgctctgtagttgttaatacttctatcatgaacttgcgtggtgattgtcttttaacagattttccatgcaaagctatgagcatctgttatccagccataacatgaagaaattgcttgtgtatacattatggaacaacgcaagtgtgctcatatcatttacaaataagctattgaacattttgttactcaagtgtagaaatggtactaatttcttgttggacgcttcttctctatcagttgtagagagcagatttacaatgtggctgcctcctgcatgatgtaggtgcatctaattttgattgcaaccttctggtgttgggagtgcatttttctgactaattagggccgggcagtattgatgaatgatggtgaccacattttcttttgagttcatactaaaaacttagaaacaaggacatggtgttaatttgttaattcttagtttggtgcagagaatttatactagactttaacctgtggatccgcatgggcaacctgttttatggttacgtttcattttttttctcgctttttactatgagagtttgcaatttctgcttaatccagcaattcctaatgacttaatacacgttattcctagaaaatagcagagttaaaatagagctgatgtatgtcctgacatattcgtgatcatattattattttaagacaaatctttttcctacaaaacatcgtgattttacggttttaaatatagaacatcacacgaagtaacttttggggaatacacattaaaagcttttttttctctacataacaccgtgactttacggttttagaggttttagatataggacatcatttggggaagacactttacaagttggatatttattggtggacactaataatattcggttgaagaggagagagaaatcacgtgaaagttttgaaatgccttgggcccacatgtcagctctcccatctcttttctatctctatcccctccatttgactagggaggatgccatggccagcgctgctgcctcctccttccgctcctttctgattggcgagctctgcgaccacctccgccgggagctcgagctcgaccccaacctcgcccaatgcctgctcctccctgcctcgccgtcgccccctccatcgacgccgactcccagccccctccccccgccccctcctccctccctccctccctccagcgtcaccaccaccaccaccaagaagaagtggtgcgcatcaccaaccgtgttgatggcccatgctgatggccgtcaatatctggcaatgggaggatgccatggcaggtcaccgcggcgccactggtggtcacggatggcagcgagcagacgccgtcagggacgctgacggacgcgtttcatctgtccaaggcggatttggagtggttttgcgtggaagtcgtcgctgttctcgtcgtcgtcattacacgggccgacaatgctgaaggtggcggtgtacgcctcggctatggtactggcattgatggtgacaacgttcgtggccttgccggggacagaccgggtgagtcgctccaacccgagcacatagctcaacctccgccccatcgataacaggttgtgagagccatggggccgcctcgagtgttggtgcgagcgtggcagggcaggcgcctcaaacagcctcgactactgctttgaccttctccttcccggcgtcgaccacgctgtccccttggtggagtcctccatcgccgcatccaagggcgacaagttcgccgtcgacctcacctcgatgcagccccagagctgagacggcacgccagggtgcagcccacgaagcagcgaaacttcagccagtggctgctcacccactacagctatcgacctactgtggcgacctatcacggcatcctccctagccggaagaaggggatagagagagaagagagataggagagctaacatgcaggcccaaaggcatttcaaaactttcacgtgatttctctctcctctccaaccacaaattattattttaaagcgtgcggtgtccaccggtaaatatcaaactttaaagagtgtatttccccaaaagtcactttatgcagtgtcctgcagctaaaaccacaaagtcataatgtcctttatccaactataatgaaaatgttcggatgataaattaccttaagaaaaaaaaagtacgaattatccccctgaactatttaggtcgtctgaattacccccttagactttaaaactagacatttgacaccctcaactactaaaactagacaaataacccccctaacccaatctggagtggttttgatcctacgtggcatacgcgtgacagtccagtcagcaattctttaaaaaagttcggtgggcccacttgtcatatctatccctcacctctatcctcttgtctttctcaatccgtatccctctctatctcttctcttgaattcctctcctcgctaaagcatgcgacagcggccgaccgtcgagcttgccggccgggctttcttctcctcggcacaacaagcacaccaccaagtcgccactctcgaaggcagttgccggagaccgtcgttgttgaggagccacggtgaggagctcgatccccttatcacgctcgcgaattgaggagaaggtgtcgtggcggttgccggtcgagagctcgaaggcgccacggcctcgtcgtcgtctccacctccatcttgatctgcctccttcgacgctgctaggtcggcctcatccctggaagctgcacggacgtcttgtcgccaaccttcgccgcttctccccgtccccctgacctccacgacctcctatgcaggaagttgcagagctcatgctcgaggaggcggccaccgacgtggatctccttctcggccacatgcgtggatctcctcctcggccaccggcgcggatctcctcctcggccacaggcaccgattgaactccaccgccggctccctgaggggaccagcctccgtcgccatgtgcctcctatgcggctgacggacgccacttccggtcaacacgccttggccctatctcttctgccctctctctctctctctccccgcgcgccgccgtccacccgccgccgcccaccgcccgttcgcagccacttgctcgagcgcgttcacgggagagagagagagcgagcgagcgaccgggtaggaagagacatgacatgtgggcccatggattctttttgctgattgaattgccacgttagtgccatgcgtgcaagatcaagtcaaaactgctcaaaacagtgtcgagggggtaattcgtccagtattgaaagtttagggtaagcaatgtctggtttttgggttaggagggtaatatggtcgaccgtaataattaaggagggtaattcgtacttttttcaagtttaagtttagcatacaacgtttggaactcaagtacatacaaactcaagtacatgcaacggttaattgcacattggcaagaatgggagttcctgaaaacaagtttggaactcaacaaacatatatttaattagagtcaggaaaaaaatacactcaaacatacactgtaatttcaataaatgttgtaagtgcttttacgtaacaatctaacgcatacgccctccgtcccattttccgttttatttaaaaaattttaaaaacgtaagtcacgagtatagcactatttatgttttatcatcttataacaacaaagatattaattataaaaaaattcaaataaaacggacgatcaaagttggacgcggaaactcatggttgcactcaaaatgggatggagagagtatttttctttgctccccagcaaatcctttgcttcatgcacaagcaaaggagaaggatgtttagggttgtgtttggcactcccttttccccatatctactttctcatttttcatgtgcacacttcctaaactactaaacaatgcattttaaaaaaattatacctaaagaattcggaacaaaatagatgtagtacttaattatgtactaacgaatcaattcatgctagggagaaaggttccgaatccttttacccgaacgtaggaactttaaccaagcagcccttggtacagtggcagtaatatgttacgggaccacctatacatttgtcgacaaattttctactaaaaatttgacagatgtaattatagtacaatcgtagtgtaattacaatataacttgtatgtaattacattgtaacttgcatgtaactacagtgtaacttgtatgtaagtttcacgtaattttgaatcgttagatctattacaagatttgttctatggaggaagaaaaaaatcacatcacacacatatatgaaagaatttgttcccgcgacctctattttactgaaataacatgttaccgagagattcttgaaagttacatacaagttacattatagttacagtgtaattacatgcaagttacagtgtaattacactacgattgtactgtaattacatctgacaaatattagggggagaaatttgatgacaaatatctagcaaaatcgatatgttacaacacatatgcaatagatagatggactgtattatattgcaagtcttcacgaagcctatttaaacaacaagaattaattaatgtatatgcattaattaccaaattgttaaaaacaggtgttaacaatacttaacatggcttatttagtgcggaaactttaacataaattggtccattagaggtgaggcccattaatgtcgtttggattcatattgcttatccatatatactacactagtataatataaggactgtagcctctattatctgttataatagatgggccctagctttttcctttttaaaaaaataagaaaggcagaagtccaatagaacagggataacagaacttgggggaacatcttgtctctcttgcttaactttttatttatgcatgaaacgcgtgttcattggaaaacaaataattataatcataatattgcatcatatatggattctccattctacctcatttatttggtagacaacaacccatcaaatatagaacaaaatagatgtaatagtgtatgagaattggtgttttaggctttagaattccacaagtagctatataaattcaattatcttaccgctcatcaagaaacccttacaaaggggtgtgagctccgtttttcccatgcattcaagcgattgcaccacctcgttgctcacacaaactacaccgcctcgtgcagcctagcttgtctcaacctccacaatcctagttctagttatcagccgagcttcaccatctaagatctggtcattagccctcctaaggccatgctcaaagcgtggttttaggcctgtggttctagccgccaactaggtttggatgcgacagtggagatttgggaggggctacatctgtgtcagagttaccttacatgagctacggtggtttgggaagaaaagaagcaaaagtgtggtccagtcggcaacaatccgaagagaaagtgggaaagagagtgcacctcatctcacgctatcgggaggacccccatcaccatcgtcgccgttgtcgagtagaacgacgactagggaagaagaggccaatgacctagggtctgtttggttgctaccctgatggagatttgcctggcctgtagcaagcctgagcaacacacaactttgtttggttgtctccctgaagacttgcctgactcaggccaccgaaaatggacgcctgatgcaggcacggtgcatgcctgcttcttcttcatagattattcattgatgtgactactaccaacacttttaatcatcctaactcacacaagtgtactttttatgtttaatatattttactcaggcttggatcatcaaccaaacaacaaattttcaacatgcctggccaggtagaactcaggcacataactcaggtcatcaaccaaacagacccctagtgtcctgatctagcggctagcacactggaggttggggagggaacaaagcttggttggcatcaacagatctaacgattatttgggcgccacatccgctatcactaagaacttggctgcggccgccgtacctggatccgcaccgccaatagcccggttgctagattccccccacgcctggatccgcatcacttagcagcgtccggagacatgaggtgataacaatccggtccaggtgaggttggccgaggcccaataacttaaggttactcagaccccaacagttctttggcacacccactcggggaaaggcccaatctccctaaaagactagtccaataggggaagggtggctctcctttttaaggtggcttcctcctcccaagctaagcaaggtgggattattcagaggctcacacggtcgccacccgacttttatgtctttgccagcgggtaatagtggaggatgtcctcatcatgagggttttcagcaaggatgaggaggagagggcggtgtggtttcttgtaacgaggaatcatgaagggatggtgggccgatggcgctcgaggtgtcgggatgatggcaacgctcgaggtgtcgatggaggaaagggaagagacaattaagaacgagagagatgggtggtgggataggtaaaaaaatagaaagtgtgactgacaggtggggtccatatgaggggtccatatgagggtaagggtatatatgtgcatcttttttcactgcgatagggtctaaaatataaaagttttaatttagtttattacaagaaataccccaaggaccttcatataaataataaagggttgaaatgcaaaatatatattagggtgttctccactatgggttatgtgattcttgtgtgattttaatccacatggcaccttgagagttgagaccactggtagtgttctccaacgtgcgtgccctaagttttagctcaaccttggcctctggctgtcaccaacacacaccagaggcccttggcctactgcctcggtacaccccatcctgagaagccagctccatgtgtggagaacagaaaagaagacagtgcaccaaaggaaaaaaaaaagaagaagaagaagcaaattatgcatcggatgggttgaaatggtgaaccgtggcaaataaacaagcgtgcacctgaactttagagagcattttagcaatggcaacaaactatgaggcatattagagtatgccatccaacttgtgcccatctgagcaattttccccatgaaaaagaaaaggagaaaacaatgcatccaaacctcagccgcctctccacatgtgcgcgtcggtcggactaagtttgtgggggccgggagaatcggggaatcgatcgatcatgcatgtgaagtgagccgaggcgaacagagtcaggcctgctccgtgacacacgcgctgcttcgctcgtacgtagccctaccagtacgtggcccagcgcaacaaccactcgtttttaatactccacggggccccctacccacacccaccaccaccaccaggaggcggtctcgctcacaaaagctgtaagcaatgtgcccatgattgacctcgctagcccagtgcggcttcggttgctcacaaaaccaaaaaaacaaaagaaaaaccatagtagtagacgagcgcgagtgatgcgggggagaagctgccaaagtgtcggcgcctcggcgcaggcggggcgggctaccgcgaaatacgaacgaacccgcgcacgcacacgcgcgcgcgcgcgcgcaccgcacggaaacgtcggaaaggggaggaaaacgcgtggagacctggccgatttgggtggtgggagcggccgggattaagggacccttcgcctcgcccacggccggcgtggagtactcgtactggactagtggtactgcacgcgctagcaatagctgctgctgctctctcgttggctcgcacttgattacgagatcgatcttctcccacttctgaacagctgcttttcttttttttttttttgttagggttggaaatggatcggattcggaccgttaatagtcctatcatattttaaacataatttttaagtggatctggaacgggtgcgaatagtatgcggatacgaagcggattgcttcagatgtcagaaatggtacaaagtcaatacggacccagtttagaaacgaattaaaaattatcagatgtcacgtatatgtgtaattaatacaacatcaacttagcgatgcaacaaacaacaatacaataataatcaatgaacgatctatcgtatactggagtgctaaacatcatgaatagatgatgtccataattttaaaacacagttacgtaagtataaggtgagacagtaagagcctcaaattaaagtgtctaggttaattgataaattaggctattttattgaacggttcatgttgtattcaacagatggagtggttacgtggattgacaatttcggattatcaggcaaacagcctcctggataatccgatagagatatcggataatccgtatccgtcggattttagataccacatccgtatccgcattagcatccatattcgtcggatttctataaactcatactttatccttgtttcggatcaattcagagcggattggatcgaataatattcgatccgttttcaccactcaattctcgtttccacgagcacatctatctatctattatatactaaaagtccattaaacttcctataaacgctcctaaaccgccacgtggcaccccctacaaatgctcctaagccgccacatggcgttttaatagacgagaaacatctaaccctcaattttcatttaaactggtggatccattattttacaccattagattagattaaaaccaatagtttatcccttcctcttctgtccctgcacgtacatctactcttccctccctccctcagtacacgtactgacgtacatattccaccctccctcacacgtatgtatgtaggcaggtagtacgtactcatcccctttttttttcttcccattcaccctactgttattttttaacctaggatacccctaaatatttttatattacttttttccgctattgacttttgagcatgtgtttgattattcatcttactaataaaaatacgtaattatcatttattttattatgattttacatggatgtcttatattcgctatattttagcacaaaatacattgtggcagatgacatccacatgtattaattaactccacaacaatttttcaaaagtaatcacatcaaactatatactttatggtatcaaatattacttaacaaatatataacggtagtttgaactatgtaaaaatgcaaaccatgtaatttagttgtgtttttaagtagatccaatttaaattttaatttgtgtaagattaacattctcaaatcatttggaatttttcaaaattatttggttggtattttaattgtaataaatcctaaattatacatatatgcaaagaaaattcaccaaaaatattttcaacaggtaaggtatatatcattggttttttcatatttttaataattatttaaatgatatgaaaaaagtcagaatataacaaaaaatacaatatttattttagaagttcaaatatagttaatatgggtcctcgataaaaaaatagttatttattttaaaagattataataaattagggttcatgattaatatatgatgaaaacatgagagacaatacatggggagagggcatgaatgagggcagaggggtggatgttgggcgatggtgcacgtatgtacatacatacaatgcccctcgggctatattggtacaatcgatgtttactttatgttttcactgccaatacatatccagaatgacatatttggttaaggtcggcttttgactctagctaccataacaattataattttatatctttatttgtgattgatcgaaaaatgtagttttgccagttagaggaaacaatcgaattcatgaattctctaaaatgtgctcaaataatccaagagtgccaaacgatcttctacataagtgctctagaatatattctatgtaacatttaaattactttattagacggtatttaatagcattttagtatatggtacatatatatacttgccggtggctatgtgcttatattccataccttacgggtatgaaaataaagtatgttttctctatgcacaaacctttaaaaagatcttatcatccatatatatggacattaactttctataaacatgtcaccatgcacatattcacttgaagaattaaattttgaatccatttatgtgttacgatacaccgagacatgaaaagaaagattaactaaacatgatcgaaactgtaaacactactacaatgaatcgtatggtaacctccgtgtctcagcatatatacaagttttacaaccatgcaacatgatgacttggaggtgcaagaaaaccattatcaccaaacaattgtcatctactagacagaaaaaatttacaatgtattgtttagactttggaacccaaaaattttcttgcgcaaactagaatgagacagcaagcaaagcagggagacactgagtagaccagttttaatgagataataatagtgcatcaatagaggataagaggagtgctattgagtccagctaggccttactttttgtcaccatagggcatattgagtagaaggtgcaagtggattgtatagtgaccaaacaaattccatgctacaaatgcaaaaagctttcaaataatttatctgatatttgaaacacatattttctagggtcttttagaacttcatagaatatgtgataattatgacaagtggatagacattataggcttcagataaacgattataaaatctaattgttactaattcatgcccaatgcaagctagctaaacaaaatatttgtgggttggttactttcgattacataattcctaatatttaactaaaaattttattaaaaaatgaaattatgggaacaatcatataaaagctcattccagataatgatatgtttgtagtaatatttaaccatccaataattgtgttctcgctagcctcgcacacttatgggttgtctcctacactgcacaatagaattggactctacaagaatatgtatttaacatagttttgaatcccctcaatccatgaataaataaacaacaggaacctattttagtattagatgtttacacaaaagttgattcatatttataaaaatgttgacatataaagctaactaattagatgtttacccattagcataagcattgcattattttttagttcttagatgattagactgcaataagtatgtaacaaaaagctaactaattagagggcacgagctttattgtgcaaatagaacatgtttattaaacaataatggatttggaaaaaaaacatttcagaaaaaaataacccttaaacaaacaattataaaaagttcgtaataaaaatttaagcaacatcaaacaaagtgcccgcgcaactgcgcgggctaccttcctagttttctaaattactgaatgatgtgttatgtataaaatgcttttatacataagtcttttcgaaagttaaataaattattttcaaattataataattaatgctcaattaatcatatggtttactttatctcatttaccgtagaacagctggttcgaatgagtctattctcgaatcacttcatcagagtatgtatgtacttcttccatataaaaagaagtctacttctaacaattggtttaggcaaacacttatctatatacataggtagattttttttttaacggaagttttatgggtgaagtaccatggagtattatggactagttgccgggggtgaaattgcagtggacatcaagtgctgggtatattctgttttgcaactaggaaacgtggttagtccacggcaatgttttgtgtttctttaatcaagtggccgggatgccaactgatcacagagaggatcagaggattccacgcacatgttgtttagacatcttgccggtgccgggtgtctttctcgtcgctacctctttcgcaggacacgctcatactcatagtcataggggcgtacgactacgagctagtaagagtggaatgcggaccgatctagggcagtagcttgctagtagtagaattctgaagctgaggcgaaacgaacacaaaggtggtgtttttttttccctgaaaaagaagaggaagattaagttttttttatgcataacgaggtagtattaatgtacgattgattgagttttaattattacaaacttaaaaaaaatatattaatatgatattttagagcaactttcatatataaagtttttacacgaaacgcatcatttagcagtatgaaaagcgtgccacgaaaatcttaatcttcatccaacttttgtgggagaaaagaacatgaccaaaatataatgacgatgtcaaattgatgcgctctccaattaaagcatatgctaaatgtgtagagtaatggccaaactcgtgaaaccttattcggttaatcttctcttcgagcaatttaatcccctcaactccttccatatttcaacccctttctcttgggattaataatttcgaagcttcgtttatgtgaatataattaaccacacgaaaaataagataagtgattagagcatgattaattaagtattaaatgttataattttgagaaatggatttatctgattttttaagaaactttcatacagaaagattttacaaaacaaaaaatatttagcaattttgaaaagtgtgttcacaatagtccaaggagttgctatcctaaaacagctcaaacaaattgagtttaatcaatgtatctatacgatgttctgcgacatgatgtgattaaaattggtcctttaatcatctgctattaattttaactgttgctatcgaaatctttagtcggatggcacgcaaacaattataaaggtcgcgacgaacgatgaagaacgcatgcgactacaaagatgacgatcacgatggacgaggcgaactcaagcatcggtgacggctgcgacggatgtggaagagggcgaaggtcgtggctgacgatgggcacgaaagacaagggcatcgacggatgaggtggatgcaagcaagttgacggtggcgtagcgtggatgtctagcctacaaacggtcaagcggatcccacaactttaagctacgtgtgccgctaggcgacaagttaatcatccgctctcgttctctctcctctcgtcttttttactcgtcctcacaaaatcctacgtgaataggagtttttatcatcaattattatacctgctctaactattgtgcatattgctgttattaatcccgactcccgaggtgatcaccgcgccgctccaccgaacactcgctcacactcacgtccagcaacaacacacgccacttcactaccgacgatcccaccgactactcgctgtcaaaacaacatggccatcccatacaacctttctttaaccacctctccacctcactaatcatcatcatcatcatcaaatcaatcaatcaacgccccctccccctaatttaatcaacccccccccctctccatccagcctagcatcgttagttagtctcccctggccccacccaccagacattccaccaacccccttcctttctctctccctcttctaaacaaaaacatctcccgtttcagtcgcccacacaccgacactctcctctctctctctctcctcgtgaaaatatttgtcacaaaaaaatttaaaagaaaaaaaaacacacccttcgctgagctagcaacgcggtggttgctgctctgctctctctccaagcaaacaccattattataccaccacctccccttccccccatttcctcctcctcccccacgcggcgcaccagctatcgccgccgccgccgacgaggagggtgcgatggaggcgagcgcggggctggtggcggggtcgcacaaccggaacgagctggtggtgatccggagggatggaggaggagggggaggggttggggggaggagggcggcggaggcgaaggcggcgtgccagatatgcggcgacgacgtcggggaagggcccgacggggagccgttcgtggcgtgcaacgagtgcgccttccccgtctgccgcaactgctacgactacgagcgccgcgagggctcgcaggcttgcccccagtgcaagacccgcttcaagcgcctcaagggtgagctcttcctccgtcgccattgctctctctgctctctgcttatgcttcgctctgacaatgttgacacggcatgatgaagtact

SEQ ID NO: 58100 - DNA, 22598 bp, Oryza sativa
cgatgggccgagagaaatccggcccatcgaccccaggggagccaaaatagacttttgcgaaggaatttgatttggaaggatttggattcggaaacgagctcgacgatagatcggggattgagatattgagatggcacggacactggacgacaatcaaagaaacaaatttcgcaattagggtttttaagagataactttcccgctaggcgccacgacggaacgggcgctacacatcgtctcccgcccgtaagtccccgctacggggatgaaaacggcgatattttttgcatgcgtgcgggcccaactaaagcagacgttggattcgttttggatggctcagatgcatggtatgtcatccggtgacttgccataccaatgtcaccaaagctgaatccgatgccttggggtctatgctaaagtggggaccggcttagttactttcttgagttttgttagcaagttttttaaaccgctaaacaacgtgttttatatgaaaacttcatatataaattttgcttttaaaagatcaaataaatttaggttactcaccttgatgtcaagttcaaattttaggaccctcatctcgacgtcgagttcgaattacatttttgaattgcaataccatatataatatgtctcgggacttaaaatgaacttattccaaattttaataatttatattcaatcatatgctaatcacatttaatcatattcaatcatctgctgcgcgacgccgtccgatgccgacgccttcgcatccccaaacagtgattgcgcgcgtctgccacaacctcgcatcttagggacgcgacgaaggtatattacagcaattaattccttttcaaaccaatatattcatgtagattcagaaaaaaactatatttttaaaaaacatttcacctgtccaagttcaagttgtagaattggtacgagtgctcatattcggtaattattttcttaataataaacaacctaatattcgacaataaagtacccgcgagctaatttaatcaatctcaagatatgttgatgaccataacaagagtgcttatatatagacataagaggagtaatatgtgcgtatgcatgttcctagaggtgtgtagtatgtgcgagtgtatactagcgtccgcttctatattatttttctgatatctggcatacacgtgcatgctcgcatatattttcaaataaacgaagtcacctgtagcatccaagtagttgtgggggtgaatcatgcacatggttcgacctgactgatacagcagcaaatgcgtaggcgaccgaccgaaatacgtggccattattattactgttattttgaaatttcaaacaaatagagagggcgagggcggcatagggcaaacttttatctatcctttcttggaaccttgatgatcagtaccgacgatttgcccatggacagcaagttaaattaagacccaatgctgccagcgagacgaggaagttctagagcaattgttgaatttttgactgcacctgtgaccaagctgattggttaaaactagagccaaaaccgtttgtgcctcgagcatttaatgtcactagccgctcacccgtgtggtgcacggactattattattattagtgtttaattataatagtacatatgacttaataagtttgttaaatatttaagaacgaactaaaatcagtattaaatattaaatcacttagaagtgttgtaacttctaaactgggtatgtatgcaaggtcgaaataattataatattgtttcaaatagacagttttatacttgcattcgacagatatttcacgttttcttatcctacaggactcatgttttattttttttacctttccttacaagatctatagataaatgggatctgtcacttttttcatgattaaggtaataatagaagacatgaaatgcttttagtaattcatcctacatacagtacatgtccacgcgaatgcgcgggctatcttcgtagtttctgttaatagctaaatcagtctatatatcgttcatctttgattcttttctgtaatctaataggtcatatttttgtttatactaccacatcaaatgttaatagtagatggaataactcataaatcaacagttaagatcattgctatatggaatagagtattatatatggtggcctcatcttttgcattggttttggggtgtttagatccagtggtgtaaaattttaacgtgtcacatcaggtattatatagggtgtcgcatggggtgttcggacactaataaaaaaactaattacataatccgtcagtaaaccgcgagacgaatttattaagcctaattaatccatcattagcaaatatttactgtagcaccacattatcaaatcatggagcaattaggcttaaaagattcgtctcgtaaattagtcgtaatctgtgctattagttatttttttagtctatatttaataatttatacaagtgttcaaacattaaatggcctattctgttgtgaacggtactgaatggaatcccccagtccacattcgatcgatcctcgtatagctctgactgtagtgcaaagttccattgcatggacgtggttgatttcaaggagtcatggagattatctgagcccttcacgtcatgatcatagacccggcatccatccgacagaattgaccggcccttgactagatcccaactttttttttcaaactttcaacttttacatcacattaaaatatttctacacacgtaaacttataacttttttcttcaaactttcaattttagtcaaacttccaaatctattatattattaaaggaatagaaaaaggagcctccacgttcgctctcatggcctagaaattctcacattaatcgaaaaaagaaaaaacagagtccatatagaaatataatttagaaatagctgaaattcggaattaaaaaataaggaatattagaatagaagactagagtccatatagaaatacaatttagaaatagttgaaattcggaattaaaaaataaggaatattagaagaggagactagagtccatatagaaatacaatttagaaatagttgaaattcggaattaaaaaataaggaatattagaagagaagactagagtccatatagaaatacaattaggaaataactgaaattcgtaattaaaaataaggaatattagaagagaagattagagtccgtatagaaatacaattaggaaataactgaaattcggaatttaaaataaaaaatattagaagagaagactagagtccatagaaatacaaatataggaatataatttagaagtaactgaaattcaaaaaattaaaaaattaaagaatattgaaagatgagtttagagtccacatagaaatgcaattagaaataataaaaattaagaaataaaaataaataatattggaagaaaagcatagagtctatatagaaatacaatttatagaaaatttagaattaaaaaaagaaatattaaaagacgagtcttgagtccatataggaatatatataatttacaaacaactaaaatttgatattaaaaataattaataattaacacgtatataaaatataatatgaaatataagaaataaaaataaataatattggaagaagagcatagagtctacatagaaatacaatttacagaaaatttggaattaaaaaaagaaatattaaaagacgagtctaaagtccatataggaatatatataatttacaaataactaaaatttaatattaaaaataattaataactaacacgtatataaaatataatataaaaattaagaaataaatataaataatattggaagaagagcatagagtttatatagaaatacaatttacagaaaattcgaaactaaaaaaagaaatattaaaagacgagtctagaatccatataagaatatatataatttacaaataactaaaatttaatattaaaaataattaataactaacacgtatataaaatataatatgaacattacacattagtagttttgtagagttattgcaaaatttaaaattatattgttattttaatatatttgaataatataatgagaaaacatataaaaatataatgatgctagccgctcaatctgcgtgggccacaatactactttgatatgaaattaaacacaccctcgatcatcttccgagtatagatgtggcgtacgtgaacatggatggatttgtttctcctgattttaccccgtttgcgtgtttcagaacagtgcctgtttctggtagttgtaacatggagaattttgcttgctgtaaatctgtaattctctccggcagcgcgctctagctcctggcatcagcggtctttcttcaccattatggagctcatgaattttttttaaacacatcacattttattaaaagacaaagtttaggggaaatgaattccgaacacatcaccaggagatagataagagttgaaccatctttaacaagagagaggtcaactgaagaaagaaagcaaacttcctaatgaaactagacagcaataaaggagcaaatctacagggtactgcagcaatgccgtgatgactgcatcgtagggcctgtattgatattgatgtgcactccgcttgacaagccgttaaatcccttcgactgcctccaccggaacaacacatatgaaaggtttgttgctgagccgtagattttggtgtgagttccaaaagtttccatatccatacctgttttcaaaaattttaaggccatataataaacactaaatctcccaaccctatccaaaatagtatactactgtaagacatctcaatttttttcctctggagggggggggggggggctactcattttgaaatggctagagatttctttgagtgaacacaatccaaagtctcccaaccctatccccgatgagatgttatgcttatgatatagggtggtactgttggttactaaaatttggaattttttgttttaaagaaaaattggaagcttagtttgcctaaggttgttagaactgaggggatcacctatacatttgtcgataaaatttctcctaaaaatttgacaaatgtaattacaatatagtcgtagtgtagttacactgtaaattacgtgtaattacactgtaactacaatgtaatttgtatgtaactttcacataattttaaaccgttagatctaagtcacaacacgtacatgtgagaggatttgttcccatactctattttaccgaaataacatgttacgtagagatttttaaaagttacatacaagttacattgtagttacagtgtaattacactatggctgtactgtaattacatctgtcaaacttttaggagaaaatttatcgataaatatatagcaaaattgatatgtaattatgacacacttacgtcggatatgaatattataaaattatgatacaaaatgggattagaaccgttctatcttggtaggtaagataccatgatttaaatcgacataccactaaccttacttctaaatacccctcatttaacaaggggcatcgatgtcatttttctcttttctactatctcgtaagagtagttattttaaatgttagacttatactactactacatttgtttcatattataagttgttttgagatttttaaatcaatctttttaggtttaaccaagtttataaaaaaatatagaaatatcttcaacacaaaacaaaagaactatcaaaatatgttaatgaaactaatttaatgctttaagtgtgtactacatttttctataaattggttaaattttcaaaaagaattagaaaatcgaagggaacttaggctgtgtttagttcacgctaaaatagaagtttggttgaaattggaacgatgtgacggaaaagttggaagtttatatgtgtagaaaagttttgatgtgatagaaaagttggaagtttaaagaaatattttggaactaaacacggcgttattttgatacggagtgaatagttccagttagcagcttgtgtgtacatggcacagtacataccagctgggtttgcagagaaagtgtgacagtgtgacagatgtgcatcatgtgggtcacaaactcatttcacagtcacacaccagataagcttcctcccctcccctgcatccactccacagtccaccacaccacaaacgtatctgcggactgcggcgatcgatttgggaggagaggattcagacgacgatcgatcgctcagaattcagatgaccagcgtgaggcgagcagacaaacgcagctgattcgacggattcagaatggcatcatcagttgcaggctcagtgactcgtcgtcctcctcccgtgctgctggcttgccgatcgcgaccaaataatcgtcgcctcatcagattgttaccgctcctcttcgccgtcgtcgtcttgcttgctcttcttccaccatgcgttcatggagctcgtgctctgaatgatgccaaagaagccaaaggtcagtcactgttgttaagatttgctgctagttgatctgcttcgtcaggagagtgagattagtgtttgtgtcaagtgtttgatcgtgaattgcagttgcagaggccagcgaccagacgacgacgacgacgcacgccgcggcggcggcggtggctcggtggtctgtcaccgtgagggaaggaggaggtggtggtggtcacggcagcggccatgccggcgccggccacggccacggcagcggccacggcaggccggagccagccgagcaccacacgggcaggcgcagcgcggcggccggatccgtgcgccctcccatggcggcctcctgcgccgccctccttgtcgccgccgtcgtcgctctgcttcgcttctgaatgaatgaattctggacccgaatcgctcccgatttcgcatttgaatttaaatcgattcatcttgctgtgtgtacatagaatgaaatgaaatgaatccaaatgaatcgccaagaatccgcccgattcggggattcccggcgagatttttccgcatcttcaatctgcaattttgtgtgtgcgctttccaagaaatcgagattttgttgaatgcgttcttggaatcgtataatccgttgctaaacttaaaaaacgtactcatctttccacgaattgcatttaaatacgtaagctgcggccatcctacggtacaccgagcaaaataaaattcaccaaccatggattcaccggtcaggaaacaatggctgctcctcctcgtcttcttcctcctggcctcctcgtgtgttcttgcagccggtgattcgtctgcaattggcagcaacgaattaacgggcaagcaattcaattcattctctccattgatctctctctctgctcgtggttagattgatctgatcccagtggcgtcttgtttgtcttgaatcttgatgatgagcaggagctgaggagaagaagacggcgagcacggcggcggagttggcggtcgtagtaagaagctcccacggcgatcaccatggccgccacggccgcggtggccgcaagcacaagggcaagaaatccggcgccgccgcctccgaccgccgccccggaggtagcacggcgatcgcttgctgcggcgtcgcctcgccgctgctgccaattggctgcttcctctctagttcgatgtacttaggctcaatggtagtagaagattagttgatcaggggttaattttgtttagctatcctttttggtattctttcactatctttttcacattttcatgttagagtgatttcactggtttgtaaggcggcagtgttaatttatggcattgtaacttaacaccgtattgagagatcatcaaaatttaaattagaactgtacctccttaaaagcagtagaaaatctcatttagttaacattctctctgtctatactctaaagaagaatgggtttacgaaagatattgtcatatttttcacttaattttaatcatactctttctactatagtaggtgttatgaaactacaaggtgatctcatgatgggatcgcaaccgaagcaaccgcgtctcttccactcgatgatccgtcgcaacgggcgcgatggttcccaaccttcgcgtctacggttgccaccccttcattgatcaataaagaacatccgattcattcgctcaattctctcttactcgttctcaatcgattctattcactttcaacagtaggtatgctcagatggattcttaacacgtgttttgatgagggctcagcttgaccccttttttttttctaggcttgaaataacccaagacctaaatgtgccatttgagcattgtaagctctagactacgtactacatcgcaaaacttaattacaatataagttgtaaaactgatttaactatttatttttaaaatgtgccgtcgtaaatatagctaaaaaaaataattctagccatgcaactggctagaatggggacatagataatacgtcatatatatgttttgtgtcataatgccgtgctaaaacatgtttttatttttcactcattttttgggtgttgtcgtttttttaggtgtggctgtatacatccctgggatgtaatggcaaggttttatttaaatccattatttaaaaaaaaggtttttaggtccggtctttcttttaaaacgagccaactctccttgatatatcccgtgtaactcccctcatcagagttttaatttttattaaaggtccttatgatgtgcatctaaaagaacaacgatttgaatgtattttcttttgaaacaaggagtcccatcttcatgacaaaaacaatgaaaccggagtacaaggacccaagaaagaaaaagaagtacagaaactctgcacaaaaagaaacaagtatagaaaacttagcatgattactactttatgctccaaaaggatctaaacaagctaagctaaatatagttttaaacaagaaccattaacaaaaacaccatgccaggccaaaattcaatcccataaaaaaaatggaagactaattgtctgtatggaaggagctaactctgaatgttgctgccaacacaatcattactagttttagttttgtgcctaaagttgatcttacaaaccatttgagcttcctggagaagttgttacaaccatttgaagagtagatgttctactgattcgaggcactgaacaaaacatgctcctcttggatcctttccacactttggggatcaggttttctttagtgagaatacaattctgcagcatcaaccatatgagcaccttaatcttcagaggcaagtttgtgttccacaaatacttgtgtgtgaacgctgcctgagtgatttgatcaaattcaaagcctacctatgcatatttgcctaaacagcacaagttagtgttctacatgacttgttccattctgaatagctctggtccttagtaattattggctgaatagctgaatgatttgtgataatatttcatgggtacaaacaaataaattaactatgataaagttggaaaatggatttaaaatagtataacaagaaattcgcacatatatatttttttctacaaaatcgtaccgtttaggagtttgggaagcattcatgttaattctattcattacaaacgaccaggtcatgacatttcataccatcaattggtacaagacccacatgcgtaattgggcgggccaaacaacacatctaaaatgtgcaataatagtactagtccttaaaaaaaacaacttggtgcatatcttttaaatatgaccaccttttgctgcattgttgcttattagtaggataatgcttttggggaaagaaagctgaggataagaaaaaaaaaaacaggaaacatgtattagtgctggatgttacaaaataaagaaataagaaaaataaacaataaagttggtgtccatagctctggcagtacaagtggaaagttccttgaagaacttattctatctcatttttaaaggatttttaagggaaggatgaagagtgttggtagcagaggcagagtatcagttcagtttacactactactacatcattagctctgctcattgcagccatggagagtgcaaagagatcttgccttgctatctccctcatcctactcctactccttgttccaagtatccatggagcaaggcatgttgctgcagctatcaagggtacaggtacgcagtgttccttctcttctctgcatgtctgtcttagtaggtttcttacaccatagtatccttatatgcatcgtttttttcagctctatgtttctatgaaacaaatgatgacaactcccgtgtatatatgttttgtattgtatctgcatagaactgtatgtttctgaatgtttgtaaagttgttattaacatgatttctatggttctgttggggttggacatgatgttcgactattcaacttaactttcgttccactacttacaatattagttttgtgggaaacacatgaagatttgtttgtttattacaagcattatgcacgatgaattttttgattatgtcaaaagtacaaccaacaccagaagtgggtccctaaaaaagaaaggcaagattatagctgtggttggttccctttggctaattgccataagtttagataagcaaaaccttagaaaatatttgaaatttatctacaccgtgtatttcttgaggaaattatctacaccctattatttgtaaaacgtttctaatttcattttgggtagcctcgcataagttgtcgtcccgtttatctatctatatatcttccttcctcactaatcaaatgcatatccacctgcaaaatgaacaaaagtaattgcaatgtcaagcatggccctactgattaattgtgtccgtcgatggaccgaagaattcagtactaaattaaaatgttcagatctggaagaaatttcttggaaaacaaagcagttgatttccttattgttaaaatattattcagtccaaacatgcctatattagttagtaattaacttattcaaaacatatcaagggtctggctggcctagatacttgaatctccagtcaaaaatcaataaacaagacaataataataataaaaacttgatgaatactcatgtggtgtgtgagcgcgcagatcaggcatcctgcctgaaaaccctgtcaagaacagatgctctgtcctgtccatgtgggggaacacagtataattaatgagatattattcccctgcatttccggagacccttgcactgcacgccgttaatgatacttaattatattcctaactaatgctctcgtgatatcacacaaagtgattattcaccaataataaatataacatggcatcatcacgtcctgtttacaaacaaacaacctgatgatcatgtgtcatgctcgatccagaacaaaccataaaaaagagtagaaaaaaacaattttaaattttgaaggacatataaaatcaagtactcgctctgtactactccctccatttacttttgatagttatatttccaaatctgaaaaatttatttttgatatgtatatttcaatccaacaacctatcaaattaatgatttttttggatttaatgcgtgactcttcattcttccacacaagattagctatataggcatcgagaaatgtaaatattaatgaatcgcttgtttacgaggaatgactagtagcatgtttaaatggatgataagtaggattatttatccttggtctatatgctaagatgaaatatgactattaaaagtagatggaggaagtagaatataaggatttttagggttagacacgtgtaactagataaaattaaatgggattgagaagtggaggtagatgaaaaaatttgaatggtgaagggttgtgattgattgagaatagaattttggtgaagaagttttatattttgagacaaatcttaagggttagaaattgttatattttgtgatggatggagtaattaacttgaatatgttattttatgattatctaaaaaaatatgttattttgtggcacgtgaagaacagaaacttgctgatacaatttcaattgatactatacgtgtgtttttttttatatacaggcgccgacagcgagatggtggtgacggagaggacggccggcggcggcggcggacatggacgcggttacacaagccaccggtcgcacaaccccaacaatcccaacgacggtggctccggcacgccggtggtggacccgcacaatgtcgccaccaggggccaccaccaccgcggcgcggcgacgaggacggccgccggcggcgacccccgcctggcagcctgcatgcttcgtctgggagcgaccttcttcctgctggttcttggctgaattatttattggaggatggatatgtggttatttttcttaagtttttttactgctttttaaatttaatttttctgcgtttttgatatagtgtggtcatagttttgtgacatgttaaataccaagagatgatacaaggtgtatatataccatgtgcatgtgaagttgggatgtgtgtgtgttttgctttgcgtgtatgaagacatatgtatggagtttgtttggcagaatgtgtggtttatatgtccatatcatattgttcaatgtagtactaggacctagagatcagagagcatctcaaatcctagtgctatcagtacagatcttctatacaccttagtgtaatacacccattttggatttgcatttatacacttcagaaaattttatatgcaataaacaggtaaaccatgcttgtgcatactcaaaatttagtgtaataacacaacaatatgtgaatatatataaattgaaagttgcaaacaaatacaaattttgtttttttacgaaacacagtacaagcacacagatgctcatatacacacgcgtgcattgatcccaatgaaagcacacgcagaaatcctagccttaccaattccgagagattgggctggcatattttgaaattgacaaagccaccattgacatcttgttgtcaataacacgtcgtcaccatggaaataataatttgctgtaaatacgatcactcatgccaagtctagcacttcagtgtcagctatcattggcaggttccttaataaaaaacagccgagctaacctcagtttgccaagtttcgtttctttcaagattggggaaatatgtttataaatggattatttcaaagccgtgaacaaattattagttgcatataggagtgtttagaacttgaaagtttcatcaattttggaatgaaaataaattttcttgtaaatatttatttatttggatcaatcaactattttttgtggtttcaatcgtactttgctatgtatgtaggtctcttaatgcaaatgagaaacttttggagaaaaaggtgtaagcactcagaaaatgtttcagccataggctcggccaaatccccaaaactaactaattagatccatgtacgatcagacatggatcgtccctggtttcctttcacaaactagcgtgacctgaattttgcaacctatagtagatgtgctacataagtctagtttgatctagcaataggagatatcaataagtacgaaacgaagaaagaacaaaaaattaactgtatttaataagtaaaagaaatacattgctttggaccagctattggccactcaacacacattttaatggaaaaacagatagatttttaaaccatatgattaacaacacgtagcttacactagacaatataaaacacataaaaccaattaataagattaaaataataagaagttaattagaaaatacatattcccctgtcccaaaatataaaatttttttatggatgcatggacatggatttagattcgtagtactatgatatcctattcaactaaaatcacttatattctgtgccacaataaatatgccattttagaaaaatgccactactattcacgattttgcggatggcgtcaaggatggcggcagcggcggcactcgagacctcccatcgcggatgcgatcgatgacagaaacggcggcggcggctcccgagccctcccacgcggatggcatcaaggatagtggcggcggcggcggctgcaggttccgagccctcccgtcgcggatggggtcgaggatagtgacggcggccggggctcctgagcccttccgcgtggatggcgttgaggacggctgctcccgagcctcctgccacagacggcagtggcagcaacggctcctaagtctcccgccgcagatagggccgacgatagtggcgacggtagtggctcctgaggccttcacggaggtggccgatgacagcagcagtgacggtggtggtcgacgacagtggtggagagagaggaaggggaaagagaagagaggggagggaagtgaagatgaaactaacagctaggtccctcgtgcagttggggttagcggagatttttgacggaaaacgtgatggagtggtatggttctaattttttcaaattccaatggcacgtagccaatattgtgaatagtaatgatatttttctaaaatggcatattttgtagtggcatgatccaattaacccttaaaaaaatatcacttcatactgcatgcacgcaactggccctcctcgccttctcttccctttcctttaatcttttctttatagtagttgagataatatttgttatttatcatattaaattctaatcaactacaaattcaaaattacacataaaatttttacatacatataatgtaatagttgagataggcttaaagtggtgttgacatattttaaattataataaataaaaatgttttttgggtcatataatgacccttttcatcatatatgacaaacaaatggcgacatatattattttattatatatcacttttacaaacatgcataactaaattcgctctacaattgaaaacgaagtttagaccatcatattatttaccattaaattaatattttactatctgttttgaatatatttcaacttataaaataaaattatatttcaggttgcattttgattcttttcatataatccaaacagacatgaaaattatataacaaatgacaatataaagcatatcattatatatctgttatcagttgacaaatatttatgactaaataggatgacaaaatccaaaaatgctattgacaaacgcccaatttcaaccaatgtcatcaacaattttatttataaatactctacacaaactaatttcatttatataattgctctcttatttcaattttaaattcatttttccaagaacatagtaagtatatgaaaaaaggaggtagcagaagtaaatataaatttgttataattggacaaaattttcctcttaccatatatatcttaatagaaagttttttccattaaaatatcctaaattccataaagatatctatagtacacaagaaaagctattacttaaagtttagaaactccaaaaatatgatatactaaatattaaaaacacatatagtacaaatgataggtccatacgaatcaactccatttccacgacacgatattttctcataaactcaagattttatgaattccaataaataattttaatgtagaatttatatgttgatagggtagttagaagaaaatcatgaccaacatttaaagcagcgatcctaaacaaattatggacaaaaacatatttagaatataataaaaacatattacaaaaaaatcacccacatgttaatattattcataaaatttcaagcaacattaaacaaggtgtcagtaatgtgcctgcggctaccttttctagttacaaatataaagacgggacaagtttttctggagctacctaattaagattcggcaatctccattattcgttgttgaagcactctacataagagttatgctccctgccttgatcaggtagttaatatgtactctcttcttggtgatttttctccggtcgggaagatgaaccctaataaaacctttatgtagcatcctgagtttgactcctttacttaaaaacgctttttattacgttttaaatttcaaaattttgaaatctcgtgccattaatgatttcaaatttgatcaatatatccctccatctaatgttccctccaaaattcatcaagttttaaattcataataaaatcctgaataaaaaaaataaaaactgtactccaattccaatcccttaataatctatatacttactgctataaaaagcaccagttcatcgaacacttatctttttcgacccttagatctattcatccaacggattatatcaagagttggatcaccctgcaattagcgattcacctctgctaatccgcggttagagcgatcggtaaaaaggagagaggaattaaatcccacgtcgtccggcgagagagagagaggaaaaaaaaaaaagaaaacccacgaacaaccgctcgctctgcggcttctccccacgccgagcgccgacgcttccctccccttctgtcgacgcgtgatctcctcccccaccacgagccacttccctcgatccctcccgtcgaccgcgcgccgcctccgcctcggcgagaacccagccacgggcatgcagggagggaatcgctcctcctcgccgaccgtctcccatgcctccttccatcgcctatgcgcctcaccggtctctgccctccccttcgccgttgcagcacctcgccggcctccacccccggttgaaatcccgtttttttttttgttttccatcggttacctgcaaatttgagcctacattgttttattgaaacgtggtctgtggatttggttgtttcagccaacgtggtttatggattttcaagtgatctgtggatttagtgagttgcattgtaatatggtattgtagatcatgtattttaggactgacttttacattaaacatgccccatggtccatggatctgtgcatcgtaatatggcctttacttatctgaaaattgcttgtgaattttgcttctttatattcatcagaattttacttatctgaaaactacttgtgaattttactttattatttactaataatagcttatttgtatcctgaatcatttgaatagcttttagatataagggaagaaaaatggaggagctgttggcctgtgcttggctaacaaaattggtggagaggtatcatgtaaccaaatcaagcacataatcccttttcccttttaacatttatagtttctaatataaagtgttctaattggggtgagactgttgactggcttaccatcttggcccctcttagtacaagagaatatatcacatcgaagttttccttctggacttcatgaaggaattaatttttcacaagtatctttggcctaatcactaatcatcacactttgtgcgaagaagtcgagcatttctttgtcggtcatctcacaagtatcgttggcatggatgtcatgctggcctaccccctgaatggtgctgcttcagtatttggtggacttcaatttcagaatgatgtggtgctctaaattttttttccttttttttatctcaggtttgacctttggattgcatcttaggcttttgcatggtcttcgactggtaataatcttcagaatattcacatttcctgtgaccaatacatacctaaagtctagaatgtcactatactttggcatggtgcaaactttggcgagttctgaaataaatattcatgaatcatgagctaacctctggttaataagttttaacattaagatcattgatttactacatccaacattgatgttttaatttgttgggataaaaatacatgaattgctggttgatcaaaataaaagttattgcttagggagcaaccatagaatttgctccagggaatttttttttgtcctaatgacacattgattttcaaattctatcaatccttttgtgtgtgctgtgcaaatctaattcattggaaaagatgttagaaaaaggttttccgaaaatgattgataggttttgtgcaaatctaccccacaaattggatttgaaaggctggttgcttagttagatccaaaaatcaaacttttctatggccttgggccctaatagtcaaccttttttcagaaaccaaatcttcatttcgccggcacaaggattgctgcacctttacatttactaataacactcttattccatatagtccatgcaccgctgccaaccttgatccacatcaagcctccgcctccaaagctacaggagaagatggttgcatcaaactcctgccttctttctcttcaagtaacatcttatctgtgttttgatggaattttggaacatgcatggataattttggtccgtgttttgatgatttctctaatttctaagtattgaccatccagagaaaattcaggtcttctgttactcatagtaaatatcatgatgataataatagtttactcctaatggttctctttgttccgctagaaagaagtggacgattgtttgaggaagtaggggagagagtgaagcatgtgatttttcaggcaagtttgtcaaagccatttgaatgagaggctcaggatagctggtggtaaagcacagaacagcattggcgctgctaaggaggctgatctccgggcaacctaatgttcattcatttgcgacatcagatttgggctgcaactgtgagttcttttcaatcttataatcaaactcgatgcattcttgaatgtggtgcaacagtttttcttttataatcatactatattatataaattcatattgtgaatataatctagatatagactaatataaaaagcacgagttgtttagttgcaattagcgcttaaccctccaattagcgcttaaccgtcgccaaatcgaaaaaaaccgcgccccgcacccctcgcctcgcctccgcctcctccgctcgtgcgcgcgtgaagaagaaagaggaacgaggagagaagaaatcgagaagaggagaaatcgagaagagaagaaaagggacactgtcaggtgggacccatgttcctttaattaatcttgcacagtaatcatcctcttaatcctgcattattatctcattgacacgtgggtccggttgcacaaattcttgattaaatctatatctatactctatactaatctactaatataaaaagtaccagttcattaccaatcccgcaatcttctagacccactctcacgtgggtcccacctgtcatccctaagaaagaaaccgcaccgcgcacgaaaaaaagaatcgctgcgaaaggaagaaactgcaccacacgcgccatccccatgccgccgctccgccctcctcacctcaccggcaaatcaatccaccgcatccactggccgctgccgccgttgccgcgatcccagaagattatgcgggcaccaccacatccatccccgacgacgtgttcttctcccacatcttcgtgaacctcccagtaacatccctcgcatgtttcagggcagtttgccgctcgtggcacgccgccgtcgacgaccccgccttggtccgctgccaactcgagcggttgcgcgcgaggcagctgccaacgtcatccttgcttgctgtcgcgagcacggaagatatatgggacgagaaagcacactctccaacttcgaggttgtcagcttcaccggctaaggcttaccctgcgggcggcggctagaccaggagcgagagcggtggcggcgccgccgctagacatcaccgccgagactgatccgatgcaccacaagtctatccctaacggcggccgtatcacccgccatatcatccccacccactgcgacggccttgtcgccttcgccacctacggcagggccatgctcgtgtgcaacccggccacccaggagctcgttgtgctgccgcccggcaacggcagcggcccatgcccacggtctacagaatcaacggcggcggttggcttcgacccgtggcggaacaggtacgtcgtcgtcaggtgcttctactgcaagtcccacaacgatccgccggtctacaacatcggacacgagatcttcacgctcgacacaggcgccggcgatggatggcagcgcatgcaagacccgtcgcgtgccatcagtcccggcgggaggagacccgccgcctgcacgcgtgggggttccttctactggttcatcaacgagtctcagccatgcgagctgctgtgattcaacctgcgagatgaggcgttcgacgcggtcccgtcctctctgggctgcacggcctgacacaacgacgaccgtctctcggacctcgccggtgagctgtgctacgtgcatcacgtccgcacgagcgtggccacccacgaagtttggatggcggcggcagtcgatgacgatgactaggagtggtggctgcgataccgagtggacctgtgacacaacccgtggggcgcggcggcggcggcaacggccaacgctggttccacaacttcggcaccacggtggccggcgacgatggcgtggaggaggaggcgacgttggtggccatgttgtacaaggagctgtggtggcacagggagcggagcaaaccggtggtgaaagacgtgaacatgcaggggagccggtgcagttgtgagtcggctcatcttgaaaataacttacacacgttgacatgtttagtcagtgtttgttgctgcttcagacatatgcaaagggaaaaatgtcagtgtacggaagaaaaatgtcatagagaggcatgggggtaggggtttatttttacaaattcaaaataaatttgatcaaacaagaaatctttaagtacatacataacctcaaattgatatggtaagctcgccaacatgtgaaaagataaccaatgaggattgatatgggacttactatcaacatcttcaggaatgatttattccaataagataacattaccagaacatagtttttttatgatttatgttaccacatactaaccctcatgattgatttaggcagtggatgtatatggtcaatatatgtcgacgtgcctcactagttattaataaagtagcactattcatcgtcctctttcccctctctctcaggccgggctagccttctctctcctatccttttatttttcagcccatcagtaagccggcccagtccactccctcctctttttttcctacgcggcccagctagcacgggccagaccgaccaacacgtgcccacgcacgcagcttgctcgacgcatgccgcgccacacctcacctcgggtcggccctgcctgctgcagcctgcatccctttagggcaagcttcacagtggagatgatagtctcccttaattcagttcacatcattaactcattaatgaaaatgtactactccctccgtattttaatgtatgacgccgttgactttataatcaacatttgaccatttgtcttattcaaaatttttgtataaatataaaaatatttatagcatgtttaaagaacatttgatgataaatcaagtcaagataaaataaatgataataacataaattttttgaataagacaaatggtcaaacgttgattaaaaagtcaacagcgtcatacattaaagtacggagggagtatatactacaacaaattacctctagcacacttaccataatacatcatattaattttgatttatttgtttgctatcaattcattggtctcttgttcttatatctcttaaagtttgtatagaggttgttccttatatgagaggtgtctctttctctctcctttcatctctctcatccacctcatcatgtgagcttacatggcacctaggggtaagtgtgtagaggcttagaccattcccaacccaatgattaggatggtgtctatagcattaaataagctgtcacctaggatgaaagatgatgcggcaagtgaataaatgagtaaagagaagggaaacaagtttggtacgagacatggtttctacacaacatccaatacatcatatgagataagcagcattaaatttaagtatggaaaaattgtgtttgcgttgaaagagtagtgtagtttattgattatgtgaagtttatgtaaactatgtctagtgttttgggttgagactggccttatactactggccactatccacttctccccaccgtcacaaagaagacatacgcatgcattagagtaagttggtttaatagtgtagccaactactagctccaaatcatctatggccaaattaatagccaatttgtataatacttactcactacgctattaatatctggtcccacctgtcatacacattatgtcttggagtccatgctgtaggcctgtagctggctatagatctgtagcccactgtttttctctcatcttttatctctttaaaatatgattatatctgatttataataatgctattgtacctgctcttgtatcgaagaacacggcaagatcacactttctgattcactttcttgtatgattttattagatacaagagaaaggtactactgcttttaaaagtaacgagctaaaaacaatcacctagactcattaaagtacttgactccttaattacctaactgactcttcgattatctgaaaaaaaaaatccttggttacttaattgactgctgtatattattacctccggattgataatacttatcgttttagaaaggatgaggtcaaac

SEQ ID NO: 58101 - DNA, 3033 bp, Oryza sativa
tcctgcagccctgaataagttgaccagacgttcctcaactttacgtcaagttcgtataacatccctataaaccacagtaccagaaagataaaagtacagcgaaggtccctcaacttgtcatcgagttacaaaatcatctcccaaccacaaaaccggataccggaggtccctcaactaacaaaaccgttcgcttgaggtcctctggtggttttgaccccggttttgtctgacgtggcgggtgagtcagcgtgggcctcacgtggaccccacctgtcagcattgccacatcagtcttctctcttttcctctgtggacccccgtttttataacaggaatcattcatgtaaacagtaccatttccctggatcaagtagtctggtacacaagttcatagctgaaataccaaaagcacatacacgagagtctagtgctaattattacatcataagcccgcaggcattgtcttaaatcatcggaccgagcggtccggaatacatccaacagaaatagataaggcagcggaattcaggcagcggcatgccattgccacaggcaacgaccgtactaagaccctcctggtagtaggcatagggatcctccgaagcttcatctcccgcttctgattaattttatatttgcaagggtgagtaccaaccgtactcagcaagtcaccacagcaacaatgcatatgaaaggggtatttcaaaggatggctatggctcttttgcgctaagccagttttgtaattcttttcacaaacctaagacctagcattgactgatcaaattttagtaccagtgtttgtatttaaacaacgacggttctgtccaccatccattgtgatcccaaggatagcttcccgccattgagtcgttatggttttctgaggacgcccaccttcccccttctcaagaagtggctccaacagcataaaaattcgtcatgcaacaacccatcccacacaagttaagaatttagagactagccaagtgtaatacatgtcctggtgctcaataaccgcgagcacggctattcgaatagatttggtttactcacactgcagtggatgtacactttacccgcactccgtgactgcccaacatatgagcttcgtcccaacacatgagacgcgtcacggcaaagcttttcgataacctcgcattggcagtatccgctccatgaacttaaatcctcatgcactctaggcgtccatgtttctagcagtgtgaggagttctggcgctcccgggaaagagaagtcttacacatattaaattatggttcaagttaagttctctctctcacacactcatggcagtcctaccaatggcgacaccgatgtagggcacgcctctcagccctacctcaacggctgtcccatcgtagcgcacctgcctcactcaggggtgaaccatctatgcagggatactgctccgctcggctatctaatccgctaggtctatacccattcgagaagtacggttgtatgggggtcgtttcatgcttaacttcatggctcggtccttaattgaccggggacggtactagcctttcctagataccacccaaatcctccgtccgccccagtcgaaaataattgtttaattttatttctcctttcacaaatcatgtcatcaacatcatggcaatgtggcgctcatgtctccacatgccgtatctcaattaccttcccaaaagtaattgcccaagcatcatttgataaatatgagtatgcatgattctagaatagcatttctaagcaattgtcataatcgactagggactcatacgtaaatatggttacgaaggaacaaggggcaaacaataatcaaggcatggcataatcacaagtatgatgttcatcattgcatgcaattttatttgtaaacaaaacaattttgcaattgggatcaacatgttcaaggaatagtgatgacttgccttgctcaaagtcttgcgggtcttggccttcacttggatccgcaactccctcgggctctatagttatgtgcgaaaattgatttgaattcggttagaattcaaataaaaatccaaataaatccaaatggaagtcgaacgcgtaaatcgattcttttatattaactttacttttcgcgaactagggcaaacccaatttcgatttttatatcctaaactattttgcgggtataaatattttgttatcataagtttttaatttaatctacccgagcattatatccatataataggttggaaatttctatcgcaagctaaatatcggacagaatcctaaaattatcttataatattatacaattaaattttagtataggactaaacgactaaatataatatacgtctaaaattcctagtgattaaatccgaatttctaccgtgaatcaattacttatagagattacccaaaataatctataatagtctataagaattcatctaatcgtttagttcttaattacatttaaactactaccgcgaattgatttcttgtagaaattaccaagaataatccataatttatattaaatttcgcaattctacgtctataactagtctataactaaatgctaattattttaaattttctaaacttccctaatctccctctaatttcctatctatttcccttttctttttcttcccttctttttctttttccttcctttctttttctttttttttctttctctctctcttttcttttctttttccttctctctctcccttttcttttctttttccttctccctctccctcccggtttctctcctccttcctttttctttctctccctcggtttctccctctctctctctctctctctcggctctctgctaccaggggcggcgacggcggccgagcaagtggtggaggcagcggcttaccgacggcggtggcggcgacggcggcgacagcgacggtggcgacgtcggcgcaaggtgcggcgcggcgcggcggcttcgtggcggtggcgcggcggctctatgcgacggcgcggcggcgtggaggcggcggcgtggaggcggcggcggcg

SEQ ID NO: 58102 - DNA, 5289 bp, Oryza sativa
tttaaagatacttctatgctcagagcataatagtgatttacactgatcttaaagcggttcggcaattctggaaccttttgtattgtgtgcgtaggttgttcggttttttgctttcatacgagtaacgtgagccctgaaggggcggaggacgcattgccaccgcgcgcgcgcgagaggccgggcagaggcagagacctcacgcgctacgcgttgcatctcattctcgcgcgcagggggcttcgcttcgctttgccccggaagagccgcaggatttcctgcgtaatccaagggaggaccggccgctggctgctaccgtgctcgctatgacctactccagctactcccaggctacaggccatgccatggacgagtgcccggaccggacgacagcgagcggcagctagctacacactagtacgtagttactgtagtcccgcgtcgcacggcatccggccggcctctcctaactccgccggttggcgggcgggtcggtggacgacgcatcaaccgcgcacgtccttgcgttggcccgacgagtgcctgccctgcaaagcttgcaaagggttcaccgatcctcgtaccaaattaaaatccgctcactagcagcataatcagatttcgtggagcctatcgataaaccaataaaaaccgataaaatctaaaaaaagatttagataatggaaatggattacatctccggtctctccatgtgaaaaatccaaataaatttgattaaaaagatataattcagttttattttttgaacttgactgaaaaactaagtggtttgtgtttctcacccgctctgaaaagtcctgattttgcgaaatccaaaccggatttcactaaaattgtggatctgcctgcaactagtaggctggaaatgaagcatgatcagtagggaaaactgatgcaccttcagtaaccgttcgggcagtgggccgcgcgaaacccagcactcagcactcagatcatctgcattttacagtggtcttagcactgagtacaatcaagggagctcctgccaatgcatatgcaggttttacggtacggcatccatgtgtgcaaatcatcatccgcatgcaagggtcagatcgctctcccaagtcagtgaaggtcacagtgaaccttttccggttcataattgcccggctagccgccgggagtccggtctaagtcgccgggtctgactctgaccaagatgttcgacctcgacatctgactgcaggacaatcaatatatctttggaccaacccaatgaatgaattgaacttgataacatatccaagctaggattaggagtatataaaacagcatcaatgtgagacttctcacaagtcacaaccccgcctgaactgaatctagtgtagtgaagacaggagtggctaaactgcatcccggaaatgcttgggaggaagaaaggatcgtcgtccaggttgagtgatcccatcaacacgactgtcactactgataacggccaggaaatggctgcttcgcatttcatctcgcagcaggcttcacagctcggtaggttcaaacccccgcttcaaactttcaatggacgtttacattgttcccggcgtaagttgagcgataagagagactcatagttcttctctcctctttgtcagatgaggctgcgaggaagagactgcaaagaatgaacgagaggctgaagttgctggagatgcagatggaaacactggaggctggcgtcgcgaaggcgagcaatgactcctacgagtagagatgtttagcaatctttgttatagacaccaggtttggtgacatgcaagcaaaattagatgatagcttgagtagttttacctgaacttgcagcaaatcaccgtcacctcgttgtagaattccggatctgtttcaggtttcagcgcttcagttttgttctttcactacgagccaataagctttagtgcagatgtcattcaagttttctgccagaaggaatttacagaatttgaaccataacagccgccatgatgatatataactctggttattgttcactttacaacagtataaaaaatgatggactttctcggacaacaatagatggacaagggcatatttacattagtccctctttgattgatttcaaaacacaggctgagcctgatttttttttcttcgcctcgactaatggtacgtttctagtaaataaatacagatgcagtaccatgatgcaaaccaaaataaaagatggccatggtagcagcccaatagaagagcttcagcagaattgaccaatgaagtatgcaaccacgctgtgacatgattgtttactcacaagctagtttagtaccgaagctgctaaggcagatggcgaaagcctgaaacgccgagagaggttggcggtaatccatagtgaagatattgctgtcaactttcccaaactgcaggataactgtttcctcgtctccaacgctatctggatggctggggtcagctgtggccacaagctggaaattcttcacggatgcaactgtcactcgcccatgaaagtttaagcaccagcactgcaagtgctcatgccagcggggagctttgttccttaagacaagtggttcctgtgcacctcaaagattttgtcttgagggaattctcccaggtttcttgagttgaagggcattccattgtgcaaaacatcctcctaggtcccctagatttaagaaggttgtatttgtatgagatctgcccaacattgaagttgcctgccgatatttgggggcagatccgtctacttccaaaacggtgggtacttccaaaacgctggctagatcgagtgcttgatgtttttgcatcatcgtatggcggctggttgtcatatatcttgaaatttgtcccccaaaaatcagacctaaaaatggtgcagcagaaacacaatcaggtcaaagaggaaataataaatgcaatggaagtgcgtcaaactgaacataagaagcacttctccaaactgttatcgccaagaaatagaaagagaagacagtaatatgacaatgcatgatcattttaaactacttaatgtaaattccaagcaagtagcaactgttggtttaagtaccaatccagattccacaacaccaataaggacatgtaagagagataacatgaaagacttgcatatgctattcctgagaaagacttgcacatacagatacagcgcttccatgcataagcctgccgtgctgtaagttgtaaacttcggaagcgttgtacaggagctttaagctcctgtagcggaagcgttgtaaaggagctttaagctccgaaagctttgtaacagatgctccttttcccccttcttaataaacttcggccagctttgccagccaggtgaaaagtttcccttttcaagtcttcaccccaagagctaaggtgaaatataggtacttttcccacaatcatgtacagaacgtacaatagtcccagcacagtaataccaataaatttctagatcatgtattaatgaattggtaccacctattaattacacttactaaatagtatttagaagaatgtttatgtgcctgtttcttggtagaaaaagacaacagaagaaaacacatggagcaagtgagcaagagcaatggaaggtaaatgataactacaggatgcgcgaaagctacctcagtttccccacatatgcattgcttccttgtgacaggtcatcagcatcaagggaaataacatactctgtgtggggccccctcctaaaccttctagcggccatgagaaacttccctttatccatggtacctgttgaacatgaaataaatagataatcagcaaagcatgtctcatgaaaaatcccatttatcatggaaatcaggaaagaatatccaaaattatccaatatatgtctgcttatccagcttgtgcacatgatgtcgtattgaattataaatatcacaaatgcactgcaaacaaagcatagaaacttggcagaaatagaactagcaacataacatttgatataagaggaatcaaacaggcaagcaggtacacatgtgactgccaataactagtgagtagtgacatcagcagcagacaggagccatacaaacgtattatgtgtaagctctcaagtcattgaagaatgtacaaagcaattcaaatacaagatgattcagtggcaataaactttgtatacaggcattaaaaaacctggctaaagctgatgcagggacaagggaaaactattccaaccacatgtgaacctaacaaaccagattgagtcataatacatggtgtttcaaattgaagtagcagtaagtgaaaaacgataatgcttcaggtcattaaggaagcacttgcatgtttggattatgccttagaaacataccattcaacaagcctaggtaaagatagaacatagatttcttcttgtttcgcttgacgaagcactggattgggaagtccttagggcctggctgctcaaacaacatggaatggagcaaaatggtgtcagcactggatatataactgaccaaaagtgcaaatgcagatacctcaaacccactcttcaagttgtaagaactgtacaaatatccacatagcttatagctaatgagctaaatatgtgctacgctattcaaccccccccccccccaaaaaaaaaaaagagagagagagactagataatccttcagcgtgccacataacgaagattataggcacaaacctgtaactactgtcctaataggcactaaatctggtcagaactgaactttctgcataatcattagtcacctaatattagtgaccacattggaacttaaaaacagagatataaagcatacatttcccaattgcaagtttcttccctactcctacatactagcaaatttattaaaacttaaaactaatattctatttctcattcccaaatcctattcgaaccccagaccaaataccggatcggtggagtactagtgtacacacagattatagaccatatcgatcccaatctgatctgccaaaaatcctacttcacaaaactggtatttctgcaaccctgcaatgaatgagccctagcaccaaatagtactaagctaattaaatcaacgcctaagcaaggggccacacctgcttgagcgatgacgggaaggtgattctgccggactcggggagcggccgcacgacggccgccgcggcctcgcgccaccggcggcagacgcacgcgcacgacacgaggtccttccgcgcgggccaccgctcgccccccgacgcctccacgcgccgcaccacctcctccacgagctccggcagcag

SEQ ID NO: 58103 - DNA, 2039 bp, Oryza sativa
ccccctccccctcccccaccgccgcctcttccttgggctcccgaaccgccgccatctcctctctcctctccctcgcgcgccgtgtgctcggaagaagcactcctcctccgcttgtctcggagaagcgaagcggatctgcgagtggtgtttggcttggctgcgggctgcggtacgcgcggtttttgtagcgcaattttgacggtttcgtcttgcgcttctagaaatcctggactggtacgggcgcactctctggtttgtgtttttgctcgttggcccggaccgagacatgtcgacggccgttggattcgaggaatggacgttgctaaagatatggtaattaaaaattaaaaaaagttaaaagttgctgattaatttttttttacttttaagatatggtaattaaaaatttgctactcaaagtctataatgtgtgtccttatgtgtccatgggtctagttgtaaattcttaattattatttcatccgtttcacaatgtaagactttctagcattgtccatatttatatagatattaatgaatatatatatataataatgtctagattcattagcatctatatgaatgtggacaatgctagaaagtgttacactgtgaaacgggggagtatatgtataagagtagcaaaagttaaatatcttgtagtgaccacctcggatgctcccgatgagagttttcaagaaattcaaaatttactagtagtagtatgtgaaatgtacaagtccgttttagatgtttgaaacggctaattaaccgcacgtaaaacaatatataatcaattaagtattaatatataaaagtttgataaattttctaaataacttatatataaaagttttctcaccgtttaaccgtttgaaaaatgtgccaacgaaaaataaggagtaactaagctacaatagcggaaaagaacatagccttaaatgtatggatttcatttgaattttattagctaaattttctactactttcgttatagaatataagaatctatatagaatatgacaattcctattactataaatctgggtatgaaacatggtttgagctcttttcaagatccactgtgctaggaggctggatggcaacacgatggaattgtgcagtgaaagagagaggggtcaacctcatactccacttacatcttcgctccgtgcagctggcggccagctgctggcccctgacaccatttgattcgcccaccttattttccttgggctcctccgtttgattccgcttctggaagaatcagatttgcctctgaatacatttgtgatgttgctggaacgtgtccactgactcagtggagattatctgtaatactgcagaggatctctgtcccgttaatttggtgttactttctacttcctccgtcccagtaaaattgacgtttcaacgccccaggcttgtctcaaaaaatgtgtcgctatacagagaagaggcactcctggacgccaaagcaagtttaattgttgattcaaatttttgaatatattaatgatggctttgcccctttatcaaacgtgtggccaaggcgccaatttatgtactccccgtaacacgtggtagtgagttgtggttacttcattactgctggaaatatcctctagaatattcggagtgcatgtataaatgctggaaatgacagctgaatcaaatcatggatacaatttggtaattttgcacaacagctaatcttagctactaaccttaaaacgtcaattttactgggacggaggaagtactactagtagcacagtatcttgtgctagtgccactgcttcagaaaaaaaatgctggatattgcgctgctgttgatcacctacacatggcttgtgtacatcaacgggagagtcagagtgatgaccaaccagtttgctaccactagttcttagcaaatcttcggtgatcggtgcacggtaatagcattgattaggctatgatagtggcctatttgattatggtactaacttcttcgatcttctgattccaattcagacttctgaaagtctaaacagttg

SEQ ID NO: 58104 - DNA, 4175 bp, Oryza sativa
tggaaatatcctttaaaatatccggagggcaaggtataaatgctggaaatgacagctgagtcaaatcatggatacaatttggtaattttgcacaacagctaatcttagctactaaccttaaaacgtcaattttactgggacggaggaagtactactagtagcacagtatcttgtgctagtgccactgcttcagaaaaaaaatgctggatattgcgctgctgttgatcacctacacatggcttgtgtacatcaacgggagagtcagagtgatgaccaaccagtttgctaccactagttcttagcaaatcttcggtgatcggtgcacggtaatagcattgattaggctatgatagtggcctatttgattatggtactaacttcttcgatcttctgattccaattcagacttctgaaagtctaaacagttggtccatggggtaggttaggttaggctccccatcagctaaattatcaggaaaaaaccctgtactagtggtacaacttattagaatttagaagtcaacaatatggatgcatctgcttaatttgctttgtccctgtcaattgctgcgtaatttcgattgcctcatagcactaattttttgaatggaacacgcagcattatttttttgaatggaacacgtagcactaattaatcttagtgtctgtctcgaggacaacgatgagtactccctccataattgtttaggacaatatttaaattaaacattaggaatataaatcataaataactatcaaattattaagtttaaaaatataaaaaatatatgaataaatttgtcttgaaaaatactttcataaaagtatacatatatcactttttaataaatatttttatagaaacatgaaatcaaagttgtgttttggagaccgtgtcgctgtccaaaacgactttctttacgaggacgaatggagtatttatccagtgcagcggggcctgagttcttcgtcccagcctcccagggaggtagcagcccagtcatttccttggttttttttggaaaattccaagagtctctatccgacgaagtagcattgcaatggcaatgtactcgctctgttttttaacatatgatgacttacttttatcattgaaaacaatttgagcatgatttatattctacatattttaaagttttgaatagcgtgagcaattgaacgtatgtctacaagttaacaaggtcgtgtatttgagagagcgttacatgagccatacgtaaacatatgattatggtatttaattattcgtattattaaaaaataatcattatttatttttgttttattacgacttactttactttagacatgacgtatacttttatatacttaagaaaattgaatgagataaatgatataacgtatgtctaaaagataatgatgtcatatgttaaaacaaacggaaggagaattatgcgagtcataaaaggtctcaattacatatgatgaggacaaattcaggggtagcgtcattgcccgtgaccatcagtgcagccgttggcaaaaagaactgcaaccagcaatccagcatgcagattgcagagtggttgcttcttggctatgattacgtggccgatttttcaaacgtgagattagcgtgtactaagtggagttgcccatggagataacgatgggttagtagtctccgtcttcgtcctcttccttcttgtttaataatccctgcattaactgatcaacacaaccgagatgtttgacaaagagagaagaatacaagggaatgcagtgaaccaagagttttacccattcctcctgtatccagtttagtcgttgcagaaaaatctcccccttttttttttctttatctgaagatttgctcctggttcttcaactactaccaagaatcgagctcctgttgcttcctctagcctctgtctagtctgaagcctgaacccttgcatgctccagtttctgcactgtgtgagcagaattatttctgaagtctgaacagcagccaagcaaaaggtatgcgctttcaattgctttcgaggtgatgaagtatcttcagttccctatctgtttctgaaactgaggttgttctttgcctgatcttggcagaaggcatctgacagtaagatatgaacacctgtgtttcaggtgaatttggctgatgattctgcccctgtgttctgatttattcaagacactagcaactgaatcatcaggtgttggtcgcgaatatcccagtgatggattcatcgagttctttcgtgctcgtggtgctgattctccaagctgtcgtgatcggttgctcctcactggacgagctacccgttcagcttagcaaccggaggctacttcatgacagaaatcacgctgctctactctacaaagatcatttcccaacagttggaaacatgacgtttccaacatctcatcaactgcaaaatgatccaaattacaagcctctagatagttcatcccaccctgccgaggcttctgcaaataaaggatcaagcaaaggattcaagaagtggctgtatatagttgtgattccagtggctggtttgattatgcttgctggcatggcatggatgttcttgccatgccgcaagaaatccgttgcgactattggcccttggaggactggactcagtggccagctgcagaaggcatttgtgtcaggtaatactgcaatatttgccattttgatttgtaatattttcttatattgttctgttacatcctattcttataacggtaagttcttgactgtgttcaagtctggttttcagatcaaatattcatgttgtgtttctggttttcactgtgttctgatctgaatgtgcttcaggagtgccccaattacagcgtccagaactggagcgtgcttgtgaggacttcagtaatattgtggcaagtcatccatactacactgtctacaagggaaccttatcatccggtgttgagatcgccgttgtatcgacaacgattaaatccagcaaagattggtcaaagcactgtgaagattgtttcaggaaaaaggtagtcataatatgtgtactagatcctcaactaatccttttgcagaattgcattagcatgaaaaaatttaccttttttttcccttgtgaacaagcagatagagtcgctctcacgaataaatcataagaatttcatcaatctgctggggttttgtgaggaggaagaacctttcacgagggtgatggtgttcgaatacgcaccaaatgggacgctttatgagaatctccatggtaaatactatgtgaaagttattctcattgttgcaatgaggaataccaattttttttcttcacattcaagtgataacatgctggtaaattatttgtgcagatgaggcctttgatcacatcgactggagaagtagaatgagaataatcatgggaatagcttactgtattcagcacatgcatgagctcaaccctgccaacgtgcaccctgatctgcattcaagtgcagtatttctttctgaagattgtgctgcaaaggtacatatggtctaactaaatccttgttatgccttatggtttatcaagaattaggcatcttagccatattcagttgctatggtttcagtagttcttttaatgtccttctgatgtgaaggaggtttagagaaaaacgcagtttcagtacccaactttattcagtactcagtaaagtacagtttgatgctaaaatctgtatcctttcttcagattgcagacttgagtgtttggcaggaagtggtttccgacggcaaaaagtcgacagcgaataatgatcatcatgaaccaatatctgctagactggcagggaacgtttacagttttggcatactgcttcttgaaatcatctcagggaaacccccttactctgaaaacgagggctccctggcgaatctggtaatcacagcagcctgcaaagtcaaatgcttcaacagtttaacttacacaaaagaaatccaattcaacatcagattaaagaaaataaaactgttttttatttttcttatcttacaggctttggggtgcattatcaaaggtcggagtatagcctccatgcttgattcagtactagagtcacacaaagaaaatgagctagatgtgatctgtcagataatcatggaatgcatccagagtgacccaacgaagagaccaggcatgagggggatc
